United States Patent 12,569,549 (FLAVIVIRUS VACCINE) - sequence listing, part 70

SEQ ID NO: 24063 - RNA, 9879 nt, synthetic construct
  misc_feature 1..9879: note = derived and/or modified CDS sequence (opt11) from DENV-1__JN819414__SS-prME
  source 1..9879: mol_type = other RNA
tctgtgaccatgctgctcatgctgctgccgaccgccttggccttccacctgactacccgcgggggggagcctcacatgatcgtgtcgaagcaagaacgaggcaagagcctcctcttcaagacctccgccggagtgaacatgtgcaccctgattgctatggacctcggggaattgtgcgaggacacaatgacctacaagtgtccccgcatcaccgaggcagagcccgacgacgtagactgttggtgcaacgcgacagacacatgggtgacctacgggacctgtagccagaccggcgagcatcggcgcgacaagcgctccgtcgccttagctcctcacgtaggcctggggctcgaaacgcgaaccgagacctggatgtcatccgaaggcgcctggaagcagatccaacgagtcgagacctgggcactgcgccatcccggtttcacagttatagccctgtttttggcgtatgctattggcaccagcattacccagaaaggaatcatcttcatactgctgatgttggtgacgccttccatggccatgcgatgcgtcggcatcggcaaccgcgatttcgtggaaggcctgagcggcgccacatgggtagacgtcgtgctggagcacggaagctgcgtgaccactatggccaaaaacaagcccacactagacatcgagctgcttaaaacagaggtcaccaaccccgcggtgctccggaagttatgcattgaagcgaagatcagcaacactaccacggacagtagatgtccaacccagggcgaggccaccttggtggaggagcaggatgctaacttcgtctgccgccgaacatttgtcgatcggggctgggggaacggctgcgggctgttcggtaaagggagccttcttacctgcgcaaagttcaaatgcgtgaccaagttggaaggcaagatcgttcaatatgagaacctgaagtactccgtcattgtaaccgtccacacgggagaccaacaccaggtggggaacgagaccaccgagcacggcactatagcgaccattacgccgcaggcccctacaagcgagatccagcttaccgactacggggctctcacgctggactgtagcccccggactgggttagacttcaacgaaatggtcctcctgacgatgaaggagaagtcttggttagtgcataaacagtggtttctcgacctgcccttaccttggacctccggggccagcaccagtcaggaaacctggaaccgccaggacctcctggtgacattcaagaccgcccacgctaaaaagcaagaggtggtggtgctgggatctcaggaaggcgccatgcatacagccctcactggggccacggaaatccaaaccagcggcaccacgacgattttcgccggccacctgaagtgccgcctaaagatggacaagttgaccctcaagggcatgagctacgtaatgtgcaccgggtcatttaagctggagaaggaggtagcggagactcagcacggcacggtactcgtccaggtgaagtacgagggcaccgacgccccgtgcaagatccctttctccacacaggacgagaagggagtaacccagaacggcaggctgataacggcaaacccaatcgtgaccgacaaagagaagcccgtgaacatcgagaccgagcctccgttcggtgagagctacatcgtggtgggcgccggcgaaaaggcactgaagctctcctggtttaaaaaggggtcgtccatcggcaagatgttcgaggccaccgcccgtggcgcccggcgcatggccatcctcggcgacacggcgtgggatttcggcagcataggcggcgtgtttacttccgtgggtaagctggtacatcaggtgtttggcaccgcctacggcgtgctgttcagcggcgtctcctggaccatgaaaatcgggatcggtatcctcctgacttggctgggccttaactcacgctccacctcattgtccatgacctgcatagccgtcggcatggtgacgctgtacctcggcgtcatggtccaggccgacagtggttgcgtaatcaattggaagggccgtgagctgaaatgcgggagcggcatattcgtcacgaacgaggtgcatacctggacagagcagtacaagttccaggccgatagcccgaagcgcctaagcgcggccatcgggaaggcgtgggaagagggggtctgcggaatccggtctgccacccgattagaaaacatcatgtggaagcagatctctaacgaactgaaccacatcctgttggagaatgacatgaaattcaccgtcgtcgtaggggacgccaacggcatcttggcgcagggtaaaaaaatgatccgaccccagcccatggaacacaagtactcctggaagtcctggggcaaggcaaagattattggcgctgatattcaaaacacaaccttcattatcgacggacccgatacaccggaatgccccgacggccagcgggcctggaatatatgggaggtcgaggactacggtttcggtatattcaccactaacatctggctgaaactccgggactcctacacccagatgtgcgaccaccgcctcatgagcgcggcgatcaaagactccaaggccgttcacgccgacatgggctactggatcgaaagcgagaagaacgaaacctggaagctggcccgcgcgtcctttatcgaggtgaagacctgcacctggccgaagagccacaccctctggtccaacggcgtcctggagagcgagatgatcatccctaaaatctacggcgggccgatctcccagcataactaccgccctgggtacttcacccagaccgccggtccctggcatctgggcaagctcgagctggatttcgatctctgcgagggcacgaccgttgtcgtagatgagcactgcgggaaccggggcccgagcctccggaccaccacggtgaccgggaagatcatccacgagtggtgctgccggagctgtaccctgccgcccttacgcttccggggagaggatgggtgctggtacggcatggagattcgcccggtgaaggagaaggaggaaaatcttgtacgatctatggtttccgccggcagcggcgaggtggacagcttctccctaggaatactatgcgtctccatcatgatcgaagaagtaatgcgctcacggtggagtcgcaaaatgctcatgacagggacgttggccgtgttcctgttgttaattatgggccagcttacttggaacgacctcatccgcttgtgcatcatggtcggggctaacgcatcggacagaatgggcatgggtacgacgtatctggctctcatggccacgttcaagatgcgcccgatgttcgccgttgggctgttgttccgcaggctaacctctcgggaagtgctgttgctcacaatcgggctttccctggtagcctcggtggagttgcctaactccttggaggaactcggtgacggcctcgcaatgggcatcatgatgctgaagctacttacagagtttcaaccccaccagctgtggacaaccttgctcagccttaccttcgttaaaaccacactgtcgctggactacgcctggaagaccactgccatggtgctgtccatagtgagtctgttcccgctctgtttgtctaccacgagtcagaagaccacctggctgccggtcctcctgggaagcttcggctgcaagcctttaaccatgttcctcataacagaaaacaagatctgggggcgtaaaagttggcccctgaacgaaggcatcatggcgatcgggatcgtcagcattctgctcagctccctgcttaagaacgatgtgcccctcgcgggaccgttaatcgccggcggtatgttgatcgcctgctacgtcattagcggctcgtcagcagacctactgctggagaaggcagcggaggtttcctgggaacaagaggccgaacacagcggggcctcccataacattctggttgaggtccaagatgacggcacaatgaagatcaaggacgaggagagagacgataccctgactatactactcaaggctacgctgctggccgtgtctggcgtataccccatgtcaattcccgctacgctattcgtctggtacttctggcagaagaagaagcaacgcagcggggtgctctgggacaccccctccccgcccgaggtagagcgggccgtcttggacgacggaatataccgcatcctgcagcggggcctccttggccgcagccaggtgggcgtgggcgtgttccaggacggcgtgttccacaccatgtggcacgtcacgcgcggagcggtcctaatgtaccagggcaagagactcgagcccagttgggccagcgtaaagaaagacctgatatcctacgggggcggctggcgtttccaggggagctggaacaccggagaggaagtgcaggtaatcgcagtcgaacccggcaaaaaccccaaaaacgtgcagactacgcctggcacatttaagacgccagagggtgaagtaggcgccatcgccctggacttcaaacctgggaccagtggcagcccgatcgtcaacagagaaggcaaaatcgtcgggctctacggcaatggtgtagtgaccaccggcgggacgtacgtctccgccatcgcccaggcgaaagcgagccaggagggccctctgcccgagatcgaagatgaggtcttcaagaaacgtaacttgactatcatggacctccaccccggctcaggtaagacccgccggtatctgcctgccattgttcgggaggcgatcaagcggaaactgcgaacccttattctggccccaactcgtgtcgttgcgagcgagatggccgaagccctgaagggcatgccgatccggtatcagactactgctgtcaagagcgagcacacggggcgggagatcgtcgacctaatgtgccacgcaacgttcacaatgagactgctgtctccggtgcgcgtgcccaactacaacatgataattatggacgaagcacactttaccgaccccgcaagcattgccgcacggggctacatctcaacccgcgtggggatgggcgaggctgcggccattttcatgacggcaacgccgcccggatctgtcgaagccttccctcagtccaacgccgtgattcaggacgaagaacgcgacatacccgagcgcagctggaattctgggtacgattggatcaccgacttcccgggcaaaaccgtatggttcgtccccagcatcaagtccggcaacgatatagcgaactgcctccggaagaacggaaagcgcgtgatccagctgtcaagaaagacgtttgataccgagtaccagaagactaaaaacaacgactgggactacgtggtgaccactgacatctccgagatgggggcaaacttcagggctgatcgggtgatcgatccccgccggtgcttgaagccagtgatcctcaaggacggcccggagcgcgtcatcctggcgggccctatgcccgttaccgtcgcgagcgccgcccagcggcgagggcgtatcggccgcaaccagaacaaggaaggggaccagtacgtctatatgggccagcccttgaacaacgacgaagatcatgcccactggaccgaggcaaagatgctcctggacaatatcaacacccccgaggggattatcccggctctgtttgagcccgagcgcgagaagtccgccgccattgacggcgagtaccggcttaggggcgaagcgcggaagacgttcgtggaattgatgcgcagaggggatcttcccgtctggctaagttacaaggtggcgtcagaaggcttccagtacagcgacagacggtggtgcttcgacggggaacgcaacaaccaggtgctggaggagaacatggacgtcgagatctggaccaaggaaggcgagcggaagaagttgcgtccccggtggctcgacgctcgtacctactcggacccgcttgccctgcgagagttcaaagagttcgccgccggccggcgaagcgtgtccggcgacctcatcttagagatcgggaaactgcctcagcacctcactctccgcgcccagaatgcgctggacaacctcgtgatgctgcataatagcgaacaaggaggaaaggcctacaggcacgcgatggaggagctgcctgacaccattgagacgttaatgctgctggcgttaatcgcggtcttgactgggggcgttaccctgttcttcctctccggcaaggggctgggcaagacctcaatcgggctgctgtgcgttacggccagctccgccctgctctggatggcctccgtcgaaccccattggatcgcagcaagtatcatactcgagttcttcctgatggttcttctgatcccagaaccagatcgccagcggactccccaagacaaccagctggcgtacgtggttatcggcctgttattcatgatcctgaccgtggccgccaacgaaatggggctcctcgagaccacgaagaaagacctgggcatcggctacgtggcagcggagaatcaccagcacgcgaccatgctggacgtggacctccgtccggcgtcggcctggaccctttacgccgtggctacgacggtgatcaccccgatgatgcgccacaccatcgagaacactacggcgaacatcagtctgaccgccatcgccaaccaggccgctatcctcatgggactggataaaggctggcccatatccaaaatggatattggggtgcccctgttggcactgggctgctactcgcaggtgaacccgctgaccctcacggccgccgtgctgatgctggtcgcgcactacgccatcataggtcccggcctccaagcaaaagccacgcgcgaggcgcagaaacgcactgcagccggtatcatgaagaaccccacggtcgatgggattgtggctatagacctggacccggtcgtctacgacgccaagttcgagaaacagctgggccagattatgctgctgatactatgcacatctcagatcctgctgatgcggacgacctgggccttatgtgaaagcatcaccctcgcgaccgggcctctgacgacgctgtgggagggcagcccgggcaagttctggaatacgacaatcgctgtctccatggccaacatttttcgcggaagctacctcgcgggcgcgggtctggcgttctccctgatgaaatctctcggcggtgggcggcggggcaccggggcccaaggtgagaccctgggcgaaaagtggaagcggcagctcaatcaactttccaagagcgagttcaatacttacaagcgctccggcatcatggaggtcgatcggagcgaagccaaggagggcctgaagcgcggcgagacgacgaagcatgccgttagcaggggcactgcgaagttgcgctggttcgtagaaaggaacctggtgaagcccgaggggaaggtgatcgacctcggctgcgggcgcggcggctggtcctattattgtgctggcctgaaaaaggtgacggaagtcaaagggtacaccaaaggggggccagggcacgaggagcctatccctatggccacctatggttggaacctagtgaagttacactctggtaaggacgtattttttatgcctccggagaagtgcgatactttactgtgtgacatcggggaatcatcgcctaaccccaccatcgaagagggtaggaccttgcgggtgctgaagatggtggaaccctggctgaaaggcaatcagttttgcatcaagatcctcaacccctacatgccgtccgttgtcgagacactggagcaaatgcagcggaaacatggagggatgctggtaagaaaccccctcagtcggaactccacgcacgagatgtactgggtaagctgcggcaccggtaacattgtctcagctgtgaatatgaccagccggatgcttctcaaccggttcaccatggcccaccgcaaacccacatacgagcgagacgttgacctcggggccggaacgcggcatgtagccgtcgaaccagaggttgcgaacctggacatcatcggtcagcgcatcgaaaacatcaaaaatgagcacaagtcaacgtggcactatgacgaagacaacccgtacaagacatgggcctaccacggatcttacgaggtcaagccctccggaagcgcgtcctccatggtaaatggcgtggtacgcctgctaacgaagccgtgggacgtgattcccatggtcactcagatagcgatgacagacaccacgcctttcgggcagcagcgcgtgttcaaggagaaagtggacacgcggaccccgagagccaagcggggaactacacagatcatggaggtcaccgccaagtggttatggggcttcctcagcagaaataagaagccacggatctgcacccgcgaggagttcacccggaaggtacgctcaaacgccgctataggggcggtctttgtcgacgagaaccaatggaacacggccaaggaagccgtagaggatgagcggttctgggacttagtacatcgtgaacgagagctgcacaagcagggcaagtgcgctacctgcgtctataatatgatgggcaagcgcgagaagaagctgggggagtttggcaaggcgaaggggtcccgggccatatggtacatgtggctcggcgcacgctttctggagttcgaagcgctggggtttatgaacgaagatcactggttcagccgggaaaactctctgagcggcgttgaaggcgagggcctgcacaaactaggctacatattaagggacatctccaaaatccccggtggaaacatgtacgccgacgacaccgcggggtgggacacacgaatcacagaggacgacctgcagaacgaggccaagataactgacatcatggagcccgagcatgccctgctcgccacctcaatcttcaagctgacctaccagaacaaggtcgtccgagtgcagcgcccagccaaaaacgggacggtaatggacgttatttcccgtcgcgaccagagggggtccggccaagtaggaacatacggtctgaacaccttcaccaacatggaggtccagctcattcgccagatggaaagcgagggtatcttccttccctcagagctggaaactccaaatttggcggagcgggccttggactggttggaaaagcacggggccgagcgtctcaaacggatggcgatctcgggcgatgactgtgttgtgaagcccatcgacgaccgcttcgcaacagctctgaccgccctgaacgacatggggaaagtgcggaaggacatccctcagtgggagccatccaaggggtggaacgattggcaacaggttccgttctgcagccatcacttccaccagctcattatgaaggacggccgcgagattgttgtaccctgtcggaatcaggacgagttggtggggcgcgcccgggtgtcccagggcgccgggtggagcctaagggagaccgcctgcctcggcaagagttatgcccagatgtggcagctgatgtacttccaccggcgcgacctgcgcttggctgccaacgctatctgcagcgccgtgccggtagactgggtgccaacctcccgaacgacctggtctattcacgcgcaccatcaatggatgactaccgaggacatgctctcggtttggaacagagtctggatcgaggaaaacccttggatggaggacaagacacacgtgagctcttgggaggaggtaccttacctgggtaagagagaggaccagtggtgcggatctctcatcggattgaccgcccgcgccacctgggcaactaacattcaagtcgcgatcaaccaagttagaagactgatcggcaacgagaactacctcgactatatgactagcatgaagcggttcaagaacgagtccgatcccgagggcgctctctggtag

SEQ ID NO: 24064 - RNA, 9879 nt, synthetic construct
  misc_feature 1..9879: note = derived and/or modified CDS sequence (opt11) from DENV-1__FJ873810__SS-prME
  source 1..9879: mol_type = other RNA
agcgtgaccatgctgctcatgttgttgcccacagccctcgccttccacctgaccaccagaggtggggagccacatatgatcgtgagcaaacaagagcggggtaagtctctcctgttcaagaccagcgtgggggtcaacatgtgcaccctgatcgcgatggacctgggcgaactctgcgaggacaccatgacgtataagtgccccaggatcacggaggcagagcccgacgacgtggactgctggtgcaacgccaccgacacttgggtaacctacgggacctgcagccagaccggcgagcaccgtagggaaaagcggtccgtggcgctggcgccgcacgtcggcctgggcctcgagacccgcaccgaaacctggatgagctcggagggcgcctggaagcagattcaacgggtagagacctgggccttacgccatcccgggttcacagtaatcgcattcttcttagcccacgccatcggcacgtcaatcacccaaaaagggatcatcttcatcctcctgatgctggtcaccccctcgatggctatgcggtgcgtaggcatcggcaaccgagacttcgtcgaggggctcagcggcgccacgtgggtcgacgtggtgctggagcatgggtcatgcgtaacgactatggcaaagaacaagcccacccttgacatcgagctgttaaaaacggaggtgaccaacccggcggtcctacggaagctctgtatcgaggcgaagatcagcaataccaccacggactcgaggtgcccgacccagggcgaggccaccctggtcgaggagcaggacgccaacttcgtgtgccgacgcacattcgtggaccgtggctggggcaacggctgcgggctgtttggcaaggggtctctcctgacgtgcgccaagttcaagtgcgtgaccaagctggagggcaagatcgtgcagtacgagaatctcaaatactcggtgatcgtaaccgtacacacaggcgaccagcaccaggtcgggaacgagacaacggagcatggcaccatcgccaccatcacgccccaggcgccaacatctgagatccaactgaccgactatggggcccttacgctagactgcagcccccggactggcctggacttcaatgaaatggtgcttctaacgatgaaggagaaatcctggctagttcacaagcagtggttcctagacctcccgctgccctggaccagtggagcaagcaccagccaggaaacctggaacagacaggacctgctcgtgacattcaagaccgcccatgccaaaaaacaagaggtcgtggtattgggctcccaagagggcgcgatgcacaccgccctaaccggagccactgagatccagaccagcggcaccaccacgatcttcgctgggcacctcaagtgccgcctgaagatggacaagctaaccctcaagggcatgtcctacgtgatgtgcaccggaagcttcaagctggagaaggaggtggctgagacacagcacggtacggtcttggtccaggtgaagtacgagggcaccgacgcgccctgcaaaatccccttctccacgcaggacgaaaaaggtgttacccagaatggacggctaatcacggccaatccgatcgtgactgacaaggagaagcccgtgaacatcgagaccgagccgcccttcggggaatcctacatcgtcgttggcgccggcgagaaggctttgaagcttagttggttcaagcgcgggagctccatcggtaagatgttcgaggcgaccgctcgcggggccagacgcatggcgatcctgggagatacggcctgggactttggaagcataggcggagttttcaccagtgtcgggaagctcgtgcaccaggtcttcggcacagcgtacggggtcctgttctccggagtgtcctggaccatgaagatcggcattggtatcctgctcacgtggctgggcctgaactcccggtccacgtctctctccatgacttgcattgcagttgggatggtcaccttataccttggcgtgatggtgcaggccgacagcggatgcgtcatcaactggaaagggcgcgagctcaagtgtggttcgggcatcttcgtgacgaatgaggtacacacctggactgagcaatacaagtttcaggccgacagcccgaaacgactcagcgcggcgatcggcaaggcctgggaggaaggggtgtgcggcatcaggtccgctacccggctggagaacatcatgtggaagcagatcagcaatgagctcaaccacatcttgctggagaacgatatgaagttcaccgtggtggtcggcgacgccaacggcattttggctcagggtaaaaagatgatccgcccccagcccatggaacataagtactcatggaagtcgtggggcaaagcgaagataatcggcgccgatatccagaacacgacgttcatcattgacgggcccgacaccccggagtgccccgacggccagcgggcatggaacatctgggaggtggaagactacgggtttggcgtgttcaccacaaacatctggttaaagttaagagactcctatacccagatgtgcgaccacagactgatgagcgccgcgatcaaagactccaaagcggttcacgccgacatgggatattggatcgagagcgagaagaatgagacctggaagttggcccgagcgtccttcatcgaggtgaagacgtgcacgtggcccaagagccacaccctgtggtccaacggggtgctcgagagcgaaatgatcatcccaaaaatatacggagggcctatctcccagcacaactaccggcccggctacttcacgcagacagcgggcccatggcacctgggcaagctggagctcgattttgatctctgcgagggaacaaccgtcgtcgtggatgagcactgcgggaaccgcggtccgtcgctgcggaccacaacagtcaccgggaagatcattcacgagtggtgttgccgctcctgtaccctgccgcccttacggtttcgcggagaggatgggtgctggtacggcatggaaatcaggcccgtgaaggaaaaagaggagaacctggtgcgcagcatggtctcagcaggcagtggggaagtggactcattctccctcggcatcctgtgtgtttcgatcatgatcgaggaggttatgcggtcccgctggagccgcaaaatgctgatgaccgggacgctcgcggtcttcctgcttttaatcatgggccagctaacctggaacgacctgatccgtttatgtataatggtaggggccaacgcgtcagaccgcatgggcatgggcactacttatttagcgctgatggccacgttcaagatgcggccaatgtttgccgtaggactactgttcagaaggctgaccagtcgggaggtattgctcctgaccatcggcctctccctggtcgccagtgttgagttgcccaactccctcgaggaactgggagacggcctggctatgggcatcatgatgctcaagctacttacggaattccagccccaccagctgtggacgaccctgctaagcctcaccttcgtgaagaccacgctgtccctggattacgcgtggaagaccaccgccatggtcctcagcatagtgtcactgttcccgctgtgcctcagcactacgtcccagaagaccacctggctgccggtgcttctagggtcattcggctgtaagcccctaacaatgttcctgatcacggagaacaagatctgggggcggaagtcctggcccctcaatgagggcatcatggcgatcgggattgtgagcatactgctgtcctcgctccttaagaacgatgtgcccctggccggccctctcatcgcgggtgggatgctaatagcctgctatgtgataagcggctccagcgccgatctttctctggagaaggccgcggaggtaagctgggagcaggaggcggagcactccggggccagccacaatatactggttgaggtgcaggacgatgggacgatgaagattaaagacgaggagcgtgacgacacattgacgatcctgctaaaggcaaccctgctggccgtctccggagtgtaccccatgagcattcccgccacgctgtttgtgtggtacttttggcagaagaagaagcagcggtccggtgtcctgtgggacaccccatcaccgccggaggtcgagcgcgcggttctcgacgacggcatctaccggatcctgcagcgcgggcttttgggccggtcccaggtcggggtgggggtcttccaggacggggtattccataccatgtggcacgtcacccgcggagccgtgttgatgtaccaagggaagcgcctcgagccctcatgggcctccgtcaagaaagacctgatcagctacgggggcgggtggcgcttccagggttcctggaacacgggggaggaggtccaggtgattgcggtcgagcccggcaagaacccgaagaacgtccaaaccacccctggcacgtttaagactccagagggggaagtgggcgccatagccctcgactttaagccgggaaccagcggctccccgatcgtaaatcgggagggtaagatcgtggggctgtacggcaacggtgtggtgacaacgtccggcacctacgtgagcgccatcgcccaggccaaagccagccaggaggggcccctccccgagatcgaggacgaggtgtttaagaagcgcaaccttacgatcatggacctgcacccgggtagtggaaagacccgccgctatctgcccgcgatcgtccgggaggccatcaagcgcaagctccgcacccttatcctggcccctacgcgggtcgtggcctcggagatggcggaggccctcaaggggatgcccatacgctaccagaccacagcggtgaagtctgagcacaccggccgggagatcgtggacctgatgtgccacgccacgttcaccatgcggctgctctccccggttagagtccccaactacaacatgatcataatggacgaggcccatttcaccgaccccgcttctatagccgcccgtggatacatttccacacgggtaggcatgggggaggccgcagcgatctttatgacggccacgccacccgggagcgtggaggcgttcccacagtccaatgccgtcattcaggacgaggagcgagacatccccgagcggagctggaactccggctacgactggatcaccgacttcccaggtaagaccgtgtggttcgtgccatctatcaaatccggcaacgacatagccaactgtttacgcaagaacgggaagcgggtaatccagctgagcagaaagacgttcgacacagaataccagaagactaagaacaatgactgggactacgtggtgactacggatataagtgaaatgggtgcgaacttccgggccgaccgcgtcattgacccccgtcggtgcctcaaacccgtaatcctaaaggatgggcccgagcgcgtcatactagctgggccgatgcccgtaaccgttgcctcagcggcccagcgccggggtcgcatagggcgcaatcagaacaaggagggcgaccagtacgtctacatggggcagcccctcaacaacgatgaggatcatgctcactggactgaggccaaaatgctgctggacaacataaacactcccgagggaatcattccagctttgttcgagcccgagagggagaagagtgcagccattgacggggagtaccgcctgcggggcgaggcccgcaagacgttcgtggagctgatgcggcgcggcgacctccctgtctggctgagctacaaggtcgcctctgaggggtttcagtacagcgaccggcggtggtgcttcgacggcgagcggaacaaccaagtgctggaggagaacatggacgtcgagatctggaccaaggagggtgagcgtaagaagctgcggccccgctggctggacgcccggacctattccgacccattagcgctccgggagttcaaggagttcgccgcaggccggcgctctgtcagcggagatctgatcctggaaatcgggaagctcccccagcacctgaccctgagagcccaaaacgccctcgacaacctggtgatgcttcacaactccgagcagggcgggaaagcttataggcacgctatggaggagttgcccgataccatcgagactctgatgctcctcgccctcattgcggtcttgaccggcggggtcactttgtttttcctgagcggcaaggggctggggaaaacgtccatcggcctcctctgcgtgacggcgagctccgccctgctatggatggcttcagtggaacctcactggatcgccgcctccatcatcctggagttcttcctaatggtgctcctgatccctgagcccgatcggcagcgcacgccccaagacaaccagctggcgtatgtggtcatcgggctcctgttcatgatcctgacggtcgccgccaacgagatgggcctcctggaaaccactaagaaggatctggggatcggctatgtggccgccgaaaaccaccagcacgcgaccatgctagatgttgacctgcaccccgccagcgcgtggactctgtacgccgtcgcgaccacggtgatcacccccatgatgcggcacactatagagaacaccacggcgaacatctccctcaccgccatcgctaaccaggccgccattctgatgggactggataaggggtggcccataagcaagatggacatcggcgtgcccctcctcgcgctagggtgctactcccaggtcaatccgctcaccctaacggccgcagtgctgatgctcgtggcccactacgctatcatcggacccgggctgcaggccaaagccacgcgggaggcccagaagcgaacagccgcgggcatcatgaaaaacccgactgtcgatggcatcgtggccatcgacttagaccccgtggtttacgacgcgaaattcgagaagcagctcgggcagatcatgctgttaatcctgtgcacaagccagatcctgctgatgcggacgacctgggccctctgtgaatcaatcaccctggcaaccgggccgctgactaccctctgggaagggagcccagggaagttctggaataccaccatagcggtttctatggcgaacatattccgcggcagctacctagccggggccggattggccttctccctcatgaagtccctcgggggcgggcggcgcggtacgggcgcccagggggaaaccttaggcgagaagtggaagcggcagctcaaccagctgtccaagagcgagttcaatacatacaagcgcagcgggatcatggaggtggaccggtccgaggccaaggagggcctgaagcgcggggagaccacgaagcacgccgtcagccggggcacagccaagctccgctggttcgtagagcggaacctggtaaagccggagggcaaggtaattgacctggggtgtggcagagggggctggtcctattactgtgcgggactgaagaaggtgaccgaggtgaaggggtacaccaagggcgggcccggccatgaggagccgatcccgatggccacatacggttggaacttggtaaagttgcacagcggcaaggacgttttcttcatgccgcccgagaaatgcgacaccctgctctgcgatatcggggagtccagcccgaaccccaccattgaggagggtaggaccctgcgggtcctgaagatggtcgaaccctggctccggggtaaccaattctgtatcaagatcctgaatccctacatgccgagtgttgtggagactctggaacagatgcagcgcaagcacggcggcatgttggttcggaatcccctgtcccgcaactcaacgcacgagatgtactgggttagctgcgggaccggcaacatcgtttccgccgtcaacatgacctctagaatgctgctaaaccgctttactatggcccaccgcaagcccacgtacgagcgggatgtggacctgggggcggggacgagacacgtggcggtcgagcccgaggtggccaatctggacatcatcggccagaggatcgagaatatcaagaacgagcacaagtccacctggcactacgacgaggacaatccgtacaagacctgggcctaccacggcagctacgaggtcaagccctccggtagcgcctccagcatggtgaacggagtggtcaggctcctgacgaaaccctgggacgtgattcctatggtgacccaaatcgcgatgaccgacaccacccccttcggccagcagcgggtattcaaggaaaaggtggacacccgcacgccccgggcgaagaggggcaccacgcagatcatggaggtgactgccaagtggctgtgggggttcctctcgcgaaacaagaaaccccgcatctgcacccgggaagagtttacccgcaaggtccgctcgaacgccgccattggagccgtatttgtggacgagaatcagtggaactcggcgaaggaagcggttgaggacgaacgattctgggacctagtgcacagagagcgggagctgcacaaacaggggaagtgcgccacctgcgtgtataacatgatgggcaagcgggagaagaagctcggggagttcggcaaggcgaaaggatcacgcgcgatatggtacatgtggctgggagcccgcttcctggagtttgaggcgctcggcttcatgaacgaggaccattggttcagtcgcgagaacagtctgagcggggtagagggcgaggggctgcacaagctcgggtacatcctgcgggacatctccaagatccccggtgggaacatgtacgccgacgacacagcgggctgggacacccgtatcaccgaggatgatttacagaacgaggcgaagatcacggacatcatggagcccgaacacgccctcctggccacctcgattttcaaattgacctaccagaacaaggtggtgcgtgtccagcgaccggccaagaacggcaccgttatggacgtgatctcccgtcgggaccaacgcggcagtggccaggtcggaacttacggcctcaacacctttaccaatatggaggtgcagctgatccggcagatggagtccgagggcatattcctgcccagcgagcttgagacgcccaacttagctgagcgcgctctggactggctcgaaaagcatggtgccgagcggcttaagcgcatggccatctcaggggatgactgcgtggtcaagccaatcgacgatcggttcgccacggccctgactgctctaaacgacatgggtaaggtgcgcaaggacataccccagtgggagccctctaagggctggaacgactggcagcaggtcccgttttgctcccatcacttccaccagctgatcatgaaggacggacgggaaatcgtcgtgccctgccgcaaccaggacgagttggtgggccgggcccgcgtcagccagggcgcgggctggtccctccgggagaccgcatgcctcggcaagagctatgcccagatgtggcaactgatgtactttcaccggcgggatctccgcctggcggccaacgccatctgtagtgccgtgcccgtggactgggtccccacaagccggaccacgtggagcatccatgcgcatcaccagtggatgactaccgaggacatgttgtcagtgtggaaccgcgtgtggattgaggagaacccttggatggaggataagacccacgtcagctcctgggaggaggtgccctacctcggcaagcgcgaggaccagtggtgcggcagcttgatcggcctcacggcgcgggccacctgggccaccaacatccaggtggccatcaatcaggtccggcggctcatcggtaatgagaactacctcgactacatgaccagcatgaagaggttcaaaaacgagtcggatcccgagggggcgttatggtag

SEQ ID NO: 24065 - RNA, 9879 nt, synthetic construct
  misc_feature 1..9879: note = derived and/or modified CDS sequence (opt11) from DENV-1__FJ850103__SS-prME
  source 1..9879: mol_type = other RNA
agcgtgaccatgttactcatgctcctgcccaccgccctggccttccacctgacgacccgcggcggggagccgcatatgattgtctccaaacaggagcgcggcaagagcttactcttcaagacctccgcgggggtgaacatgtgcacgctgatagctatggatctgggcgaactgtgcgaagataccatgacctacaaatgcccccggatcaccgaggcggagcccgacgacgtcgattgctggtgcaacgctaccgacacgtgggtcacctacgggacctgtagccagaccggcgagcaccgacgcgagaagcgatccgtggccctggcaccgcacgtgggcctggggctcgagacgcgcaccgaaacctggatgagctccgagggcgcctggaagcagatccagagggtcgaaacctgggccctgcgccatcctgggttcacggtcatcgccttcttcctcgcgcacgccatcggcaccagcatcacccaaaaggggatcattttcattctcctcatgctggtgaccccctccatggctatgcgctgcgtcggaatcggcaaccgggacttcgtggagggactctcaggcgccacatgggtcgatgttgtgctggaacacgggtcctgtgtcacaaccatggcgaagaacaagcccacactggatatcgagcttctcaagacggaggtcactaaccccgcggtgcttcggaaactttgtattgaggccaagatctccaatactacaacggactcccgctgtccgacccagggcgaggccacccttgtggaagaacaggacgcgaactttgtttgtcgccgcacattcgtggaccgaggctgggggaacggctgtgggttgttcggcaaagggtcgctactcacgtgcgctaagttcaagtgcgtgaccaaactggaaggcaagatcgtccagtacgagaacctcaagtacagcgtgattgtgaccgttcacacgggcgaccagcaccaggtggggaacgagacgaccgagcatggcaccatcgctaccattacaccccaggcccccacgagcgagatccagctcaccgattacggggccctgaccctcgactgctcccctcgcacgggcttggacttcaacgagatggtgctgctcaccatgaaggaaaagagctggctagtgcacaagcaatggttcctggacctcccgctgccctggacctccggtgcctccaccagtcaagagacctggaatcggcaggacctgctcgtgacgttcaagaccgctcacgcgaagaagcaggaggtcgtggtccttggcagccaagagggcgccatgcataccgccctgaccggggccacggagatccagaccagcggcaccaccaccatctttgcgggtcacttgaagtgtcgcctgaaaatggacaagctgaccctcaaaggcatgtcctacgtgatgtgcaccggcagcttcaagctggagaaagaggtggcggagactcagcatggcacggtgctggttcaagttaaatacgaaggcaccgacgccccctgcaagatccccttctccacacaagacgagaagggggtgacccagaacggccgactgattacggccaaccccatcgtcacagacaaggagaagccggtcaacatcgagaccgaaccacccttcggggaaagctacattgtggtcggggctggcgaaaaggcgctcaaattatcctggtttaagcgcgggagctccatcggtaagatgttcgaggccactgcccgtggggccagacgcatggccatcctaggcgacacggcgtgggacttcgggagcatcggcggtgtgttcacctccgtggggaaactcgtccaccaggtgttcggcaccgcatatggggtgctgtttagtggcgtctcctggaccatgaagatcggtatcggcatactgctcacgtggcttggcctgaacagccggagtaccagtctcagcatgacctgcatcgcggtaggaatggtgacgctatacctcggagtcatggtgcaagccgacagcgggtgtgtgataaactggaaggggcgcgagctcaagtgcgggtccggcatcttcgtcaccaacgaggtgcacacctggacggagcagtacaagtttcaggcggacagcccgaagcggctgagcgcggccattggcaaggcctgggaggagggggtgtgcggcattcgctccgccacaagattggagaacatcatgtggaagcagatcagcaatgagctcaaccatatcttactggagaacgacatgaagttcaccgtcgtagtgggggatgctaacggcatcctagcgcaggggaaaaagatgatccgaccccagcccatggagcataaatattcctggaaaagctggggcaaggccaagatcatcggcgcagacattcaaaacacgaccttcatcatcgacgggcctgacacgcctgagtgcccggacggccagcgggcctggaacatctgggaggtcgaggactacggatttggcgttttcacgacgaacatctggctgaagctgcgcgactcctacacccaaatgtgtgatcatcggctcatgagcgcggccataaaggactccaaggcagtgcatgcggacatgggatattggatagaaagcgagaagaatgagacttggaagctggcccgcgcgtccttcattgaggtcaagacctgcatctggccgaaatctcacacactgtggtccaacggtgtacttgaaagcgagatgattatccccaaaatctacggcggcccgatctcccagcacaactaccggcccggatatttcactcagaccgccggaccctggcacctgggcaagttagagttggacttcgacctttgcgagggtactacggtcgtcgtggacgagcactgcgggaacagaggccccagcctccgaacaaccaccgtgacgggtaagatcatccatgagtggtgctgccgctcctgtactttaccacccctgcggttccgcggcgaggatgggtgctggtatggaatggagatccggcccgtcaaggagaaggaggagaatctggtccgctccatggtgtccgctggtagcggggaggtcgatagcttctccctcggcatcctgtgcgtgagcatcatgatcgaggaagtgatgcggtcccgatggagccggaagatgcttatgaccgggaccctcgccgtattcctgctgctcatcatgggtcagctgacgtggaacgacctgatccggctctgcatcatggtgggagccaacgcgagcgaccgcatgggcatgggcactacctacttagccttaatggccacttttaagatgcggccgatgttcgccgtggggcttctgttccgccggctgacgtcgcgggaggttctcctgctgaccatcggactctccctggtggcctcggtagaactgcccaattccctcgaggaactgggggacggcctggcgatgggcataatgatgctcaaacttttgaccgagttccagccgcaccagctctggaccaccctgctgagcctcacctttgtgaaaaccacccttagtctcgactacgcctggaagacgactgccatggtgctctctattgtctcccttttccccctgtgcctcagcacgacctcccagaagacgacctggctgccggtgctgctcgggagcttcggctgcaagcccctgaccatgttcctaatcaccgagaataagatctggggacggaagtcctggcccctcaacgagggaatcatggccatcggaatcgtgagcatcctactaagcagcctcctgaaaaacgacgtccccctcgcggggcccctcatcgctggcgggatgctgatcgcctgctacgtgataagcggctccagcgctgacctgtccctcgaaaaggcagcggaggtcagctgggaacaagaagccgaacactccggggcctcgcacaatatcctggtcgaggtacaagacgatggcaccatgaaaatcaaggatgaggagagggacgacaccttgactatcctcctgaaggccaccctgctcgcagtgtccggggtgtaccccatgagcatccccgcgaccctgttcgtgtggtacttctggcagaagaagaaacagaggagcggcgttctgtgggacacaccctcgccgccggaggtcgaaagggcggtgctcgacgacgggatctatcggatcctgcagcgcgggctcctgggccggtcccaagttggggtcggagtgttccaagatggggtgttccacaccatgtggcacgtcacacgcggagccgtgctcatgtaccagggcaagcggctagagccctcctgggcctctgtcaagaaggacctgatcagctacggaggcgggtggcggttccagggttcctggaacaccggggaagaagtccaggtgatcgccgtggagcccggcaagaacccgaagaacgtccagaccacccctggcaccttcaaaacccccgagggtgaagtgggtgcgatagcactcgacttcaagcccgggacgtcaggttccccgatagtcaatcgggaaggtaaaatcgtcgggctgtacggcaatggtgtggtgaccaccagcggcacctacgtctccgccatcgcgcaagccaaggcgagccaggaaggacctctgcccgagatcgaggacgaggtgttcaagaagcgtaacctgaccatcatggacctgcatccgggctcaggcaagacgcggcgctacctgcccgctatcgtgcgggagtccatcaagagaaagctgcgcaccctgattctcgcccccacaagggtcgtagccagcgagatggccgaggccctaaaggggatgcccatccgctaccagacgaccgcggtgaagtcggagcacacggggcgtgagatcgtggatctgatgtgtcacgccacgtttacgatgcgcctgctcagtccggttcgggtacccaactacaatatgataatcatggacgaggcccactttaccgaccccgcctccatcgccgcacgcgggtacatctccacccgggtcggcatgggtgaggccgcggcaatcttcatgaccgctacgccccctggctccgtggaggccttcccgcaatcgaatgcagtgattcaggacgaggagcgcgacatccctgagcggtcctggaactccggctacgactggattaccgacttccccggtaaaactgtctggtttgtgccgtccatcaagtcgggaaacgacatcgccaactgcctgcgtaagaacgggaagcgggtaatacagctgtcaagaaagaccttcgatacagagtaccaaaagaccaagaacaatgactgggactacgtagtcaccaccgacatcagcgagatgggcgctaactttcgggccgatcgcgtcatcgacccccggcgctgtcttaagccagtcatcttgaaggacggacccgagcgggtaatcctggccggcccaatgccagtcacggtggcctccgctgcccagcgccggggccgcatcgggcgcaatcaaaacaaggagggggaccagtatgtgtacatgggccagccgttaaacaacgacgaagaccacgctcactggaccgaggcgaagatgttgctggacaatatcaacaccccagaaggcatcatcccggccctctttgagcccgagagagagaaaagcgcggccatagacggggagtaccgcctgaggggcgaggccagaaagacatttgtcgagctgatgcgccggggcgacctccccgtgtggctgtcctataaggtggctagcgagggattccagtactcggaccggcgctggtgtttcgatggcgagcgcaacaaccaggtcctcgaagagaacatggacgtggagatctggacgaaggaaggcgagcgcaagaaacttcggccccgctggctggacgcgaggacctacagcgacccgttggctctacgcgagttcaaggagttcgccgccggtcgacgcagcgtgtcaggtgatctgatactggagatcggcaagctcccgcaacaccttaccctacgagcccaaaatgcgctcgataacctagttatgctgcacaatagcgagcagggagggaaggcgtaccgccacgccatggaggagctacctgacaccatcgagacgcttatgctgctcgccctgatcgccgtactgacgggtggggtgaccctatttttcctatccggcaagggcctgggcaaaacaagcataggcctcttatgcgtaacagcttccagcgctctgctctggatggcgtccgtggagccccattggatcgccgccagcatcatcctggagtttttcctgatggtgctcctgatcccggaacccgaccggcagcgcacgccccaggacaatcagctggcgtacgtggtgatcgggctgctgttcatgatcctgaccgtggccgccaacgagatgggcctcctcgagaccacaaagaaggacctgggcatcggttacgtagccgccgagaaccaccaacacgcgacgatgctagacgtcgatctgcatcccgcctccgcctggaccctttacgccgtggccacgaccgtcatcacgcctatgatgcggcacaccatcgagaacaccaccgcgaacatcagcctcacggcaatcgccaaccaggccgccattctgatgggcctcgacaagggttggcctatttccaagatggacatcggtgtgcccctactcgcgctagggtgttacagccaggtgaaccctctcacattgacagccgccgtgctaatgctcgtagcccactacgccatcatcggccccgggttacaggccaaggccactcgcgaggcccagaagcgcacggctgctggcatcatgaagaaccccacggtcgacggcatcgtcgccatagacctggatcccgtagtatacgacgcaaagttcgagaagcagctcgggcagataatgctgctgatcctctgcacgagtcagatcttactgatgagaaccacgtgggccctctgtgagagcatcaccctggccactgggccactgaccacgctctgggaggggagccctggcaagttctggaacacaacaatcgcggtctcgatggccaacatcttcaggggctcctacctagccggggccggcctggcctttagcttgatgaaatccctgggtggcgggcgtcgcggcaccggcgctcagggggagacgttgggcgagaagtggaagcggcagctcaaccagcttagcaagagtgagttcaacacatacaagcgatccgggattatggaggtcgaccggtcagaggcgaaggagggcctgaaaagaggggaaaccaccaagcacgcagtcagtcggggcacggcaaagctccgatggttcgtggagcgcaatctggtgaagcccgagggcaaggtgatcgacctggggtgtggccgagggggctggtcctactactgcgcggggttaaagaaggtcaccgaggtgaagggatataccaagggcgggcccggccatgaggagccaatccccatggccacttacggctggaacctcgtgaagctgcactccggcaaggatgtcttctttatgccacccgagaagtgcgacacactgctatgcgatattggagagagctccccgaaccctacgatcgaggagggccgaacgctgcgcgtgctgaagatggttgagccctggttgaggggcaaccagttctgtatcaagatcctgaacccctacatgccgtcggtcgttgagaccctggaacagatgcagagaaagcacggagggatgctcgtacggaacccattatcccgcaattcaacccacgagatgtactgggtcagttgtgggacgggaaacatcgtgtccgccgtaaatatgacctcccggatgctgctgaaccgcttcaccatggcccaccgcaagcccacgtacgagcgcgatgtggacctgggcgccggcacgcgtcatgttgcggtggagcccgaggtcgcaaacctcgacatcattggccagcggattgagaacatcaagaacgagcacaagagtacctggcattacgacgaggataacccatacaagacctgggcctaccacgggtcctacgaggttaaacctagcggctccgccagctccatggtcaacggagtggtgaagctcctgaccaagccctgggacgtcattcccatggtgacgcagatcgccatgacggacaccaccccgtttggccagcaaagggtgttcaaggagaaggtcgacacgcggaccccacgcgcgaagcgcggaaccactcaaataatggaggtgacggcgaagtggctgtgggggttcctctctcgcaacaagaagccccgtatatgcactcgcgaggagttcacccggaaggtgaggagcaacgccgcgatcggcgccgtctttgtagacgagaaccagtggaacagtgcgaaggaggccgtggaagacgaacgattctgggacctggtccatcgtgagcgggagctgcacaagcaagggaagtgcgccacgtgcgtatacaacatgatgggcaagcgagagaagaagctcggagagttcggcaaggcgaaaggcagccgggctatctggtatatgtggttaggggccagattcctggagttcgaggccctgggctttatgaatgaagaccactggttcagtcgggagaacagcctgtccggggttgagggagagggcctgcataagttaggatacatactgagagacattagcaagatcccgggagggaacatgtatgcggacgataccgccggatgggacacccggatcaccgaggatgacctccagaacgaggcgaagattaccgacatcatggagcccgagcatgccctcctcgccacctccatattcaagttaacataccagaacaaggttgttcgcgttcagcgccccgccaagaacgggaccgtcatggatgtgataagcaggcgcgatcagcggggctcaggacaggtggggacgtacgggctcaacacgttcaccaacatggaggtccaactgatccgacagatggagagtgagggtattttcctgccaagtgagctcgagaccccgaacctagccgagcgggcgctggactggttagagaagcacggcgccgagcgcttgaagcggatggccatcagcggggacgactgcgtggtgaagcccatcgatgaccgcttcgcaaccgccctgacggcgctcaacgacatgggcaaagtccggaaggatattccccagtgggagccctcaaagggctggaacgactggcagcaggtcccgttctgcagccaccactttcaccaactgatcatgaaggacgggcgtgaaatcgttgtcccatgccggaaccaggacgagctggtgggccgcgcacgggtctcccagggggccggctggagcctccgcgagactgcctgcctgggtaaatcctacgcccagatgtggcagctgatgtacttccatcgccgtgacctccggctggcggcaaacgccatatgcagcgcggtccccgtggactgggtccccaccagccgaaccacgtggtccatccacgcgcaccaccagtggatgacgaccgaggacatgctgagcgtctggaaccgggtgtggatcgaggagaacccgtggatggaggataagactcatgtgtccagctgggaggaagtcccctacttgggcaagcgcgaggaccagtggtgcggctccctgatcggcctgacggcccgcgccacgtgggcgaccaacatccaggtggccatcaaccaggtgcggcgcctcatcggcaacgagaattacctagactacatgaccagcatgaagcggttcaaaaacgagtccgacccggaaggggcactgtggtga

SEQ ID NO: 24066 - RNA, 9879 nt, synthetic construct
  misc_feature 1..9879: note = derived and/or modified CDS sequence (opt11) from DENV-1__FJ850104__SS-prME
  source 1..9879: mol_type = other RNA
agcgtgactatgttgctcatgctgctgccgaccgccctcgccttccacctgaccacgcgcggcggggagccccacatgatcgtgtcaaagcaggagcgggggaagtcactgctgttcaagacctcagcgggggtcaacatgtgtacgctgatcgccatggacctgggcgagctctgcgaagatactatgacctacaagtgcccgcgcatcaccgaagcggagcctgacgacgtggactgttggtgtaacgtgaccgacacgtgggtgacctacggaacctgcagccaaaccggggagcatcggcgtgacaagcggtccgtggccctggcaccccatgtcggactcggcttagagacccgcacagagacctggatgagctccgagggggcctggaagcagattcaaagggtcgagacttgggccctgcgccatcccggttttacagtgatcgccctgttcttagcccacgccatcggcacctcaattacacagaaagggattatcttcattcttctgatgctggtgacaccctccatggccatgcggtgcgtgggcatcgggaaccgcgacttcgtggaggggctgagcggcgccacgtgggtagacgttgttctggaacatggctcctgcgtcaccacaatggctaagaacaaacccacgctcgacatagagttactgaagacggaggtgaccaaccccgccgtgctccggaagctatgcatagaggctaaaatttcaaataccacaacggattcccgctgtccgacccagggcgaggccaccttagtcgaggagcaggacgccaacttcgtgtgcagacgtacctttgtggatcggggctgggggaacggctgcggcttgtttgggaaggggagcctgctgacgtgcgccaagttcaagtgcgtcaccaagctcgagggcaagattgtgcagtacgagaacctgaagtactccgtgatagtcaccgtacacactggagaccagcaccaagtcgggaacgagacgaccgaacacggaacgatcgcaaccatcacccctcaggcgccgacgagcgaaatccaactgaccgactacggggccctgaccttggactgcagcccccgcaccggcctagacttcaacgagatggtgctcctgacgatgaaggagaagtcctggctggtgcacaagcagtggttcctcgacctgccgcttccctggacctccggtgccagtaccagccaggagacctggaaccggcaggacctcctcgttacgttcaagaccgcccacgccaaaaagcaggaggtggtggtcttgggctcccaggagggcgcaatgcacactgccctaacaggggctacggagatccagaccagtggcacaaccacgatcttcgcagggcacctgaagtgccgcctgaagatggacaaactcacgctcaagggcatgtcctacgtcatgtgcaccggcagctttaaacttgaaaaagaggtggcagagacccaacatggcactgtgcttgtacaagtgaaatacgagggtaccgatgcgccatgcaagatccccttcagcactcaggacgagaaaggtgtcactcagaatggccggctaattacggctaaccccatcgtgaccgataaagaaaagcctgtgaacatcgagactgaaccgcctttcggggagtcgtacattgtcgtgggggcgggtgaaaaagcgttgaagctgagctggttcaagaagggaagctccatcggcaaaatgttcgaagcgacagctcgcggggcccggcgcatggccatcctgggcgacacagcttgggatttcgggtccataggcggcgtgtttacgtccgtcggaaagctggtgcatcaagtattcgggaccgcctatggggtcctgttcagcggcgtaagttggaccatgaaaatcgggatcggcatcctcctgacgtggctgggcctcaacagccgctcgacctcgctgagcatgacctgcatcgccgtaggcatggtgaccctgtacctcggcgtgatggtgcaggccgactcagggtgtgtcatcaactggaagggcagggagctcaagtgtgggtccggtatcttcgttacgaatgaggtgcacacctggaccgagcagtacaaattccaagccgacagcccgaaacgcctgagcgccgcgatcggaaaggcctgggaagaaggtgtctgcggcatccgctctgccactaggctcgagaacataatgtggaagcagattagcaacgaactgaatcacatcctcctcgagaatgacatgaaattcaccgtggtggttggtgatgcgaacggaatcctggcccaggggaagaagatgatccggccccagcccatggagcacaagtactcctggaagagttgggggaaggcgaagatcattggcgccgacatccagaatacgacctttatcattgatgggcccgacaccccggagtgccccgacgggcagcgagcctggaatatctgggaggtggaggattatggattcggcatcttcacaactaatatttggctgaaactacgggatagttacacgcagatgtgtgaccaccgactgatgtctgccgcgatcaaggattccaaggccgtgcatgccgacatgggctactggatcgagagcgagaagaacgagacctggaagctcgcacgggccagcttcattgaggtcaagacgtgtacgtggcccaagtcacacaccctgtggtcgaacggggtgctagagtcggagatgataatcccgaagatctacggcgggccgataagccagcacaaccaccgtcccgggtacttcacacagaccgcgggaccctggcatctgggtaagctcgagctggatttcgacctgtgcgagggaacaacagtagtcgttgacgagcactgtgggaaccgcggcccgtcgctccgcaccaccacggtcactgggaaaatcatccatgaatggtgctgtaggtcctgcacactcccgcccctacggttccggggcgaggacggttgctggtacggaatggaaatccgtcccgtcaaggaaaaagaagaaaacttagtgcgttctatggtcagcgccggaagcggggaggttgacagcttttccctaggcatcctgtgcgtgagcatcatgatcgaggaggtgatgaggtcccggtggagccgcaaaatgctgatgaccgggacactggccgtcttccttctcctgatcatgggccagctaacctggaacgacctgatccgactgtgcattatggtgggagccaacgcctccgacagaatgggcatgggcactacctacctggccctcatggccacgttcaagatgcgccctatgttcgcagtgggcctgcttttcaggcgtctcacctcccgggaggtactgctactcaccatcgggctgtccctggtggccagcgtcgagctccctaacagccttgaagaactgggggacggactcgccatgggtatcatgatgctgaagctgctcaccgagttccaaccgcatcagttatggacgaccctgctgtcactgacgtttgtgaagaccaccctatcactcgactacgcgtggaagactaccgccatggtcctgtcgatagtctctctgttcccgctctgtctgagcaccacgtcccagaagaccacctggctgccggtgctcctggggagcttcggctgcaagcccctgacgatgttcctcatcaccgagaacaagatctggggacgcaagtcctggccactgaacgagggcatcatggccatcggtatcgtgagcatcctgttgtcctcgctactgaaaaatgacgtcccgctcgccggcccgctgatcgcgggagggatgctgatagcatgctacgtaatcagcgggagcagcgctgacctctccctggaaaaggcagctgaggtgtcgtgggagcaggaggctgagcactccggggcctcgcacaacatcttagtggaggtgcaagatgatggcacgatgaaaatcaaggacgaagaacgggacgacaccctcaccatcctgctaaaggcgaccctcctagcagtgtccggggtctaccccatgagcatcccggcgactctgttcgtgtggtacttctggcagaaaaagaaacagcgttcaggcgtgctctgggacacccccagcccgcccgaggtcgaacgggctgtgctggacgacggaatctaccgtatactgcagcggggcctgttaggccgctcccaagtaggggtcggcgtattccaggacggggtgttccacacaatgtggcatgtcaccagaggggccgtgctaatgtaccagggcaagcgcttggagccctcgtgggcttccgtgaagaaggatctcatctcatacggaggagggtggagattccaggggagttggaacactggggaggaggtccaggtcatcgcagtagaacccgggaaaaatcccaagaatgtccagaccacccccgggacctttaagacgccggagggggaggtgggggccatcgcgctggactttaaaccaggcaccagcggctccccgatcgtgaatcgcgaggggaagattgtcgggctctacggcaatggcgttgtcaccacctctggcacgtacgtctccgcgatcgcacaggcgaaggccagtcaggaggggcccctccccgagatcgaggacgaggtcttcaagaaacggaatctgaccatcatggacctacacccaggctctggcaagacccgcagatacttaccggctatcgtacgcgaggccatcaagcgtaaactgcggaccctgattctcgcgcccacgcgcgtcgtcgcgtccgagatggcggaggccctgaaagggatgcccatccggtaccagacaacagccgtcaagagcgagcacacaggcagagagattgtcgacctgatgtgccacgccactttcaccatgagactcctgtctccggttcgcgtgcccaactacaacatgataatcatggacgaggcccatttcacagaccctgcgagcatcgccgccagagggtacatatccactcgcgtcggcatgggcgaggccgcggcgatcttcatgacggccacgccgcccggtagcgtggaggcatttcctcagtccaacgccgtgatccaggacgaagaacgggacatccccgagcgctcgtggaactccggctacgactggatcaccgattttcccgggaaaaccgtctggtttgtgcccagcatcaagtccggaaacgacattgccaactgcctgcggaaaaacgggaagagagtgatacaactctcacggaagacgttcgacaccgagtatcagaagaccaagaacaacgactgggactacgtcgtaaccaccgacatctccgagatgggtgcgaactttcgcgccgaccgggtgatcgaccccagaaggtgcctgaagcccgtcatcctgaaggacgggcccgagcgcgtgatcctcgccggcccgatgcccgtcactgtggctagcgcggcacagcggcgcggccgtatcgggcggaatcaaaacaaggagggagaccagtacgtgtacatggggcagccccttaacaacgacgaggaccatgcccactggaccgaggccaaaatgctgctcgacaacatcaatacccccgagggcatcataccggctctgttcgagcccgagcgcgaaaaatccgctgctatcgacggtgagtaccgtttgcgcggagaggcccggaagacatttgtcgaactcatgcgccggggcgacctgcccgtgtggctctcatacaaagtcgcctcagagggtttccagtatagcgacagacggtggtgcttcgacggcgagcgcaataaccaggttctggaggagaacatggacgttgaaatctggacgaaagagggggagcggaagaaactgagaccccggtggcttgacgcccgcacttactcagacccgcttgccttgagggaatttaaggagttcgccgccgggcgacggagcgtcagcggagacctcatccttgagatcggtaagctcccccaacacctgacgctccgcgctcagaacgccctcgataacctggttatgctccacaactccgagcagggcgggaaagcgtatagacatgctatggaggaactgcccgatacaatagagacgctgatgctcctggcactgatcgcggtcctcaccggaggggtgaccctattcttcctgagcggcaagggactcgggaagacctccatcggcctgctatgcgtcacggcctcgtccgccctcttatggatggccagcgtggagccccactggatcgccgcctcaatcatcctcgagttctttcttatggtgctgcttatcccggaacccgaccgccaacgaacgccccaggataaccagttagcgtacgtcgttatagggctgttattcatgatacttaccgtggcggccaacgagatgggcctgctagaaaccaccaagaaggacctagggattggctacgtcgctgccgagaaccaccagcacgcgacaatgctggacgttgatctccgaccagctagcgcctggactttgtacgccgtggcaaccactgtcatcacccccatgatgaggcatacgatagagaataccactgcgaacatatccctgacagccatcgccaaccaggcggcaatactgatgggcctcgacaagggatggcccattagcaagatggacatcggcgtgcccctgttggcgctcgggtgctactcccaagtgaacccgctgacccttaccgccgcggtcttaatgctagtggcccactacgcgatcatcggacccgggctgcaggccaaggccacgagggaagcacagaagcgcactgccgctggcatcatgaagaacccgaccgtggacggtatcgtcgccattgacctggaccccgtcgtgtacgacgcgaagtttgaaaagcagcttgggcagatcatgctgcttatcctgtgcaccagccaaatcctgctcatgcggacgacctgggctctgtgcgagtctattaccctggccacgggcccgctcacgaccctctgggaggggagccccggcaaattctggaacaccaccatagccgtgtcgatggccaacatcttcagaggatcttacctggcgggggcaggcctcgcattctccctgatgaaatctcttggcggcggccggcgcgggacgggagcgcagggcgagactctgggcgagaagtggaagcggcagctgaaccagctgtctaaaagcgagttcaacacctacaagcgcagcgggatcatggaggtggaccggtccgaggctaaagaggggttaaaacgcggtgaaactacgaagcacgccgtgagccggggcacggccaagctccgctggttcgtcgagcggaaccttgtgaaacctgagggtaaggtgatcgacctgggctgcggccgcgggggctggtcctactactgcgcgggcctaaagaaagtcaccgaagtaaagggttataccaagggcgggcccggccacgaggagccgattccgatggccacatacgggtggaacctggtgaagctgcacagcgggaaggacgtcttcttcatgcctcccgagaaatgcgacaccctcctttgcgatattggggagtccagcccaaatcctacgatcgaggagggccgcaccctgagagtgctcaagatggtggaaccctggttaaggggaaaccagttctgcatcaaaatcctgaacccctacatgccgtccgtcgtggagaccttagagcaaatgcagcgcaagcacgggggcatgctggtccggaatcccctgagtaggaactccacgcacgagatgtattgggtcagctgcgggaccggtaacatcgtatccgccgttaacatgacctctcggatgctcctgaaccgcttcaccatggcccaccgcaaacccacttacgagcgggatgtcgacctgggggcagggacccggcatgtggcggtggagcccgaggaagccaacctcgatatcataggacaacgcatcgagaacatcaagaacgagcacaaatccacctggcactacgacgaagacaacccgtacaagacctgggcctaccatgggtcttacgaggtcaagcccagtggcagcgcatcgtcgatggtgaacggggtcgtgcgcctcttgacgaagccctgggacgtgatccccatggtcacccagatagccatgactgacactaccccgttcggacagcagcgtgtcttcaaggagaaggtagacacccgcacgccccgcgcgaagcgcgggacgacgcagatcatggaagtgaccgccaagtggctctgggggtttctgtcccgtaacaagaagcctcgcatctgcacccgtgaagagtttacccgcaaggtgcggtcgaatgccgccatcggcgccgtattcgtcgacgagaatcagtggaatagcgcgaaagaggccgttgaggacgagcgcttctgggacctggtgcaccgggagcgcgagctgcacaagcagggaaagtgtgcaacctgtgtctacaacatgatgggtaagcgggagaagaagctgggagaatttggtaaggccaaggggtcccgcgcgatctggtacatgtggctaggtgcccggttccttgagttcgaggctctcggctttatgaatgaggaccactggtttagcagggagaacagcctgagcggggttgagggcgaggggctccacaagctgggctatatcctccgggatatctcaaagatcccgggcgggaacatgtacgccgacgacaccgccggctgggacacacggatcacagaggacgacctccagaacgaggcgaaaatcacggacatcatggagcccgagcacgccttattagctacatcaatcttcaaacttacctaccagaacaaggtggtccgcgtgcagcggcccgccaagaacgggaccgttatggacgtcatctcccgaagagaccagcgtggctcaggccaggtggggacgtatggcctgaacacctttaccaacatggaagtccagctcatccggcagatggagtccgaagggatcttcctcccgtccgagctcgaaaccccgaacctggccgaacgcgtcttggactggctggagaaacatggcgcagaacgtctgaaacgcatggccatctccggagacgattgcgtagtgaagcccatcgacgatcggtttgccacggcgctgaccgcgctaaacgacatgggaaaggtccgcaaagacataccccaatgggagcccagcaagggctggaatgactggcagcaggtcccgttctgctcccatcacttccaccaactgatcatgaaggacggacgggagatcgttgtcccatgccgcaaccaggacgagcttgtgggccgggcgcgagtgtcgcagggggctggatggtcactgcgtgagaccgcctgcctgggcaagagctacgcccagatgtggcaacttatgtatttccaccgcagagaccttcgtctggcggcgaacgccatttgctccgccgtccccgtggactgggttcccaccagccggaccacttggagcattcacgcccaccaccagtggatgacaacggaggacatgctcagtgtctggaacagggtgtggatcgaggaaaacccgtggatggaagataagacacacgtcagctcctgggaagaggtcccttacctgggcaagagagaggaccagtggtgcgggagcctgatcgggctcactgcgcgtgccacctgggccactaacatccaggtggccatcaaccaagtccgacggctgatcgggaacgagaattacctggactacatgacctcaatgaagcggttcaagaacgaatctgaccccgaaggtgccctctggtga

SEQ ID NO: 24067 - RNA, 9879 nt, synthetic construct
  misc_feature 1..9879: note = derived and/or modified CDS sequence (opt11) from DENV-1__JN819405__SS-prME
  source 1..9879: mol_type = other RNA
tctgtgaccatgctgctaatgctgctacccactgccctcgcgttccacctgacaacccgcggcggggagccccacatgatagtgtcgaaacaggagcgggggaagagcctgctgttcaaaacaagcgctggggtgaatatgtgcaccctgattgccatggacctgggggagctctgcgaggacactatgacctacaagtgccccaggatcacggaggccgagccagatgacgtagactgctggtgcaacgccactgacacctgggtcacctacgggacctgttcacagactggggagcaccgaagggacaaacggtcagtagccctggcgccccacgtgggtctgggcctcgagacccggaccgaaacctggatgagctccgaaggcgcctggaagcagatccaacgagtggagacctgggccctgcgacaccccgggtttacggtgatcgccctgttcctcgcgcacgccatcgggacgagcatcacccaaaagggaatcatcttcatcctgctgatgctcgtgaccccgtccatggccatgcggtgcgtcggcatcggcaaccgggacttcgttgaagggctgagcggcgctacgtgggtggacgtcgtgctggagcatgggtcctgtgtgaccaccatggccaagaacaagccgaccctcgatatcgagctgttaaagacggaggtcacgaatcccgcggtgttgcggaagctgtgcatcgaagccaagatcagcaataccaccacggactcccgctgcccgacacagggcgaagccacgctggtggaagagcaggacgccaacttcgtctgccggaggaccttcgtcgaccggggctgggggaacggctgcggcttgttcgggaagggaagtttactgacgtgcgccaagttcaagtgcgtgaccaagttagaagggaagatcgtccagtacgaaaacctgaagtattccgttatcgtaaccgtacacaccggcgaccagcaccaagtggggaacgagacgaccgagcatggaaccattgcgaccattacgccccaggcccccacgagtgagatccagctaacagactacggggccctcaccctggactgtagcccccgtaccggcctagacttcaacgagatggtcctcttgacgatgaaggaaaagtcctggctggtgcacaagcagtggttcctcgacctgccactgccctggacatctggggcctcaactagtcaggagacctggaacaggcaggatctcctggtgacgttcaaaaccgcccacgctaagaagcaggaggtcgtggtgctgggatcccaggagggggccatgcacaccgccctcaccggtgcgactgaaatccagaccagtggcaccaccacgatcttcgccgggcacctaaagtgtcgcctgaagatggacaagctcacactgaagggcatgtcatacgtcatgtgcaccgggtccttcaagctagagaaagaagtggccgaaacccaacacggcacggttctggtccaggtgaagtatgagggaaccgacgccccctgcaagatccccttctccacccaggatgagaaaggggtgacccagaacggccggctcatcacggccaaccctatcgtgacagataaggaaaaacccgttaacatcgaaaccgagccaccctttggggagtcctatatcgtggttggcgccggcgagaaggcgctcaagttaagctggtttaagaaagggagctccatcggcaaaatgtttgaggcaaccgcccgcggggcccggcgcatggccatcctcggcgacacggcgtgggacttcgggagcatcggcggcgttttcacctccgtgggtaaactggtccatcaggtgttcgggaccgcctacggggtgctgttcagcggcgtttcctggaccatgaagatcgggattggcatcctcctgacatggctcggactcaacagccgatccaccagcctgtccatgacttgcattgccgtcggaatggtgaccctctaccttggcgtcatggtccaggccgacagcgggtgcgtgatcaactggaaaggccgggaactaaagtgcggatccgggatattcgtcaccaacgaggttcacacctggaccgagcaatacaagttccaggccgacagcccgaagcgcctgagcgcggctatcggcaaggcctgggaggaaggggtatgtggaatcagatccgccacccgccttgagaatatcatgtggaagcagatcagcaatgaactaaaccatatcctgctcgaaaacgatatgaaattcaccgtcgtggtgggggacgccaacgggatcctggcccagggcaagaagatgatacgcccgcagcccatggagcataaatattcctggaagtcctggggtaaggccaagataattggcgccgacatccagaatactaccttcataatcgacggacccgataccccagagtgcccggacggacagcgcgcctggaacatctgggaggtagaggactacggtttcggcatattcaccacgaatatttggctgaagctccgggactcctacacccagatgtgcgaccaccgactgatgagcgcggccatcaaggattcaaaggccgtccacgcagacatgggctactggatcgagtccgagaaaaacgagacctggaagctggcacgggcgagctttatcgaggtgaaaacctgcacgtggcccaagagtcacactctctggtccaacggggtcctggagagcgaaatgatcatccccaagatatacggcgggccgatcagtcagcacaattaccgccccgggtacttcacccaaaccgccggcccatggcacctgggcaagctcgagcttgacttcgacctatgtgaaggcacgaccgtggtggtcgacgagcactgcgggaaccggggcccgagcttgcgcaccacgacagtgaccgggaagattattcacgagtggtgttgccggtcctgcacactgccgcctctgcgcttccggggcgaggacgggtgctggtacggaatggagatccgaccggtcaaggagaaggaggagaatctcgtccggagcatggtgtccgccggaagcggggaggtggacagcttctccctgggaatcctgtgcgtcagcatcatgatcgaagaggtgatgcgctccagatggagccgcaagatgcttatgaccggtacgctggccgtcttcctgctcctgatcatgggccagctgacctggaatgatctgatccgcctgtgcatcatggtcggggccaacgcgtccgacagaatgggcatgggcaccacccacctagcactcatggccacgttcaagatgcgcccgatgtttgccgtggggctgctattccggcgcctcacttcgcgggaggtgcttctcttgaccatcggcctatcactgatggcctcgatggaactccccaatagcctggaggagctaggggacggcttggcgatgggcatcatgatgctgaaacttctcaccgaatttcagccccaccagctgtggacgaccctgctgagcctgacattcgtcaagaccacgctctccctcgactacgcctggaagaccacagccatgattctgtcgatcgtctccctgttccccctatgcctgtccactacgtcacagaaaacaacctggcttccggtcctcctggggagcttcggctgcaaacccctgaccatgttcctcattacagagaacaagatttgggggcgcaaatcatggcccctgaacgagggcatcatggcaattgggatcgtgagcatcctgctctccagcctgctgaagaacgacgtgccattagcgggacctctgatcgcgggcggtatgctgatcgcgtgctacgtcatcagcgggtcctcggctgacctctccctggagaaggccgcggaggtgtcgtgggagcaagaagcagaacactccggggccagccacaacatcctggtggaggtgcaggacgatggcacgatgaagatcaaggacgaggagcgagacgacaccttgaccatcctgctgaaggccaccctgctggccgtgtccggggtgtaccccatgtcaatacccgccacgctcttcgtttggtatttctggcaaaagaaaaagcagagatcaggcgtgctctgggatacccccagcccgccagaggtggagagagccgtactggacgacggcatctaccgcattttacagcgcgggctactcggtcgctcccaggtgggggtcggcgtcttccaggatggggttttccacaccatgtggcacgtgacccggggcgccgtcctgatgtaccaggggaagcgcctggagcccagctgggcctcggtgaagaaggacctaattagctacgggggcgggtggagattccagggctcctggaacacgggggaagaggtgcaggtcatcgccgtggaaccaggtaagaacccgaagaacgttcagaccacccccggcacctttaagacgcccgagggggaggtaggcgcgatcgccctggacttcaaacccgggaccagcgggtcccccatcgtgaaccgcgaaggcaagatcgttgggctgtacggcaatggggtggtaaccacctcaggaacatacgtgtccgccattgcccaagccaaggcatcgcaggaggggcccctgcccgagatcgaagacgaggttttcaaaaagcgaaatctgaccatcatggacctgcatccgggcagcggcaagacccgccggtacctccccgccatcgtccgcgaggccatcaagcggaagctacgcaccctgatcctcgcccccacacgcgtggtagcgtccgagatggctgaggccctgaaggggatgcccattcggtatcagacaaccgccgttaagagcgagaccacgggccgcgaaattgtggacctgatgtgccacgcaaccttcaccatgcgtttgctgtccccggttcgggtgcccaattacaacatgatcataatggacgaggctcatttcaccgatcccgcttcaatagccgcccgagggtacatctccacgcgagtggggatgggggaggccgctgccatattcatgacagccacgccgcccggcagtgtcgaggcattcccccagtccaacgccgtgatccaagacgaggagcgggacatccccgagagaagctggaactcgggatacgactggatcaccgacttccccgggaagacggtgtggtttgttccctctatcaagtccggcaacgacatcgcgaactgcctgcgcaagaacgggaagcgcgtgatccagttgtcgcggaagaccttcgacaccgagtaccaaaagaccaagaacaacgactgggactacgtggtgacgaccgacatctcagagatgggggcgaacttcagggcagaccgggtgatcgacccccgccggtgtttgaagcccgtcatcctgaaggacggccccgagagggtcatcctcgccgggccgatgcccgttaccgtggcgagcgccgcccaacggcgtggcaggataggaaggaaccagaacaaggagggtgaccagtacgtttacatggggcaacctctgaataacgacgaggatcacgcacactggaccgaggccaagatgctgcttgacaacatcaacactcccgagggcataataccggcgctgttcgaaccggagcgagagaaatcagccgccattgacggggagtaccggctgcgcggcgaggcccggaagacttttgtggagctcatgcgccgtggagatctgccggtatggctgagctacaaggtggcctccgagggatttcaatacagtgaccgccggtggtgctttgacggcgagcgcaataaccaggtactggaggaaaacatggacgtcgagatctggaccaaggaaggtgaaagaaaaaagctccgaccccggtggctggacgcgcgcacctattcggaccctcttgccctgcgtgaatttaaggaattcgccgccgggcgccgctcggtgtcaggtgacttaatcttagagatcgggaagctgccccagcacctgactttgcgcgcgcagaacgcgttggacaacctggttatgctccataacagcgagcagggcgggaaagcctaccgacacgccatggaggagctgcccgacactatcgagaccctgatgctcctggccttaatcgcggtcttgacgggcggggtgaccttgttcttcctatctggcaagggcctcgggaaaacgtcgatcggcctgctgtgcgtgactgcctcctccgcgctcctgtggatggcctctgtggagccccactggatcgcagcctcgatcatcctggagttctttctcatggtgctgctgatcccggagcccgataggcagcggacgccccaggacaaccaactagcctacgtggtcatcgggctgttatttatgatcttgaccgtggccgcaaacgagatgggcctgcttgagacgaccaagaaggaccttgggatcggctacgtagcagcggagaaccaccagcacgccacgatgctggacgtcgatctgcgccctgccagcgcctggacactctacgctgtggcgacgacagtgataacgcccatgatgcgacacacgatcgagaacactaccgcgaacatcagtctgaccgccattgccaaccaggccgctatcctaatggggttggacaaagggtggccgatcagcaagatggacattggcgtccccctcctggccttagggtgctactcccaggtcaacccgctgaccttgacggctgccgtcctcatgctggtcgctcattacgcgattatcggtccaggattacaggccaaggccacccgcgaggcccaaaagaggaccgcggccggcatcatgaaaaacccgacagtggatggcatcgtggccatcgacctcgaccccgtcgtttatgacgctaagttcgagaagcagctggggcagatcatgctgctcatcctgtgcaccagccagatcctgctcatgcgtactacctgggccctctgcgagagcatcaccctggcgactggaccgctcaccaccttgtgggaagggagccccggtaaattctggaacactacgatcgccgtgagtatggccaacatcttccgcggcagctacctggccggggcgggcctcgccttctccctgatgaagagtctcggcggcggccggcgtggtaccggcgcacagggggaaactctcggcgagaaatggaagcggcagctgaaccagctgagcaaaagcgagttcaacacatacaagcgctcagggatcatggaggttgacaggtccgaggccaaggagggcctgaagaggggggaaacgacaaagcacgccgtcagtcggggcaccgccaagctgagatggtttgtggagcggaacctggtcaaacccgagggaaaggttatagaccttgggtgcggccgcgggggctggtcctactattgcgccggcctgaagaacttcacggaggtaaaagggtacacctccggaggacccggccacgaggagccgatccccatggccacgtacggttggaatctcgtaaagctgcactccggcaaggacgttttcttcatgccgcccgagaagtgcgacaccctgctttgtgacataggggagtcgtccccgaacccgactatcgaggagggccggaccctgcgtgtactcaagatggttgagccatggctcaagggcaaccagttctgcatcaagattttgaacccttacatgccgagcgtggtggagacgctcgagcagatgcagcggaagcacggaggcatgctggtccgcaaccccctgtcccggaactccacccacgagatgtattgggtatcctgcgggacgggcaacatagtcagcgccgtcaatatgacctcccgcatgctcctgaatcggttcacgatggcgcaccggaagcccacttacgaacgcgatgtcgacctgggggccgggacccgtcacgtggcggtcgagccagaggtggccaacctggacattatcggccaacgcatagagaacattaagaacgagcacaagagcacctggcactacgatgaggacaacccgtacaagacgtgggcataccacgggtcctatgaggtgaaaccgagcggatccgccagctccatggttaacggggtggtgcgtcttcttaccaagccctgggacgtcatccccatggtgacccagatagcgatgaccgacacgactcccttcggccagcagcgcgtcttcaaggaaaaggtggacacccgtacaccccgcgccaagagggggacgacccagatcatggaggtcacagcaaagtggctctgggggttcttaagccgcaacaaaaagccgcggatctgcacccgtgaggagttcacgcggaaagtgcgcagtaacgccgctatcggtgcggtgttcgtggacgagaaccagtggaactcggcgaaggaagccgttgaggacgagcggttctgggacctggtgcaccgcgagcgggagctccacaagcagggtaagtgcgcgacctgtgtctacaatatgatgggcaagcgcgagaaaaagctgggggagtttggcaaggcgaagggcagccgggctatctggtacatgtggctgggggcccggttcctggagttcgaggccctgggcttcatgaacgaggaccattggttctcgcgggaaaacagcctctccggcgtcgagggcgaggggctccacaagcttggctacattctacgggacatctcaaagatcccgggcgggaacatgtatgccgacgataccgcgggctgggacacccggatcacggaggacgacctccagaacgaggccaaaataacggacatcatggagcccgagcacgccctgctggctacctcgatcttcaagttaacctaccagaacaaggtggtgcgagtccagcgcccagcaaagaacgggacggtgatggatgttatcagccgtcgcgatcagcggggctccggacaagtgggtacctatggcctaaacacctttactaatatggaggtgcagctgatccgccagatggagtcagaggggatctttctcccctcagagctggaaacgccgaacctggcggagcgggtcctcgactggttagaaaagcacggcgccgagcgcctgaaacggatggccatcagcggggacgactgcgtcgtgaagcccatagatgaccgcttcgccactgctctcaccgctttaaacgacatgggcaaagtgcgcaaggacatcccacagtgggagccctccaagggctggaacgactggcagcaagtcccgttctgcagccaccatttccatcagctgataatgaaggacgggcgcgagatagtcgtgccctgccggaaccaggacgagttggtcggccgcgctcgggtatcccaaggagccggttggtcactacgtgagaccgcctgcctggggaagtcctacgcccagatgtggcagctcatgtacttccaccggcgagacctgcggctggccgcaaacgcaatctgctccgccgtcccggtcgattgggtacccacctcaaggacgacctggtccattcacgcgcaccaccagtggatgaccaccgaagacatgctcagcgtgtggaaccgggtctggatcgaggagaacccgtggatggaggataagactcacgtgtcaagctgggaggaggtcccctacctgggcaagcgcgaggaccagtggtgcggctcactgatcgggctcaccgccagggctacctgggcgacgaacatacaggtcgccatcaaccaggttcgacgcctgattggcaacgagaactatctggactacatgacgagcatgaagcgtttcaagaatgagagtgatcccgagggggcgctctggtga

SEQ ID NO: 24068 - RNA, 9879 nt, synthetic construct
  misc_feature 1..9879: note = derived and/or modified CDS sequence (opt11) from DENV-1__GQ199877__SS-prME
  source 1..9879: mol_type = other RNA
tccgtgactatgttgctcatgctgctgcccaccgcgctcgcgttccacctcaccacccggggcggggaaccacacatgatcgtgtccaagcaggagcggggcaagagcctcctgttcaagaccagcgcgggcgtgaacatgtgtaccctaatcgcaatggacctgggcgagctctgcgaagacaccatgacctacaagtgcccccggattaccgaagccgagcccgacgacgtggattgctggtgcaacgcgaccgacacctgggttacctatgggacctgcagccagacgggcgagcaccggcgagagaagcgctccgtggccttagcgccccacgtgggcctgggtctcgagacccgcacagaaacctggatgagctccgaaggcgcctggaagcaaatccagcgggtcgagacctgggccctgcgccaccccgggttcacggtgatcgccttcttcctggcgcacgccatcggcaccagcatcacccagaaggggatcatcttcatccttttgatgctggtgaccccctccatggccatgcgctgcgtcggcattggcaatagggacttcgtggaagggctaagcggcgctacgtgggtggacgtcgtcttagagcacgggtcctgcgtaaccaccatggccaaaaacaagcccaccctggatatcgagctcctgaagacggaggtgacaaaccccgcggtgctgcgtaagttatgcatcgaggccaagatcagcaacaccaccacggattcccgctgcccgacccagggcgaagccaccctggtggaagaacaagatgcgaacttcgtctgccggcgcaccttcgtggacagaggctgggggaacggctgcgggctgttcggcaaggggagcttactgacgtgcgccaaattcaagtgcgtaactaagctggagggcaaaatcgtccagtatgagaacctaaagtactcggtgatcgtcactgtccacaccggcgaccaacaccaggtggggaacgagacgaccgagcacggtaccatagcgacaatcacgccccaggcccccacgtcagaaatccaactgaccgattacggggccctgaccttagattgtagccctcggaccggcctggacttcaacgagatggtgctcctcacgatgaaggagaagtcgtggttggtccacaagcaatggttcctggacctcccgctgccatggacctcgggtgcaagcaccagccaggagacctggaacaggcaggacctcttggttacgttcaaaacagcacatgcgaaaaagcaggaggtcgtggtgttagggtcccaggagggtgcaatgcacaccgccctgacaggcgccactgagatccagaccagtggcaccaccacgatcttcgccgggcacctaaagtgcagattaaaaatggataagctgactctcaagggcatgagttacgtaatgtgcaccgggagcttcaagctggagaaggaggtggcggagacccaacatggcactgtgctggtccaggtaaaatacgagggcaccgacgccccctgcaagatccccttctccacgcaggacgagaagggggtgacccaaaatggccggctgatcacggccaatccgatagtcaccgacaaggagaagcccgtaaacatcgagaccgagccgcccttcggggagagctacattgtggtcggcgcgggcgaaaaagccctgaaactgtcctggttcaaacgggggagctccatcgggaagatgttcgaggccaccgcccgcggggcgcgccgcatggccatcctgggcgacacggcgtgggacttcgggagcatcggcggtgtgttcacttcagtggggaagttggtacaccaggtgttcgggaccgcctacggggtgctgttcagcggtgtctcttggaccatgaaaattgggatcggaatcctgctcacgtggctgggcctgaactctcggtcaacaagtctttccatgacttgtatcgctgtcggaatggtgaccctgtacctgggcgtcatggtgcaggccgacagcgggtgcgtgatcaactggaagggcagggagctcaagtgcgggtccggcatcttcgtaactaacgaggtgcacacctggacagagcaatacaagttccaggctgacagccccaaaagactgagcgcggccatcggcaaggcgtgggaggagggagtgtgcggcatccgttccgccacccggctggagaacatcatgtggaagcaaatcagcaatgagctcaaccacatcctgctggagaacgacatgaaattcaccgttgtcgtcggggacgccaacggcatcctcgcgcagggaaagaagatgatccgtcctcagcccatggagcacaagtactcctggaagagttggggcaaagccaagatcatcggcgccgacatccagaatacgaccttcatcattgacgggcccgatacccccgagtgccccgacggtcagcgggcctggaacatctgggaggtcgaggactatgggtttggcgtgttcaccacgaacatctggctgaagctgagggatagttatacccagatgtgcgaccacaggctgatgtctgcggccattaaggactccaaagccgtacacgccgatatgggctactggatcgagagcgagaagaacgaaacctggaaactggcccgcgcgtccttcatcgaagtaaaaacctgtacgtggcccaagagtcacaccctgtggtctaacggcgtgctcgagagcgaaatgatcatccccaagatctacggcgggccgatttcacagcacaactaccggccgggctacttcacccagaccgccgggccctggcatctcgggaagctggagttggatttcgacctgtgcgagggcacgaccgtggtcgttgacgagcactgcgggaaccgaggcccgagcttgcggaccactacggtgaccgggaaaatcatccatgaatggtgctgccgctcctgcacgttgccgcccctgcggttccgcggcgaggacgggtgctggtacggcatggagatccggcccgtcaaggagaaggaggagaacctggtccgcagcatggttagtgccggctctggggaggtcgactctttctccctcgggatcttatgcgtgagcatcatgatcgaggaggttatgcgctcccgctggagccgcaagatgctgatgaccgggacgctagccgtcttcctgctgctcatcatgggtcagctgacctggaatgacctgatccggctctgcatcatggtgggggccaacgcgtccgatcggatgggcatgggcaccacctacctggccctgatggccacgttcaagatgcggccgatgttcgccgtggggttactgttccgccgattgaccagtcgcgaggtcttgctgctgaccatcgggctctccctggtagctagcgtcgaactgccctcgagcctcgaggagctcggggacggcctagcgatgggcatcatgatgctcaagctgctgacagagttccagccccaccagctctggacgacccttctgagcctcactttcgtcaagaccacgctgagcctggactacgcctggaagaccaccgcaatggtgctctcaatagtcagcctgttcccgctgtgcctctccacaacgagccagaagaccacatggctgcccgtgctgctcgggtctttcggctgtaagccactgaccatgttcctcatcaccgaaaataagatctgggggcgcaagtcatggcccctcaacgaaggaattatggccatagggatcgtttccatactgctgagcagcctgctgaaaaacgacgtccccctggcgggcccgctcattgccggagggatgctgattgcctgctacgtgatcagtggcagctccgccgacctgagcctcgagaaggccgcggaggtctcctgggagcaggaagccgagcacagcggggcctcccacaacattctcgtcgaggtgcaggacgacggcacgatgaagatcaaggacgaggaacgcgacgacactctgacgatcctcctgaaggccaccctgctcgccgttagcggggtataccccatgtccatccccgcgacgttgttcgtgtggtacttttggcagaaaaagaagcagcgcagcggagtgctgtgggacaccccctccccgcccgaggtcgagcgcgccgtcctcgatgacggtatctaccgtatcttacaacgcgggctgttaggccggtctcaggtgggggtcggcgtgttccaagacggggtgttccacaccatgtggcacgtcacccgaggcgcggtactcatgtaccagggcaagcgtttagagccctcctgggcgtcggtaaagaaggacctgatctcgtacggagggggttggcgcttccaaggctcatggaacacgggggaggaggtccaggtgattgccgtggagcccggcaagaacccgaagaacgtccagacgacccccggcacctttaagacgcccgagggggaggtgggcgctatcgccctcgacttcaaacccgggacctccggcagcccgatcgtgaaccgagagggcaagattgtcgggctttacggcaacggggtggtgacgacctccggcacctacgtcagcgcaattgcgcaggccaaggcgagccaagaggggcccctgcccgagatcgaggacgaggtgtttaagaagcgcaacttaaccatcatggacctgcatcccggctccggtaagacccggcgctacttacctgccatcgtgcgggaggccatcaagcgcaaactccgcaccttgatcctcgcgcccacgagggtcgtggcgagcgaaatggccgaggccttgaaggggatgcccatccgctaccagaccacagccgttaaatcagagcacaccggtcgggagattgtcgacctgatgtgtcacgccacgttcacaatgcgcctgctcagcccggtgcgggtgcccaactacaacatgatcataatggacgaggcgcacttcaccgaccccgcctccatcgccgcccgcgggtacatcagcactcgggtcggcatgggggaggccgcggccatttttatgacggccacgccgcccggcagcgtggaggcattcccccagagcaacgccgtcatccaggacgaggagagagacatcccggagcggtcctggaacagcggctacgactggatcaccgacttcccagggaagaccgtctggttcgtcccctccatcaagagcgggaacgacatcgcaaactgcctgcgcaagaacgggaagcgggtgatccagctgtcccgtaagacgttcgacaccgagtaccagaagaccaagaacaacgactgggattacgtcgtgaccacggacatcagcgagatgggcgccaacttccgggccgaccgcgtcatcgacccacggcgctgcctcaagcccgtcatcctgaaggacgggcccgagcgggtgatcctggccggcccgatgcccgtcaccgtggcatccgccgcccagagacggggccgcatcggacgcaaccagaacaaagagggcgaccagtacgtgtacatggggcagccacttaacaacgatgaggaccacgcccactggaccgaggctaagatgttactggacaacatcaatacccccgagggcatcataccagccctctttgagcccgaacgggagaagtccgccgccatcgacggggaataccgcctgcggggcgaggcccgtaaaacgttcgtcgagctgatgcggcgcggcgacctccccgtgtggctgtcctacaaggtggcctccgagggcttccagtattcagaccggcgctggtgcttcgatggcgagcggaacaaccaggtgctggaggagaacatggacgtggagatctggacaaaggagggtgagcggaaaaagctcagaccccgctggctggacgcgcggacctacagcgacccgttggccctgcgcgagttcaaggagttcgctgccggaaggcgcagcgtgtccggggatctgatcctggaaatcgggaaactcccccaacacctgacattacgggcgcagaacgcgctagataacctggtcatgctgcacaattcggagcagggcgggaaagcctatcggcacgccatggaggaactccccgacaccatcgagacgctgatgctgctcgcgctgattgcggtgctgacaggcggggtgaccctctttttcctgtccggaaaaggcctggggaagacctcaatcggcctcctgtgcgtaacagcctccagcgcccttctctggatggcctccgtggaaccccattggatagcagcaagcatcatcttggagttctttctgatggtgctcctgatcccggagccggaccggcagcgcacgccccaggacaaccagctggcatacgtcgtgatcgggctactgttcatgatcttaactgtggccgccaacgagatggggttactggagaccacgaagaaggacctggggatcggctacgtcgccgcggagaaccaccagcacgccaccatgttagatgtggatctccaccctgcctccgcctggaccctgtacgctgttgcgaccacggtcattaccccaatgatgcggcacaccatcgagaacaccacagccaatatctctctcaccgccatcgccaaccaagccgctatactaatgggcctggacaaagggtggcccatttccaagatggacatcggcgtgcccctcttggccctggggtgttacagccaggtgaatcccctcaccctgacggcggcggtcctgatgttagtggcgcactacgccatcatcggccccggactgcaggccaaggccacgcgcgaggcgcagaagcgcacggcggccggcatcatgaagaaccccaccgtggacggcatcgtcgcgattgacctggatcccgtggtgtacgacgccaagttcgagaagcagctcgggcagatcatgctgctcatcctctgcacgagtcagatcctcttaatgcggacgacctgggccctctgcgagtctatcaccctggcgaccggtccgctgacgaccctctgggaggggtccccgggcaaattctggaacactaccattgcggtcagcatggccaacatcttccgcggctcctacctggccggggctggcctggctttctcgttaatgaagtccctcgggggcgggcggcgcggcactggagcccagggggagaccctgggcgagaagtggaagcggcagctcaatcagttgagcaagagcgagtttaacacatacaagaaatccgggatcatggaggtggaccgcagcgaggccaaagagggcctgaagcgcggagagaccacgaagcacgccgtttcccgtggcaccgcgaagctccggtggttcgtcgaaagaaaccttgtgaagcccgagggcaaagtgatcgacttagggtgcggccgcgggggctggagctactactgcgccggactgaagaaggtcactgaggtaaagggctacaccaagggcgggcccggacacgaggagccgatccccatggccacctatgggtggaacttggtgaaactgcactccggcaaggacgtcttcttcatgccgcccgaaaagtgcgacacgctgttatgtgacataggggagtcgtcgccgaaccctaccatcgaggagggccgcaccctacgggtgctgaagatggtggagccgtggctacgggggaaccagttctgtatcaagatcttaaacccctacatgccgagcgttgtcgagaccctagagcagatgcagcgcaagcacgggggcatgctagtgcgcaacccgctgtcccggaacagcacgcacgagatgtactgggtctcctgcgggacgggcaacatcgtgagcgccgtgaacatgacctcccggatgctgctcaaccggttcaccatggcccaccgaaagcccacgtacgagcgtgacgtcgacctgggcgcggggacccggcacgtcgccgtggagcccgaggtcgcaaacctcgacatcatcggccaacgcatcgagaacatcaagaacgagcataagtcaacctggcactacgacgaggacaacccgtataagacctgggcctaccacgggtcctacgaggttaagcccagcggctccgccagtagtatggtcaacggagtggtgcgtctcctgacgaagccctgggacgtcatccccatggtgacccagatcgcgatgaccgacaccacgccgttcggccagcagcgcgtgttcaaggagaaggtggacacccggacgccccgggccaaaaggggcaccactcagatcatggaggtgaccgccaagtggctgtgggggttcctcagccggaacaagaaaccccggatctgcaccagagaggagttcacacgtaaggtgcgcagcaacgctgcaatcggcgctgtcttcgtggacgaaaaccaatggaactccgccaaggaggccgtggaggacgagcggttctgggacctggtccaccgggagcgggagctgcacaagcaagggaagtgtgcgacgtgtgtctacaatatgatgggcaagcgcgaaaagaagctcggcgagttcggtaaagcgaagggcagccgggccatctggtacatgtggctgggggcccgcttcctggagttcgaggcgctcggattcatgaacgaagaccactggttctcccgggagaacagcctgtccggcgtggagggcgagggtcttcataaattaggctacatcctgcgcgacattagcaagatcccgggcgggaatatgtacgccgacgacaccgcgggctgggacacccggatcaccgaagacgacctgcagaatgaggccaagatcacggacatcatggaacccgagcacgctctcctggccacctccatcttcaagctgacatatcagaataaggtcgtgagggtgcagcgccccgccaagaatgggaccgtaatggacgtgattagccgacgcgaccagcggggctccggacaggtggggacgtacggcctcaatacgttcaccaacatggaggtccagcttatccggcagatggaaagcgaggggatcttcttgccgtccgagctcgaaaccccgaacctggcggagcgggccctggattggctagagaagcacggggccgagcgcctgaagcggatggccatcagcggggacgactgtgtggtgaaacccatcgacgatcggttcgccacggccctgaccgcgctcaacgacatgggtaaggtcagaaaggacattccccagtgggagccctccaaaggctggaacgactggcagcaggtaccattctgcagccaccacttccatcagctgattatgaaggacgggcgcgagatcgtggtaccctgccggaaccaggacgagctggtcggccgcgctcgggtgtcccagggggccggttggagcctccgcgagaccgcctgcctggggaagtcctacgcgcagatgtggcagctgatgtatttccatcggcgcgacctccgtctagccgcgaacgccatttgtagcgctgtacccgtggactgggtgcccacctcgcgcaccacgtggtccatccacgcccaccatcagtggatgacaacggaggacatgctgagcgtctggaaccgggtgtggatcgaggaaaacccgtggatggaggacaagacccatgtatccagctgggaggaggtcccctacctcggcaagcgcgaggaccagtggtgcgggagcctgatcgggctgaccgccagggccacctgggccaccaacatccaggttgcgatcaaccaggtgcggaggctcatcggcaacgagaattacctggattacatgaccagcatgaagcggttcaagaacgagtcagacccagagggagctctgtggtaa

SEQ ID NO: 24069 - RNA, 9879 nt, synthetic construct
  misc_feature 1..9879: note = derived and/or modified CDS sequence (opt11) from DENV-1__GU056029__SS-prME
  source 1..9879: mol_type = other RNA
tccgtgacaatgttgttaatgctgctgcccaccgccctcgcctttcacctgacaacccgcggcggggagccccatatgatcgtgtccaaacaggagcgagggaaatccttactgtttaagaccagcgcaggggtgaacatgtgcacccttatcgcgatggacttaggcgagctctgcgaagacaccatgacctacaagtgtccgcgcattacggaggcggagcccgacgatgttgattgctggtgcaatgcaaccgacacctgggtgacctatggtacctgtagccagaccggcgagcataggcgtgaaaagaggtccgtggcccttgcgccccatgttggccttgggttagaaacaagaacggagacctggatgagctccgagggcgcgtggaagcagatacaacgggtcgagacttgggcactccgccaccctggttttacggtgatcgccttcttcctggcccacgccatcggcaccagcataactcaaaagggtattatattcatcctcctgatgctggttaccccctccatggcgatgcggtgcgtcggcatcggcaacagggacttcgtggagggattatccggggccacgtgggtagacgtcgtgttagagcacggctcctgcgtgaccacaatggccaaaaacaagcccaccctggacatagagctcttaaaaacggaggtcaccaaccccgcggtgcttcggaagttatgcatcgaggccaagatcagcaacaccaccacggactcccgctgccccacccagggggaggcaaccctggttgaggagcaggacgcaaactttgtgtgtcggagaaccttcgtggataggggctgggggaacgggtgtggcctgttcggcaaggggagcctactaacgtgcgccaaatttaagtgtgtgaccaagctagagggcaagattgtccagtacgagaacctgaagtactcggtgatcgtgaccgtacatacaggtgatcagcaccaggtagggaatgagacgaccgagcatggaaccatcgcgacgatcacgccccaagcccccacgagcgagatccagttaaccgactacggggcgttaacactagactgcagccctcggaccggcctggatttcaacgagatggtactgctcactatgaaggagaagtcctggttggtccacaagcaatggttcctggacctgccgctgccctggacctctggggccagcactagccaggaaacctggaatcgtcaggacttgctcgtaaccttcaagaccgctcacgcgaagaagcaggaggtcgtggtgttaggctcccaggagggcgctatgcacaccgccctgaccggggccacggagatccagacaagcggcaccaccaccatcttcgcgggacatctcaagtgccgccttaagatggacaagctgaccctcaagggcatgtcctacgtcatgtgcaccgggagctttaagctcgagaaggaggtggcggagacccagcacggcacggtgctggtccaggtaaaatatgagggtaccgatgcgccctgcaaaattccattctccacgcaggatgagaaaggggttactcagaacggccgcctaatcacggccaaccccatcgtcaccgataaggagaagccggtaaacatcgagaccgagccgccctttggcgaaagttacatcgtcgtaggagctggcgaaaaggcgctcaagttgtcctggttcaagcgcggtagctcaatcggcaaaatgttcgaggccacggcgcgcggcgcgcgtcgcatggcaatcctgggcgacacggcgtgggacttcgggagcattggcggggtgttcacatcagtcgggaagctcgtgcaccaggtgtttggcactgcctacggggttctgttctcgggtgtctcctggaccatgaaaatcgggatcggcatactacttacatggctgggcctgaacagtagatccaccagcttgtccatgacctgcatcgccgtggggatggttaccttatacctgggcgtgatggtccaagctgacagcggctgcgtgataaactggaagggtcgagagctgaagtgcgggtccggcattttcgtgacgaatgaggtgcacacctggaccgaacagtataagtttcaggccgacagcccgaagcggctgagcgctgctataggcaaggcctgggaggagggggtatgcggcatccgcagcgccacccggctggagaacatcatgtggaaacagataagcaatgagttgaaccacatactgttagagaacgacatgaaattcaccgtggtggtgggcgacgccaatgggatcttggttcaagggaagaagatgatccgcccacaacccatggagcacaagtactcctggaaatcgtggggcaaggctaagatcatcggcgctgacattcagaacaccaccttcatcattgatgggcccgacaccccggagtgccccgacggccagcgggcgtggaacatttgggaagtggaggactatggcttcggcgtgttcaccacgaacatctggctaaaactccgcgactcatacacgcagatgtgcgaccataggcttatgtcagccgcaatcaaggactccaaggccgtacacgccgacatgggctactggatcgagtcggagaagaacgagacctggaagttggcccgcgcgtccttcatcgaagtcaaaacgtgcacgtggcccaagagccacaccctgtggagtaatggggttctcgagagcgagatgatcatccccaaaatttacggcgggccgatctcccagcacaactatcggcccggctacttcacccagaccgcggggccttggcatctcggcaagttagagctcgacttcgacttgtgcgagggcacgaccgtcgtggtggacgagcactgtgggaaccgcggcccgagcctgcggaccaccacggtcaccgggaagatcatacacgaatggtgctgtcgctcctgcacgctgccgcccctccgtttcagaggcgaggatgggtgctggtacggaatggaaatcaggcccgtgaaagaaaaagaggagaacctggtgcgcagtatggtgagtgccggctctggagaggtggacagtttttccttgggcatcctgtgtgtgagcataatgatcgaagaggttatgcggtcccgctggagccgcaaaatgctgatgaccgggacgctcgccgtgtttctgttgctcatcatgggccaacttacctggaatgacttgattcgtctctgtatcatggtgggggccaacgcttccgaccgcatgggcatggggactacctacctggccctgatggcgacttttaagatgcgaccgatgttcgccgtcgggctccttttccgacggttaaccagccgcgaagtgcttctgcttacaattggattatccctggtagccagcgtggagctgccaaactccctagaggagttaggggacggattggcaatgggcatcatgatgttaaagctcctgaccgagttccagccccaccagctttggacgacgctcctaagtctgacctttgtaaagacagctctctccttagattacgcctggaagaccaccgcgatggttctctcgatagtgtcgctgttccccctttgcctctcaaccaccagtcagaagactacttggttgccggtgctgctcgggagcttcgggtgtaagcccctgaccatgttcctgatcaccgagaacaagatctgggggcgtaagtcctggccgctcaacgagggtataatggccattgggatagttagcatcctgttatccagcctcctaaagaacgacgtgcccctggcggggccactcattgccggcgggatgctgattgcgtgctatgtgatcagcggatccagcgccgatctgtccctcgagaaggccgccgaggtcagctgggagcaggaggcggagcacagtggggcttctcacaacatcctcgtagaggtgcaggacgacggtaccatgaagatcaaggatgaggagcgtgatgacacgctgaccatcttactgaaggccacactgcttgctgtctctggggtgtacccaatgtccatccccgctacgctatttgtgtggtacttttggcagaaaaagaaacaacggtccggggtcctttgggacacgccctcacctcccgaggtcgagcgcgcagtcctcgacaacggcatctaccgcattttgcagcgtgggctgctgggcagatcccaggtcggagtaggggtgttccaggatggggtgttccacaccatgtggcacgtaacccgcggcgccgtgctcatgtaccaaggaaaacggttagagcccagttgggcctccgtcaagaaggacctgattagctacgggggcggttggcgtttccaaggctcctggaacactggggaggaggtccaggtgatcgcagttgagcccggcaagaacccgaaaaacgtgcaaactaccccaggcacgtttaagacccccgagggtgaagtgggcgcaatagccctcgacttcaagcccgggacttccggctccccgatcgtcaaccgggagggcaagatcgtcgggctgtacggcaacggggtagtaaccacctctggcacctacgtgtcggcgatcgcacaggcgaaggccagccaggaaggacccctgcccgagatagaggacgaggtattcaagaaacgcaacttaacgatcatggatctccaccctggttctggcaagacccggcggtacctgccagcaatagtacgggaggccatcaagcgcaaacttaggaccctgatactggcccccacccgggtggtggcgtcagagatggcagaggccttaaaagggatgccaatccgctaccaaacgaccgcggtaaagagcgagcacaccgggcgtgagatcgtggacctgatgtgccacgccaccttcaccatgcggctactcagcccggtacgggtccccaactacaacatgatcatcatggacgaggcgcattttaccgaccccgccagcattgccgcccgcgggtatatctcaacccgggtgggcatgggggaggccgcggccatatttatgaccgccacgccccctggcagcgtggaggccttcccccagagcaacgcggtgatccaggatgaggagcgtgatatacccgagcggagctggaactccggctacgactggatcaccgacttccccgggaagaccgtctggttcgtgcccagcatcaagagcggcaacgacatagcgaactgcctccgcaagaacgggaagagggtcatacagctgagtcgcaagactttcgacaccgagtatcaaaagaccaagaacaacgactgggactacgtcgtaaccaccgacatctccgagatgggcgccaacttccgtgccgaccgcgtgatcgaccctcggcgctgcctcaagccagtgatcctgaaggacgggcccgagcgggtcatcttagctggcccgatgccagtgacggtggcgagcgccgcccagcgccggggccgcatcgggcgcaaccagaacaaggaaggcgaccaatatgtgtatatggggcagcccctcaacaacgacgaggaccatgcgcactggaccgaggcaaagatgctgctggacaacatcaacacacccgaggggatcatccctgcccttttcgaacccgagcgggaaaaatccgccgcgatcgacggggaatacaggctccggggcgaggccaggaagaccttcgtggagcttatgcggagaggcgacttgcctgtctggctgagctacaaagtcgcatccgaagggttccaatacagcgaccgccgctggtgcttcgacggtgagcgaaacaatcaggtcctggaggagaatatggacgtggaaatatggacaaaagaaggggagcggaagaagctcaggccccgctggttagacgcgcggacctactcggacccgcttgcccttcgggagttcaaggagttcgccgccggccggcgcagcgtctccggcgacctgatcctggaaatagggaagctcccccagcacctgaccctgcgcgcacagaatgcgctcgacaatctggtcatgcttcacaatagcgagcagggcgggaaggcttaccgccacgcgatggaggaactccccgacaccatcgagaccctgatgctgttggccttaatcgcggtcctgacgggaggggtgacactcttctttctgagcggaaaaggtttagggaagacgagcatcgggctcctgtgcgtaaccgcctcgtccgccctgctctggatggccagtgtggaaccccactggatcgccgcgtccataatcctggagttcttcctgatggtcctcttaattccggagcccgaccggcaacggacgccacaggacaatcagctggcctacgtagtgatcggtctcctcttcatgatccttaccgtggccgccaatgaaatggggctcctggagacgactaagaaagacctgggtataggatacgtggccgcggagaatcaccagcatgccacgatgctagacgtggacttgcatccagcgagtgcgtggacactgtacgcggtcgcgaccacagttatcacgcccatgatgcggcacaccatcgagaacaccaccgccaacatctccttaacggccatcgccaaccaagcagcgatactgatgggcctagacaaggggtggcccatttcaaaaatggacatcggagttcccctgctagccctggggtgctactcccaggtcaacccgctcaccctgaccgccgccgtgctaatgctcgtcgcccactacgccataatcggccccgggctccaggccaaggccactcgcgaggcacagaagcgcactgcggcaggcatcatgaaaaaccccaccgttgacggcatcgtggcaatagaccttgacccggtcgtatacgacgccaagttcgagaagcagctcggtcagattatgttactgatactctgcaccagccagattctgttgatgagaactacgtgggccctctgcgagagcatcaccctggcgacaggtccgctaaccaccctctgggaggggagccccggcaaattctggaacacaactatcgccgtttccatggcaaacatattccgcggcagctacctggcaggggccggcctggcgttctccctcatgaagtccctcggcggcgggcggcgcggaaccggcgcccaaggggagacgctgggcgagaagtggaagcgtcagctcaaccaactgagtaagagcgagttcaacacctacaagcgctccgggatcatggaagtcgaccggtccgaggcaaaggagggcctgaagcgcggggagacgaccaagcacgccgtgtcacggggcactgcgaagctcaggtggtttgtcgaacggaacctggtgaagcccgaggggaaggtcatcgatttggggtgcggccgcggcggctggagttactactgcgctgggctgaagaaggtaaccgaggttaagggctacaccaagggtgggcccggccacgaagaaccgatccccatggcaacctacgggtggaacctcgtcaagctgcacagtggcaaggacgtcttcttcatgccgcctgagaagtgcgacacgctgctctgtgatataggggagagctcccctaacccgacgattgaggagggccggacccttcgggtgctcaaaatggtcgagccctggctccgaggcaatcaattttgcatcaaaatcctgaacccctacatgccgtccgtggtcgagaccctggagcagatgcagcgcaagcacggagggatgctcgtccggaaccccctgtcgcgcaattccacccacgagatgtattgggtgtcgtgcgggacgggcaacattgtgagcgcagtcaacatgaccagccggatgctgctcaaccgcttcaccatggcccaccgcaagccgacctacgagcgggacgtggatcttggcgcggggacgcgccatgtggccgtcgagcccgaggtggcgaacctggacatcatcggtcagcggatcgaaaacatcaaaaacgagcacaagagcacctggcactacgatgaggacaatccgtacaagacctgggcctatcacggcagctacgaggttaagccttccgggtctgcgtcctctatggtaaacggtgttgtccgcctcctgaccaaaccctgggacgtgatccctatggtgactcagatagcgatgaccgacacgaccccattcggccagcagcgggtcttcaaggagaaggtggacacccgcacgccccgcgccaagcgcggcaccacgcaaatcatggaagtcacggccaagtggctgtgggggtttctatcccggaataagaagccccgcatctgcacacgagaagagttcacccgcaaggttcgcagcaacgcggccataggcgcggtgtttgttgatgagaatcagtggaacagcgccaaggaggccgtcgaggacgaacggttctgggacctggtgcaccgtgagcgcgagttacacaagcagggtaagtgcgcgacttgcgtgtacaacatgatgggcaagcgagagaagaagctcggcgaatttggcaaggcgaagggctcccgcgccatatggtacatgtggctgggtgcccgtttcctagagttcgaagccctcggcttcatgaacgaggaccattggttcagcagagaaaactccctgagcggggtggagggggagggcctgcacaagctagggtacatactgcgcgacatctccaagataccgggtggaaatatgtatgccgacgacacggcgggctgggatacccgcatcacagaggacgatctgcagaatgaggccaagatcactgacatcatggagcccgagcacgccctcttggccactagcatcttcaagctgacttaccaaaacaaggttgtgcgggttcagcgccccgccaaaaacgggaccgtgatggatgtgatctcccgtcgagaccagcgcgggtcgggtcaggtcgggacctacggtcttaatacgtttacgaacatggaggtgcagcttatccggcagatggaatccgaagggattttcctacccagcgagttggagacaccgaacctggctgagcgcgccctggactggctcgaaaaacacggcgcagagcggctgaagcgtatggccatctcgggtgatgattgtgttgtcaagcccattgacgataggtttgctaccgcgcttactgccctcaatgacatgggaaaggtgagaaaggacatccctcaatgggaaccctcaaagggctggaacgactggcagcaagtccctttctgctcccaccacttccatcagctgatcatgaaggacggtcgcgagatcgtcgtgccatgccgcaatcaagacgagctcgtgggccgggcaagagttagccagggggctggctggtccttgcgagagaccgcctgcctcggcaagagctacgcgcagatgtggcagctgatgtactttcaccgccgggacctccgcctagcagctaacgcgatctgcagtgccgtgccggtggattgggtccccaccagccgtaccacgtggtcaatccatgcccaccatcagtggatgacgaccgaggacatgttgtcggtttggaaccgtgtgtggatcgaagagaacccgtggatggaggacaagacccacgtgagttcctgggaggaggtgccctatctcggcaagagagaggaccagtggtgtggcagcctaatagggctaacggcccgggccacgtgggcgaccaacatccaggtagcgatcaaccaggtccgccggctcatcgggaatgagaactacctggactatatgacctctatgaagagattcaagaatgagagcgattccgagggggctctgtggtga

SEQ ID NO: 24070 - RNA, 9879 nt, synthetic construct
  misc_feature 1..9879: note = derived and/or modified CDS sequence (opt11) from DENV-1__GU056030__SS-prME
  source 1..9879: mol_type = other RNA
agcgtaacgatgcttctcatgttgctaccgaccgctttggcattccacttaaccacgcgcggcggcgagccccacatgatcgtatcaaaacaggagcgcggcaagtccctcctcttcaagaccagcgccggggtcaacatgtgtactctgatcgccatggacctgggcgaactctgcgaggacactatgacctataagtgcccccgcatcacagaggccgagcccgacgacgtggactgctggtgcaacgccaccgacacctgggtcacctacggaacctgtagccagaccggcgaacatcggagagagaagcggtcggtggccctggcgccccacgtgggcctgggactcgaaacgcgtaccgagacttggatgagctcagaaggagcctggaagcagatacaacgggtagagacatgggccctgaggcacccggggttcactgtgatcgcgttcttcctggcgcacgccatcggcactagcatcacccaaaaggggatcatattcatcctgctcatgctggtgaccccgagtatggccatgcggtgcgttggcataggcaacagagacttcgtcgaagggctgtccggggccacgtgggtggacgtcgtgctggagcacggttcctgcgtgacaacgatggccaagaataagcccactctggacatcgagctcctgaagactgaggtcacgaacccggcggtcctgcggaagctgtgcatcgaagctaagatcagcaataccactaccgactcccgttgcccgacccaaggcgaagccacattagtggaagagcaggacgccaacttcgtctgccggcgcaccttcgtggaccggggctgggggaacggctgcgggctcttcgggaaagggtcgctactgacttgcgccaagttcaaatgcgtgacaaagctggaagggaagatcgtccaatacgagaacttgaagtactccgtcatcgtcaccgtccacacgggcgaccagcaccaagtggggaatgagacgactgagcacggcaccatcgctaccatcaccccccaggcccccacgagcgagatccaactgacagattacggggccctgacactggactgttccccccgcacgggcctggacttcaatgaaatggtcctgcttacgatgaaggagaaatcctggctggttcacaagcagtggttccttgatctaccgctgccctggacctccggggccagcaccagccaagaaacctggaaccgtcaggacctgctggtgacgttcaagaccgcccacgcgaagaaacaggaggtcgtggtcctgggctcccaggaaggtgccatgcacacagcactgactggggcgacggaaatccagacaagcggtaccacgacgatttttgcggggcatctcaagtgcaggctgaagatggacaaactaaccctcaagggtatgtcgtacgtcatgtgcaccgggagcttcaagctagagaaagaggtggcggagacccagcacggcaccgtgttggtccaagttcggtacgaggggacagacgcgccctgtaagataccattttccacccaagatgagaagggggtgacccagaatggtcgcctgatcacggcgaaccctattgttactgacaaagagaagcccgtgaacatcgaaacagagccgccctttggagagagctacatcgttgtcggggcgggcgaaaaggctctcaagctgtcgtggttcaagcgggggtcaagcatcggtaagatgttcgaagccaccgcgcgcggggctcgccgaatggccatcctgggcgacacggcgtgggacttcggcagcatcggtggcgtgttcacctccgtggggaagctcgtacaccaggtgttcggcaccgcctacggggtgctgttcagcggcgtctcctggaccatgaaaatcgggatcggtatcctgttgacttggctgggccttaacagccgctccaccagcttgtccatgacttgtatagccgttgggatggtgactctgtacctgggcgtcatggtacaggcggacagcgggtgcgtaatcaattggaagggtcgagagctcaagtgcggctccggaattttcgttacgaacgaggtgcacacctggactgaacagtacaagtttcaggccgatagtcctaagcgcctgtccgcagccattggcaaggcctgggaagagggcgtgtgcggcatccggtctgccacccgactggaaaatatcatgtggaagcagatcagcaacgagctcaatcacatactcctggagaacgacatgaagttcacagtagtggtgggggacgccaacggcattctcgcccagggcaagaaaatgatccggccgcagccaatggagcacaagtactcctggaagagttggggcaaggcgaagatcatcggcgccgacatacagaatacgaccttcataatcgacgggccagacacccccgaatgccccgacggccaaagagcctggaacatttgggaggttgaggattacggtttcggcatctttaccacgaatatttggctgaagctgcgggactcctacactcagatgtgtgaccaccgcctcatgtctgcagcaattaaggactcaaaggccgtgcacgccgacatgggctattggattgagtcagagaaaaacgagacctggaaactggcccgtgcgtccttcatcgaggtaaaaacctgcacgtggcccaaatcgcacaccctctggtccaacggggtccttgagagcgagatgatcatccccaagatttacggggggccaatctcccagcacaattatcgccctggctactacacccagaccgccggcccctggcatctggggaagctagagctcgatttcgacctgtgtgagggcactaccgtggtggttgacgaacactgcggtaacaggggcccgagtctgcgcaccaccaccgttaccgggaagatcatacacgagtggtgttgtcggtcctgcaccctgccgcccttgcgattccgtggtgaggacgggtgctggtacggcatggaaattcgccccgtaaaggaaaaggaggagaacctagtccggagcatggtgtccgcgggatcaggcgaggtggataacttttccctaggtatcctgtgtgtctccataatgatcgaggaggtgatgcgcagcaggtggtcgaggaagatgttaatgacaggaacgctcgctgtgttcctgttactcataatgggccagctgacctggaacgacctgatccgcctctgcatcatggtcggcgccaatgcgtctgacggtatgggcatggggacaacctatcttgccctgatggctacgtttaagatgcggcccatgttcgccgtgggcttactgttccgccggctgacgtcccgcgaggtgctcctgctgaccattggcctcagcctggtagcctccgttgagctgcccaactcgctcgaggagctaggtgatggcctggcgatgggaatcatgatgttaaagctgctgaccgaattccagccccaccagctctggacgacgctgttatcccttacgttcgtcaagaccacgctgagcctggactatgcctggaaaaccaccgccatggtgctcagcatcgtgtcactgttccccctgtgcctaagcaccacgagccagaagaccacctggctgccggtcctgttaggcagtttcgggtgcaaaccgctgaccatgttcctgatcaccgagaataaaatctggggaaggaagagctggcctctcaacgaggggatcatggccatcggcattgtgtcgatcctgttgtcatccctcttaaagaatgatgtgcccttggccggccccctcattgctggcggaatgctcatcgcttgctacgtcattagcggcagcagcgccgatctgtccctagacaaggctgcggaagtttcctgggagcaggaggccgagcactccggcgcttcccacaacatatctgtcgaggtgcaggacgacggtacgatgaagatcaaggacgaggagcgcgacgacaccttgaccatcctactcaaagctaccctcctggccgtgtccggcgtgtaccccatgagcattcccgctaccctcttcgtctggtacttttggcagaagaagaagcaacgatcgggcgtgctgtgggacaccccgagcccgcccgaggtggagcgcgccgtgctggacgacggcatctaccgcattctgcaacgcggtctgctggggcggtctcaagtgggtgttggggtgttccaggacggcgtgttccacactatgtggcacgtcacccgcggcgccgtcttgatgtaccaggggaagcggttggaacccagctgggcctgcgttaagaaagaccttatctcctacggcgggggctggcgtttccaggggagttggaacacgggagaggaggtgcaggtcatcgccgtggagccgggtaaaaaccctaagaatgtgcagaccaccccagggaccttcaagacgcccgagggagaggtcggtgcgatcgccttagatttcaagcccggaactagcggcagtcccattgtaaaccgggaggggaagatcgtcggcctctacgggaacggcgtcgtgaccacttcggggacgtatgtcagcgccatcgcccaggcgaaggcgagccaggagggccccctgcccgagatcgaggacgaagtatttaagaagcgtaacctgaccatcatggacctccacccgggcagtggcaaaacccggcgctacctgcccgccatagtgcgtgaggccatcaaacgcaagctgagaaccctcattctggccccgacgcgggtggtcgcaagcgagatggctgaggccctgaagggcatgcccatcaggtatcaaaccacggccgtaaaatccgagcacacagggcgggagattgtagacctcatgtgccacgccacttttaccatgagattgctgtcacccgtccgagtgcccaactacaacatgatcattatggacgaggcgcacttcaccgaccctgcctctatcgcggccagggggtatatatccacccgggtgggaatgggcgaggccgcagctatattcatgaccgctacgcctcccggctccgtcgaggctttcccgcagagcaacgcagttatccaggacgaggagcgcgacatccccgagcggtcgtggaacagcgggtacgactggatcaccgacttcccggggaagaccgtgtggttcgtaccatccattaagagcgggaacgacatagcaaactgtcttcggaaaaatggaaaacgggtgatacagctttcccgcaagacgttcgacactgaatatcagaagaccaagaacaacgactgggactacgtggtcaccacggacattagcgagatgggggcaaacttccgggccgaccgagtgatcgacccacggcgctgcttaaagcccgtaatcctcaaggacggccccgagagagtcatccttgccggccccatgcccgtgaccgttgcgtccgcggcccagaggcgggggcgcatcggtcgcaaccagaacaaggagggagaccagtacgtatatatggggcagcccctgaacaatgacgaagaccacgcccattggaccgaggccaagatgctgctggataacataaacacgcccgaggggataataccggccctgtttgagcccgagcgggagaagtccgccgccatagacggggagtaccgcctccggggcgaggcacgcaagacgtttgtggaacttatgcggcgaggggacctgcccgtgtggctatcctacaaggtggccagcgagggcttccagtactccgaccggcgctggtgtttcgatggtgagaggaacaaccaagtgctggaggagaatatggacgtcgagatctggaccaaagagggcgagcgcaagaagctgaggccccgctggctcgacgcgcgaacctatagcgacccgctggccctgcgcgagtttaaggagttcgccgccggccggagaagtgtgagtggggatctcatcctggaaatcggcaagctgccccaacacctcacactgcgtgcccagaatgcgctggacaacctcgtcatgctgcataacagtgagcagggcgggaaggcctaccgccacgccatggaggagctgcccgacaccatcgagacgctcatgttgctggccctcatcgcggtcctgaccggcggcgtcaccctgttcttcctgagcggcaaagggctgggcaagacgagcataggactgctctgcgtcacggcctcgagcgccctgttgtggatggcaagcgtagaaccccactggatcgccgcgtctatcatcctcgagttcttcctgatggtactgcttatccccgagccagaccggcagcgcactccccaggataatcagctggcctacgtggtcatcggccttctcttcatgatcctgaccgtagcagccaacgagatggggcttctcgagaccacgaagaaggatctgggcatcggctacgttgccgcggaaaaccaccaacacgccaccatgctggacgtagacctacaccccgccagcgcgtggaccctgtacgccgttgcgaccactgtaataacccctatgatgcggcataccatcgagaacacaacggctaacataagcctgaccgccatcgccaaccaagcagcgatcctcatggggctggataagggctggccgatctccaagatggacattggggtcccccttctcgccctgggctgttactctcaggtgaacccactgaccctcaccgccgccgtgctgatgttagtagcgcactacgccatcatcgggcccggtctccaggcaaaggccactcgcgaggcccaaaaacgcaccgccgccggcatcatgaagaaccccactgtggatggaatcgtcgccatcgacctggacccggtcgtgtacgacgttaagttcgaaaagcagctgggccagatcatgctcctgatcctctgtacatcccagatcctgctgatgcggaccacctgggccctgtgcgaatccataaccctcgctaccggtccgctcacgaccttgtgggagggttcccccggcaagttctggaacaccaccatcgctgtgagcatggccaacattttccgcgggtcctacctcgccggcgcagggctggcgttcagcctgatgaagtcgctcggcgggggccggcgcggcaccggcgcgcagggagagacactgggtgaaaagtggaaacggcagctgaatcaactcagtaagtccgagttcaacacttacaagcgcagtggcataatggaggtcgatcgttcggaggccaaggagggtctgaaacgcggcgagacaactaatcacgccgtgtccagaggcaccgctaagctgcgttggttcgtcgagcgcaacctggtgaagcccgaaggcaaggtaatcgatttaggctgtgggcgcggcgggtggagctactactgcgccggactgaagaaagtcaccgaggtaaagggctatactaagggagggcccgggcatgaagagcctatacccatggccacttacggatggaacctggtgaagctacattcggggaaggatgtgttttttatgccgccggaaaagtgcgatactttactctgtgacatcggagagagctccccgaatcccacaatcgaggagggccggactctccgcgtcctgaaaatggttgagccctggctacggggtaaccagttctgcatcaagattctcaatccgtatatgccgagtgtggtggagaccctggaacagatgcagcgcaagcacggcgggatgttagttcggaaccccctctccagaaacagcacgcatgagatgtactgggtgtcctgcgggaccggcaacatcgtcagcgccgtaaacatgacttcccggatgctgctgaaccgcttcaccatggcccaccggaagcccacatacgagcgggacgtcgaccttggcgccggcacgcgccacgtaaccgtcgagcccgaggttgccaacctggatatcatcgggcagcggatcgagaatatcaagaacgagcataagtctacctggcactacgacgaagacaacccgtacaagacatgggcctatcacggcagctatgaggtgaaacccagcgggtccgccagctccatggtgaatggtgtggtacgcctactcaccaagccctgggacgtaatacccatggtgacccagattgcgatgaccgacactacccccttcggacagcaacgcgtgtttaaggagaaggtcgacactcgtacgccccgggccaagcgcgggacgacccagatcatggaggtgaccgcgaagtggctgtggggctttctgtcacggaacaagaagccccgaatctgcacgcgagaggagttcacgcggaaggtccggagcaatgccgcgatcggggcggttttcgttgacgagaaccagtggaacagcgctaaggaagcggtggaggacgaaagattctgggacctcgttcatagggagcgcgaacttcataagcagggtaaatgcgcgacatgcgtatataacatgatggggaaacgcgaaaaaaagctgggcgagttcggcaaagccaagggatcccgagccatatggtatatgtggctcggcgcgaggttcctggaattcgaggccctggggtttatgaacgaggaccactggttctcacgagaaaactccctctccggcgtagagggagaaggtctgcacaagctgggatacatattgcgagacatcagcaagatcccgggcggtaacatgtatgccgatgacaccgccgggtgggacacccgaatcacggaggacgatctgcagaacgaggccaagataacagatataatggagcccgagcatgcgctgctcgccacaagtatcttcaaactgacctaccagaataaggtagtgcgagtgcagagacccgccaaaaacgggacagtgatggacgtgatcagccgccgtgaccaacgcggctccggtcaggtgggcacctacgggctgaacacattcactaacatggaggtccaactaatcagacagatggagagcgaaggcatattcctgccgtcagaactggagacgccgaacctagccgagagagtgctggactggctggagaagcatggggccgaacggctcaagcgcatggccatcagcggcgacgactgcgtggtcaagcccatagacgaccggttcgcaacggcccttaccgctctcaacgacatgggcaaggtgcgcaaagatatccctcagtgggagcccagcaaggggtggaacgactggcagcaggtccctttctgtagccaccacttccaccagctcatcatgaaggacggccgggagatcgtcgtcccgtgtcgcaaccaggacgagctggtggggcgggccagagtctcacagggcgcgggctggtcgctgcgggagaccgcgtgcctcggcaagtcctatgcgcagatgtggcagcttatgtacttccaccgccgggacttgagactcgccgcgaacgcgatttgcagcgcggtgccagtggactgggtacccacttcgagaacgacatggagcatccacgcccaccatcaatggatgaccacggaggacatgctgagtgtatggaatagggtctggatagaggagaatccgtggatggaggacaagacccacgtctcctcgtgggaagaggttccgtacctgggcaagcgtgaggaccagtggtgtgggtcgctcataggcctgaccgccagagctacgtgggccaccaacatccaggtcgccatcaaccaagtgcgccggctcatcgggaacgagaactaccttgactatatgacgtctatgaaaaggttcaaaaatgaatccgacccagagggcgcactgtggtga

SEQ ID NO: 24071 - RNA, 9879 nt, synthetic construct
  misc_feature 1..9879: note = derived and/or modified CDS sequence (opt11) from DENV-1__GU056031__SS-prME
  source 1..9879: mol_type = other RNA
tcggtaactatgctgttaatgctgctaccgacggctctggccttccacctaacaacacgtgggggagaaccacatatgatagttagtaaacaggaaagaggcaaaagcctactattcaaaacatcagcgggagtaaacatgtgcacactgatcgcaatggatttaggggaattgtgcgaagatacaatgacgtacaagtgcccaagaatcacggaagccgaaccggatgacgtcgactgctggtgcaacgccacggacacgtgggttacgtatggtacatgtagccaaacaggagagcatagacgagagaaaagatccgtcgctctcgcgccacacgtcggactgggcttggaaacgcgaacggaaacgtggatgagtagcgaaggggcgtggaaacagatccagagagtagaaacttgggcattgagacatccgggatttacggtgatagccttcttcttggcccacgcaattggaactagcataacccagaaaggcataatcttcattcttctgatgctcgtaacaccctcaatggcgatgcgatgcgtaggaatcggtaaccgggactttgtagagggcctaagtggcgctacctgggtagacgtggtacttgaacacggatcgtgcgtaactaccatggccaagaacaagcccaccctggacatagaactattgaaaacggaagtcacaaaccccgccgtactcagaaaactttgtatagaagccaaaatatctaacacaacgaccgatagcagatgccccacgcagggagaggcgactcttgtcgaggaacaagatgcaaactttgtttgcaggagaacctttgtggaccgcggctggggcaacggatgtggcctttttggaaaaggtagccttttaacgtgcgcgaaatttaaatgtgtcacgaaattggaaggaaaaatagtacagtacgagaatctaaagtactcagtcatagtaacggtacatactggagaccaacatcaagtcggtaacgaaacaacagagcacgggacgatagcaacgataacgccccaagcgccaacaagcgaaattcaactcaccgattacggggcacttacgctggactgcagcccccgcacaggcttggacttcaacgagatggtactcctaactatgaaagagaagagttggcttgtacataagcaatggttcctcgaccttccattgccatggacgagcggagctagcacatcgcaagaaacatggaaccgccaagacctcttagttaccttcaaaacggctcatgccaagaagcaagaagttgtagtgctaggaagccaggaaggcgccatgcacaccgcattaactggcgccacagaaatccagacaagcggcacgaccaccatcttcgccggtcacctaaaatgtaggttgaaaatggacaagctaacattaaaaggaatgagttatgtgatgtgtacgggcagcttcaaactagagaaagaagtagctgagactcagcacggcacagtcttagtgcaagtgaagtatgaaggaaccgatgcgccttgcaagattccgttctcaacacaagacgaaaaaggcgtaacccaaaatgggagattaatcacggccaacccaatagtcactgacaaggagaagcccgtgaacatagagaccgaacctcccttcggggaaagctatatagtggttggcgcaggggaaaaggccttgaaactgtcgtggtttaaaagaggaagcagcataggaaaaatgttcgaggctacggcgaggggcgcccggcgaatggcaatacttggcgatacggcctgggacttcggcagcataggcggagtattcacaagcgtagggaaactggttcaccaagtgttcggcacggcctacggggtcctgtttagcggcgtatcctggaccatgaagatagggataggaatactgctaacatggctgggactgaacagccgctccacgagtctttcaatgacctgcatagcagtgggaatggtaacgctgtatctgggcgtgatggttcaagccgacagcggatgtgtaataaactggaaggggcgtgaactcaagtgtggatctggcatatttgtcacaaacgaagtgcacacctggaccgagcaatacaaatttcaagcagattcaccaaaacggctgtctgcggccataggaaaagcgtgggaagaaggggtctgcgggatacggagcgcaacccgcttagagaacataatgtggaaacaaatctcgaacgagctgaaccacatcctactagaaaacgatatgaagtttacggttgtagtaggcgacgctaatgggatactcgcacaaggcaagaagatgatcagacctcaaccgatggagcacaagtacagttggaaaagttgggggaaagccaagatcatcggcgctgatatacaaaacacaaccttcatcatagacggaccggacacgcccgaatgcccagacgggcaaagagcctggaacatatgggaggtcgaggactacggttttggggtattcacgactaacatatggctcaagctacgggattcgtacacgcagatgtgcgatcaccggctaatgtcagccgccataaaagattcgaaagcggtccacgccgatatggggtattggatagaaagtgagaagaatgagacctggaagctggctagagctagcttcatagaagttaagacttgtacctggcccaagagccacaccctgtggagcaacggggtactcgaatctgaaatgatcatcccgaagatctacgggggcccaatcagccagcataactatcgcccgggttacttcacgcagacggctgggccatggcacctagggaaacttgagctcgacttcaacctctgtgagggaacgaccgtcgtcgtggatgagcactgtggcaatcgcggaccatccttacgaaccaccactgtcacaggaaaaataatacacgagtggtgctgcagatcatgcacgctaccgccactacggtttcgaggtgaagacggatgctggtacggtatggaaataagacccgtcaaggagaaggaagagaacctcgtcagatcgatggtaagcgcaggctcgggagaagtagacagtttcagcctagggattttatgcgtatcgataatgattgaagaggtcatgcgaagtagatggtcgcgaaagatgctgatgaccggaacactagccgtattcctattgctaatcatggggcagctgacatggaacgacctcatcagactctgtataatggtcggagcgaacgccagtgataggatgggcatgggaacaacgtacctagcactgatggcgaccttcaaaatgagaccaatgttcgcggtcggcttgctgtttcgacgacttacctcgcgcgaagtcctgttactgacgatcgggctatccctggtagcatccgtggagctgccgaactcattagaagaattaggcgatggcctggcgatggggataatgatgctaaagctgctaacggagttccaaccacatcagctctggacgacactcctgagcttgacattcgtaaagacaacgttgagcctagactatgcgtggaagaccacggctatggtactatccatcgtttcactattcccactatgcctatcgaccacatcccagaaaacaacatggctgccagtattactgggatcatttgggtgtaaaccgagcacgatgttcctcataaccgagaacaaaatatgggggcggaaaagctggccgctgaacgaagggataatggcgataggcatcgtatctatcctccttagctcccttctcaaaaatgacgtaccgctagccggacctctgatcgccggcgggatgctcatcgcctgctacgtaataagcgggagtagcgcagacctatccctagaaaaagcggccgaggtttcatgggaacaagaggccgagcactccggggcatcgcataacattctcgtggaggtgcaagacgacggaaccatgaaaattaaggacgaagaacgggacgacacattaaccatcctattgaaagccaccctactagccgtcagcggggtctacccgatgtcaatcccagcaacactatttgtatggtacttttggcagaagaagaaacagcgcagtggagtactttgggacacaccttcaccacccgaggtagagcgcgcggttcttgatgacggaatctaccgaatcttacagagaggactcctcggccgaagtcaagtcggcgtgggagtgttccaggacggggtgttccatacaatgtggcacgtaacccgaggagcagtactaatgtaccaaggaaagcgactggagccctcatgggcatccgtgaaaaaggacctcatctcctacggtggcggatggcgattccaaggttcatggaatacaggcgaagaagtccaagtaattgccgtggaaccggggaaaaaccccaaaaacgtacaaacaacacccggcacatttaagacgccagagggcgaggtcggggcaatcgcactagatttcaagccagggacctccgggagtccaatcgtaaacagagaggggaagatagtgggcttgtacggcaacggggtagtgacaacgtccggcacctacgtatccgctatcgcgcaggcgaaggcttcacaggaggggcctcttcccgagatcgaagacgaagtgttcaaaaagaggaacttgacgatcatggacctacacccggggtcaggaaaaacacgacgttacttgccagcgatcgttagagaagcaatcaaacgaaagctcaggaccttaatattggcaccgacgagagtcgtcgcctcggagatggcagaagccctcaaaggaatgccaatcaggtatcaaaccaccgcagtgaaaagcgaacacaccggaagggagatagtcgacctgatgtgccacgcaacatttacaatgcggctattatcaccagtacgagtaccaaactacaacatgatcatcatggacgaggcgcacttcacagaccctgcttccatcgcagcacgcggttacatctcgaccagagtcggtatgggggaggcagcagccatattcatgacagccaccccgccgggcagcgtcgaggcgttcccccaaagcaacgcagtaatacaagatgaagaaagagatataccagaacgaagctggaacagtggatatgactggattacggactttccaggcaaaaccgtctggtttgtcccgtcaattaagtcaggaaacgacattgcgaactgcctgcggaagaatggcaaaagagtgatacagctgagccgcaaaactttcgacaccgaataccagaagaccaaaaataacgactgggactacgtagtgacaacagacatctcggaaatgggcgcaaactttagagcagaccgtgtaatcgatccccgccgatgcttaaagccggtaatactaaaggacgggcctgagcgggtaatcctagcagggccgatgccagtaaccgtcgcaagcgcggcgcagcgaagggggagaataggacgaaaccagaacaaagaaggtgaccagtacgtatacatggggcaaccgctaaacaacgacgaagatcacgcacactggaccgaagcaaagatgcttttggacaatataaacacacccgaaggcataatacccgctctattcgaaccagaacgagagaagtcggccgcaatagacggtgaataccgattaagaggagaggctcgcaagaccttcgtagaactgatgagaaggggagatctgccagtctggttgtcctacaaagtagctagcgagggattccagtactctgaccgtagatggtgtttcgacggagagcgcaacaaccaagtgctagaagaaaacatggacgtagagatctggacgaaagaaggggaaaggaagaaactcaggccgcgctggctcgacgcccggacgtactcggaccccttagcgctgagggagttcaaagagttcgccgccggcaggcgctcggtcagcggtgacctaatattggaaatagggaaactgcctcaacacctcacgctacgggcccagaacgctctggataatctcgtcatgctccacaatagtgagcaaggaggaaaggcgtaccgtcacgccatggaagaactaccggatactatagagacactaatgctgctagctctcatcgccgtcctgacgggaggggtgaccctattcttcctgagtggaaagggtctcggtaagacaagcatagggctgctatgcgtaaccgcaagttcagccttactgtggatggccagcgtggaaccccactggatagcggctagcataatcttggagtttttcctaatggtgttactaatcccggagcccgaccgtcagcgcacgcctcaagacaaccagctcgcctatgtagtcatcggactactattcatgatcctaactgtagccgccaatgagatgggactcttagaaacgaccaagaaagacttaggcatagggtacgtggccgcagagaaccaccaacacgccaccatgctggacgtggaccttcaccctgcgtcagcttggacgttatacgctgtagcaacgacggttatcacgccgatgatgcgccacaccatcgaaaacacaaccgcgaatatcagccttacagccatagccaaccaagcagccattctaatgggactagacaagggatggccgatcagcaagatggacatcggggtacccctattagccttaggatgttacagccaggtgaacccactgactcttaccgctgcggttctgatgctcgtagctcactacgccattataggcccgggactacaagcgaaggcgacccgcgaggctcaaaaacgcactgctgcaggaatcatgaaaaatccgaccgtagacggtatcgtagccatagatctagatcccgtggtctatgacgccaagttcgagaagcaactaggacaaataatgctgttaatactttgcacatcgcaaatcctcttaatgaggacgacatgggccctatgcgagtcgataacactagcgacgggaccacttacgacactatgggaagggtcgccgggcaagttctggaacaccacgatcgccgtttcaatggcaaatatcttccgcggctcctatctggcgggagctggtctcgcattcagcctgatgaaaagtctaggaggaggaagaaggggtactggcgcgcagggagaaacactaggggaaaaatggaaaagacagctgaaccagctaagcaagagcgagttcaacacctataaacgcagcggtataatggaggtagacaggtcagaagcaaaagaagggctgaaacgcggagaaaccaccaaacacgccgtttcgcgagggacagcgaaactgcgctggtttgttgagcggaacctcgtaaagcctgaaggaaaggtcatcgacctggggtgtggacggggagggtggagttactactgtgcaggcctaaagaaagtaacagaggtaaaaggatataccaaaggaggtccaggtcacgaggagccaatacctatggcgacatacggatggaacctcgtgaagctccattcaggaaaggatgtgttctttatgccgccggaaaaatgcgacacgcttctttgcgacataggagaatcgagccctaacccaactatagaagaaggaagaacactacgcgttttaaagatggtagagccgtggctacggggtaatcaattttgtataaagatactaaatccctacatgccatccgtcgtggaaacgctagaacaaatgcagcggaagcacggcgggatgctagtccgaaaccccttatcacgtaactctacgcacgagatgtactgggtctcttgtggcaccggcaacatcgtatcggcagtcaatatgacgagtcggatgcttctcaaccgctttaccatggcgcaccggaaacccacctacgagcgagatgtagacttgggagccgggacgagacacgtcgcagtagaaccagaagtggcgaaccttgatataatcggacaacggatagagaacatcaagaacgaacacaaaagcacctggcactacgatgaagataacccatacaaaacttgggcctaccacgggtcctacgaagtcaagccgtccggatccgcaagtagcatggtgaatggagtagtacgacttctcaccaagccctgggatgtgataccaatggtgacacagatcgccatgaccgacaccactccgttcgggcaacaaagagtgtttaaggagaaggttgacacccgaacaccccgtgccaaacggggtaccacccagatcatggaggtaacggcaaagtggttatggggctttctttcccgaaacaaaaagccgaggatctgcacccgcgaggagttcaccagaaaagtgcgctcgaacgccgcaataggcgccgtattcgtggacgaaaaccaatggaactccgccaaagaagcggtagaggacgagagattctgggacctagtccacagagaacgagagcttcacaaacaagggaaatgcgcaacatgcgtctacaacatgatgggaaagagggagaagaaactcggtgagtttggaaaagcaaaaggaagccgagctatatggtacatgtggcttggcgcgcgattcttggagttcgaagcactcggattcatgaacgaggaccactggttctctagagagaactcactttcaggagtcgaaggcgaaggactgcataagttggggtacatcctgagagatatctctaaaatcccaggagggaacatgtatgctgatgatactgccggctgggacaccaggatcacggaagacgacttacaaaacgaggccaaaatcaccgatataatggaaccagaacatgccttacttgcgacgtcaattttcaagttgacgtaccaaaacaaagtcgtaagggtccagaggccagcgaaaaacgggaccgttatggacgtaatcagtaggagggaccaaagggggtcgggacaggtcggaacctacggcctcaacaccttcaccaacatggaagtacaactgatccgacagatggaaagtgagggcatctttctgccctcagagctagaaacgcccaacttggcagagcgagccctcgactggctggaaaaacacggagcggaacgtctaaaaagaatggctatcagtggcgacgactgcgtcgtcaagcccatagacgacagattcgcgacggcactaaccgcactaaatgacatggggaaagtgcggaaagacatcccccagtgggaacctagcaagggctggaacgattggcagcaggtacccttctgctcacaccatttccaccagttgatcatgaaagacggacgagaaatcgtggtaccatgccgaaaccaagacgagctcgtcgggcgggccagggtgtcccaaggtgccggatggagcctacgagaaaccgcctgcctaggtaagtcgtatgcccagatgtggcaacttatgtacttccaccgccgagatctccggctcgcagccaatgcaatctgcagtgcagtgccggtggactgggtcccaacaagccgaaccacatggagcatacacgcccaccaccaatggatgactacagaagacatgctgtcggtatggaatcgtgtgtggatagaagagaatccgtggatggaagataagacgcatgtttcatcatgggaagaagtcccatatctaggaaaacgggaagatcaatggtgtggcagtctaatcggcctcacagcacgggcaacatgggcaaccaacatacaagtagccatcaaccaggtacggcggctcatcggaaacgagaactacagcgactacatgacgtcgatgaaacgatttaaaaacgagagtgacccggaaggggcactatggtaa

SEQ ID NO: 24072 - RNA, 9879 nt, synthetic construct
  misc_feature 1..9879: note = derived and/or modified CDS sequence (opt11) from DENV-1__GU056032__SS-prME
  source 1..9879: mol_type = other RNA
tcggtggccatgcttctcatgctgctgcccaccgccttagccttccacctgaccacccgtggtggggagccccacatgatcgttagcaagcaggagcgggggaagagtctactgttcaaaaccagcgccggagttaacatgtgcaccctgatcgccatggatctcggcgagctctgcgaggacactatgacctataaatgcccgcgcatcaccgaggctgagccggacgatgtagactgctggtgcaacgctaccgatacctgggtgacctacggcacctgcagccagaccggcgagcaccgtcgcgataagcgatccgtggcgttggcgccccacgtgggcctagggctcgagacacgcaccgaaacctggatgtctagtgagggggcctggaagcagatccagagggtcgagacctgggccctgcgacaccccgggttcaccgtgatcgcactgttcctcgcccacgccatcggcacgagcataacccagaagggtataattttcattttactaatgctcgttaccccctccatggccatgcggtgcgtcggcatcgggaaccgcgacttcgtggagggactgtcgggcgccacttgggtggacgttgtgctggaacacgggtcctgcgtgacgacgatggcgaagaacaagcctaccttagacatcgagttgctgaagaccgaggtcacgaaccccgcagtactccggaagctttgtatagaggcgaagatcagcaataccactaccgacagtcgatgcccaacgcagggcgaggctaccctggtggaggagcaggacgcaaacttcgtatgccgcagaacctttgtagatcggggctggggtaatggctgcggcctcttcggaaagggaagcctgctgacctgcgcgaagttcaagtgcgtgacgaagctcgagggcaagatcgtccagtacgagaacttgaagtattcagtgatcgtgacggtccacacaggcgaccaacaccaggtggggaacgagaccacggagcacggcaccatcgccacgatcactccccaggcccccacctcagagatccagcttacggattatggggccttaaccctggactgcagcccccggactggcctcgacttcaacgagatggtcctcctgacaatgaaggaaaagtcctggctggtgcacaagcagtggttcctcgatctgccgttgccatggacgagtggggcaagcacaagccaggagacctggaaccggcaagacttgctggtgaccttcaagacggcgcacgccaagaaacaagaggtcgtggttctcgggtcccaggagggggccatgcataccgcccttaccggggccaccgaaatccaaacgagcggcaccaccacgatcttcgcggggcaccttaagtgccgcctcaaaatggacaaattaacgctgaagggcacatcctacgttatgtgcacggggagcttcaagctggagaaggaggtggccgagactcagcacgggactgtactcgttcaggttaagtacgagggcacggatgccccctgcaaaatccccttctccacgcaggatgagaagggtgtgacccagaacgggcggttgattacggccaatccaattgtcaccgacaaggagaaacccgtcaacatcgagaccgaaccccccttcggggagagctacatcgtggtcggcgccggcgagaaggcactgaagctgtcctggttcaagaagggctcctcgatcggcaaaatgttcgaagccacggccagaggcgccaggcgcatggcgatccttggagacacggcgtgggacttcgggagcataggcggcgtgttcacctcggtggggaagctggtacaccaagtgttcggcaccgcctacggtgttctgtttagcggggtctcgtggacaatgaagattgggatcggcatcttgctcacgtggctgggcctcaacagtcgctccactagcctgtccatgacctgcatcgccgtggggatggtgactctctatctcggcgttatggtgcaagcagacagcggctgcgttatcaactggaaaggccgagaattgaagtgcgggtccggcatctttgtgacgaacgaggtgcacacctggaccgagcagtacaagttccaggccgacagccccaagcgcctgagcgcagccatcggcaaagcctgggaggagggtgtgtgcggcatacggtccgccactcgcctcgagaacatcatgtggaagcagatcagcaacgagctgaaccacattctactcgaaaacgacatgaagttcaccgttgtggtgggggacgccaacggaatccttgctcaagggaagaaaatgatccggccacagcccatggagcacaagtactcctggaaatcctggggcaaagctaagatcatcggcgccgacatccaaaacacgaccttcatcatcgacgggcctgacaccccggagtgccccgacgaccagcgcgcgtggaatatctgggaagtcgaggactacgggttcgggattttcaccacgaatatctggctgaagctgcgggactcctacacacagatgtgcgaccacagactgatgagcgctgccataaaggactccaaggccgtgcacgccgacatggggtactggatcgagagtgagaagaacgagacctggaagctggctcgggcctccttcatcgaggtgaagacatgtacgtggcccaagagccataccttgtggagtaatggggtcttggagagcgagatgataatccccaagatctacgggggcccaatctcccagcacaactaccgccctggttacttcacccagaccgccggcccctggcacctggggaagctcgaactggacttcgacttatgcgaggggacgacagtggtggtcgacgaacattgtggcaatcgggggccgagcctccgcaccaccacggtgaccggcaaaattatccacgaatggtgctgccggtcctgcaccctgccaccccttcgattccgcggggaggacgggtgctggtacgggatggagatccgccccgtgaaagagaaggaggagaatctcgtccggtcaatggtgtccgcgggcagcggcgaagtggactctttttccctgggaatcctgtgtgtttccatcatgatcgaggaggtgatgcgctcacggtggagccgcaagatgctcatgacaggcacgttagcggtgttcctgctcctgatcatgggtcagctgacctggaacgatttaatccgcctctgcatcatggtcggcgctaacgccagtgatcgtatgggcatgggcacaacatacctggccctaatggccactttcaaaatgcggcccatgttcgctgttgggctgctgtttcggcgcctcaccagtcgtgaggtgctcctcctcacaatagggctatccttggtggcaagtgtggagctccccaactccctggaggagctgggcgatggtctggccatgggcatcatgatgctgaagctgctcacggagttccagccccatcagctgtggacgaccttgctcagcctgaccttcataaaaaccacgctgtccctcgactacgcctggaagaccactgccatggtcctgagcatcgtgtcactgtttcccctctgcctgagcacgacgtcccaaaagacgacgtggctgccggtgctcctggggtcgttcgggtgcaagcccctcaccatgttcttgattaccgagaacaaaatatggggccgtaagagctggcctctgaacgaggggatcatggcggtcggcatcgtgagcatgctgctctcctccctactgaagaatgacgtgcctctcgccgggccgctgatcgccggcggcatgctgatcgcctgctacgtcatcagcggatccagtgccgatctcagcctggagaaggcagcagaggtgagctgggagcaggaggcagagcactccggcactagccacaacatcctggtggaggtccaggacgacgggaccatgaagattaaagacgaggagcgggacgacactctaaccatactgctaaaggccacgctcctggccgtctccggtgtgtaccccatgagcattcccgcaaccctcttcgtatggtacttctggcagaagaagaagcagcgtagcggggtgctctgggacactcccagcccgcctgaggtggagcgggccgtccttgatgatggaatctaccggatactgcagcgggggttgctcggtcgctcccaggtgggggtgggggtcttccaggatggagtgttccacaccatgtggcatgtgacgcgcggcgccgtcctaatgtaccagggcaagagactagagcccagctgggcctccgtgaagaaggacctcatcagttacggcggcggctggcggttccaggggtcgtggaacacgggcgaggaggtgcaggtcatcgccgtggagcccgggaagaatccgaagaacgtgcaaaccacccctggcacgttcaagactccggagggtgaggtcggggcgatagccctggacttcaagcccggcacgtccgggagcccgatagtgaaccgcgagggcaaaatcgttggcctgtatggcaatggcgttgtgaccacgtcggggacctatgtgtccgccatcgcccaggccaaggcatcacaggagggaccattgcccgagatcgaggacgaggtctttaagaagcggaacctgacaattatggacctgcacccagggagtggcaagactcgccggtacctccctgccatcgtgcgcgaggccatcaagcggaagctgagaacgctcatcctcgcccccacccgagtagtagcatccgagatggccgaagctctgaagggcatgcccatccggtaccagacgaccgcggtcaagagcgagcacacggggcgcgagatcgtggacttgatgtgccacgccactttcaccatgcggctgctctcgccggtccgcgtgcccaattataacatgatcatcatggacgaggcgcatttcaccgaccccgccagcatagccgcccggggctacatatccacgcgcgtggggatgggcgaagccgcggcaatcttcatgaccgctacgccgcccgggagcgtcgaagcattcccccaatccaacgccgtgattcaggacgaggagcgggacatccctgagcgctcgtggaactccggctatgactggatcaccgacttccccgggaaaacggtatggtttgtacccagcataaaatccggaaacgacatcgcgaactgcctgcgcaagaacggaaagcgcgtgatacagctctctagaaagaccttcgacaccgaataccagaagaccaagaacaatgactgggactacgttgtaacgacggacatctccgaaatgggggccaactttcgcgccgatcgggtgatcgatccccggcgatgcctgaagcccgtgatcctgaaggatggccccgagcgcgtcatactcgcgggaccgatgcccgtgaccgtcgctagcgccgcccagcggcgcggccggatcggccgcaatcagaacaaggagggggatcagtacgtgtacatgggccagcccctgaacaacgacgaggaccacgcacactggaccgaggccaaaatgctgttggacaacatcaacacgcccgaggggattatcccggcgctgttcgagcccgagcgagagaagtccgccgccatcgatggtgagtacagactgcgcggggaagcccggaagaccttcgtggaacttatgcgtaggggcgatctgcccgtctggctgagctacaaggtggcctccgagggcttccagtactctgaccgccggtggtgcttcgacggggagcgcaataaccaggtgctagaggagaacatggacgtcgagatctggaccaaggaaggcgaacggaaaaaactgcgcccgcggtggctggacgcgcgcacctactccgacccgctcgccctacgcgagttcaaggagttcgccgccggtcgccggtctgtcagtggagatctgatactcgagatcggcaagctgccccagcaccttaccctccgcgcccagaatgcgctggacaacctggtgatgctccacaacagtgaacagggcgggaaggcctaccgacacgccatggaggaattgcccgacacgatagagaccctgatgctcctggccttaatcgcggtcctcaccgggggcgtgaccttgttcttcctgagcggcaaaggtctcgggaagacgagtatcgggttgctgtgcgtgactgccagctccgccctattatggatggcaagcgtggagccccactggatcgccgcgagtatcatcctggagttcttccttatggtgttactaatacctgagcccgatagacagcggacaccccaagacaaccagttagcgtacgtagtcatcggcttgctattcatgatcctcaccgtggcagcaaacgagatgggactgcttgagacgactaaaaaagacctgggcatagggcacgtggccgcggaaaaccatcagcacgcaaccatgctggacgtcgacttaaggccggccagcgcctggaccctctacgcggttgcgacgaccgtaatcacgcccatgatgcggcacaccatcgagaacacgaccgctaatatctccttaacggccatcgcgaatcaagccgcgatcctgatgggcctggacaaaggctggcccatcagcaagatggacatcggtgtccccctgctggccttaggctgctactcgcaggtgaacccgctgaccctgacggcagccgtgttgatgctggtcgcgcactacgctattatcggacccggcctccaggccaaggccaccagggaagcccagaagagaaccgcggctgggattatgaaaaatcccaccgtggacggcatcgtcgccatcgacctcgatcccgttgtgtatgacgccaaattcgagaagcaactggggcagatcatgctgctcatcctgtgcacgtcccagatactgctcatgcgtaccacgtgggccctctgcgagtccatcactctggcgacggggcccctcaccaccttgtgggagggaagccccgggaagttctggaacactacgatcgctgtatccatggccaacatattcaggggctcttacctggccggcgcggggctcgcgttctccctgatgaagtccttgggcgggggcagacgcgggaccggtgcccaaggcgagaccctcggggagaagtggaaacggcagctgaaccagctcagcaagagcgagttcaatacttacaagcgctccggcatcatggaggtggataggtctgaggccaaagagggtctcaagcgcggcgagacaacgaagcacgccgtgagccgggggaccgcgaagcttcgctggttcgtggagcggaacctggtcaaaccggagggtaaggtaatcgacctgggctgcgggagaggcgggtggtcctactactgcgccggactcaagaaggtgaccgaggtcaaggggtacaccaagggcggcccagggcatgaagagccgatccccatggcaacgtacggatggaacctggtgaaactgcatagtggaaaagacgtgttcttcatgccgcccgaaaagtgcgataccctcctgtgcgacatcggcgagtccagcccgaaccccaccatcgaggaggggcggacccttcgcgtcctcaagatggtggagccttggttgcggggaaaccagttctgcataaagatcctgaacccgtacatgccgtccgtggtcgagacgctagagcagatgcagcgcaagcacggagggatgttggtccggaaccccttgagccgcaactccacacacgaaatgtactgggtcagctgcggtaccgggaacatcgtctccgctgtaaatatgacctctcggatgctgctgaaccgcttcacgatggcccaccgcaaacccacctacgagcgggacgtggatctgggagcaggcacgaggcacgtcgccgtggagcccgaggtcgccaacctcgacatcattgggcaacgaatcgagaacatcaagaacgagcacaagtccacctggcactacgacgaggacaacccgtacaagacttgggcctatcatggcagttacgaggtcaagccttccggcagcgcctcatctatggtgaacggcgtcgttcgcttattgaccaagccctgggacgtcatcccaatggtcactcaaatcgccatgacggacacgaccccgttcgggcagcagcgggtcttcaaggagaaggtagacacccgcactccccgggccaaacgcggcaccacccagatcatggaggtcaccgccaagtggctctggggcttcttatcccggaacaagaagccccgcatctgcacccgggaggagttcactcgtaaggtgcggtcgaacgccgccataggggctgtattcgtggacgagaaccagtggaacagcgccaaggaggccgtggaggacgagcgcttctgggacctggtgcacagagagcgagagctgcacaagcagggcaagtgcgctacgtgtgtctacaacatgatgggaaagcgggaaaaaaagctgggcgaatttgggaaggcgaaagggtcccgcgccatctggtacatgtggctaggcgctcgtttcctcgaattcgaggcactggggttcatgaacgaggaccattggttcagccgcgagaactccctgagcggcgtggagggggaggggctccataagctgggttacatcctgcgggacatctccaagatcccgggcggcaatatgtacgccgacgacaccgccgggtgggacaccagaatcacggaagacgacctccagaatgaagccaagataaccgacatcatggagcccgagcacgccctgcttgccaccagcatttttaagttaacctatcagaacaaggtggtccgcgtgcagcggcccgccaagaatggaacggtgatggacgtgatctcccggcgggaccagcgcggaagcggccaggtgggaacctatgggctcaacacgtttaccaacatggaggtgcagctaatccggcagatggagagcgagggcatctttctccccagcgagctggagaccccgaacctggcggagcgcgtcctcgactggctggagaagcacggggccgagaggctgaagcgcatggctatctccggcgacgattgcgtggtgaagcccatcgacgatcggttcgccaccgccctaaccgcacttaatgacatgggaaagatccgtaaagatatccctcagtgggagccctccaagggctggaacgactggcagcaggttccgttctgctcccaccacttccaccaactgatcatgaaagatggccgggaaatagtggtgccctgccgcaaccaggatgaactcgtcgggcgggcgcgcgtgagccagggcgccgggtggagcttgcgggagaccgcctgtctgggtaaaagctacgcccagatgtggcaactcatgtacttccaccgtcgggacctgcgcctggcggctaatgccatttgctccgccgttcccgtcgattgggtgcccaccagccggacgacatggagcatccacgcgcaccatcagtggatgaccaccgaggatatgctatccgtgtggaaccgagtctggatagaggagaacccgtggatggaggacaagacgcacgtgagctcctgggaggaagtgccctacttgggtaagcgcgaggaccagtggtgcggaagcttaatcggcctcactgcccgtgccacctgggcaactaacatccaggttgccatcaaccaggtgcgccggctgattgggaatgagaactacctggactatatgacgagtatgaagagattcaagaacgagtcagatactgaaggtgcgctatggtga

SEQ ID NO: 24073 - RNA, 9879 nt, synthetic construct
  misc_feature 1..9879: note = derived and/or modified CDS sequence (opt11) from DENV-1__GU056033__SS-prME
  source 1..9879: mol_type = other RNA
tcggtgaccatgctcctaatgctcttacccaccgccttggcgtttcacctgacgacgcgaggcggggagccccacatgatcgtgtcaaaacaggagcgaggcaagagcttgctgttcaagaccagtgtaggggtgaatatgtgcacattgatcgccatggatttaggggagttatgcgaagacacgatgacatacaagtgcccccgcatcaccgaggccgaacccgacgatgtggactgttggtgtaacgccaccgacacctgggtgacatacgggacgtgttcacagaccggcgagcatagacgggacaaacgatccgtagccctggcgccccacgtagggcttgggctagaaacgcgcactgagacctggatgagcagtgagggcgcgtggaagcaaatccagagggtcgaaacctgggcccttagacaccccgggttcacggtgatcgcactgttccttgcacatgctatcgggacgtctatcacccagaaggggataatcttcatcctattgatgctcgtcaccccctccatggcgatgcggtgtgttggcattggtaatcgagacttcgtggaggggttatcgggcgccacgtgggtcgacgtggtgcttgagcacgggagctgcgtgactacgatggccaagaacaagccgaccctcgacatcgagctgctaaagaccgaggttaccaaccccgccgtcctccggaagctatgcatagaagctaagatcagcaacaccactacagattcccgctgccctactcagggcgaagcgaccctagtcgaggagcaggacgccaactttgtttgcaggcgcacctttgtcgaccgcggatgggggaacggctgcggccttttcggcaagggatcactacttacctgcgccaaatttaagtgcgtaactaaactagagggtaagatcgttcagtacgagaacctgaaatactcagtcatagtcactgttcacaccggagatcagcaccaagtgggtaatgagacaaccgagcacggcaccatcgccactattacgccccaggcgccaacgtcggagatacagcttaccgattacggcgctctcaccctagactgcagccccaggactggccttgacttcaacgagatggtgctgctgacgatgaaggagaaaagctggttagtgcataaacagtggttcctcgacttaccgctgccctggacctccggagccagcaccagtcaggagacctggaaccggcaagacctgctggtcacgttcaagaccgcgcacgcgaaaaagcaggaggtagtcgtactgggctcccaagaaggcgcgatgcatacagccttgactggggctactgagatacaaacttcgggaacaacgacgattttcgccgggcaccttaaatgcaggttgaagatggacaagctgaccctgaagggcatgagttacgtgatgtgcaccggatcattcaagctagaaaaggaagttgcagagacccagcacggcactgttcttgtccaggtaaagtatgagggcaccgacgcgccctgcaagatccctttctccacccaggatgagaaaggggtcacccaaaacggccgtttgataacggctaaccctattgttacagacaaagaaaagccggtcaatatcgagaccgagccgccgttcggggaatcctacatcgtggtcggggccggagagaaagccctgaagctgtcctggtttaagaaggggagctccatcggaaaaatgttcgaggcgaccgcccgcggggctcgaaggatggccatcctaggcgatacagcctgggactttgggtctattggcggggtcttcacatccgtagggaagctagtgcaccaggttttcggtacggcgtacggagtgctattcagcggtgtgtcgtggaccatgaaaatcggaatcggcatcctcttaacgtggctagggctcaactcgaggtcgaccagcctgtccatgacctgtatagccgttgggatggtcacattgtatctcggggttatggtgcaggccgacagcgggtgcgtaatcaactggaagggccgggagctgaagtgcgggtccggaatatttgtcacgaatgaggttcacacctggaccgagcaatacaagtttcaagccgacagcccgaaaagactcagcgcagcgatcggaaaggcatgggaggaaggagtttgcggcatacggtctgctaccaggttagaaaacattatgtggaagcaaatctctaatgagctgaaccacatcttgctagagaacgatatgaaattcactgtggttgtcggggacgtcaacggcatcctggctcaggggaagaaaatgatccgcccccagcccatggaacacaagtattcttggaaatcctggggcaaggccaagatcataggggctgacatacaaaatacgaccttcatcatagacggacccgacaccccagaatgtcctgatgatcagcgcgcctggaatatctgggaagtggaagactacggctttgggatcttcacgactaatatatggcttaaactcagagactcatacacccagatgtgtgatcaccgcctcatgtctgcagccattaaggattcaaaggcggtccacgcagatatgggttattggatcgaatcagagaaaaacgagacatggaaactggccaaggcctcttttatcgaggtgaagacatgtatttggcccaagagccatacactctggagtaacggggtgttagagagcgagatgattatccccaagatttatggtggtccgatctcccagcataactacaggcccgggtacttcacccagactgccggaccctggcatctcggaaaactcgagttagactttgacctttgcgaaggtacaactgtcgtagttgatgagcattgcggcaaccgcgggccgtctctgcgaacaacgaccgtcacgggcaaaatcatccacgagtggtgttgcaggtcctgcacgttaccgccactgcggttccgcggggaggacggatgctggtacggcatggagatccggcccgtgaaggagaaggaggagaacctcgtcaggtcaatggtaagcgcgggcagcggcgaggtcgactccttttctctgggaatcctgtgcgtgagcatcatgatcgaggaggtcatgcggtcccggtggagccgtaagatgctcatgaccggcaccctcgctgtattcttactgctgatcatgggccaactgacgtggaatgacttaatccgtctgtgcatcatggtcggcgcgaatgcctccgaccgaatgggcatggggaccacctatttggctctaatggcaaccttcaaaatgcggccgatgtttgccgtcgggctgcttttccgtagactcacgagtcgcgaagtgttactgcttactatcggcctatccttagtcgcgagtgtggagctgcccaattcccttgaggaactcggagacggcttagcgatgggcataatgatgcttaagttgttaactgagttccagccacaccagttgtggacgacgctactcagcctgaccttcatcaagaccacgctttcccttgactacgcctggaagactacggcgatggcattaagcatcgtgtccttatttcccctctgcctgtcgaccacttcgcagaagacaacttggctgccggtgctcctcggctcgttcgggtgtaagcccctgaccatgtttttgataaccgagaacaagatctgggggcgaaaaagctggcctctgaacgaggggataatggccatcggaatagtgagcatcttactctccagcctgctgaaaaatgacgtgcccctggctggtcccctaatcgccggtggcatgctgatcgcgtgctatgtcatcagtggatccagcgccgacctcagtttagagaaggccgccgaagtaagctgggaacaagaggcggagcacagcggcacgtcgcataacattctggtggaggtccaagacgacggcacaatgaagatcaaagacgaagaacgcgatgatacgctcaccatcctgctgaaggccaccctcttagcagtatccggcgtgtatcccatgagtatccccgcgacgctattcgtctggtatttctggcagaagaagaaacagagatccggggtgctgtgggacaccccgtcacctccagaagttgaacgtgccgtcctggatgatggtatctaccggatttcccagcggggcctgctggggcggtcgcaggtaggcgtaggggtgttccaggatggcgtcttccacacaatgtggcacgtgacacgcggcgcggtcctaatgtatcagggcaaacggttagagccctcctgggccagcgtcaaaaaggatttaattagctacggagggggttggcgcttccaggggtcctggaacacgggcgaggaagtgcaggtcatcgccgtggaaccaggaaagaacccgaagaatgtgcagacgaccccaggcacctttaagacgcccgagggcgaagtcggtgccatcgccctcgacttcaagccaggcacctccgggagccccattgtcaatcgggagggtaagatcgtaggcctgtacggaaacggggttgtcaccacctcgggcacgtacgtgtctgcaatcgcccaggccaaggcttcacaagaaggccccctgcccgagatcgaagacgaggtcttcaagaagcgcaacctcaccataatggacctacacccggggtccggcaagacccgccggtacctgccagccatcgttagggaggcgatcaaacgaaagctcagaacccttatccttgcccccacgcgtgttgtcgccagcgagatggccgaggcgttgaaaggcatgcctatccgctaccaaacgaccgcggtgaaaagtgaacacaccggtagagagatcgtggatctgatgtgccatgcaacgttcacgatgaggctcctcagcccggtccgggtgcccaattacaacatgatcattatggacgaagcccacttcactgacccggcctcgatcgccgcccgaggctacatcagcacccgggtgggtatgggagaagcagcagccatctttatgaccgctacgcctcccgggtccgtggaggcattcccccagagcaacgccgtcatacaggacgaggagcgggacattccggagcggtcatggaacagcggctacgactggatcaccgactttcccgggaagacggtgtggttcgttccatcaatcaagagcggaaacgatatagcaaactgcctacgcaagaatggcaagcgggtgattcagctgtcgcgcaagacctttgacaccgaatatcagaagaccaagaacaacgattgggactacgtggtcacaacggacatcagcgagatgggggcaaacttccgagcggatagagtcatcgaccctcgtcgttgcctcaaacccgtgatcctgaaggacggccccgagagagtcattcttgcggggccgatgcccgtgacggtggcctccgccgcacagcgccgggggcgcataggtaggaatcagaataaagaaggggaccagtacgtgtacatgggccaaccgcttaacaacgatgaggaccacgcgcactggactgaggccaagatgctactagacaacatcaataccccagaggggattatcccggccctcttcgagcccgaacgcgaaaagagcgccgcgatagacggtgaatacaggttacgcggagaagcccgcaaaacgttcgtggagctaatgcgtcgcggtgacctccctgtctggctgtcctacaaggtggccagcgaggggttccagtacagtgaccggcgctggtgcttcgacggggaacggaacaatcaggtgctggaggagaacatggacgtagaaatctggaccaaggagggcgagaggaagaagttgaggccccggtggctcgacgctaggacctacagtgacccacttgctctgcgcgagtttaaggagttcgcggccgggcggcgctcagtatccggtgatctgatcctggaaattggcaagctcccccaacaccttactctgcgggcacaaaacgcactcgacaaccttgtgatgctccacaacagcgagcagggtggtaaggcttatcgccacgctatggaggagttacctgatacgatcgagaccctgatgctgctcgcccttatcgccgtgctgaccgggggtgtaacgttattctttctgtcagggaagggcctgggcaaaaccagcatagggttgctgtgcgtgacagccagcagcgcgttactctggatggcctcagtcgagccccactggatcgccgccagcatcatcctggagttctttctcatggtgctactgatcccggaacccgatcggcagcgcacgccccaggacaaccaattagcctacgtggtgattggcctcctgttcatgatactcaccgtggctgccaacgaaatggggctcctggagactacgaagaaggacctaggcataggtcacgtggccgccgaatctcatcaacatgctaccatgctcgacgtcgaccttcgtccagcgagcgcctggaccctatacgccgttgccaccacggtgataacgcctatgatgcgccacacaatcgagaacaccacggccaacatctcattaaccgcgatcgctaaccaagccgccattctgatgggtctggataaggggtggccgattagcaagatggacatcggcgtacctctcctagcgctagggtgctactcccaagtgaacccgttaaccctgaccgcggccgtgcttatgctcgtcgctcactacgccatcataggtcccggtctccaggcgaaggccacccgggaggcccagaagcgcacagctgccggcatcatgaagaatcccacagtggacggcatagttgcgatcgatctggacccggtcgtgtacgacgcgaagtttgagaagcagttgggccaaatcatgttattgatcttatgcaccagccagatactgcttatgaggacaacgtgggccctgtgtgagtccatcactttagcaaccggaccgttaacgaccctctgggaaggttcgcccggtaagttttggaatactacaatcgccgtgtccatggcgaacatcttccgaggcagctatctggctggagcggggctggccttctcgctcatgaagtcgctgggcggaggacgacgggggactggcgcccagggcgaaactctgggcgagaaatggaagcgccaattaaaccagctgagcaagacggagttcaacacctacaagagatccggcatcatggaagtcgatcgcagcgaggcgaaggaaggcttaaagcgcggcgagacgactaagcacgccgttagcagggggaccgctaaactccggtggttcgtcgaacgcaacctggtaaagcccgaaggcaaggtgatcgacttagggtgtgggcgcggcggctggtcgtactactgtgcaggtctgaagaaagttaccgaggtaaaaggctacaccaagggaggcctcggtcatgaggaaccaatccctatggcgacgtacggctggaatctcgtgaagctccacagcgggaaggatgtgttcttcatgccacccgaaaagtgtgataccttactgtgtgacataggagaaagttcccccaacccaacaatcgaggaggggcgcaccctcagagtcctcaaaatggtggaaccctggctgcgtggcaaccagttctgcattaagatccttaacccttacatgcccagcgtggtggagacgctggaacagatgcaaagaaagcacggcgggatgctcgtgagaaaccctctgtccaggaatagcacgcatgaaatgtactgggtgtcatgcggcacaggaaacatcgtcagcgcggtgaacatgacatcccgcatgcttctaaatcggtttacgatggcccaccgcaagcccacttacgaacgggacgtggacctgggcgcgggtacaaggcacgtagccgtggagccagaggtggcgaacctcgacatcatcgggcagcgcatcgaaaacatcaagaacgagcacaagagtacctggcactacgacgaggataacccctataagacgtgggcataccacggctcatacgaggttaagccaagcggctcagccagcagcatggtgaacggcgtcgtaaagttactgacgaaaccatgggacgtgataccaatggtcacccagatagccatgacggatacgacccccttcgggcagcaacgggtgttcaaggagaaggtggacacccgcacccctcgggctaaacgcggcactacccagataatggaggtaacagcaaagtggctatggggctttttatcacggaacaagaagccgcgcatctgcacacgcgaggagttcacacgcaaggtgcgcagcaacgcagccatcggtgccgtgttcgtcgacgagaaccaatggaactccgccaaggaggccgtggaggatgaaaggttctggaatctggtacaccgtgagcgggaactgcacaagcaaggcaagtgcgcgacctgcgtctataacatgatgggaaagcgcgagaaaaagctgggcgagtttgggaaagccaaaggctcgagggccatctggtacatgtggctgggagcgcggtttctcgagtttgaggccctggggttcatgaacgaggaccactggttctctcgcgaaaattctctttccggtgtggagggtgaaggtctccacaagttagggtacatactccgcgacattagcaagatacctggtggcaatatgtacgccgacgacacggccgggtgggatacccgcataactgaggacgacctccagaacgaggccaaaattaccgacataatggaaccagaacatgcactgctggccacctctatatttaagctgacctaccaaaataaggtggtaagggtgcagcgacccgctaagaacggcacggtgatggatgtgatcagccggcgtgaccagagagggtccggccaagtgggtacctatgggctcaataccttcaccaatatggaggtgcagctgatccgtcaaatggagtcagagggaatctttctcccctcagagctagagactcccaacctggccgagcgcgtactggactggctggagaagcacggggcagaacggttgaagcgaatggcgatctctggcgatgattgcgtggtgaagccgatcgacgatcggttcgcaacggcgcttactgccctgaatgacatgggtaaggtccgcaaagacattccccagtgggaaccgtcaaagggctggaacgactggcagcaggtccccttctgctctcaccattttcaccagcttatcatgaaagacgggagagaaattgtcgttccgtgccgtaaccaggatgagttagtggggcgtgctagggtgtcgcaaggggcggggtggagcctacgcgaaaccgcctgtctcggcaagagctatgcccagatgtggcaactaatgtactttcaccggcgcgacctacgtctggcagctaatgcaatctgcagcgcagtaccagtcgactgggtaccgacaagtcgcaccacctggtcaatccatgcacaccaccagtggatgaccaccgaggacatgctcagcgtgtggaatagggtgtggattgaggaaaacccctggatggaggacaagacgcacgtgtcctcatgggaggaagttccttatctgggcaagagagaggatcagtggtgcggcagcctcataggccttacggcacgggccacttgggccacaaatatacaggtggccatcaaccaggttcgtcggcttatcggtaatgaaaactacctagactacatgacaagcatgaagcgtttcaagaacgagtccgacccggagggcgcactttggtga

SEQ ID NO: 24074 - RNA, 9879 nt, synthetic construct
  misc_feature 1..9879: note = derived and/or modified CDS sequence (opt11) from DENV-1__GU131833__SS-prME
  source 1..9879: mol_type = other RNA
agcgtgaccatgctgctcatgctgctgcccaccgccctcgcctttcacctgaccacccggggcggggagccccacatgatcgtgtccaagcaggagaggggcaagagcctcttgtttaagacctccgccggggtgaacatgtgtaccctaatcgccatggacctcggcgagctctgtgaggacaccatgacctacaagtgcccccgcatcaccgaggctgagccggacgatgtggactgctggtgcaacgccactgacacctgggtcacctacgggacctgtagccagaccggcgagcaccggcgcgataagcggagcgttgccctggccccgcacgttggcttggggctcgagacgcgcaccgagacctggatgagctccgagggcgcttggaagcagatccagcgggtcgagacctgggccctgcgccacccggggttcacggtgattgccctgttcctcgcgcatgccatcggaaccagcatcacccagaagggaatcatcttcatcctgttgatgctagtgacccccagtatggccatgcggtgcgtcggcattggcaaccgcgactttgtggaggggctgtctggcgccacgtgggtggacgtcgtgctagagcacgggtcctgtgtgaccaccatggccaagaacaagcccaccttggacatagagctgctgaagacggaggtcaccaatcctgcggttctccggaagctgtgtatcgaggcgaagatcagcaacaccaccacggactcccgctgcccgacccagggcgaggccaccctggtggaggagcaggacgccaactttgtctgccggcgcaccttcgtagacaggggctggggaaacgggtgcggactgtttggcaaagggtccctactgacgtgcgccaagttcaagtgcgtgaccaagttggagggaaagattgtccagtacgagaacctgaagtattccgtgatcgtcaccgtccacacaggcgaccagcaccaggtggggaacgagacgacggaacacggcaccatcgcgacaatcacgccgcaggcccccacgagcgaaatccagctgaccgattacggggccctcaccctcgactgcagcccgcggaccggcctggatttcaacgagatggtcctcctgacgatgaaggagaaatcctggctggtgcacaaacagtggttcctcgatttgcctctgccctggacctccggtgccagcaccagccaggagacatggaatcggcaggacttactggtaacgttcaagaccgcccacgcaaagaagcaggaggtcgtggtgctgggcagtcaggagggcgccatgcataccgccctcaccggtgccacggagattcagaccagcggcactaccaccatttttgccgggcacctgaagtgtcgcctgaagatggacaagctaaccctgaagggaaccagttacgtaatgtgtactgggagctttaagcttgagaaggaggtggcggagactcagcacggcaccgtgctggtccaggtgaagtacgagggcaccgacgccccctgcaagatacccttcctcacccaggacgagaaaggtgttacccaaaacggaaggctgatcacggccaacccaattgtcaccgacaaagaaaaaccggtgaacatcgagaccgagccgcccttcggggagagttacatagtggtcggcgccggcgagaaggcgttgaagctcagctggttcaagaaggggtccagtatcgggaagatgttcgaggctacggcccgaggcgccaggcgcatggccatcctcggcgataccgcgtgggacttcgggagtatcggtggcgtatttacaagcgttggcaaactggtgcaccaagttttcggcactgcctacggggtccttttctcaggcgtctcatggacgatgaagatcgggattggcatcctgctgacctggctcggactgaactcccgtagcacctccttgagcatgacctgcatcgctgttgggatggtgacactctacctgggcgtcatggtgcaagccgattccgggtgcgtgattaattggaagggccgcgagctgaagtgcgggagcggcatctttgtgaccaatgaggtgcacacttggaccgagcagtacaaatttcaggctgattccccgaagcgccttagcgcggccatcggcaaggcctgggaggaaggggtttgcggtattcggagcgccacccgcctggagaacatcatgtggaaacagatttccaacgagttaaaccacatccttctggagaacgacatgaagttcacagtcgtggtcggggacgccaacggcatcctggcacaagggaagaagatgatccggccccaacccatggagcacaagtacagctggaagtcctggggcaaggctaagatcatcggcgccgatatccagaacaccaccttcatcatcgatgggccagacacgccggagtgccccgacgatcagcgcgcgtggaatatctgggaggtcgaggactacgggtttgggatcttcacgaccaacatctggctcaagctcagggatagctacacccagatgtgtgaccaccgccttatgtccgcggccatcaaggacagcaaggccgtacacgcagacatgggctactggatcgagtccgagaagaacgagacctggaaactcgcccgggcgagcttcatcgaggtgaagacgtgcacctggcccaaatcccacaccctgtggagcaacggcgtcctggagtccgagatgatcatccccaagatctacgggggcccgatcagtcagcacaactatcgcccagggtacttcacgcagacggcaggcccctggcacctcgggaagctggagctggactttgacctctgcgaaggaaccaccgtggtggttgacgagcactgcggaaaccgagggccgagcctgcgcacgacgaccgtgaccggcaagattatccatgagtggtgctgccggagctgcacgctgccgcccttacgcttccgcggagaggacggctgctggtacgggatggagatccgccccgtgaaagagaaagaggagaacttagtccggtccatggtgagtgccggctccggcgaggtggatagcttcagcctgggtatcctctgcgtttccattatgatcgaggaggtgatgcgtagccggtggtcccgcaagatgctgatgacgggcaccctggccgtgttcctcctcctaatcatggggcagctcacttggaacgacctgatccgcctgtgcatcatggtcggcgcgaacgcgagcgaccggatggggatgggtaccacctacctcgccctgatggcgacattcaagatgcgcccgatgttcgccgtggggctcctcttccggcggctgacctcccgggaggtactactcttaaccatcggtctgagcctcgtcgcctccgttgagctgcccaacagtctggaggagctcggcgacgggctggcgatgggcatcatgatgctgaagctcctgaccgagttccagccccaccagctgtggaccaccctcctgtccctgacatttatcaagacaactcttagcctggactacgcctggaagacgaccgccatggccctgtccatcgtcagcctcttccccctatgcctgtccacgaccagccagaagaccacctggctcccggtgttgctgggctccttcggctgcaagcccctcacgatgttcctgatcacggagaataagatctggggtcgcaagagctggcccctgaatgaggggattatggcgataggcatcgtgtccatcctcctgagctccctgctcaaaaacgacgtccccctggccgggccgctgattgccggaggcatgctgatagcctgctacgtgatcagcggtagctccgccgacttgagcctggagaaggcggcggaggtttcctgggagcaagaagccgagcacagcggcacctcccacaacatcctcgtagaggtccaggacgacgggaccatgaagataaaggatgaagagaaggacgataccctgacgatcctgctcaaggccaccctgctggccgtgagcggggtgtatcccatgtccatacccgcgaccttgttcgtgtggtacttctggcaaaagaagaagcagcggagcggtgtgctgtgggatacacctagcccgcccgaggtcgagcgcgctgtcctggatgacggaatctaccggattctgcagcgtggattactggggcggagccaggtgggcgttggggtgttccagaacggtgtgttccacaccatgtggcatgtcacccgcggggccgtccttatgtaccagggcaagcggctcgagccctcctgggccagcgtgaagaaggacctgatctcttacggcgggggctggcgcttccaggggagctggaacaccggcgaagaggtccaggtgattgccgtggagcccgggaagaacccgaagaacgtccagaccacgcccggtaccttcaagacccccgagggcgaggtgggggcgatcgccctggacttcaagcccggcacctcagggagcccaatcgtgaaccgggaaggcaagattgtagggctctacgggaacggggtggtgacgacttccgggacctacgttagcgccatcgcccaggctaaagcgtcccaggagggcccacttccagagatcgaggacgaggtgttcaagaagcgcaaccttaccatcatggacttacacccgggtagcggcaagacacggcgctacctgcccgccatcgtgcgtgaggccatcaagcgcaagctgcggacgctcatcctagccccgacccgcgtcgtggcgagcgaaatggcggaggctctgaagggcatgcccatccgctaccaaaccaccgccgttaagtccgagcacaccggacgggagatcgtggacctcatgtgccacgccaccttcaccatgcgcctgctgtctccggtgcgggtgcccaactacaatatgatcatcatggatgaagcgcacttcaccgaccccgcctccatcgccgcccgcggatatataagcacccgggtcgggatgggcgaagccgcggccatcttcatgaccgccacgccgcccgggagcgtggaagccttccctcagtcaaatgcagtgattcaggacgaggaacgcgacataccggagcggtcctggaacagcggctacgactggatcacggattttcccggcaagactgtctggtttgtcccttccataaagagcggcaacgacatagctaactgcctccgcaagaacggcaagcgggtgatacagctgtccagaaagacttttgacaccgagtaccagaaaacgaagaataatgactgggactacgtcgtgactactgacatatctgaaatgggggccaacttccgggccgacagagtgatcgaccccagacgctgcctgaagcccgtcatcctcaaggacggacccgagcgggtcatactggccggtccgatgcccgtgaccgtcgcttccgccgcccagcgccgaggacgcatcggacggaaccagaacaaagagggggaccagtacgtgtacatgggccagcccctgaacaacgacgaggaccacgcacactggacggaggccaagatgttgctggataacatcaacacccccgaggggattatcccggcgctattcgagcccgagcgcgagaagtccgccgccatcgacggcgagtaccggctccgcggggaggcccgcaagaccttcgtcgaactgatgcggcgcggcgacctgccagtttggttgtcctacaaggtggccagcgagggcttccaatacagcgaccggcgctggtgtttcgacggtgagcggaacaaccaggtcctggaggagaacatggacgtggagatatggaccaaggagggggagcgaaagaagctgcggccccgctggctcgacgcgcggacctactccgatccgcttgccctgagagagttcaaggagttcgccgctggacggcgctccgtgagcggcgacctaattctagaaatcggtaaactgccccagcatctaacgttacgggctcagaacgcgctggataacctcgtgatgttgcacaacagcgagcagggagggaaggcctaccgccatgccatggaggagcttcccgacaccatcgaaaccctcatgctgcttgccctcatcgccgtgctgacggggggtgtgacgctgtttttcctctccgggaagggcctgggcaagacctcaatagggttactctgtgtcaccgcctccagcgccttgctctggatggccagtgtggagccccactggatcgccgcgagcatcatccttgagttctttcttatggtgctgctcatcccggagcccgaccggcagcgcacgccccaggacaaccagctggcctacgtcgtgatcggcctcctcttcatgatccttacggtggccgccaacgagatgggtctgctcgagaccaccaagaaggatctgggcatcggtcacgtcgccgcggagaaccaccagcacgccaccatgctggacgtcgacctccggccggcatctgcctggacgctgtacgccgtggcgaccaccgtcatcacccctatgatgagacacacgatcgagaacacaaccgccaacatcagcctgaccgccatcgccaaccaggctgccatcctcatgggcctggacaaaggctggcccatctcaaagatggacatcggggtgcccctactcgccctgggctgctacagccaagtgaacccgctcacgctcaccgcggccgtccttatgctggtggcgcattacgctattatcgggcccggcctccaagcaaaggccacccgtgaggcgcagaagcgcaccgcggcagggataatgaagaaccccaccgtggatggcatagtggccatcgacctggaccccgtggtgtacgacgctaagttcgagaagcagctgggccaaataatgctcctgatcctgtgcacctcccaaatcctcctgatgaggaccacctgggccctctgcgagagcataacgctagcgaccggtcccctgaccaccctgtgggagggctcccccgggaaattctggaacacgaccatcgccgtctcaatggccaacatcttccggggctcctacctagccggcgccggtctcgcgtttagcctgatgaagtccctcggcgggggcagacgggggaccggcgcccagggcgagaccctcggggagaaatggaagagacagctgaaccagctaagcaagtccgagttcaacacgtataagcggtccgggattatggaggtggaccggagcgaggccaaggagggactgaaacggggcgagaccaccaagcacgccgtgtctcgcgggaccgctaaactgcggtggtttgtggagcgcaacttggtgaagcccgagggcaaggtgatcgacctcggatgcgggaggggggggtggagttactactgcgccggactgaagaaggttaccgaggtgaagggttacacgaaaggcggccccgggcacgaggagcctatccccatggccacctacggctggaacctggtgaagctccactccggtaaggacgtatttttcatgccgcccgagaaatgcgacaccctcttgtgcgacatcggcgagtcgtccccaaaccccaccatcgaggaagggcgcaccttgcgggtgctgaagatggtggagccctggctgcgcggcaatcaattctgcatcaagatcctcaacccctacatgccgagcgtagtggagaccctggagcagatgcagagaaagcacggagggatgctggtgcgcaaccccctctcccggaacagcacacacgagatgtactgggtctcttgcggcaccgggaatattgtgagcgccgtgaacatgacgtcgcgcatgttgctcaaccggttcactatggcccatcgaaagccgacctacgaacgcgacgtcgacctcggcgcgggcacccggcacgtggctgtggagcccgaggtagccaacctagacataatcgggcagcgaatcgagaacatcaagaatgagcacaagtcaacttggcattacgacgaggataatccgtacaagacctgggcctatcacggctcctacgaggtgaagcccagcgggtccgccagctccatggtcaacggcgttgtgcggctcctcaccaagccctgggacgtaatccccatggtgacccaaatcgcgatgacggacaccaccccgttcgggcagcaacgcgtattcaaggagaaagtcgacacccggacgccccgcgccaaacggggcaccacccagatcatggaagtgaccgcccgctggttatggggtttcctctcccggaacaagaagccccgcatctgcacgagagaggagttcacccgcaaagtgcggtccaatgccgctatcggcgcggtctttgtggacgagaatcagtggaattctgcgaaggaggccgtagaggacgagcgcttctgggacctcgtccacagagagcgtgagctgcacaagcagggcaagtgcgcgacctgtgtgtacaacatgatggggaagcgggagaagaagctgggtgagttcgggaaggcgaagggctcgcgcgccatctggtacatgtggttaggcgcccggttcctagagttcgaagcactggggttcatcaacgaggaccactggttcagccgcgagaatagcctctccggcgtggagggcgaggggctgcataagctggggtatatcctccgggacatcagcaagatcccgggcggcaacatgtacgccgatgacaccgcggggtgggatacgcgcatcacagaggacgacctgcagaacgaggcgaagatcaccgacatcatggaacccgagcacgccctgctcgccacctccattttcaagctgacatatcagaataaggtggtacgcgtgcagcggcccgccaagaatggcaccgtcatggacgtgatttcaagacgtgaccagcgcgggtccggccaggtgggaacctacgggctgaacaccttcacgaacatggaagtacagctcatccgacagatggagagcgagggcatttttctaccctccgaactggaaaccccgaacctcgcggaacgcgtgctagactggttggagaagcacggggcagagcggctcaagcgcatggccatcagcggggatgactgtgtggtcaaacccatcgacgaccggttcgccaccgccctaaccgcgctaaacgacatggggaaagtgcgcaaggacatacctcagtgggagccctccaagggctggaacgattggcaacaggtccctttctgctcgcatcactttcaccaattgataatgaaggacggccgggagatcgtcgtgccatgccgcaaccaggacgagctggtggggcgggcgcgcgtctcccagggcgcaggatggtcacttagggagaccgcgtgcctcggcaagtcgtatgcccaaatgtggcaactgatgtacttccacagacgggacctgcgcctcgcagcaaacgccatctgcagcgccgtgcccgtggactgggttcctacctcccggacgacctggagcatccatgcgcaccaccagtggatgacaacggaggacatgcttagcgtatggaaccgcgtgtggattgaggagaacccgtggatggaggacaagacccacgtctcctcgtgggaagaggtgccctacttggggaagcgcgaggaccagtggtgcggctccctcatcggcttaaccgcgcgggcaacctgggcaacgaatatccaagtagcgataaaccaggtccgccggttgatcgggaacgagaactatttggactacatggcgtcaatgaagcgttttaagaacgagtctgacccggagggcgcactatggtga

SEQ ID NO: 24075 - RNA, 9879 nt, synthetic construct
  misc_feature 1..9879: note = derived and/or modified CDS sequence (opt11) from DENV-1__GU131834__SS-prME
  source 1..9879: mol_type = other RNA
agcgtgaccatgctgctcatgctgctgcccaccgctctcgccttccacctgaccacccgcggcggggaaccccacatgatagtcagcaagcaggagcggggcaagagccttctgttcaagaccagcgccggggtgaacatgtgcaccctgatagccatggatctgggagaactctgcgaagacaccatgacttacaagtgcccccgcatcaccgaggctgaacccgacgacgtggactgctggtgcaatgccaccgatacctgggtgacctacggtacatgctcccagacgggcgagcaccggcgcgataagcggagtgtggccctcgcaccccacgtgggcctcggactcgagacccgcaccgagacctggatgagctccgagggcgcctggaagcaaatccaacgggtggagacctgggccctgcgccacccaggcttcactgtaatcgcccttttcctcgcgcacgccatcggcactagcatcacccagaagggtattatcttcatcctcctgatgctagtgacccccagtatggcgatgaggtgcgtcggcatcggcaaccgcgatttcgtagaggggctgtcaggagccacgtgggtggacgtcgtgctggagcacggctcctgcgtgaccaccatggccaagaacaagcccaccctcgacatcgagctgctgaagacggaggttacaaatcccgccgtgttacggaaactttgcatcgaggcgaagatttcgaacaccaccacggacagccgctgcccgacacagggcgaggctaccttagtagaggaacaggacgccaacttcgtctgccggcgcaccttcgtggatcggggctggggcaacggctgcggcctcttcggaaagggatcattgttgacgtgcgccaagttcaaatgcgttactaaactcgagggtaaaatcgttcagtatgaaaacctgaagtactccgtgatcgtgaccgtccacactggcgaccagcaccaggtggggaacgaaacgaccgagcacggcaccatcgctacgatcacgccacaggcccccacgtcagagatccagttaacagactacggggccttaaccctcgattgcagccctcgtactggcctcgatttcaatgagatggtcctcctgacgatgaaggagaagtcctggctggtgcacaagcagtggttcctggatctcccgctgccctggacctccggggccagcaccagccaggagacatggaatcggcaggatctcctggtgacgtttaagaccgcccacgcgaagaagcaggaggtcgtggtactgggcagccaggagggcgccatgcacaccgccctcaccggggccacggagatccagaccagcggcaccaccacaatcttcgccggacacctgaagtgccgcctgaaaatggacaagctcacgctcaagggcatgtcctacgtaatgtgcaccgggagctttaagctggagaaggaggtggcggagacccagcacggcacggtgttagtccaggtcaagtacgagggcaccgacgccccatgcaagatccccttttctacccaagatgagaagggggtgacccagaacggccggctcatcacggcaaacccgatcgtcactgacaaggaaaaacccgtaaacatcgaaaccgaacctcccttcggggagagctatatcgtggtcggggcaggcgagaagacccttaagctgtcctggttcaagaaggggtcctccatcggtaagatgttcgaggcgacggcccgcggggccaggcgcatggccatcctcggcgacaccgcctgggacttcgggtctatcggcggtgtgtttaccagtgtggggaagctggtccatcaggtgttcggcaccgcgtacggggtgctgttcagcggcgtctcgtggacgatgaagatcgggataggcatccttttaacctggcttggtctcaatagccgctccacatcattatctatgacgtgcatcgccgtcgggatggtgacgctgtacctcggcgtcatggtccaggccgattccggctgcgtaataaattggaaaggcagggagctgaagtgcgggtccgggatcttcgtcacgaacgaggtgcacacttggaccgagcagtacaagttccaagccgacagcccgaagcgcctgagcgcagcgatcggcaaggcctgggaggagggggtgtgcggcatacggagtgccacccgcttggagaacatcatgtggaagcagataagcaacgagctgaaccacattttgctagaaaacgacatgaaatttacggtcgttgtgggcgacgcgaacggcatcctagcccaggggaagaagatgattcgaccccagcccatggagcacaagtactcctggaagtcctgggggaaagcgaagattatcggcgcagacattcagaacaccaccttcatcatcgacggacccgacaccccggaatgccccgacggccagagggcctggaacatctgggaggtcgaggactacgggttcggcatattcacgaccaacatctggctgaagctccgggattcctacacacagatgtgtgaccaccgcctgatgagcgccgcgattaaggactccaaggccgtgcacgccgacatgggatactggatcgagagcgagaagaatgagacctggaagctcgcccgggcctccttcatcgaggtgaagacgtgcacctggcccaagtctcacacactctggtccaatggcgtcttagagagcgagatgataatccccaagatctatgggggaccgatctcccagcacaactatcgccccggctacttcacccagacggcggggccctggcacctgggtaagctcgaactggatttcgacctatgcgagggaaccactgtggtcgtcgacgagcactgcgggaatcggggcccgtctctccggaccacaacagtgactgggaaaataatccacgagtggtgctgccggtcctgcaccttaccacccctgagattccggggcgaggacgggtgctggtacggcatggagatccgccccgtgaaggagaaggaagagaacctcgtccggtctatggtatccgctggaagcggggaggtggacagcttctccctgggcatcctgtgtgtaagcatcatgatcgaggaggtgatgcgctccaggtggagccgcaagatgctcatgacggggaccctggccgtgttcctgctcctgatcatgggccagttaacctggaacgacctcatccgcctgtgcatcatggtgggggccaacgcgtccgaccggatgggcatgggaaccacgtacctggcgctcatggcgacctttaagatgcgccctatgttcgccgtggggctgctgttccgaagactcaccagcagggaggtcctgctgctcacaatcggactgagcctggtcgccagcgtcgagctcccgaactccctggaggagctgggggatggcctcgccatgggcatcatgatgctaaagctgctcaccgagttccagccccaccagctctggaccaccctgctcagcctgaccttcgtcaagactaccctgtccctcgactatgcgtggaagaccaccgccatggtgctgagtattgtttcccttttccccctctgcctgagcacgacctcccaaaagactacgtggcttccggtcctcctcgggagcttcggctgcaagcccctgaccatgttcttcatcactgagaacaagatctggggacggaaatcatggcccctcaacgaaggcatcatggccatcgggatagtcagcatcctgctgtccagcctccttaaaaatgacgtgcccctggccggcccgctgattgccggcggcatgctgatcgcctgctacgtcatcagcggctcctcagcggacctgtccctcgagaaggccgccgaggtgagctgggagcaggaggcggagcactccggggctagccacaacattctggtggaggtccaagacgacggcaccatgaagattaaggacgaggagcgggacgacacgctgaccatcctcctgaaggccacgctgttagccgtgtccggggtgtaccccatgagcattccggccaccctgttcgtgtggtacttctggcagaagaagaagcagcgctccggcgtgctgtgggataccccgtccccgcccgaggtggagcgggctgtcctcgatgacggcatctaccgcatcctgcagcgggggctgctgggtcgctcccaggtgggggtgggcgtattccaggacggtgtgtttcacaccatgtggcacgtaacacggggcgcagtcctcatgtaccaaggcaagcgcctggagccgagctgggcctctgtgaagaaggacctcatcagctacgggggcggctggcggttccaaggctcctggaacacaggggaggaagtgcaggtaattgctgtggagcccggcaaaaacccaaagaacgtgcagacaacccccggcacgtttaaaacccccgagggggaggttggcgccatcgcgctcgactttaaacccgggaccagcggcagtcctatcgtgaaccgcgagggcaagatcgtggggctgtacggcaacggcgtcgtgaccactagcggcacctacgtgtcggccattgcccaagccaaggcaagccaggaggggcccctgcccgagatcgaggacgaggtctttaagaagaggaaccttaccatcatggacctgcatccgggcagcggaaaaaccaggcggtatctgcccgcgatcgtgagggaggccatcaaacggaagctccgcacgctgattctggcacccacccgcgtggtcgcatccgagatggctgaggccctcaagggcatgcccatccgataccagacaaccgccgtcaagtccgagcacacgggccgcgagatcgtggatctcatgtgccatgccacctttaccatgcgactgctctccccggtgcgcgtgcccaactacaacatgatcatcatggacgaggcccactttaccgaccccgcgtcgatcgccgccaggggatacatttccacgcgcgtcggcatgggggaggccgcggcgatctttatgaccgccaccccgcccggcagcgttgaggcctttcctcaatcaaacgccgtgatccaggacgaagaacgggacatccccgagaggtcttggaactccggctacgactggattaccgacttccccgggaagacggtgtggttcgtgcccagcatcaagtccgggaacgatatcgccaactgcttacggaagaacgggaagcgcgtcatccagctgagcagaaagacattcgacacggagtatcagaaaaccaagaacaatgactgggactacgtggtcacgaccgacatttcagagatgggcgcgaacttccgcgccgaccgagtgatcgacccccgacggtgcctcaagccggtgatcctcaaggacggtccggagcgcgttatccttgcgggcccgatgcccgtaaccgtcgccagcgcggcccagaggcgcggccggatcggccgcaaccagaacaaggagggcgaccagtacgtgtacatgggccagccacttaataacgacgaggaccacgcccactggaccgaagccaagatgctgttagacaacataaacacacccgaaggcatcatcccggccctcttcgagcccgagcgggaaaagtccgcggccatcgacggggagtaccggctgagaggtgaggcccggaaaaccttcgtggagctgatgcgccggggcgatctccccgtctggctgagctataaggtggcctccgaggggttccagtactccgaccgccgatggtgtttcgacggagagcgcaataaccaggtgctggaggagaacatggacgttgagatttggaccaaggagggggagcggaagaagctccgcccccggtggttagatgcccgcacgtattccgacccgctggctctccgcgagttcaaagagttcgcggccggccgccggtctgtatcaggtgacctgatcctggagatagggaaactcccccagcacctgaccctgcgagcccagaacgccttggacaacctggtgatgctgcacaactccgagcagggcggaaaggcgtaccgtcacgccatggaggaactccccgacacgatcgaaacactgatgcttctcgccctgatcgccgtcctaaccggtggggtgacactatttttcctgtccggcaagggcctggggaagacgtccatcggcctcctgtgcgtgaccgcgagctccgccctgctatggatggccagcgttgagccacactggatagccgccagcatcatccttgagttcttcctgatggtgctcctgatcccggagcccgaccgccagcggacgccacaggacaaccagctggcgtatgtggtgatcgggctcctgttcatgatcctgaccgtggccgccaacgagatggggctcctggagacgaccaaaaaggacctgggcatcggatacgtggccgccgagaaccaccagcacgcgaccatgctcgacgtcgatctgcgcccagcctccgcctggacactgtacgccgtggccaccaccgttatcaccccgatgatgcggcacaccatcgaaaacacgaccgcgaatatctccctaaccgcgatcgccaaccaggcagccatcctgatggggctggacaaggggtggcccatctctaagatggatatcggagtccccctcctggcgctggggtgctactcccaggtgaatccgctcaccctgacggctgcggtgctgatgctcgtcgcccactacgcgatcatcggtcccgggctgcaggccaaggccacccgagaggcacagaagcgcaccgccgcgggcataatgaagaaccctactgtggacggcatcgtggccatcgacctggaccccgtcgtgtacgacgccaagttcgagaagcagctagggcagataatgttactgatcctctgcacgagccagattctgctaatgaggaccacgtgggccttatgcgagtccatcactctggccacgggcccgctaaccaccctctgggaggggagtcccggcaagttttggaacaccacgatagcggtatccatggccaacattttccgcggcagctacctggccggggccggcctggccttctccctcatgaagtccctcgggggcgggcggcgcggcaccggcgcgcagggcgagacgctgggcgaaaagtggaagcggcagctcaatcagctgtccaagagcgagttcaacacctacaagcgcagcgggattatggaggtcgaccgatccgaggccaaggagggcctgaagcgcggggaaacgaccaagcacgccgtgagcagaggcaccgccaagctccgctggttcgttgagcggaacctggtcaagcccgaaggtaaggtgatcgacctcggttgcgggcgcggtggctggtcctactattgcgcggggctgaagaaggtgactgaggtcaagggctacaccaagggcgggccgggccatgaggagccgatccccatggccacgtacgggtggaacctagtgaagctgcacagtggcaaggacgttttctttatgccgcccgagaagtgcgacaccctactctgcgatatcggggagagcagcccgaaccccaccattgaggaggggagaactctccgcgtactcaaaatggtcgagccctggctccgaggcaaccagttctgcatcaagatcctgaacccctacatgccgtccgttgtcgagacgctggaacaaatgcagcgcaaacatggaggcatgctcgtgcggaaccccttgagccgcaactccacccacgagatgtactgggtgtcatgcggcactggcaacatagtttccgccgtcaacatgaccagccggatgctgctcaaccgcttcacgatggcccaccgcaagcccacatacgagcgggatgtggacttaggcgctgggaccagacacgttgcggtggagcccgaggtggccaacctggacatcatcgggcaaagaatcgagaacatcaagaacgagcacaagagcacctggcactatgatgaggacaacccgtacaagacctgggcctaccacgggtcttacgaggtcaagccctccggcagcgcatccagcatggtgaatggggtcgtgcgcctcctgaccaagccatgggacgtgatccccatggtcacgcaaatcgccatgaccgacacgaccccgttcggccagcagcgggtcttcaaagagaaggtggacacccgcacgccccgggcgaagcgcggcacgacccagataatggaggtcactgccaagtggctgtgggggttcctcagccgtaacaagaagcctaggatctgcacccgggaggagttcacgcgcaaagtccggagcaacgccgccatcggcgccgtgttcgtcgacgagaaccagtggaacagcgcaaaggaggcagtggaggacgaacgcttctgggatctggttcacagagagcgggagctgcacaagcagggaaagtgcgctacatgtgtctacaacatgatgggtaagcgggagaagaaacttggggagttcggaaaggccaagggctcccgcgcgatctggtacatgtggctgggggcacggttcctggagttcgaggccctcggcttcatgaacgaggaccactggttcagtcgagaaaattccctcagcggcgtggagggcgaggggctgcacaagctcggctacattctacgcgacatctccaagataccgggcgggaacatgtacgccgatgacaccgccggctgggacacccggatcacggaggacgacttacaaaacgaggcgaaaatcaccgacatcatggagcccgaacacgccctcctggccacaagcatcttcaagctgacctaccaaaacaaggtagtccgcgtgcagaggccagccaagaacggcacagtgatggacgtaatctcccgacgggaccagcgcggcagcgggcaggttgggacctacggactcaacaccttcaccaacatggaggtacagctgatccggcaaatggagtccgaggggatcttcctgcccagtgagctcgaaaccccgaatctggcggagcgcgtgctggactggctcgagaagcacggcgcggagcggctgaagcgaatggccatctccggagacgactgcgttgtgaagcccattgacgaccggttcgccacggccctcaccgccctcaatgacatgggtaaggtcaggaaggacatcccccagtgggagcccagcaaagggtggaacgactggcagcaggtccctttctgctcccaccacttccaccaactgataatgaaggacggtcgggagatcgtggtcccctgccgcaatcaggacgagctggtgggcagagcgcgtgttagccagggagccggctggtccctccgggagaccgcgtgcctgggaaagagctacgctcagatgtggcagctgatgtacttccaccgccgggacctccggctggccgccaacgccatctgctccgccgtcccggtcgactgggtgcccacctcgcggacaacctggagcattcacgcccaccaccagtggatgaccaccgaggatatgttatccgtctggaatcgcgtgtggatcgaagagaacccatggatggaagacaagacacacgtgagcagttgggaagaggtaccctacctcggcaagcgggaggaccagtggtgcggcagcctgatcgggctgaccgcgcgggccacctgggccaccaacattcaggtggctatcaatcaagtgcgtcgactcatcggcaacgagaactacctggactacatgacgtccatgaagcgcttcaagaacgagtctgaccccgagggggcgctgtggtga

SEQ ID NO: 24076 - RNA, 9879 nt, synthetic construct
  misc_feature 1..9879: note = derived and/or modified CDS sequence (opt11) from DENV-1__GU131835__SS-prME
  source 1..9879: mol_type = other RNA
agcgtgaccatgctgctcatgctactacccaccgccctcgccttccacctgaccacccggggcggggagccgcatatgatcgtatcaaagcaggagaggggcaagtcgctcttattcaagacctctgccggggtcaacatgtgcaccctgatcgccatggacctgggcgagctctgcgaggatacaatgacgtacaagtgccccagaatcaccgaagccgagcccgacgacgtagactgctggtgcaacgcaaccgacacgtgggtcacatacgggacctgctcccagaccggcgagcaccggcgcgataagcggtctgtggccctggcgccccacgtgggccttgggctcgagacgcggaccgagacatggatgagcagcgagggcgcctggaagcaaatccagcgggtcgaaacctgggtcctgagacaccctgggttcacggtgatcgctttcttcttagcgcacgcgattggcaccagcatcacccaaaaggggatcatcttcatcttactgatgttggtcacgccttccatggctatgcgatgcgtcggaatcggcaaccgtgacttcgtcgaggggctcagcggcgccacgtgggtcgacgtggtgcttgagcacgggtcctgcgttaccaccatggccaaaaacaaacccacactggacatcgaactcttaaagacggaggttaccaatcccgccgtgcttcggaagctctgtattgaggcaaagatcagcaataccaccacggacagccgctgcccaacccagggcgaagccaccttagccgaagaacaggacgccaatttcgtctgtcggcgcaccttcgtagatcggggctgggggaacggctgcggactgttcggcaaggggagtttattgacgtgcgcaaagtttaaatgcgtgactaaactggagggcaagatcgtacagtacgagaacctcaaatactccgtaatcgtgaccgtccacactggtgaccagcaccaggtcgggaacgaaacgaccgagcatggcaccatcgcgacaatcacgccccaggccccaacgagcgagatacaactgaccgattacggggccctgaccctcgactgcagcccccggacggggctggacttcaacgagatggtcctgctcacgatgaaggagaagagctggttggtacacaagcagtggttcttagacctcccgctgccctggacctccggagcctctaccagccaggagacctggaaccggcaggacctgctcgtgacgttcaaaaccgcccacgcgaagaagcaggaggttgtggtgctgggctcccaggagggtgccatgcacaccgccctgaccggggccactgagatccagacaagcggcaccaccacgatctttgccggacatctcaaatgcagactgaagatggacaagctgactctcaagggcacctcctatgtcatgtgtaccgggagcttcaagctggagaaggaggtggcggagacgcaacatgggaccgtgttagtgcaggtgaagtacgagggcaccgatgccccctgcaagatccccttttctacccaggacgagaaaggggtaacgcagaatggccggctaatcaccgccaacccgatcgtcaccgacaaagaaaagcccgtgaacattgagaccgagccgccctttggggagagctatatagtggtcggagcgggcgagaaagcgctcaagctgagttggttcaagaaggggtcttcgatcggtaagatgttcgaggctacggcccgcggagcaaggcgtatggccatcctgggcgacaccgcctgggacttcgggagcattggcggcgtgttcacctccgtgggtaagctcgtgcaccaggtgttcgggaccgcgtacggggtgctattcagcggagtatcctggaccatgaagatcgggatcgggatcctgctaacttggttgggcttaaattccagatccaccagcttgtccatgacctgcattgccgtgggaatggtgacgctgtacttaggcgtcatggtgcaagctgacagcgggtgcgttataaactggaagggtagggagcttaagtgcggttccggaatcttcgtcacaaacgaggtacacacctggaccgagcagtacaagttccaggcggacagcccgaagaggttgagcgcggcaataggcaaggcctgggaggagggggtctgcggcatcaggtccgccaccagactcgagaacatcatgtggaagcagattagcaatgagctcaaccatatcctgctggagaacgacatgaagttcacggtagtggtaggggacgccaacggtatcctcgctcagggtaagaagatgatccggccacagcccatggagcacaaatactcctggaagtcctgggggaaggccaagatcattggcgccgacatccagaacaccacgttcataatcgacggccccgacaccccggagtgcccagacgaccaacgcgcctggaacatctgggaggtcgaggactacggcttcgggatattcacgaccaacatctggttaaagttacgggactcctacacccagatgtgcgaccacaggctcatgagcgcggcgataaaggattccaaggcggtccacgccgacatgggctattggatcgagtccgagaagaacgagacctggaagctcgcccgggcgtcgttcatcgaggtgaagacgtgcacctggcccaaaagccacactctgtggtccaacggggtgcttgagagcgaaatgatcattcccaagatctacgggggcccgatctcccagcataactaccgtcccgggtatttcacccagacggccggcccctggcacttggggaagctggagctggactttgacctgtgcgagggcaccaccgtggtcgtggacgagcattgcggcaaccgcgggcctagccttaggaccacgaccgtgaccggcaagataatccacgaatggtgctgccggtcctgcaccttaccgcccctccggttccgcggggaggacggctgttggtacgggatggagatccgccccgtgaaagagaaggaggagaacctggtgagaagcatggtgtccgccggcagcggcgaggtagattcgttctccctcgggatcttgtgcgtctcaattatgatagaagaggtgatgcgctcccgatggagccgcaaaatgctaatgacgggaaccctcgccgtgttcttgttactcataatggggcagctgacctggaacgacctgatccgcctgtgtatcatggtcggagccaacgcgtccgacaggatggggatgggcactacttacttagccctgatggccacctttaagatgcgcccgatgttcgccgtgggcctcctattccggcggttgacctcaagagaggtgctgctactgaccatcgggctctcccttgtcgccagcgtggagctgcccaactccctcgaggagttaggcgacgggctggcgatgggcatcatgatgctcaagctgttgaccgagttccagccccaccagttatggacaaccctgctgtcgctcaccttcatcaagacgaccttgtccctggattacgcctggaagacgaccgccatggtcctcagcatcgtatcactgttccccctctgcctcagtacgacctcccagaaaactacctggctgccggtgctgctcggctccttcgggtgtaagccccttaccatgtttctgatcactgaaaacaagatatggggccgcaagagctggcccctcaacgaagggatcatggcgatcggcatcgtctcgatcctgctgtccagcctcctgaagaacgacgtgcccctggcggggccgctcattgccggcgggatgctgatcgcctgctacgtgattagcgggagcagcgccgacctgtccttagagaaggccgcggaggtcagctgggaacaggaggccgagcactccggcaccagccacaatatcctggtggaggtacaggacgacgggaccatgaagattaaggacgaggaacgggacgacaccctcacgatcctcctgaaggccaccttattagccgtctccggggtgtaccccatgagcatcccggccacgttattcgtgtggtacttctggcagaaaaagaaacagcgctccggggtcctgtgggacactcccagcccgcctgaggtggagcgagcggtgttggacgacggaatctaccgcatcttgcagcggggcctgctcgggcgttctcaggtgggcgtcggggtctttcaggatggcgtttttcacacgatgtggcacgtgacccgcggcgcggtgttgatgtaccagggcaaacgcctggagccgagctgggcctcggtcaagaaggatctgataagctacggcgggggctggcggttccagggctcctggaacactggcgaggaggtccaggtaatcgccgtcgagcccgggaagaacccgaagaatgtgcagaccaccccaggcaccttcaagacccccgagggcgaagtgggggccatcgcgctcgacttcaagcccggcaccagcgggtccccgatcgtcaaccgcgagggcaaaatagttggcctgtacggaaacggggtagtaacgaccagcggtacctatgtgtccgcgattgctcaagccaaagcaagtcaggagggccccctgcccgagatcgaggatgaggtttttaagaagagaaacctcactatcatggatcttcacccgggtagcggcaagacacgccggtacctgcccgccatcgtcagggaggccatgaagcggaagctccgcaccctgatcctggccccaacccgcgtggtagcctccgagatggcagaagccctaaagggaatgccaattcgctaccagaccacggctgtaaagagcgagcacaccgggagagagatcgtggatctcatgtgccacgccacgttcactatgcggctgctctccccggtgcgcgtgcctaattacaacatgatcatcatggacgaggcccacttcacagaccccgcgagcatagctgcccggggctacatctccacccgagtcgggatgggtgaggccgccgcgatcttcatgaccgccacgccgcccgggagcgtggaagcctttccccagtccaacgctgttattcaggacgaagagcgggacatacccgaacgcagctggaacagcggctacgagtggatcacggatttccccggtaagaccgtgtggttcgtccctagcatcaagtccgggaatgacatcgctaactgcctgcgtaagaacggaaaacgcgtgatccagctaagtagaaagaccttcgacactgaataccaaaagacgaagaacaacgactgggactacgtggttacgaccgatatttccgagatgggggcgaatttccgcgccgatcgagtcatcgacccccgccgctgcctcaagccagttatcttgaaggacggccccgagcgcgtaatcttagccgggccgatgcccgtcacggtggccagcgcggcccaacggcgcggccggattggccgcaaccaaaataaggagggggaccagtacgtctacatgggccagcccctcaacaatgacgaggatcacgcccactggacggaggctaaaatgctactggacaacatcaacacccccgaggggatcatcccggccctcttcgaacctgagagggagaaaagcgctgcaatcgacggcgagtaccggctgcgaggggaggcccggaaaacttttgtggagctgatgcgccggggcgacctccccgtgtggctaagctacaaggtcgcatccgaggggttccagtattcagaccgccggtggtgcttcgacggggaacgcaacaaccaggtgctggaggaaaatatggatgttgagatctggaccaaggagggcgagcggaagaagctccggccccgatggctggacgcccgcacctacagtgacccgcttgcgctcagggagttcaaggagttcgccgcggggcgccggagcgtgagcggcgacctgatcctggaaatcggcaagttgccccagcatttaacgctgcgcgcgcagaacgccctcgacaacctcgtgatgctgcataatagcgaacaaggggggaaggcgtaccggcatgccatggaggagctccccgacacgatcgaaacgctgatgctactcgccctgatcgccgtgctgaccgggggggtcatgctgttcttcctgagcgggaagggcctgggcaaaacgtccatagggctcctctgcgtgacggcgagctccgcacttctctggatggcctctgtggaaccccactggatcgcggcttccatcgttctggagttctttctgatggtgctcctgatccccgagccagaccgccaacggactccccaggacaaccagctggcgtacgtagtaatcggtctcctgttcatgatccttaccgtggccgcaaacgagatgggactcctggagacgaccaagaaggacctagggatcggacacgccgccgcggagaaccaccagcacgccaccatgctcgacgtggacctgcggcctgctagcgcctggaccctgtacgcggtcgcgacgaccgtaataacccccatgatgcggcacaccatcgaaaacacgaccgccaacatctccttaaccgcaatagcaaaccaggccgcaatcttaatgggcctggacaagggctggcccatttcaaagatggacatcggggttcccctactcgccctgggctgctattcccaggtcaaccccctcacgttgacggccgccgtgctgatgctcgtggctcactacgccatcatcgggcctggcttacaggccaaggctactagggaggctcagaagcggactgctgcaggaatcatgaagaaccccaccgttgacggcattgtggccatcgatctggatcccgtggtctatgacgccaagtttgagaagcagcttggtcagatcatgctgctgatcctctgcacgtcacagattctgctgatgcgtaccacttgggccctatgcgagtcaatcaccttggcgacggggccgctgacaaccctctgggagggctcaccggggaagttctggaacaccacgatcgccgtgtccatggccaacatcttccgcggctcttacctggccggcgccggactggcgttctccctcatgaagtcattggggggtggccggcgcggtaccggcgcccagggcgagaccctgggggagaagtggaagcggcagctcaaccagctgtccaagccagaattcaacacctacaaacgcagcggtatcatggaggtcgaccggagcgaggccaaggaggggctgaaacgaggcgaaacgaccaagcatgctgtctcccgtgggacagcaaagctccgctggttcgtggagagaaatctggtgaagcccgaaggcaaggtgatcgacctgggatgcgggagaggcgggtggagctactactgtgccgggttgaagaaagttaccgaggtgaagggttacaccaaaggcggcccggggcacgaggagcctataccaatggccacgtacggttggaatctagtcaaactgcattccggcaaggacgttttttttatgcctccggagaagtgcgacacactgctctgcgacattggcgagagctcccccaacccgaccatcgaggaagggcgcaccctgcgtgtgctgaagatggtcgaaccctggctacggggcaatcagttctgcatcaagatcctgaacccgtacatgcccacggttgtggaaacgctggagcagatgcagcgcaagcacggtgggatgttggttcgtaaccccctttcgagaaactccactcacgaaatgtactgggtgagctgcgggaccgggaacatcgtgtccgccgtcaacatgaccagcagaatgctgctcaaccgcttcaccatggctcatcgcaagcctacctacgagcgcgatgtggacttgggtgcgggcactcgccacgtggccgtcgagccggaggtggctaacctggacatcatcgggcagcggatagagaatatcaaaaacgagcataagtccacatggcattatgacgaggacaacccctataagacctgggcctaccacggcagctacgaggtgaaaccctccggatcagccagtagcatggtcaacggcgtggtccgactcctgacaaagccctgggacgtgattcccatggtgacccaaatcgcgatgacggacaccacccctttcgggcagcagcgggtcttcaaggagaaggtggataccaggacgcccagagccaagagaggtactacccaaatcatggaggtgaccgccaagtggctgtggggattcctgtcccggaacaaaaagccgcgcatctgcacgcgggaagagttcactcggaaggtacggtctaacgccgcgatcggggccgtattcgtggacgaaaaccaatggaactccgccaaggaggccgtcgaagacgagcgtttctgggacttagtacatagggagcgcgagctgcacaagcaagggaagtgcgcgacctgcgtgtacaatatgatggggaagagagagaagaagttgggcgagttcgggaaggcgaagggcagccgcgccatctggtacatgtggctgggtgcacgctttctggaattcgaagcgctcgggttcatgaacgaggaccactggttctcgagggagaactccttgagcggcgtcgagggtgagggcttgcacaagctcgggtacatcctgagagacatctccaggatccccggtggcaatatgtacgccgacgataccgcggggtgggacactcggatcacggaagacgacctgcaaaacgaggccaaaatcaccgacatcatggagcccgagcacgcattactcgcaaccagcatcttcaagttaacataccagaataaggtggtgcgggtccagcgccccgctaagaacgggaccgtgatggacgtgatctcccggcgcgatcagcgggggagcggccaggtcggaacctacgggctcaataccttcacgaacatggaggtgcaactgatccgccagatggagtccgagggcatcttcctgccgagcgagctcgagaccccgaacctggctgagcgtgtactggactggctcgagaagcacggggcagagaggctaaagcggatggcaatttctggagacgactgcgtcgtgaagcccatcgacgatcgctttgccactagcctgacagccctcaacgacatgggcaaggtgcggaaggacatcccccagtgggagccgtccaaaggctggaacgactggcagcaggtccctttctgctctcaccacttccaccagctcatcatgaaagacggccgcgagattgtggtgccctgtaggaaccaggacgagctggtcgggagagcgagggtatcccagggcgccgggtggtctctccgcgagaccgcctgcctgggaaagtcctacgcccagatgtggcaactgatgtacttccaccggcgagacctccggctcgccgcgaacgcgatctgcagcgccgttcccgtcgattgggtgccgacgtccaggaccacctggtctattcacgcgcatcaccaatggatgaccacggaggacatgctgagcgtttggaaccgcgtctggattgaggagaacccctggatggaggacaagacccatgtatcctcatgggaggaggttccctatctaggtaagcgggaggaccagtggtgcggatccctaataggcctgacggcgcgcgcaacctgggccacgaacatccaagtcgcaattaaccaggtcaggcggctcattggcaacgagaactacttagactacatgacctcgatgaagcggttcaagaatgagtccgacctggagggcgccctgtggtag

SEQ ID NO: 24077 - RNA, 9879 nt, synthetic construct
  misc_feature 1..9879: note = derived and/or modified CDS sequence (opt11) from DENV-1__GU131836__SS-prME
  source 1..9879: mol_type = other RNA
tcagtgaccatgctgcttatgctgctgcccacagcactagctttccacctgaccacgcgcggcggggaaccgcacatgatcgtcagcaaacaggagcggggtaagagcttgctgttcaagactagtgcaggagtaaacatgtgcactcttatcgcgatggatctaggcgagctctgcgaagacaccatgacctacaagtgcccccgaatcacggaggccgaacctgatgacgtggactgctggtgtaatgctaccgacacctgggtcacatacgggacttgcagccagaccggcgagcaccggcgcgacaagcggtccgtagccctggcaccccacgtaggcctaggtctcgagacccgcaccgagacctggatgagctccgagggcgcttggaagcagatccaacgggtcgagacctgggcactgcgccaccccgggttcacagtgatcgctctgttccttgctcacgccatcggcaccagcattactcagaaggggatcatcttcattttactgatgctcgtgacccccagcatggccatgcggtgcgtcggcatcggcaatagagatttcgtggaggggttgagcggcgccacgtgggtggacgtcgtcttggagcatgggtcctgcgtgaccacgatggccaaaaataagcccaccctagatatcgagcttctgaaaacggaggtcactaaccccgcggtactccggaaactgtgcatagaagctaagatctccaacaccaccacggactcccgctgcccgacacaaggggaggctacactggtagaagaacaggatgccaactttgtctgccggcgcaccttcgtggaccggggctgggggaacggttgcgggctcttcggcaagggaagcctgctgacgtgcgccaaatttaagtgtgtgaccaagctagagggaaaaattgtacagtacgagaatctgaagtattccgtaatcgtgaccgtccacaccggcgaccagcaccaagtggggaacgaaacgaccgagcacgggaccattgctaccatcacgccccaggcccccacgtcggagatccagttaaccgactacggggcactcaccctagactgtagtccccggaccggcttggacttcaacgaaatggtcctcctaacgatgaaggagaaatcctggctagtgcacaagcagtggtttctcgacctgccgctgccttggacctctggtgcctccactagccaggagacctggaacaggcaagacctccttgtgacattcaaaaccgcccacgcgaagaagcaggaggtcgtggtgcttggctcccaggagggggccatgcacaccgcacttacgggcgccacggaaatacaaaccagcggcaccaccacgatcttcgccgggcatttaaaatgccgcttgaagatggacaagctcaccctgaagggcacctcctacgtcatgtgtaccgggagttttaagctggagaaggaggtggccgagacgcagcatggcaccgtgctggtccaagttaagtacgagggcaccgacgccccgtgtaagatccccttctccacccaggatgagaaaggtgtcactcagaatggccgcctcatcaccgccaaccctatcgtcactgacaaggagaagccggtgaacatagagaccgagccacctttcggggagagctacatcgtggtcggcgcgggcgagaaagccctgaagctatcctggttcaaaaagggcagctccatcggcaagatgttcgaggcgacggccaggggggcccggcgcatggccatcctcggggacaccgcgtgggacttcgggagcatcggcggggtgttcacctccgtggggaaactcgtccaccaggtattcggcaccgcctacggcgtgctcttcagcggcgtctcatggacgatgaagatcgggatcgggattttgctgacctggctgggcctcaacagccgatccaccagcctttccatgacctgcatcgccgtgggtatggtgaccctgtacttaggcgtcatggtgcaggcagactcaggttgtgtgatcaactggaagggacgggagctgaagtgcgggtcaggaatattcgtaacgaacgaggtgcacacgtggaccgaacagtacaaattccaagccgacagcccgaagcgcttaagcgcggccatcggcaaagcctgggaagagggcgtctgcggaatcaggtccgcaacccgcctcgaaaacatcatgtggaagcagattagcaatgagctgaatcacatcctgctcgagaacgacatgaagtttacggtcgtggttggagacgccaacgggatcttagtacaaggcaagaaaatgattagaccccagcccatggagcacaaatactcctggaagagctgggggaaggcgaagatcatcggagctgacatccagaacaccactttcatcatcgacggacctgacacccctgagtgccccgacgaccagagagcctggaacatctgggaggtagaagattacggtttcgggatctttacgacaaatatctggctgaagctcagagactcttacacccagatgtgcgaccaccgtctgatgagcgccgccataaaggattctaaggccgtgcatgccgacatgggctactggatcgagagcgagaagaacgagacctggaagctgtctcgtgccagcttcatagaagtcaagacgtgcacctggccaaagtcccacaccctctggagcaacggggtgctggagtcagagatgatcatccccaagatttacgggggcccgattagtcagcataactatcgccccgggtatttcacccagacggccggcccctggcatctgggaaagctagagttggacttcgacctgtgcgaaggcaccaccgtggtcgtggacgagcactgcggcaaccggggcccgtccctccgcaccacgaccgtcaccggaaagataatccacgagtggtgctgccgctcatgcaccctgcctcccctgcgctttaggggcgaggatggctgttggtacgggatggagatccgccctgtcaaggagaaggaagaaaacttggtccggtccatggtgagcgcaggcagcggcgaggtcgactccttctccctggggatcctgtgcgtatccattatgatcgaggaggtaatgcggagcagatggtccagaaagatgttgatgacgggcaccctggccgtgtttcttcttctgatcatgggccagctgacttggaacgacctcatccgcctgtgtatcatggtgggagctaatgcctcggaccgcatggggatgggcaccacgtacctggcccttatggcgaccttcaagatgcgccccatgtttgcggtggggctgctgttccggcgcctcaccagccgggaggtcctgctgttgaccatcggactgagcctggtcgcctccgtcgagctccccaactcactcgaggagctcggcgacggtctcgccatgggcatcatgatgctgaagcttctcacggagttccagcctcatcagttatggaccacattactcagtctgacgttcatcaagacgactttgagcctagattacgcctggaaaaccaccgcgatggcgctgtccatcgtttccctgttccccctctgtctatccaccacctcccagaaaacgacctggcttccagtcctactcggctccttcgggtgcaagcccctgacgatgttcctcatcaccgaaaacaagatctggggtcgcaagagctggcccctgaatgagggaataatggccatcggcatcgtctccatactgctctctagcctgctgaagaacgatgttcctctcgccgggccgttgatcgcgggaggcatgctgatcgcctgctacgtgatatccgggagctccgctgacctcagtttggagaaggccgccgaggtctcatgggagcaggaggcggaacacagtggaacctcccataacatcctagtggaggtgcaagacgacggaacgatgaagatcaaggacgaggaaaaggacgataccctaacaatcctgctgaaggcaacccttctcgccgtcagcggcgtgtacccgatgtctatccccgccaccctgtttgtgtggtacttctggcagaagaagaaacagcggagtggggtcctctgggacaccccctcaccgcccgaggtagagcgcgctgtactggacgacggtatatatcggatcctccaacgcggcctgctcgggcggagccaggtcggcgtgggtgtattccaggacggcgtcttccataccatgtggcacgtgacacgaggggcagtgctaatgtaccaaggcaagcggctcgagcccagttgggcctctgtcaagaaggatctcatttcgtacggcggtggctggcgattccaggggtcctggaacacaggcgaagaggtccaggtgatcgccgttgagccagggaagaacccgaagaacgtgcagaccacgcccggcaccttcaaaacgcccgaaggtgaagtgggggccatcgctctggacttcaagcccggcacatccggcagccccatcgtcaacagggagggcaagatcgtaggcctttacgggaacggcgtggtcactacctccgggacctacgtgtcagctatcgcccaggccaaggcctctcaggagggccccttacccgagatcgaggacgaggtctttaaaaagcgtaacctgaccatcatggacctccatccagggtcaggaaagacgcggcgctacctcccagccattgtccgtgaagcgatcaagcgtaaattgcggaccctgatcctcgcccccacccgagtggttgcaagcgagatggccgaggcactgaagggcatgcccatcagataccagaccacggcggtcaagtccgagcataccgggcgggaaatcgtagacctgatgtgccacgccactttcaccatgcgactcctgagtccggtgcgggtccctaactacaacatgattatcatggacgaggcccacttcactgatcctgcctccatcgcggcccgcgggtacatcagcaccagagttgggatgggcgaggctgcggccatcttcatgacggcgacgccgcctgggtccgtggaagcgttcccccagagcaacgcagtcatccaggacgaggagcgcgacatcccggagcgcagctggaatagcggctacgactggatcacggacttcccaggcaagaccgtgtggtttgtgccttccatcaagagcgggaacgatatcgctaactgcctacgcaagaacggaaagcgggtcatccagctctcccggaagaccttcgataccgagtaccaaaagacaaagaacaacgactgggattacgtggtgacgacagatatctctgagatgggagcaaacttccgcgcggaccgcgtcatcgacccgcggcgctgcttgaagcccgtgattcttaaagacggccccgaacgggtgatcctcgccggaccgatgcccgtcaccgttgcctccgccgcgcagcgcagaggccgcatcggccggaaccagaataaagagggggaccagtatgtctatatggggcagcccctgaataacgatgaggatcacgcccactggacggaggccaagatgcttctcgacaacatcaacaccccagaggggatcatcccggccctgtttgagcccgaacgggagaaatccgctgcgatagatggcgagtacagactgcgaggggaggctcggaaaaccttcgtggaactcatgagaagaggcgacctacccgtctggctgtcctacaaggtggcgtctgagggctttcagtactccgaccggagatggtgtttcgacggggaacggaataatcaggtgctcgaagagaacatggacgttgagatatggacgaaggagggggagcgtaagaagctgcggcctcgatggctggacgcccggacatatagcgacccgctagccctgcgtgagttcaaggagttcgcggccgggcggcgcagcgtctccggtgaccttattttggaaatcggcaaactcccccaacacctgacgctccgagcgcaaaatgccctggacaacctggtgatgctgcataacagcgaacagggcggcaaggcctacagacacgcgatggaggagctgcccgacaccatcgagacccttatgctcttagccctgatcgccgtgctgacagggggcgtcacgctattctttctgtcaggaaagggtctcggcaagaccagcatagggctcctgtgtgttatggcttctagcgcgctcctgtggatggcttctgtcgagccccattggatagccgcatctatcatcctcgagttcttcttgatggtcctcctgatcccggaaccggacagacaacgcacgccccaggacaaccaactcgcatatgtggtgatcggcctgctctttatgatcctcaccgtagcagccaacgagatggggctgttagaaacgaccaaaaaggatctcggcataggtcacgttgccgccgaaaaccaccagcacgccaccatgctcgacgtggacctgcgcccggcgtccgcctggaccctctatgcggtagcgacgaccgtgattacccccatgatgagacataccatcgaaaacacgaccgcgaacatcagcctgaccgcgatcgccaaccaggccgctatcctgatggggctcgacaagggctggcctatctccaagatggatatcggggtgcccctgttagcccttggctgctacagccaggtcaacccactaacgctgacggcggccgtgctcatgctagtggctcactacgccattatcggcccgggcctgcaggcgaaggcaacccgggaagcccagaagcgcaccgcagctgggataatgaaaaaccccacagtggacggcattgtagcgattgacctcgacccagtggtctatgatgcaaagttcgagaaacaactgggtcagatcatgctgctgatcctctgcacgtcccagatccttctaatgcgcacgacttgggccctgtgtgagagcattaccctggcaacgggaccactcactaccctatgggagggctctccgggcaagttctggaacaccacgatcgccgtgtccatggcgaacatcttccgaggctcctatctggcaggggccgggctcgcgttcagcctgatgaaatccctgggcggggggcgccggggaaccggggcccagggcgaaaccctaggggagaagtggaaaagacagcttaatcagcttagcaagagcgagtttaacacctacaagcggtctggtatcatggaggttgaccgctcagaagcgaaagagggtctcaagcggggcgagacgacaaagcacgcggtttcgcgcgggaccgccaagctgcgctggttcgtggagcgcaacctggtgaagcccgagggcaaagtcatagacctgggctgtggacggggcgggtggagctactactgcgcgggcctgaagaaggtaaccgaggtgaaggggtacaccaagggcggcccagggcacgaggagccgatcccgatggcaacctacggctggaatctggtcaagctgcactcagggaaggacgtcttcttcatgccccccgagaagtgcgacaccttactttgcgacatcggtgagtcttcccctaacccaaccatcgaggagggccgcacccttcgcgtgttaaagatggtggaaccctggctgcgcggcaaccagttttgcatcaagatcctgaatccatacatgcctagcgtggtggagacactcgagcagatgcagcggaagcacggcgggatgctcgtgagaaaccccctgtcgcggaacagcacccacgaaatgtactgggtgtcctgcggcacggggaatatagtgtcagccgtcaacatgacctcccgcatgctcctgaatcgcttcacgatggcacaccgcaagcccacctacgagcgcgacgtagacctgggagccggcactcggcacgtggccgtagagcccgaggtcccgaacctcgacatcatcgggcagaggattgagaacatcaagaacgagcataagtcgacatggcactatgatgaggacaacccctacaagacgtgggcctaccacggctcctacgaggtaaaacccagcggatccgctagctccatggtcaacggtgttgtaaggttgttaacgaagccgtgggacgtgataccgatggtgacccagatcgccatgaccgacacgacccccttcgggcaacagcgcgtctttaaggagaaggtggacacccggacaccgcgggccaagcgtggcacgacacaaattatggaggttaccgccaaatggttatggggcttcctgtcccgaaacaaaaagccgcggatttgcacccgcgaggagttcacacggaaggtgcgcagcaacgcggccatcggggcagtattcgtggacgaaaaccagtggaactccgccaaggaggccgtcgaggacgagcggttttgggacctggtgcacagagagcgggagctccacaaacagggaaagtgtgctacctgcgtatacaacatgatggggaagagggaaaagaaactgggcgaattcggaaaggccaaaggcagccgcgcaatttggtacatgtggctgggcgcacgcttcctcgagttcgaggctctgggtttcatgaacgaggaccactggttctcgcgggagaacagcctgtccggcgtggagggggagggcctacataagctagggtacatactccgcgacatcagcaagatccccggtggcaacatgtatgccgacgacactgccgggtgggacacccgaattacggaggacgatttgcaaaacgaagcgaaaatcaccgacataatggagcccggccatgcactgctggcgacctccatattcaagttaacgtaccagaataaggtggtacgagttcagcgccctgccaagaacgggacggtgatggatgtgatcagccggcgtgaccagcggggctccggccaggtcgggacctacggcctgaacaccttcacgaatatggaggtgcagttgatccgccagatggagtcagaggggatcttcctcccgtccgagctggaaacccctaacctggccgagcgggtcctcgactggctggaaaagcacggcgctgagcgcctgaagcgtatggccatatcgggtgacgactgtgtcgtgaagcccattgacgaccgctttgcgaccgcccttacagctttgaacgacatgggcaaggttcggaaggatatcccccagtgggagccgtccaaggggtggaacgactggcagcaggttccgttttgcagccaccacttccatcagctgatcatgaaggacgggcgcgagatcgtagtgccatgtcggaaccaggacgagctcgtcggccgcgcccgggtgtcccagggcgctggctggagcctgcgggagaccgcgtgtctggggaaatcctacgcgcagatgtggcagttgatgtacttccaccgtagggatctgcggctggccgcgaatgccatctgttcggcggtgcccgttgactgggtacctaccagccgcacgacctggtccatccacgcacaccaccagtggatgaccaccgaagacatgctaagcgtatggaaccgcgtctggatcgaggagaatccctggatggaggacaagacgcatgtttcctcatgggaggaggttccctatctgggcaagcgcgaggaccagtggtgcggctcactgattgggctcacagcccgcgccacctgggcgactaacatacaagtcgccattaaccaggtgcgacgcctgatcggcaatgaaaattatctggactatatgacgtccatgaagaggtttaagaacgagtccgaccccgaaggggccctctggtag

SEQ ID NO: 24078 - RNA, 9879 nt, synthetic construct
  misc_feature 1..9879: note = derived and/or modified CDS sequence (opt11) from DENV-1__GU131837__SS-prME
  source 1..9879: mol_type = other RNA
agcgtgaccatgctactaatgctgctaccaaccgcactcgcttttcatctcaccacccgcggcggggaaccccacatgatcgtgagcaagcaggaacggggcaagagcctgttgttcaaaacctccgcgggggtgaacatgtgcaccctgatcgccatggacctgggggagctctgcgaggacacaatgacctataagtgtccccgcataaccgaggccgagcccgacgacgtggactgttggtgcaacgctaccgacacctgggtcacctatggaacctgcagccagactggcgagcaccgccgcgacaagcgctccgtggccctggcgccccacgtgggcttgggtcttgagacgcgcaccgaaacctggatgagtagtgagggcgcatggaaacagatccagcgggtggaaacttgggccctgcgccaccccggcttcacggtgatcgccttattcctcgcgcacgccatcgggacgagcataacccagaagggaataatcttcatcctgctgatgcttgtgaccccctccatggccatgcggtgcgtcggcatagggaaccgagattttgtcgagggtctgagcggggccacgtgggtcgacgtggtactagagcacgggtcctgcgtgacgaccatggccaagaacaagcccaccctggacatagaattactgaagacggaggtcactaaccccgcagtcttgcggaagctatgcatagaggcaaagattagcaatacaaccaccgattcccggtgcccgacccagggcgaggccaccctggtggaggagcaggacgccaacttcgtctgccggcgtaccttcgtggaccggggatgggggaacggctgcggcctgttcggcaaggggagcctgctgacctgtgccaaattcaagtgcgtgaccaagctcgagggcaagatagtccagtacgagaacctgaagtactccgtcatcgtgaccgtccacactggggaccagcaccaggtagggaacgagaccaccgagcacggtaccatcgcgaccatcactccccaggcccccacgagcgagatccagctgaccgattacggggccctcaccctggactgttcgccccgcaccggcctggacttcaacgagatggtcctcctgacgatgaaggaaaagtcgtggctggtgcacaagcaatggttcctcgacctgccgctgccctggacctcaggggccagcaccagccaggagacttggaaccggcaggacctcctggtgacgtttaagaccgcccacgccaagaaacaggaggtagtggtgctgggctcccaggagggcgccatgcacaccgcccttaccggagccacggaaatccagaccagcggcacaaccaccatcttcgccgggcacctgaagtgccgcttaaagatggacaagttaaccctgaagggcatgtcctacgtcatgtgcaccgggagcttcaagctggagaaggaggtggcggagacccagcacggcacggtgctggtccaggtgaagtacgagggcaccgacgccccctgcaagatccccttctctacccaggatgaaaagggtgttacccagaacggccggctgatcacagccaacccgattgttaccgataaggagaagcccgtgaacatcgagaccgagccgcccttcggggaatcttatatcgtggtcggggccggcgagaaagcgctgaaattaagttggttcaagaagggaagctcgatcggcaagatgttcgaggctaccgccagaggggcccggcgtatggcaatcctcggcgacacggcgtgggatttcggcagcataggcggcgtgttcaccagtgttgggaaattagtccaccaagtgttcgggacggcctacggggtgctgtttagcggagtctcctggaccatgaagatcgggatagggatcctcctcacgtggctggggctcaattcccgcagcacttcactgtcgatgacctgcatcgccgtggggatggtgaccctgtacctcggcgtcatggtccaggcagatagcgggtgcgtgatcaactggaaaggacgggagctgaagtgcgggtccggcatcttcgtcacaaacgaagtgcacacctggaccgagcagtacaaatttcaggcggatagcccaaagagactgagcgcggcaatcgggaaagcctgggaggaaggggtgtgcgggatccggtccgcaacccgcctcgagaacatcatgtggaaacagatcagcaacgagcttaaccacatcctgctcgaaaacgacatgaagttcaccgtcgttgtgggggacgccaacggcatcttagcgcagggtaagaaaatgatccggccccagcccatggagcacaagtactcctggaagtcctgggggaaagccaaaatcatcggcgccgacatccaaaacacgaccttcatcattgacgggcccgacaccccggaatgcccagatggccagcgcgcatggaatatttgggaggtcgaggactacgggttcggcatcttcaccactaacatatggctgaaacttcgggattcgtacacccagatgtgcgaccaccgcctcatgtcagcggcaatcaaagactccaaagccgtgcacgccgatatgggttattggatcgagagcgaaaagaacgagacctggaagttggcacgggcgtccttcatcgaggtgaagacctgcacgtggcctaagagccataccctctggtccaacggagtcttagaatccgagatgatcatcccgaaaatatatggcgggcccatatcccagcacaactaccggcccggctacttcacccagaccgccgggccctggcacctgggaaagctcgaactggactttgacttgtgcgaaggcacgaccgtagtagttgacgagcattgcgggaaccgcggacccagcctccgtacgaccacggtaacggggaagatcatccacgagtggtgctgccggtcctgcacactaccgccgctgcggttccggggcgaggacgggtgctggtacggcatggagattcgacccgtcaaggaaaaggaggagaacttagtcaggtcgatggtgtccgccggcagcggcgaggtggacagctttagtctgggtatcctgtgtgtcagcatcatgatcgaagaggtgatgcgctccagatggagccgcaaaatgctaatgaccgggaccctggccgtgttcctgctcctgatcatgggccagctgacctggaatgacctcatccgcttatgcatcatggtcggtgccaacgcgtccgaccgcatgggcatgggtaccacctacctggccctcatggccacgttcaagatgcgcccgatgttcgccgtggggttgctgttcaggcgactcacgtccagagaagtcctgctgctcaccatagggctgtccctcgtcgccagcgtggaactccccaactcactggaggagctgggagacggcctcgcgatgggcatcatgatgctgaaactgctgaccgagttccagccccaccagctgtggacgaccctattaagcctgacgtttgtcaagaccacgctgagtcttgactacgcttggaagaccacagccatggtgctgagcatcgtgtcgctgtttcccctctgcctgagcacaacgtcccagaagaccacctggctgccggtgctactagggtcattcggatgtaagcccctaaccatgttcttgatcactgagaacaagatctgggggcgcaagtcctggccactgaacgagggtatcatggccattgggatagtgtctatcctgctctccagcctacttaagaatgacgtcccccttgcggggccgttgatcgccggcgggatgctgatcgcctgttacgtcataagcggctccagcgccgacctctccctggaaaaagccgcggaggtgtcatgggagcaggaggccgaacattccggggccagccacaatatccttgtggaggttcaggacgacggcactatgaagatcaaggatgaggagcgtgatgacacactcaccattctgctcaaagccacgctcctcgccgtctccggggtgtatcccatgagcattcccgcaactctcttcgtctggtacttctggcaaaagaagaagcagcgctccggcgtactatgggatacccccagcccaccggaggtcgagcgggccgtcctggacgacggcatttatcgcatcttgcagcgggggctgctcggccgctcccaggtaggcgtgggagtgttccaggacggtgtcttccacaccatgtggcatgtgacccgtggcgccgtactgatgtaccagggcaagagattggagccgagctgggcctccgtgaaaaaggacttgataagctatgggggtggatggcggttccaggggtcctggaacacgggagaggaggtgcaggtcatcgccgttgagcccggcaagaacccgaagaacgtgcaaaccaccccaggaacattcaagacccccgagggcgaggtcggtgcgattgccctggacttcaagccagggaccagcggttccccaatcgtgaaccgcgagggcaagatagtggggttgtacggcaacggcgtcgtgacaaccagcggcacgtacgtgtccgcaatcgcccaggccaaggctagccaggaggggcctctccccgagatcgaagatgaggtcttcaagaagcggaatctgaccatcatggacctgcaccctggcagcggcaagacacgcagatacctccccgccatcgtgcgcgaagccatcaagcggaaactccgcactttaatactcgccccgacgagggtggtcgcgtccgagatggccgaggcccttaagggaatgcccattcgttaccagaccaccgcggtcaagagcgagcacaccggccgcgagatcgtggacctgatgtgccatgcgacgttcaccatgcggctcctctcccctgtcagggtgcccaattataacatgattatcatggatgaggcgcacttcaccgacccggcctcaatcgccgcacgaggctacatcagcacccgcgtgggcatgggtgaggccgcggccatattcatgactgccaccccgccaggcagcgtcgaggccttcccgcagtccaacgccgttatccaggatgaggagcgggacatacccgagcgcagctggaactccggctacgattggatcaccgacttcccagggaagaccgtgtggttcgtccccagcattaagtccggtaatgacatcgcgaactgcctgcggaagaatggcaagagagtgatacagctgagccggaagacattcgacaccgagtaccagaagaccaagaacaacgactgggactacgtggtcacgacagacatctccgagatgggcgccaacttccgcgccgaccgggtgattgacccgcggcggtgcctgaagccggtgatcctgaaagatgggcccgagcgggtcatactcgcaggccccatgcctgtgaccgtcgcgagcgccgcccagcggagaggccgaatcgggcgtaatcagaacaaggagggcgaccagtacgtatacatggggcagcccttgaataacgacgaagatcacgcccattggaccgaggctaaaatgctgctcgacaacataaacacaccggaaggtatcatcccggctctttttgagcccgagcgtgaaaagagcgccgccatcgacggggagtaccgccttaggggcgaggcacggaaaacgttcgtagagctcatgcgccgtggcgacctgcccgtctggctgagctataaggtggccagcgaggggttccagtacagcgatcgccgttggtgtttcgacggcgagcgcaacaaccaggtgctcgaggagaatatggacgtagagatctggaccaaagagggggagcggaaaaagctgcgcccccggtggctggatgcgcggacctactccgacccgttagctctccgggagttcaaggagttcgcggcgggccgccggtctgtgagcggcgacctgattctcgagatagggaagctgccccaacacctcacgctcagggcccagaatgcgctagacaacctggtgatgctccacaacagcgagcaaggcgggaaagcctaccggcacgccatggaggagctgcccgacaccatcgaaacccttatgctcctggccctaatagctgtcctcacgggtggggtgaccttattcttcctgagcgggaaggggctcgggaagacctccatcggcctgctgtgcgtgacggccagctcggccctcctgtggatggccagcgtcgagccacactggatcgcggcctccatcatccttgagttctttctcatggtgctgctgatcccagagcctgaccgccagcggaccccacaggacaaccagttagcctacgtggttatcgggctgctgttcatgatcctcacagtggcagccaacgagatgggcctgctggagaccactaagaaggacctcggaatcggctacgtggccgcggagaaccaccagcacgccaccatgctggacgtcgacctgcgcccggcaagcgcctggacgttatatgccgtcgcgaccactgtgatcacgcccatgatgcggcacactatcgagaacacgaccgccaatatctcactgacagccatcgccaatcaggccgctatcctgatgggcctcgacaaggggtggcccatcagcaaaatggacataggcgtccccctgctggccctcggttgttatagccaggtgaaccccctgacgttaaccgccgccgtgctgatgctggttgcgcactacgcgatcatcggcccagggctgcaggccaaggctacccgggaggcccagaagcgcaccgcggccggcatcatgaaaaaccccaccgtagacggcatcgtagccatcgacctcgaccctgtcgtctatgacgccaagttcgagaagcagctggggcagatcatgctgctcattctgtgcaccagtcagattctgctcatgcgaacgacctgggctctatgcgaatccattactctagcaaccggccccttaacgaccctgtgggaggggagccccggtaagttctggaacaccacaattgccgtgtccatggccaacatcttccgcggcagctacctggccggggccggcctcgcgtttagcctgatgaagtccctcgggggcggtcgccgcggaacgggcgcccagggtgaaaccttgggcgagaagtggaagcggcagctgaaccaattgtctaagtcagagttcaatacctacaaacgaagcgggatcatggaggtcgatcggtccgaagcaaaggagggcctcaaacgcggggagactaccaagcacgccgtgagccggggcactgcgaagctgaggtggttcgtggaaagaaacctggtaaaacccgagggcaaggtcatcgacctggggtgtggcagagggggctggtcctactactgcgctggactcaagaaggtgaccgaggtgaagggctacaccaagggagggccaggccacgaggaacctatcccgatggccacttatggatggaacctggtgaagctgcacagtggcaaggacgtgttcttcatgccgcccgagaaatgcgacacgctcctgtgcgacataggggaatccagccccaaccccactatcgaggagggccggaccctgagagttctcaagatggttgaaccctggctgcggggcaatcagttctgtattaagatcttgaacccctacatgccgagtgtggtcgagaccctcgagcagatgcagcgcaagcacgggggtatgctggtgcggaatccgctgtccaggaactccacgcatgagatgtattgggtgtcttgcgggaccggcaacatcgtctccgccgtcaacatgacaagccggatgctcctgaaccggttcaccatggcccaccgcaagcctacgtacgagcgggatgtggacctgggcgcagggacccgacacgtcgcagtggagcctgaggaagcaaatctcgacataatcggccagcgaatcgagaacatcaagaacgagcacaagtccacctggcattacgacgaagacaacccgtacaagacctgggcctatcatgggagctacgaggtaaagccttccggctccgcatccagcatggttaatggggtcgtcaggctactaacaaagccctgggacgttatccccatggtgacccagatcgcgatgaccgacactacgcctttcggccagcagcgcgtctttaaggagaaggtggatactcgcacgccccgggcgaaacgcggcacaacccagattatggaggtgaccgccaagtggctatggggtttcctgtcacggaacaagaagccccgcatctgcacccgggaggagttcaccagaaaggtccggagcaacgcggccatcggagcagtcttcgtggatgaaaaccagtggaacagcgccaaggaggctgtcgaggatgagcggttctgggacctcgtgcaccgggagcgcgagctccacaagcaggggaaatgcgccacatgcgtgtataatatgatgggcaagcgggagaagaagctgggtgagttcgggaaagcgaagggctcgcgagcgatctggtacatgtggctcggggcacggtttctcgagttcgaagctctcggtttcatgaacgaggaccattggtttagccgagagaactccttaagcggggtggagggcgagggactccataagctaggctatatcctgcgggacatttccaagattccgggcgggaacatgtacgccgacgacaccgccggctgggacacccgcatcacggaggacgacctccagaacgaggcaaagatcacggacattatggagcccgagcacgccctgctggctacctccatatttaagctcacttaccagaacaaagtagtgcgcgtccagcggcctgccaaaaatgggaccgtcatggacgtgatctcccgccgggaccagcgcggaagcggacaggttggaacttacgggctgaacacctttaccaatatggaggtacagttgattcggcagatggagtcggaaggtattttcctcccctctgaattagagactcctaacctggctgagcgcgttctcgattggctagagaagcacgggactgaacgactgaaaagaatggctatctccggggacgattgcgtcgtgaagcccatcgatgacaggttcgccaccgccctgacagcgctgaacgacatgggcaaggtgcgcaaagacatcccccagtgggagccgtctaagggttggaacgactggcagcaggtcccgttctgctcccatcacttccaccagctcatcatgaaggacgggcgggagatcgtggtgccctgcagaaaccaggacgagctcgtgggccgggcgcgcgtaagccagggtgccggctggtcccttcgggagaccgcgtgcctgggcaagtcttacgcccagatgtggcagctcatgtatttccacagacgggacctgcgcctggccgcgaacgccatctgctccgccgtgcccgtcgactgggtgcccaccagtcggacgacctggagcatccacgcccaccaccagtggatgaccactgaggacatgctctccgtgtggaacagagtctggatcgaggagaacccttggatggaggacaagacgcacgtgagcagctgggaggaggtgccctacctgggcaaacgcgaggaccaatggtgcggcagcctgatagggctcaccgctcgggccacctgggccaccaacatccaggtcgcgattaaccaggtgagacggctcataggcaacgaaaattacctggactatatgacgtctatgaagcgctttaagaacgagagcgaccctgagggggccctctggtga

SEQ ID NO: 24079 - RNA, 9879 nt, synthetic construct
  misc_feature 1..9879: note = derived and/or modified CDS sequence (opt11) from DENV-1__JN819415__SS-prME
  source 1..9879: mol_type = other RNA
agcgttaccatgttgctcatgctactgcccaccgccctagcctttcacctgacgacaagaggcggggagccacacatgatcgtgagcaagcaagagagaggcaagagtttgctgttcaagacctctgccggggttaacatgtgcaccctgatcgccatggatctgggcgaactctgcgaggacacgatgacctacaagtgcccccgcatcaccgaagccgaacccgacgacgtggactgctggtgcaacgccacggacacgtgggtgacatacgggacctgcagccagaccggcgagcatcggcgcgataaacggtctgtggcactggcgccccatgtaggtctggggctcgaaacgcgcaccgagacctggatgagctccgagggcgcatggaagcagatccaacgggtcgagacttgggccctgcgccaccccgggttcacggtgaccgcactgttcctcgcgcacgccatcggcaccagcattacccagaaggggattatcttcatcctgctgatgctcgtgacgccctccatggctatgaggtgcgttggaatcggcaatcgagacttcgttgaggggctgagcggcgccacctgggtggatgttgtgctggaacatgggtcctgcgtcaccaccatggctaagaacaagcccacgctcgacatcgagctgctgaagaccgaagttaccaatcccgctgtcctccggaagttatgcatcgaggccaagatcagcaacaccacgaccgactcccgctgtcccacccagggggaggccaccctggtagaggagcaagacgcgaacttcgtctgccggcgaaccttcgtggaccggggctgggggaacggctgcggcctctttggcaaggggtcgctgctgacctgcgccaagttcaaatgcgtgaccaagctcgagggtaagatagtccagtacgagaacctcaagtactccgtgatcgtcaccgtccacacgggcgaccagcatcaggtgggtaacgagaccaccgagcacggcaccatcgcgaccatcacgccccaggccccgacttcagaaatccagctgaccgattacggggcactcaccctggactgcagcccccggacgggcctggattttaacgagatggtccttctgaccatgaaagagaaatcctggctggtgcacaaacagtggttcctagacctgccgctgccctggacctccggcgccagcaccagccaggagacgtggaaccggcaggacctgctggtgacctttaagaccgcccacgcgaaaaagcaggaggtcgtagtgctgggctcccaggagggcgccatgcacaccgccctcacgggggccaccgagatccagacctcaggcaccacgaccatcttcgccgggcacctgaagtgccgcctgaagatggacaagctcactcttaaaggcacctcctacgtcatgtgcacggggagcttcaagctggagaaggaggtggcggagactcagcacggcaccgtgctggtccaggtgaagtacgagggcacagacgccccctgcaagatccccttctcgacgcaggatgagaagggggtgactcaaaacggacggctcatcaccgcgaacccgatagtcacagacaaagagaaacccgttaacatcgagacggaaccgcccttcggggagagctacatcgtcgtcggcgccggggagaaagcactgaagctgtcctggttcaaaaaggggagctcgatcgggaagatgttcgaggccaccgcccgaggggcccgacgcatggccatcctcggcgacaccgcatgggacttcgggagcatcggcggcgtgttcacctccgtggggaaactggttcaccaggtgttcggcacggcctacggggttctgttcagcggcgtctcctggacaatgaagatcggaatcggcatcctcctgacctggctgggtctcaacagtcgctctactagcctgagtatgacgtgtatcgccgtggggatggtgaccctatacctcggcgtcatggtgcaggccgatagcggttgcgtgatcaactggaagggccgggaactgaagtgcgggtccggcatcttcgtcacaaacgaggtacacacctggaccgagcaatacaagttccaggctgacagcccgaagcgcctgagcgcggccatcggcaaggcttgggaggagggagtgtgcgggatcagatccgccacgcgcctcgagaacatcatgtggaagcagattagcaacgagctgaaccacatcttgctcgagaacgacatgaagttcaccgttgtggtgggcgacgccaacgggatcttagcgcaggggaagaagatgatccggccccagcccatggagcacaaatactcatggaagtcctggggcaaggcaaagatcatcggcgctgacatccagaacaccacatttataattgacgggcccgacacgccggagtgccccgatgaccagcgcgcctggaacatctgggaggtcgaggactacgggttcggtatcttcaccacaaacatctggttgaagctccgagactcttacacccagatgtgcgaccaccgtttgatgtccgcagccatcaaggactccaaggccgtgcatgcggacatgggctactggatagagagcgaaaaaaacgagacttggaagctggcccgggcctcgttcatcgaggtgaagacctgcacctggcccaagagccacaccctctggtccaacggcgtactggagtcggagatgatcatccccaagatctacgggggccccatctcccaacacaactaccgccccgggtacttcacacagaccgctggcccctggcacctggggaagctcgagctggacttcaacctgtgcgagggcaccactgtagtggtcgacgagcactgcggcaatcgaggtccgagcctgaggacgaccacagtgacgggtaagatcatccatgagtggtgttgtcggtcctgcaccctaccgcccctgcgcttccgcggggaggacggctgctggtacggaatggagatacgccccgttaaagaaaaggaagagaatctcgtccgttcaatggtttccgccggcagcggcgaggtggacagcttctccctggggattctttgcgtcagcatcatgatcgaggaggtgatgcgcagccggtggagccgcaagatgctcatgaccggtaccctggccgtcttcctgctcttaatcatggggcaactgacgtggaacgacctcatccgcctgtgcatcatggttggcgccaacgcgtccgaccggatggggatgggcacgacctacctggccctcatggcgacattcaagatgcgccctatgttcgcggtgggcttgctcttccggcgcttaacctcaagagaggtgctgctgctcacgattgggctgtccctggtcgcctctgtggagctccccaattcactggaggagctgggcgacgggcttgcgatgggcatcatgatgctcaagctgctcaccgaattccagccgcaccaactctggacaaccctgctctccctgacattcatcaagaccaccctatccctcgactacgcctggaagacaacggccatggctttgagcatcgtttccctattccccttgtgcctgagcaccacctcccagaagaccacatggctgccggtgctcttggggagcttcgggtgcaagccgctcacgatgttcctcatcaccgagaacaagatctggggccgcaagtcctggcccctgaatgagggaatcatggcgatcggcatcgttagcattctgctctccagcctgctgaagaacgacgtccccctcgcggggcccctgatagccggcggcatgcttatcgcctgctatgtgataagtgggtccagcgccgacctctctctggagaaagcggccgaggtgagctgggagcaggaggccgagcactccggaaccagccacaacatcttggtcgaagtgcaggacgacggcacaatgaagatcaaggatgaggagaaagacgacacgctcaccatactgttaaaggccactctcctagccgtgtccggcgtctaccccatgtccatccccgcgactctgttcgtgtggtacttctggcagaagaagaagcagcggtccggggtgctctgggacacgcccagcccgccagaagtcgagcgcgccgtgctggacgacggcatctaccggatcctgcagcgcggcctccttgggcggtctcaggtgggcgtcggtgtgttccaggatggtgtgttccacactatgtggcacgtgacccgcggggccgtgctcatgtaccaagggaagcggctggagccctcctgggcgtctgtgaagaaggatttgatcagttacggcgggggctggcgcttccagggctcctggaacaccggcgaggaggtccaggtgatagccgtggagcccgggaagaaccctaagaacgtccagacgacccccggcaccttcaagacgcccgagggcgaggtgggggcgatcgcccttgacttcaagccaggcacaagcgggtcgccgatcgtgaatcgggagggtaagatcgtcggtctgtatgggaacggcgtggtgaccaccagcggcacctacgtctccgccatcgcccaagccaaggcgtcgcaggaaggcccccttcccgagatagaggacgaggtgttcaagaagcgcaatcttacaatcatggatctgcaccccgggagcggaaagacccgccgctaccttcccgccatcgtgcgggaggcaatcaagcgcaagctgcggaccttaatattggccccgacccgcgtcgtggcatccgagatggccgaggccctgaagggtatgccgatccgataccagacgaccgcagtcaagagcgagcacaccgggcgggagatcgtcgacctgatgtgccacgctacgttcacgatgcgcctcctgtcaccagtgcgggtgccaaactacaacatgatcataatggatgaggcacacttcaccgaccccgccagtatcgccgctcgcggctacatctccacccgggtcgggatgggcgaggctgcggccatcttcatgaccgcaacgccgcccgggagcgtggaggccttccctcagtccaatgccgtgatacaggacgaggaacgcgacatccctgagcggagctggaactctggctatgactggatcactgacttcccgggcaagaccgtctggttcgttccgagcatcaagtccgggaacgacatcgcgaactgcttgcgcaagaacggcaagcgggtaatccagctcagccgcaagacctttgacacggagtaccagaagactaagaacaacgactgggactacgtggtgaccacagatatctccgagatgggggccaacttccgagcggatcgcgttatcgaccctcggcgctgcctgaagcccgtcatcctgaaggacggccccgaacgggtgattttagccggtccgatgcccgtgacggtcgcgagcgcggcccagcgacggggccgcatcggccggaaccaaaacaaggagggggaccagtacgtgtacatgggccaacccctgaataacgacgaggaccacgctcattggacggaggccaagatgctgctcgacaacatcaatacacccgaggggatcatcccggcgctgttcgagcccgagcgcgagaaaagtgccgccatagacggagagtaccgcctgcgcggggaggcccgcaagacctttgtcgagctcatgcggcgcggcgacctacccgtgtggctgagctacaaggtcgcctctgagggcttccagtactccgaccggcgatggtgcttcgatggggagcggaacaaccaggtgctcgaggagaacatggacgtggaaatctggacgaaggagggcgagaggaaaaagctgcggccccgctggctggacgcgcggacgtactccgatccacttgctctgagagagttcaaggagttcgcagcagggcggcgaagcgttagcggcgacctgatactcgagatcggcaaactcccccagcacctaaccctccgggcccagaacgcgttagacaacctggtcatgctccacaactcagagcagggcgggaaggcctatcgccatgccatggaggagctgcccgacaccatcgagaccttgatgcttctggccctgatcgcggtactcaccggcggggtgaccctattcttcctgagcgggaaggggctcggcaagacctccatcgggctgctgtgtgtgacagccagcagtgccctcctgtggatggccagcgtggagccccattggatcgccgcgtctatcattctggagtttttcctcatggtgctgctgatcccggagcccgaccggcagcgcacgccccaggacaaccagctcgcctacgtcgtgatcggcctgctattcatgatcctcacagttgccgccaacgagatgggactgctagagaccaccaagcgggacctcggcatcgggcacgtcgccgctgaaaaccaccagcacgccactatgctggatgtagacctgcgccctgccagcgcctggacattatacgccgtggcgaccaccgtgatcacgcccatgatgcgtcacaccatcgagaacacaacagctaacatctccctaacggccatcgccaaccaagctgctatcctgatgggcctcgacaagggctggccaatcagcaagatggatattggggtgccgctactggccctcggctgctactcccaggtcaacccgctgaccttgaccgccgccgtcctcatgctggtggcgcactacgccatcatcggacccgggttgcaggccaaggctacccgcgaagcgcagaagcgaacggccgccgggatcatgaagaaccccactgtggacgggatcgtggcaattgatctcgaccccgtggtttacgacgccaagttcgagaagcaactgggccagatcatgctgctcatcctctgcaccagtcagatactgcttatgcgcaccacttgggccctgtgcgagagcatcaccttggcaaccgggccgctcaccacgctgtgggagggctcgccgggtaagttctggaacaccactatcgcggtttccatggccaacatattccggggcagctatctggccggcgccgggctcgcgttctccctgatgaagtccctgggcgggggccggcgggggaccggcgcccagggagagacactcggggagaagtggaagcggcagttaaaccagctatccaagagcgagttcaacacctacaagcgcagcggcatcatggaggtggaccggtccgaagccaaggaggggctgaagaggggagagaccaccaagcacgccgtttctcgtgggaccgcgaagcttcgatggttcgtcgaaagaaatctggtgaagcccgagggcaaggtgatcgacctgggctgcgggcgcggcgggtggtcgtattactgcgccggactaaagaaagtcacggaggtgaaggggtataccaagggcggaccggggcacgaagagccgatccccatggccacctacggctggaacctggtgaagctgcacagcgggaaggacgtcttcttcatgccgcccgagaagtgcgataccctcctctgcgacattggcgagtccagccctaacccaacgatagaggaaggacggaccctgcgggtgctcaagatggtggagccgtggctgcggggcaaccaattctgcataaagatccttaacccctacatgccgtccgtcgtggagaccctcgagcagatgcagcgcaaacacggtggcatgctggtgcggaaccctctgagccgcaactccacccacgaaatgtactgggtctcgtgcggcacggggaacatcgtaagtgcggtgaacatgaccagccggatgctcctgaaccgctttaccatggcccacaggaagcccacctacgagcgagacgttgacttgggcgcgggcactcgccatgtggctgtggaaccagaggtcgctaatctcgacatcatcgggcagcgcatcgaaaacatcaagaacgagcataagtccacctggcactacgacgaggacaacccgtacaaaacctgggcctaccacggcagctacgaggtgaaaccctccgggagcgcctcctccatggtgaatggcgtcgtgcgcctcctgaccaagccctgggacgtcatccccatggtgacgcagattgcgatgacagacaccactccgttcggccagcagcgggtgtttaaggagaaggtcgacacccgcacgccccgggctaagcgcggcaccacccaaatcatggaggtgacggcaaagtggctctggggcttcctgtctcggaacaagaaaccccgcatttgcacccgcgaggagttcaccaggaaggtgcggagcaacgccgccattggggcggtttttgtggacgagaaccagtggaatagcgccaaggaggccgtggaggacgagcgattctgggacctcgtccaccgagagcgcgagttacacaagcagggtaagtgcgcgacctgtgtgtacaatatgatggggaaacgggagaagaagctgggggagttcgggaaggctaagggctcccgcgccatctggtacatgtggctaggggcgcggttcctcgaattcgaggccctggggttcatgaatgaggaccactggttctcccgcgagaactccttgagcggcgtggagggggaaggtctccataagctagggtacatccttcgggatatctccaagattccaggcggcaacatgtacgcggatgacacggcgggatgggacacccgcattacggaggacgacttgcagaacgaagccaaaatcacagacatcatggagcccgaacatgccctgctggccacgagcatcttcaagctcacttatcaaaacaaggtcgtgcgggttcagcggcctgccaagaacggcactgtaatggacgtgatcagccgacgggatcagcgcggcagcggccaggtgggcacctatgggctgaatacgttcaccaacatggaggtccagcttatccggcagatggagtccgagggcatcttcctccccagcgagctggagaccccgaacctggctgagcgcgtactcgattggctggaaaagcacggggcagaacggctcaagcgcatggccatctccggtgacgactgcgtcgtcaagcccatcgacgaccggttcgcaaccgctctcactgccctaaacgacatggggaaggtgcgcaaagacataccccagtgggagcccagtaagggctggaacgactggcagcaggttcctttttgttcccaccacttccaccagctgattatgaaggacggcagagagatcgtcgtgccctgccggaaccaagacgagctcgtcgggcgagcacgcgtcagccagggcgccggatggtcccttcgagagacggcctgcctgggcaagagctacgcccagatgtggcagctcatgtactttcaccgacgggacctgcgcctggcggccaacgccatctgctccgccgtgccagtggactgggtccccaccagccggaccacctggagcatacacgcccaccaccaatggatgacgactgaggacatgttatcagtgtggaaccgcgtgtggatcgaggagaacccgtggatggaggataaaacccatgtcagctcctgggaggaggttccgtaccttgggaagcgcgaggatcagtggtgcggctccttgatcggcttgaccgcccgggccacgtgggctaccaacatccaggtggccatcaaccaggtccgccggctgatcgggaatgaaaactacctggactatatgacctccatgaagcgcttcaagaacgagagcgaccccgaaggcgcgctctggtga

SEQ ID NO: 24080 - RNA, 9879 nt, synthetic construct
  misc_feature 1..9879: note = derived and/or modified CDS sequence (opt11) from DENV-1__GU131838__SS-prME
  source 1..9879: mol_type = other RNA
agcgtgacaatgctgctcatgttattacccaccgccctcgcattccacttaaccacacgcggtggggaaccccacatgatcgtgagcaagcaggagaggggcaagtctctcctgttcaagactagcgccggtgttaatatgtgcaccctgattgctatggacctgggggaactgtgcgaggacaccatgacctacaagtgccctcgtatcactgaggcggagcctgacgatgtggactgctggtgcaacgccaccgacacctgggtgacctacgggacatgctcgcagacaggcgagcacagacgcgagaagcggtccgtggccctggcaccccacgtgggcctggggctcgagacccgcaccgagacctggatgagctccgagggtgcatggaagcagatccagcgggtcgagacctgggccctgcggcaccccgggttcaccgtgatagccttcttcctagcgcacgccatcggcaccagcataacccagaaggggatcatatttattctactgatgttggtgaccccgtccatggccatgagatgcgtcggcatcgggaatagagacttcgtggagggtctaagcggcgctacgtgggtggatgtcgtgctagagcatgggtcctgcgtgaccacgatggccaagaacaagcccaccctggacatcgagctcttaaagacggaggtcaccaaccccgcagtgttgcgcaagctctgcatcgaggccaagatcagcaacaccaccacggactcccgctgcccgacccaaggcgaggccaccttagtggaggagcaagatgcaaacttcgtctgccggcgcactttcgtggacagaggctgggggaacggctgcgggctgttcggcaagggctctctcctgacgtgcgctaagttcaagtgtgtgaccaagctggagggcaagattgtccagtacgagaacctcaagtactccgtgattgtaaccgtccacactggcgaccaacaccaggtggggaacgagacgaccgagcacgggaccattgcgaccatcacccctcaggcccccacgagcgagatccagctgaccgattacggggcgctgaccctagactgtagccccagaactggcttagactttaacgagatggtcctgctcacgatgaaggaaaagagctggttggtgcacaaacaatggttcctggacctcccgctgccgtggacatccggggctagcacgagccaggagacctggaatcggcaagatctgttagtaacgtttaagaccgcccacgcgaagaagcaggaggtcgtagtactgggctcccaagagggcgccatgcacaccgctttgaccggggcgacggagatccagaccagcggaaccaccacgatcttcgccgggcacctcaaatgccgcctgaagatggacaagctaaccctcaagggcatgtcctacgtcatgtgcaccgggtcattcaagctggagaaggaggtggcggagacccagcacggcacggttctggttcaggtgaagtacgaaggcaccgacgccccctgcaagatcccattctccacccaagacgagaaaggggtgactcagaatggccggctgatcacggctaatccgattgtcaccgacaaggagaaacccgtcaacatcgagaccgagccgcccttcggcgagagctacatagtggtcggcgccggggagaaggcgcttaagctgtcctggttcaagcgcggtagctccatcggcaagatgttcgaggccacagcccgcggggcccgcaggatggccatcctgggcgacacagcttgggacttcgggagcatcggcggcgtgtttacctccgtggggaaacttgtccaccaggtcttcggcacggcctacggggttctcttcagcggcgtctcctggaccatgaagatcggaataggtatcctgctcacgtggctgggcctgaatagccggtcgacgtccctcagcatgacttgcatcgccgtcgggatggtgacactatatctgggcgtcatggttcaagccgactctgggtgcgtcatcaactggaagggccgcgagctcaaatgtgggtccggcatcttcgtcacgaatgaggtgcacacgtggaccgaacagtacaaattccaggccgacagtcccaaacggctgtcggcggccatcggtaaggcatgggaggagggtgtttgcggcatccgcagtgccactcggctagagaacatcatgtggaagcaaatctctaacgagctcaaccacatcctgctggaaaacgacatgaagttcaccgtcgtagtgggggacgccaacggcatcctggcgcaggggaagaagatgatccgcccccagccgatggagcacaagtactcctggaagtcctggggtaaggcgaaaatcatcggcgctgacatccaaaatacgactttcatcatcgacggccccgacaccccggagtgtcccgacggacagcgggcctggaacatctgggaggtcgaggattacggtttcggcgtgttcaccactaacatctggctgaagttacgagactcctacacgcagatgtgcgaccaccggctcatgagcgctgccatcaaagactccaaggccgtgcacgccgatatgggctactggatcgagtccgaaaagaacgagacctggaagctggcccgcgcgtctttcatcgaggtcaaaacatgcacctggcctaagtctcacaccttatggtccaacggggtgctcgaaagcgagatgataatccccaaaatctatggagggccaatctcccagcacaattaccggcccggctactttactcagactgccgggccctggcacttaggcaagctggaactcgacttcgatctgtgcgagggcacgaccgtagtcgtggacgagcactgcgggaaccgcggaccctccctccgcaccaccacggtcaccgggaagatcatacacgagtggtgctgccgctcctgcaccctgccgcctcttcggttcaggggcgaggacggttgttggtacggcatggagatccgtcccgtcaaggagaaggaggagaacctagtccgcagcatggtgtctgccggatcaggggaggtagacagcttctccctcggcattctgtgtgtgagcatcatgatcgaggaggtgatgcggtcccgctggagccgcaagatgctgatgaccgggacgctcgccgtcttcctgctgctcatcatggggcagctgacgtggaacgatttgatccgtctctgcatcatggtgggcgccaacgcgtccgaccgcatgggcatgggcacaacctatctggccctgatggctaccttcaaaatgcggccgatgttcgccgtggggcttcttttccgccggctgaccagccgcgaggtcctcttactgacaatcggcctatcgctggtggccagcgtcgagctacctaactctcttgaggagctgggggacggtctggcgatgggcataatgatgctaaagttacttaccgagtttcagccccaccagctctggacgacactcctgagcctaaccttcgtgaagacgacattgtctctggactatgcttggaagactaccgccatggtgctcagcatcgtctccctgttccccttgtgcctcagcaccacgtcccaaaagactacgtggctgccggtgctgctcggcagcttcggctgtaagccactgaccatgttcctcataaccgagaacaagatctgggggcggaagtcctggcccctaaacgaggggatcatggccatcgggatagtgagcatacttctgtccagcctcctgaagaacgacgttcccctggccggcccgctcatcgccggcgggatgctgatcgcttgctacgtgatcagcgggtcgagcgccgacctgtctctcgagaagacggccgaagtgagctgggagcaggaggctgagcactccggggcgagtcacaacattctggttgaagtccaggacgacggcaccatgaagatcaaagacgaggagagagatgacaccttgaccatactcctgaaggctacgctcctcgccgtgtccggggtctatcccatgagcatccccgccaccctgttcgtgtggtacttctggcagaagaagaagcagcggtccggcgtgctgtgggacacccccagtccacccgaggttgagcgcgcggtgctcgacgacggcatctaccggatcctgcagcgcgggctgctgggcaggtcgcaggtcggggttggagtgttccaagacggggtgttccacaccatgtggcacgtcacgcgcggcgccgtgctcatgtaccaaggcaaacgcctggagcctagctgggcctccgtcaagaaggacctgatctcttatgggggagggtggcggttccaggggtcctggaacaccggggaggaggtacaggtgatcgctgtggagccgggaaagaacccgaagaacgtccagacaacccccggaacgttcaaaacccccgagggcgaggtcggcgcgatcgcgctcgacttcaaacccggaacaagcggctcaccgatcgtgaaccgcgaaggaaagatagtcggtctgtatggtaacggggtggtgactacgagcggcacctacgtcagcgccatcgcccaggcaaaggctagccaggaggggcccttacccgaaatcgaggacgaagtgttcaaaaagcgcaatctcaccatcatggacctgcacccgggctcgggcaaaacccggaggtacctgcccgccatcgtgcgggaggccataaagcgcaagttacgcacactaatcctggcccccacccgcgtcgtagcctccgagatggcggaggccctcaaagggatgccgattcgctaccagaccacggcggtcaagtcggagcatactggcagagagatcgtagacctgatgtgccacgccacattcaccatgcgcctgttgtccccggtgcgtgtgcccaactacaacatgatcatcatggacgaggcgcactttactgatccagcgagtatcgcggcccgcggatacattagtacacgcgtcggcatgggagaggccgccgcgatcttcatgaccgccaccccgcccggaagcgtagaagccttcccacagtcgaacgccgtgatccaggatgaggagcgcgacatccctgagagatcctggaactccgggtacgattggatcaccgacttccccgggaagacggtatggttcgtgcccagcatcaagtccggcaacgacattgctaactgtttacgaaagaacggaaagcgtgtgatacagctaagccgcaagacttttgacaccgagtaccagaagaccaaaaacaacgactgggactacgtcgtgacaaccgacatctccgagatgggcgccaacttccgggctgacagggttatcgacccccggcgctgcttaaagcctgtcatattaaaggacggaccagagcgggttatcctggccggccctatgccagtcaccgtggccagcgctgcccagcgccggggaaggatcgggcgcaaccagaacaaggagggcgaccagtacgtctacatggggcagcccttgaacaacgacgaggaccacgcgcactggaccgaagccaagatgctgctggataacatcaatacgcccgagggtatcatccccgctctctttgagcctgagcgggagaagtcagcagccatcgatggggaataccgattacggggcgaagcccgcaagaccttcgtcgaactaatgcggagaggcgaccttccggtatggctgtcgtacaaggtggcgtccgaggggttccaatacagcgacaggcgttggtgcttcgacggtgagcggaacaaccaagtcctggaggaaaacatggacgtggagatatggaccaaagagggggagcgcaagaagctccggcccagatggttggatgcccgaacctactccgacccgctggcgctccgcgagttcaaggagttcgccgccggccggcgcagcgtgagcggcgacctgatcctggagatcgggaagctcccccagcacctgaccttgagagcccaaaacgctctcgacaacctagtcatgctgcacaacagtgagcagggcgggaaagcgtatcgacatgcaatggaagagttacccgatacgatcgagactctgatgctgctcgctctcattgccgtgctgaccggaggggtgaccctcttcttcctgagcggcaagggactggggaagacgtcgattggcctcttgtgcgtcaccgcgagctccgctttactctggatggccagcgtggagccccactggatcgctgcttccattatcctagagtttttccttatggtgctcctgatcccggaacccgaccggcaaagaacgccacaggacaaccagctggcatacgtcgtgatcgggctcctgttcatgatcctgactgtagcggccaacgagatgggcctgctcgagacgaccaagaaggacctgggaataggctacgtcgccgccgagaaccaccagcacgcgaccatgctcgacgtggacctgcacccggcaagcgcctggaccctgtacgccgttgccacaacggttattaccccgatgatgcggcacaccatcgagaacacgacagcgaatatctccctcaccgctatcgccaatcaggccgccatcttgatgggcctggacaaaggctggccaatcagcaaaatggacatcggcgtgcccctccttgcgctggggtgctactcccaagtgaatccgttgaccttgacagccgccgtcctaatgctcgtggcccactacgcgatcatcggccccgggctacaggccaaggccacccgcgaggcccagaagcgaaccgcagcgggcataatgaaaaaccccacggtggacggcatcgtcgccattgatctggaccccgtggtgtatgacgccaagttcgagaagcagctcgggcagatcatgctcttaatcctctgcacgagccagatcctgctgatgaggaccacctgggccctctgcgaatccatcaccctggcaacgggcccactaaccaccctctgggaggggagccccggcaagttctggaacacaactatcgcagtctccatggccaatatcttccgcggctcttatctggcgggggctggcctagcgttctccctcatgaagtccctcggcggcgggcggagaggtactggcgcgcagggagagacattaggcgagaagtggaagcgacagttaaaccagctgtccaagagcgagtttaacacctacaagcgcagtgggatcatggaagtcgacaggtcagaggccaaggagggccttaagcgcggcgagacgaccaagcacgccgtgagcaggggtaccgccaagttgcgctggttcgtcgagcggaacctggtgaaaccagaggggaaggtgatcgacctgggctgtggccgcgggggttggtcctactattgtgcggggctgaaaaaggttactgaggtgaagggctacaccaagggcggtcccggccacgaggaaccgatccccatggcaacgtacgggtggaacctcgtgaagctgcacagcggcaaagacgtcttcttcatgccgcccgagaagtgcgacaccctgttgtgcgacatcggggagtccagcccgaaccccactatcgaggagggcagaaccttaagggtgctgaagatggtggagccatggctccggggcaaccagttctgcattaagatcctgaacccctacatgccgtctgttgtggagacgcttgaacagatgcagcggaagcacggagggatgctcgtgcggaaccccctgtctcgcaactctacgcacgagatgtactgggtcagctgtgggaccggcaacatagtgtccgccgtgaacatgactagccggatgctgctcaaccgcttcaccatggcccatcgcaagcccacatacgaacgcgacgtcgacctaggcgccggcacccgccacgtggcggttgagcctgaggtcgccaaccttgacatcatcggccagcggatcgagaacatcaaaaacgagcacaagtccacctggcactacgatgaggacaatccgtacaagacgtgggcttaccatgggtcgtacgaagtgaaaccctccggtagcgcctcatccatggtcaacggggtcgtgcgactcctgaccaagccctgggacgtcattcccatggtgacccagatcgctatgaccgacacgaccccgttcggtcagcagcgggtgttcaaggaaaaggtcgacacccgaactccccgggcgaagcgcggtacgacccagatcatggaggtgacggccaagtggctgtgggggtttctctctagaaacaaaaagccccgcatctgtacccgagaggagttcacgcgcaaggtccggagcaacgccgcgataggcgccgtattcgttgatgagaatcagtggaacagcgcgaaggaggccgtggaggatgagagattttgggatctggtccaccgggagcgcgaactgcacaagcagggtaagtgcgcgacctgcgtatataacatgatgggcaagagagaaaagaagctcggggagttcggcaaggccaagggttcccgcgcgatatggtacatgtggctgggggcccggttcctggagttcgaggccctcggcttcatgaatgaagaccactggtttagccgagagaacagcctgagcggggtcgagggcgaggggcttcacaaactcggatacatcctgcgggacatctccaagataccaggagggaacatgtatgccgacgataccgccggctgggacactcgcattacggaagacgacttgcagaacgaggccaagattaccgacatcatggagcccgaacacgccctcctggccaccagcatcttcaaacttacgtaccagaacaaggtcgtacgcgtgcagcggccggccaagaacgggaccgtcatggatgtcatctcgcgccgtgaccagcgcggcagcggacaggttggcacctacggcctcaataccttcacgaatatggaggtccagctgatccggcagatggaatcagagggaatttttctgccctccgagctggagacgccgaacctggcggagcgggctctggactggctcgagaagcacggcgcggaacgacttaagcgcatggctatctccggcgacgactgtgtggtgaagcccatcgacgaccggttcgcgaccgcactgaccgcgctcaacgatatggggaaggtccgcaaagacatcccccagtgggaaccgtcgaaggggtggaacgactggcagcaggtccccttctgctcccaccactttcaccaactgatcatgaaggacgggcgggagatagtggtcccctgccgcaatcaggacgaactcgtgggacgggcccgcgttagccagggggccggctggtccttaagagagacagcctgcctgggcaagagctatgcccagatgtggcagctgatgtactttcaccgtcgggacctccggctggcggccaatgcgatctgttccgccgtccccgtggactgggtccccaccagccggacgacttggtccatccacgcgcaccatcagtggatgaccaccgaggacatgctgtccgtctggaaccgcgtgtggatcgaggaaaacccgtggatggaggataagacgcacgtgagctcttgggaggaggtcccgtacctcggcaagcgcgaggaccagtggtgcggcagcctgatcgggctgacagcgcgagcaacgtgggctaccaacatccaagtggccattaatcaggtgcgccgcctcatcgggaacgaaaactacctggactatatgacctccatgaagcgcttcaaaaacgagagcgatcccgaaggggcgctgtggtaa

SEQ ID NO: 24081 - RNA, 9879 nt, synthetic construct
  misc_feature 1..9879: note = derived and/or modified CDS sequence (opt11) from DENV-1__GU131839__SS-prME
  source 1..9879: mol_type = other RNA
agcgtgaccatgctgctcatgctgctgcccacagcactcgccttccacctgaccacccgcggcggggaaccccacatgatcgtgagcaagcaggaacgtggaaaatcacttctgttcaaaacgtccgccggagtgaacatgtgcaccttaatcgccatggacttgggcgaactctgcgaagacaccatgacctacaagtgcccccgcatcaccgaagccgagcccgacgacgtggactgttggtgcaacgccaccgatacctgggtgacctacgggacatgctcacagaccggagagcatcggcgcgagaaacggtccgtggccctagcgccccacgtgggactggggctcgagacacgcactgagacctggatgagcagtgagggagcgtggaagcagattcagcgggtcgagacctgggccctgcgccatccaggatttacggtgattgcgttcttcctggcgcatgccatcggcacgagcattacgcagaagggcattatctttatccttctgatgctggtgactccctccatggccatgcggtgtgttggtatcggcaaccgcgattttgtggaggggctctcaggcgcgacgtgggtggacgtcgtgcttgagcacgggtcctgcgtgaccaccatggccaagaacaaacccaccctggacatcgagctcctaaagacagaggtcaccaaccccgcggtgctccgcaaactctgcatcgaggccaagatcagcaacaccaccacggactcccgttgccccacccaaggcgaggccaccctggtggaggagcaggatgccaacttcgtttgtcggaggaccttcgtagaccggggatgggggaacggatgtgggctgttcgggaaaggaagcctcttgacgtgcgctaagttcaagtgcgtcaccaagctggagggtaaaaccgtgcagtacgaaaacctcaaatactcggtgatcgttacagttcacactggcgaccagcaccaggtggggaacgagaccaccgagcacggcacgatcgcgaccatcactccccaagccccaaccagcgagatacaactaaccgactatggggccttaaccttagattgtagcccccggacgggcctggatttcaacgaaatggtactgctcacaatgaaggagaaaagctggctggtgcacaagcagtggttcctggatctccctctgccctggacctccggggcctcgaccagccaagaaacgtggaaccgtcaagacctgctcgtgaccttcaagaccgcccacgcgaagaagcaagaggtcgtggtgctcggcagccaagaaggggccatgcacaccgcacttacgggtgcgaccgagatccagacgtcgggcacgaccaccattttcgcgggccacctcaaatgccgcctgaagatggacaagctgaccctcaaggggatgtcctacgtaatgtgcacagggtctttcaaacttgagaaggaggtggcggagactcaacacggaaccgtgctggtccaggttaaatacgagggcacagacgccccctgcaagatccccttttccactcaggatgaaaagggggtgacgcagaacggccggctaatcaccgctaatcccatcgtcacagacaaggaaaaacccgtgaacatcgagactgagccgcccttcggagagagctacatcgttgtcggcgctggcgagaaggctctcaagctgagttggttcaagcgcgggagctccatcggcaagatgttcgaggcgacggccagaggggctcgccgcatggccatcctgggggacaccgcgtgggactttgggagcataggaggggtatttacgtccgtgggcaaactcgtccaccaggtgttcggcaccgcctacggggtgctgtttagcggcgtatcgtggacgatgaagatcggtataggcatccttctcacgtggctgggcctgaacagccggtcaaccagcctctccatgacctgtatcgccgtggggatggtgacgctgtacctgggcgtgatggtacaggcggacagcgggtgcgtgatcaactggaagggccgcgaactcaagtgcgggtccggcatcttcgtgaccaacgaggtgcacacctggaccgagcagtacaagttccaggccgactcaccgaagaggctgtctgctgccatcgggaaagcctgggaagagggggtatgcggcatccgctcagctacccggctcgagaacattatgtggaagcagatttccaacgagctcaaccacatcttactggagaacgacatgaagttcacggtcgtggtgggggacgcgaacggcatcctcgtccagggtaagaagatgatcagaccccagccaatggaacacaagtacagctggaagtcctggggtaaagccaagattatcggcgccgatactcagaacaccacgttcatcatcgacgggcccgacactccagagtgcccggacggccagcgggcctggaacatctgggaggtggaggactacgggtttggtgtgtttaccaccaacatctggctaaagctgcgcgactcgtacacacagatgtgcgaccaccggctgatgtcggccgcgatcaaggactccaaagccgtccacgcagacatgggctattggatcgagtccgagaagaacgaaacgtggaagttagcacgcgcctcatttatagaggtgaagacctgcacctggccaaagagccacaccctttggagcaacggggtgctcgagagcgagatgatcatcccaaagatctacggcgggccgatctcccagcataactaccggcccggttacttcacgcagaccgcgggaccatggcacctggggaaactggagctagacttcgacttatgcgaaggaaccaccgtagtggtggacgagcactgcggcaacaggggacctagcctgcggaccaccaccgtcaccgggaagatcatccacgagtggtgctgtcggtcttgtacgctgccacccctgcgtttccgaggcgaggacgggtgctggtacgggatggagatccggcccgtgaaggagaaggaagagaaccttgtacgcagcatggtctccgccggctcaggggaggttgatagcttctccctcggcatcttgtgcgtgagcatcatgatcgaggaggtcatgcggtcccgctggtctcggaagatgttgatgaccgggacccttgccgtgttcttgctactcatcatgggccaactgacatggaacgaccttatccggctctgcatcatggtgggggccaacgcctcagaccgcatggggatgggcacgacctacttggcgctgatggccaccttcaaaatgagaccgatgttcgccgtagggctgctgttccgccggctgacctcacgcgaggtgctcttattaacgatcggtctctccctggtagcaagtgtcgagcttcccaatagtctcgaggaactgggggatggcctggccatgggcataatgatgctgaaactgctgaccgaatttcagccccatcaactctggaccacactgttgagcctcacgtttgtgaaaaccgcgctgtccttagactatgcctggaagacgaccgccatggtcctcagcatcgtgagcctgtttcccctgtgcttgagcacgacctcccaaaagacaacttggctgccggtactgctcgggagcttcggctgcaagcccctgaccatgttcctgattaccgagaacaagatttggggacgaaagagttggcccctcaacgagggcatcatggccatcgggatcgtcagcatcctgctgtcctctctcttaaagaatgatgtccccctggcgggaccgctcatcgccggtggtatgctgattgcgtgttatgtgatcagcggctctagcgccgacctgtccctcgagaaggccgccgaggtcagctgggagcaggaggccgagcactccggggccagccacaacatcctggtggaagtccaagatgatggtaccatgaagatcaaggacgaggaacgggacgacacgctgaccattctcctgaaggcaacgctgttagcagtgtccggggtgtacccgatgagcattcccgcgaccttattcgtgtggtacttttggcagaagaagaagcagcggtccggcgtcttatgggacacccccagcccgcccgaggtggaacgcgccgtgctcgacaacggaatctaccggatcctgcagcgcgggctgctgggccgaagtcaagtcggggtcggcgtgtttcaggacggggtgttccatacaatgtggcacgtgacacgcggcgcagtgctcatgtatcagggcaaacgtctggaacccagctgggcctccgtcaagaaagacctgatcagctacgggggagggtggcgcttccaaggctcctggaacacgggggaagaggtccaggtgatcgcggtcgagcccggcaagaacccaaagaacgtgcagaccacacccggcacgtttaagacgccagagggggaagtgggcgcgatagccttagacttcaaacccgggaccagcggctccccaatcgtcaatcgggagggcaagatcgtggggctgtacggcaacggggtcgtcaccacgtccgggacctacgtgtccgccatagcacaggccaaagcgtcgcaggaagggcccctgcctgaaattgaggatgaagtgttcaaaaagcgcaacctgacgatcatggacctgcacccgggcagcggcaagactaggcgttacctgcccgccatcgtgcgggaggccattaagcgcaagctccgcacgctgatcctggcacccacgagggtcgtggcgagcgagatggccgaggccctcaaggggatgcctattcgctaccagaccactgccgtaaagagcgagcatacgggccgggagatcgttgacctgatgtgccacgcaaccttcacgatgcggctactctccccggtgcgggtccccaactacaacatgatcataatggacgaggcacacttcaccgaccccgcctcaatcgcggcaaggggttatatctcgacacgagtgggcatgggggaagccgcggcaatcttcatgacggccacgcccccaggcagcgtagaggcctttccacagtccaacgccgtgatccaagacgaggagcgcgatatccccgagcggagttggaactcaggctacgactggattaccgacttccctgggaaaactgtgtggttcgtgccctccatcaaatccggaaacgacattgccaactgcctgcgcaagaacgggaagagggtgatccagctcagccgtaaaaccttcgacaccgagtaccagaagaccaagaacaacgactgggactacgtggtgacgacggatatctctgagatgggcgccaacttccgggccgaccgcgtcatcgacccccgtcgctgcctcaaaccggtgatcctgaaggacggtcctgaacgggtcatcctggccgggccgatgcccgtgaccgtggcgagtgccgcgcagcggagaggaaggatcgggcgcaaccaaaacaaggaaggcgaccaatacgtttacatgggccagcccttgaacaatgacgaagaccacgcccactggaccgaggcgaagatgctgttagacaatatcaacacgccggagggcattatcccggccctcttcgagcccgagagggagaagtccgcagccatcgacggagagtatcggcttcggggcgaggcccgcaagacctttgtagagctgatgagacgcggcgacctccccgtgtggctgagctacaaggtcgcctccgaagggttccaatattccgatcgtcgctggtgcttcgatggcgagcggaacaaccaggtgctggaggagaacatggatgtggaaatatggaccaaggagggggagcgcaagaaactccggcctcgctggctggacgcgcggacctactccgacccgctggccctgcgcgagttcaaggagttcgccgccggccgtcgcagcgtcagtggcgatcttatcctggagatcggcaagctcccacagcacctgaccctacgggcgcagaatgcgctcgacaaccttgtgatgcttcacaactccgagcagggcggtaaggcttaccggcatgccatggaggagctcccagacaccatcgagaccctgatgctgctcgcccttatcgcggtcctgacgggcggagtaaccttattcttcctaagcggcaagggactgggcaagacgtctatcggtttgctgtgcgtgactgccagcagcgccttgctctggatggcctccgtggaaccccactggatagccgcgtctatcatcctggagttcttcctgatggttctcctgatcccagagcccgaccggcaacgaactccacaagacaaccagttagcctacgtggtgatcgggctcctgttcatgatcctgaccgtggccgccaacgagatgggcctgctggagacgaccaagaaagacctcgggatcgggtatgtggccgcggagaaccatcaacacgccacaatgttggacgtggacctacatcccgccagcgcctggaccctttacgccgtcgcgactaccgtgattaccccgatgatgcggcacaccatcgagaacaccaccgccaatatctccttaaccgcaatcgccaaccaggccgcgatcctgatggggttagacaaggggtggcccatcagtaagatggatataggcgtacccctcctggccttaggatgctactcccaggtaaacccgttgacactgacgagcgccgtgctgatgctcgtggcgcattacgcgattatcggccccgggctgcaggccaaggccaccagggaggcccagaagagaactgccgcgggcataatgaagaaccccaccgttgacggcatcgtggccatcgacctagaccccgtggtctacgacgccaaatttgagaagcagctcgggcagatcatgctgctgatcctttgtacgtcccaaatcctgttgatgaggactacgtgggcgctctgcgagagcattactttagccacgggccccctgaccaccctctgggagggttcccccggcaagttctggaacacgacaattgcggtgagcatggccaacattttccgcgggtcctatctggccggggccggcctggccttcagcttgatgaagtccctcggcgggggtcggcgcggtaccggcgcacagggggagaccctgggagagaaatggaagcggcagctcaaccagctgagcaagtctgagttcaacacctacaagcgctccggcattatggaagtggaccggagcgaggcaaaggagggcctgaagcgtggggagacgaccaaacacgctgtatcccggggtacggccaagctccgctggttcgtggagcgcaacctagtaaagccagagggcaaggtcatcgacctggggtgtggtcgcgggggctggtcatactactgcgcggggctgaagaaggtgaccgaggtaaagggctacaccaagggcgggcccggccacgaggaaccgatccccatggctacgtacgggtggaatctcgtcaagctgcactcgggcaaggacgtcttcttcatgccgcccgagaaatgcgacacgctgctctgcgacataggggagagctcaccgaaccctaccatcgaggaggggcggactctgcgtgtgctgaagatggtcgagccctggctccgggggaaccagttctgtatcaagatactgaatccgtacatgccgtctgtggtggagacgctggagcagatgcagaggaagcacgggggtatgctagtccgaaaccccctgtcccgcaacagcacccatgagatgtactgggtgtcctgtgggaccggcaatatcgtgagcgcggtcaacatgacctcccggatgctgctaaaccggttcactatggctcaccgaaagcccacctacgagcgggacgtggacctgggagccgggacacgacacgtggcggtcgagcccgaggtggccaacctggacatcataggccagcggatcgagaatataaagaacgagcacaagtctacctggcattacgatgaggataacccatacaagacgtgggcgtaccacggttcctatgaggtcaaacccagcggctccgcctcgtcaatggtgaacggtgtggtcagactcctgaccaagccctgggacgtgatccccatggtgacccagatcgccatgaccgacacgaccccgtttggtcaacagcgagtctttcgcgagaaggtggacacccggacgccccgcgcgaagcgaggcacgacccaaatcatggaggtgaccgctaagtggctgtggggattcctcagccgcaacaagaagccccggatatgcactcgcgaggagttcacgcggaaggtgcgcagcaacgccgcgatcggcgccgtgttcgttgacgagaaccagtggaactccgcgaaggaggccgtcgaggacgagcggttctgggacctggtgcaccgcgagcgggagcttcataagcaggggaaatgtgcgacctgcgtgtataacatgatgggcaagcgggagaaaaagctcggggagttcggcaaagccaagggttcccgtgcgatctggtacatgtggctgggggcacgcttcctcgaatttgaggccctcggcttcatgaacgaggaccactggttttcccgcgagaatagcctgtccggtgtcgagggggaggggctgcacaagctcggctatatcctgcgcgacatcagcaagatcccgggcgggaacgtgtacgcagacgatactgccggctgggacacccgcataacggaggacgacctgcagaatgaggcgaagataaccgacattatggaacccgagcacgccttgcttgccacctccatattcaagctgacgtatcagaacaaggtggtacgagttcagcgccccgccaagaatgggacggtgatggacgtcatctctcggagagaccagcggggcagtggccaagtcgggacctatggcctcaacaccttcaccaatatggaggtgcaactgattcgccagatggaaagcgaagggatcttccttccctcggaactcgagacgccgaatctggctgagcgggctctggactggctcgagaagcacggcgtagagcggctgaagcgaatggctatctcaggggacgactgcgtggtaaagcccatcgacgatcgcttcgccaccgccctgaccgcgctcaacgacatgggcaaggtgcggaaggacataccccagtgggagccctccaagggctggaacgactggcagcaggtcccgttctgctcccaccacttccaccagcttataatgaaggacgggcgcgagattgtggtcccctgccggaaccaggacgagctggttggccgcgcgcgggtgtcccagggggccggctggagcctccgcgaaaccgcctgcctggggaagtcctacgcgcagatgtggcagctgatgtacttccatcggagagatctccggctggcggcgaatgccatctgctcagccgtacccgtcgactgggtgcccaccagccgcacaacctggtccatccacgcccaccaccaatggatgaccaccgaggacatgctgtccgtctggaaccgagtgtggatcgaggagaacccgtggatggaagacaagacgcacgtgtcgtcttgggaagaggtcccctacctcggcaagcgggaggaccaatggtgcggctccctgatagggcttaccgcgcgcgccacatgggccaccaacatccaggtggcaatcaaccaggttcggcgcctcattggcaacgagaactacctggactacatgacgagcatgaagcggttcaagaacgagtcggacagtgagggggccctgtggtga

SEQ ID NO: 24082 - RNA, 9879 nt, synthetic construct
  misc_feature 1..9879: note = derived and/or modified CDS sequence (opt11) from DENV-1__GU131841__SS-prME
  source 1..9879: mol_type = other RNA
agcgttactatgcttctcatgttactgcccaccgcccttgccttccacttgaccacccgcggcggggagccccacatgatcgtaagcaagcaggagcggggcaagagcctccttttcaagaccagcgtaggggtgaacatgtgtaccctgattgcgatggatctgggcgagctctgcgaggacaccatgacctacaagtgcccccggatcaccgaggctgagcccgacgacgtagactgttggtgcaacgccacggatacctgggtgacgtacgggacttgcagccagaccggcgaacatcggagagagaagcggtccgtggccttagcgccccatgtcggcctgggtctcgagacacgcaccgaaacatggatgagctccgagggcgcctggaagcagatccagcgggtggagacctgggccctgcgccacccgggtttcacggtaatcgcatttttccttgcctatgcgataggcacttcgatcacccagaaaggcatcatcttcatcctcctgatgctggtgactccctccatggccatgcggtgcgtcggtatcggcaaccgcgacttcgtggagggtctcagcggcgccacgtgggtggacgttgtcctggagcacggctcatgcgtcactaccatggccaagaacaaacccaccctggacatcgaactcctgaagacagaggttacaaaccccgccgtgctgcggaaactctgcatcgaggcgaagatcagcaacaccaccacggactcccggtgtccgacccagggtgaggccaccctggtcgaagagcaggacgccaacttcgtatgccggcgcacattcgtggatcggggttgggggaacggctgcgggctgttcggcaaggggagtctcttgacgtgcgccaagttcaagtgcgtcaccaagctggagggcaagattgtgcaatacgaaaacctcaagtattccgtcatcgtcacagtgcacaccggcgaccagcaccaggtcgggaacgagacgaccgagcacgggaccatcgccactatcacgccccaggctcccacgagtgagatccagcttaccgactacggggccctcaccctcgactgcagccccaggaccggactggactttaatgagatggtgctgctgacgatgaaggagaagtcctggctggtacacaagcagtggttcttagacctacctctgccctggaccagcggggcaagcaccagccaggaaacctggaatcggcaggaccttttagtcacgtttaagaccgcccacgccaagaagcaggaagtggtggtgctgggctcccaggagggcgcgatgcacaccgccctgactggggcaacggagattcaaacgagcggcaccaccacgatcttcgccgggcacctaaagtgcaggctgaagatggacaagctgacgctcaagggcatgtcctacgtcatgtgcaccgggagcttcaagctggaaaaggaggttgccgagacccaacacggcacggtcctggtccaggtgaagtatgagggcactgatgcgccctgcaagatccccttctccacccaagacgagaagggggtgacccagaacggccggttgatcaccgctaacccgatcgtgaccgataaggagaaacctgtgaacattgaaacggagccgcccttcggggagagctacatcgtcgtgggggccggcgaaaaggccctgaagctgtcctggtttaagcgcgggagctccatcgggaagatgttcgaggcgaccgcccgtggggctcgccgtatggccatcctgggtgacacggcatgggacttcgggagcatcggcggggtgttcacatcggtcggaaaactcgtgcaccaggtgtttggcaccgcgtatggtgtcttgttcagcggcgtgtcctggaccatgaagatcgggatcggcatcctgctcacatggctggggttaaacagccggtccaccagcttgtccatgacatgtattgccgtgggcatggtcaccctgtacctgggagtaatggttcaggccgacagcggttgcgtcataaactggaagggccgcgagctcaagtgcgggagtggtatcttcgtcacgaacgaggtgcacacctggaccgaacagtacaagttccaggcagacagccctaagagactgagtgccgcgatcggcaaggcttgggaggagggtgtctgcggcatccgctctgcgacccggcttgagaacattatgtggaagcagatatccaacgagctcaaccacatcctgcttgaaaacgacatgaagttcaccgtggtggtgggggacgccaacggtatcctcgcccaagggaagaagatgatccgcccacagcctatggaacataagtactcctggaagtcttggggaaaggcgaagatcatcggcgccgacatccaaaatacgaccttcattatcgacggccccgacaccccagaatgccctgacgggcagagggcctggaacatctgggaggtggaggattacgggttcggcgtgttcaccacgaacatctggctgaaactgcgcgactcctacacacagatgtgcgaccaccgcctaatgagcgccgcaatcaaggactccaaggccgtccacgccgacatgggttattggatcgagagcgagaagaacgagacctggaagcttgcccgcgcctcgttcatcgaggtcaagacctgcacgtggcctaagagccacaccttatggagcaacggggtgctcgagagcgagatgatcatccctaaaatctatggcgggccaattagccagcataactaccggcccggctacttcacccaaacggcggggccctggcacctgggcaagttggagctcgacttcgacctgtgcgagggcaccaccgtcgtggtcgacgagcattgcggaaaccgaggccccagcctgcggaccaccaccgtcaccgggaagatcatccacgagtggtgctgccgctcctgcaccctccccccactacggttccgcggagaagacgggtgttggtacggcatggagatcagacccgttaaggagaaggaggagaacctggtgcgcagcatggtctccgccggctcaggcgaggtggattcattttccttgggcatactgtgcgtaagcatcatgatcgaggaggtcatgcggtcgcgctggtcgcgcaagatgctaatgaccggtacgctagccgtgttcctgcttcttatcatgggccagctgacctggaacgacctcatcagattatgcatcatggtgggggccaacgcctccgacaggatgggtatggggaccacctacctggcgctgatggcgacgttcaagatgcgcccgatgtttgccgtcggtctcctgttccgcagactgaccagccgcgaggtgctcctgctgaccattggcctgtccctggtcgccagtgtggagctgcccaactccctcgaggagctaggggatggactggctatgggcatcatgatgctcaagctgcttaccgagttccaaccccaccaattgtggacgaccctgctgagtcttacattcgtgaagaccacgctgtcccttgactacgcctggaaaacgaccgcgatggtcctcagcatcgtgtccctgtttcccctgtgcctcagtaccacgtcccaaaagaccacatggctcccggtcctgctcggttctttcggttgcaagcccttaaccatgttcctgatcaccgagaacaagatctgggggcggaaatcctggcccctaaacgaaggcatcatggcaatcgggattgtctctatcctgctgtcctcgctcctgaagaacgacgtgccccttgctgggccgctcatagcgggcgggatgctcatagcctgctatgtgatcagcggctccagcgccgatctttctctggagaaggccgcagaggtctcctgggagcaggaagcagaacattccggggccagccacaacatcctggtggaggtgcaggacgacggcactatgaagatcaaggacgaagagcgcgacgacacactgaccatccttctgaaagccacgctgctcgccgtttccggcgtgtatcccatgagcatacccgccacgctgttcgtgtggtacttctggcagaagaagaaacagcggtccggggtcctctgggataccccaagcccacccgaagtcgagcgcgccgtgctcgacgacggcatctaccggatcctgcagcgcggattactgggccggtcccaagtcggggtcggtgtgttccaggacggggtctttcataccatgtggcacgtgacccgtggggccgtgttaatgtaccagggaaaaaggcttgagcccagctgggcatccgtcaaaaaggacctcatcagctacgggggcgggtggcgcttccagggctcctggaacacgggggaggaagtccaggtgatcgctgtggagccaggcaagaaccccaagaacgtgcagacgactcctggcaccttcaagacgcccgagggcgaggtgggcgccatcgcgcttgatttcaaaccagggacgagcggctccccgattgtcaaccgtgagggtaagatagtgggtctgtacggcaacggggtggtcaccacaagcggtacgtacgtaagtgccatcgcgcaggcaaaggccagccaggagggccccttaccagagatcgaggacgaggtgttcaagaaacgcaacctaaccatcatggacctacatccggggtctggaaagacccggcgctacctgcccgctatcgtacgggaggcaatcaagcgcaagctccgcaccctgatcctggcccccacgagggtggtggcatcagagatggctgaggctttgaaggggatgcccatccgttaccagactaccgccgtcaagtccgagcacacaggacgggagatcgtggatctgatgtgccacgccacgttcaccatgcgcctgctctccccggttcgcgtcccgaattacaacatgatcatcatggacgaggcccatttcacagaccccgccagcattgctgcccgtggttacatctccaccagggtaggcatgggggaggccgctgcgatattcatgacggccacaccgcccggcagcgtagaagccttcccccagtccaatgccgtcatccaggacgaggagagggacatcccggagcggagctggaactctggctacgactggatcaccgatttccccgggaagacggtgtggttcgtgccctctatcaagtccggtaacgacatcgcaaactgcctgcgaaagaacgggaagcgtgttatacagctgagccgcaaaacgttcgataccgagtatcagaagaccaaaaataacgactgggattacgtggttaccacggacatctccgaaatgggtgcgaatttccgagccgatcgggttatagacccccggcgatgtttaaaaccggtgatcctgaaggacgggcccgaacgggttatcctggcaggcccgatgcccgtgaccgtggccagcgcagcccaaagacgggggaggattgggcgcaaccagaacaaggagggcgaccagtacgtctatatggggcagcccctcaacaatgatgaggaccacgcccactggaccgaggccaaaatgctcctggacaacataaacacccccgaggggatcataccagccctcttcgaacccgaacgggaaaagtccgcggccattgacggggaatacagactgcgaggcgaggcacgcaaaacattcgtggaactcatgcggcgcggtgacctcccagtttggctgagctacaaggtcgctagcgaagggttccagtatagcgaccggcgatggtgtttcgacggggagcggaacaaccaggtgctggaggagaacatggatgtggagatatggaccaaggagggggagcgcaaaaagctcagaccccgctggttggacgccagaacgtattccgatccgctggcgctcagggagttcaaggagtttgccgcgggtcggcgctccgtcagcggtgatctaatcctggagatcgggaagttgccccagcacctgaccctgcgtgcccagaacgccctcgacaacctggtgatgttgcataacagtgagcagggcgggaaggcgtatcgccacgcaatggaggagctccccgacaccatcgagacgctgatgttgctagccctgatcgctgtgctgacaggcggggtgaccctcttcttcttaagcggcaagggcctggggaagacctccataggtctcctgtgtgtgacggcgtcatctgccctgctttggatggccagcgtggagccccactggatcgccgcctccatcatcctggagttcttcctgatggtactcctaattccggagcccgatcggcagcgcacgccccaggacaaccagctggcgtacgttgtcatcggattgctcttcatgatcctaaccgtcgcggcgaatgagatgggcctcttggagaccacgaaaaaggacctgggaattggctacgtggccgccgagaaccaccagcacgcgaccatgctggacgtggacctgcacccggcgtccgcctggaccttgtacgccgtcgcgacaacagtgattacccccatgatgcggcacaccatcgagaacacaacggccaacatttccctaaccgccatcgccaaccaagccgccatcttgatgggtctggacaaggggtggcctataagcaagatggatatcggagtgcccctcctggcgctggggtgctactcccaggtcaacccactcaccttaaccgcggccgtgctgatgctcgtggcccactacgcgatcatcggcccggggctgcaggcgaaggccacgcgagaggcacagaagcgcaccgccgcgggtatcatgaagaacccgaccgtagacggcatcgtggccatcgacctagatcccgtggtctacgatgccaagttcgagaagcagttggggcagatcatgctgctaatcctctgcactagccaaatcctgttaatgcggacgacctgggccctctgtgagtcaataaccttagccacgggcccgctcacgaccctctgggaagggtccccaggcaaattctggaataccaccatcgctgtatccatggcaaacatttttcgcggcagctacctggctggggccggcctggccttctccctcatgaaaagtctcgggggtgggcggcgagggacgggcgcgcagggcgagaccctgggcgagaagtggaagcggcagctaaatcagctgagcaagagcgagttcaacacctataagagaagcggtatcatggaagtggaccgctcagaggccaaggagggcctgaagcgcggagagacaactaaacatgcggtcagccggggcaccgccaagcttagatggttcgtggagcggaacctggtgaagcctgagggcaaagtcatcgacttaggatgcggccgcgggggctggtcctactactgtgcggggttaaagaaggtgaccgaggtgaagggatacaccaagggcggacccggccatgaggagccgatccccatggccacctacggctggaacctcgtgaaactccacagcggcaaggacgtgttctttatgccgcccgagaagtgcgacacgctgctctgcgacataggggaaagtagcccgaaccccaccatcgaggagggcagaaccctgcgcgtgctgaagatggtcgagccttggctccggggcaatcagttctgcataaagatcctgaatccctacatgccgagcgtggttgaaaccctcgagcaaatgcaaagaaaacacgggggcatgcttgtacggaaccccttaagccgcaattccacacacgagatgtactgggtgagctgcggcactggtaacatcgtttccgccgttaatatgaccagccggatgctcctcaaccgcttcaccatggcccatcgcaagccgacgtacgagcgggacgtggacctgggcgccgggacccgccatgtggcggtcgaaccggaggttgccaacctggacatcatcggccaacggattgaaaacatcaagaatgagcacaagtccacctggcactatgacgaggataacccgtacaagacatgggcctatcacggaagctacgaggtcaagccctccggtagcgcgagttcaatggtgaatggagtggttcgcctcctgacgaagccgtgggacgtgatcccgatggtcacacagatcgccatgaccgacactacaccgttcggccagcagcgggtatttaaggagaaagtggatactcgcacgcctcgggcgaagcgcggaaccacgcagataatggaggtgaccgccaagtggctgtggggtttcttgtcccggaacaagaagccccgaatttgtacccgagaagagttcaccaggaaggtccggagcaacgccgcgatcggtgccgtgttcgtagacgaaaaccaatggaatagcgcaaaggaggccgtcgaggacgagcgcttctgggacctagtccacagagagcgcgagctgcacaaacaggggaagtgtgccacgtgcgtgtacaacatgatgggtaagcgggagaaaaagctcggggagttcggcaaggccaaaggctcccgagcgatctggtacatgtggctcggggcccggttcctggagttcgaagccctcggtttcatgaacgaggaccactggttcagcagggagaactccctgtcgggcgtcgagggggaagggttacacaaactcggctatattctgcgagacataagtaagattccgggcgggaacatgtacgccgacgacaccgccggctgggacacccggataaccgaggacgacctgcaaaacgaagcgaaaatcacggacattatggagccggaacacgcactcctggccaccagcatcttcaagctgacttaccagaacaaggtagtgcgcgtccagcggcccgccaagaacgggactgtgatggacgttatctcccgccgggaccaacgcggcagcggccaggtcgggacgtacggcctcaatacattcacgaacatggaggtgcaactgatccgccaaatggaatctgaggggattttccttcccagcgaacttgagaccccgaacttggccgagcgtgcgctggactggctcgagaagcacggcgccgaacgactgaagcgcatggcaatctctggggacgattgcgtggtgaagccaattgacgaccgtttcgccacggccttgacggcgctcaacgacatgggcaaggtgcgcaaggacatcccccagtgggaacctagcaaagggtggaacgattggcagcaagtgcccttctgcagccaccacttccatcagctgatcatgaaggatgggcgggagatcgtcgtgccctgccgcaaccaggatgaacttgtaggccgcgcgcgcgtatcccagggagccggctggagccttcgggaaactgcctgcctgggaaagagttacgcccagatgtggcagttgatgtacttccaccgccgagacttgagactggcggcgaacgccatctgttcagccgtgcccgtggattgggtcccgaccagccggactacttggtcgattcacgcgcaccaccagtggatgaccaccgaggacatgctgtcagtgtggaaccgagtgtggatcgaggagaacccgtggatggaggacaagacccacgtctcaagctgggaggaggtaccatacttgggtaaaagggaggaccagtggtgtggcagcctgatcgggctgacggccagagccacctgggccacaaacattcaagtggccataaatcaggtacgacggctcatcggcaacgaaaactacctggactacatgacctccatgaagcgcttcaagaacgagagcgaccccgagggggcactgtggtaa

SEQ ID NO: 24083 - RNA, 9879 nt, synthetic construct
  misc_feature 1..9879: note = derived and/or modified CDS sequence (opt11) from DENV-1__GQ868601__SS-prME
  source 1..9879: mol_type = other RNA
agcgttaccatgttactaatgctgttacccaccgccctcgcattccaccttaccacccggggcggggagccccacatgattgtgagcaagcaggagcgcggcaagagcctccttttcaagacctccgttggggtgaacatgtgcacacttatcgcaatggaccttggcgagctgtgcgaggacaccatgacatataaatgcccccgaataaccgaggcagaacccgacgacgttgattgttggtgcaatgctaccgatacgtgggttacatacggtacctgctcacagactggcgaacacaggcgagacaagcgttccgtcgccctggcgccccacgtcggcttagggctcgagacgagaaccgagacctggatgagctccgagggcgcctggaagcagatccagaaggtggagacctgggccctgcggcaccccggctttactgtaatcgccttattcctcgcgcacgcgatcggcaccagcatcacccagaagggaatcatctttatcctgctcatgcttgtcaccccgtccatggccatgaggtgcgtaggtataggcaaccgggactttgtggaagggctgagcggggccacgtgggtcgatgtggttctggagcacggttcctgcgtgaccaccatggcgaaaaacaagcccaccctcgacatcgagctgctgaagacggaggtgacgaaccctgctgtgctccggaagctgtgtatcgaggcgaagatcagcaataccactactgactcccggtgccccacccagggcgaggccaccctggtagaggagcaggacgctaacttcgtctgccgccggaccttcgtggacaggggatgggggaacgggtgcgggctcttcggcaagggaagtctgctgacgtgcgctaagttcaagtgtgtcacccggctcgagggaaagatcgtgcagtacgagaacctgaagtactccgtgattgtcaccgtgcacaccggagaccaacaccaggttgggaacgagacgacagagcacgggacaattgctaccataacgccccaggcgcctacgtcagagatccagctaaccgactacggggccctcaccctggattgcagccccagaaccggccttgacttcaacgagatggtcctcctcacgatgaaggagaagtcctggctggtgcataaacagtggttcctcgacctgccgctgccctggaccagtggggccagcacctcgcaggagacctggaacagacaggacctcctggttacgtttaaaaccgctcacgccaagaaacaggaggtggtggtactagggagccaggagggcgcgatgcacaccgccctcactggagccacggaaatccagacaagcggaacaaccacgatcttcgccgggcacctgaaatgccgcttaaagatggacaaactcaccctaaagggaatgagttacgtgatgtgcaccgggagcttcaagctggagaaggaggtggctgaaacccagcacggcacggtccttgtccaagttaagtacgagggtactgacgccccatgcaagatcccattcctcacgcaagacgagaagggtgtcacgcagaacggacggctgatcacggccaaccctatcgtgactgataaagagaagcccgtgaacattgagacggagccgccgttcggggagtcctacattgtagtgggtgctggcgagaaggcgctaaaactcagctggttcaagaagggctctagcatcgggaagatgttcgaggctactgccagaggggcccggcgcatggccattctgggggatacggcttgggactttggttccatcggcggcctgttcaccagcgtggggaaactcatccaccaggtctttgggaccgcgtacggtgtgctgttcagcggagtgtcctggactatgaagatcgggatcggcatcctcctcacgtggttaggcctgaactcccgcagcacctctctcagcatgacctgcattgccgtcgggatggtgacactatacttgggtgtaatggtccaggctgactccgggtgtgtgatcaattggaagggtcgggaacttaagtgtgggagcggtatcttcgtgacgaacgaggtccacacctggaccgagcagtacaaattccaagccgacagccctaaacgcctgagcgccgctatcggcaaggcctgggaggagggggtgtgcggaatccggagtgccacccgcctggagaacataatgtggaagcagatttcaaacgagctgaactatatcctgctagagaatgatatgaagttcaccgtggtcgttggggatgccaatggaatcctcgcccaggggaaaaagatgatcagaccccagcccatggagcacaagtatagctggaagtcctggggcaaggcgaagatcatcggcgcagacatccagaacacgacctttatcatcgacggcccagacaccccggagtgccccgacgaccagcgcgcgtggaatatctgggaagtggaggactacggcttcgggattttcacgacgaacatctggttgaagctacgggacagctacactcagatgtgtgaccaccgcctcatgtccgcagcgatcaaggacagcaaggccgtccacgcggatatgggatactggatagagagtgagaaaaacgaaacgtggaagctggcgcgggccagctttattgaggtgaagacctgcatctggcctaaatcccacacgctatggagcaacggcgtgctcgagtccgagatgatcatccccaagatctacggcggacctataagccagcacaattaccgccccgggtacttcacccagaccgcgggaccctggcacttagggaagttagagctcgacttcgacctgtgcgagggcaccacagtcgtggtcgacgagcattgcggctaccgggggccgtccctgcgcaccaccaccgtcacgggcaaaatcatacacgaatggtgctgccgcagctgcaccttgccgcccctgcgcttccgcggggaggacggctgttggtacgggatggaaattcgccctgtgaaggaaaaggaggaaaacctggtgagaagcatggtaagcgccggctccggcgaggtggacagcttcagcctcgggatcctatgcgtgtccatcctgatcgaggaggtcatgcgttctcgatggtccagacgcatgctgatgaccggaacacttgccgtgttccttctcctgatcatggggcagctgacatggaacgacctgatccggctatgcatcatggtgggggccaacgcgagcgaccgtatggggatgggcaccacctacctggcgctcatggccaccttcaagatgcggccaatgttcgccgtgggacttctgttccggcggctcacgtcacgggaggtgcttctgctcaccatcgggctgagcctggtggcctccgtggagctccccaacagtttggaggagctgggcgatggcctcgccatgggcatcatgatgctgaagcttctcacagactttcagccccaccagctgtggactacgctcctatccctgaccttcatacggaccaccctgtctctcgactacgcgtggaagacgatggccatggccctgtccatcgtgagcctgtttcccctctgtctttccacgacaagccagaaaaccacttggctgccggtcctcctgggttcctttggctgtaagcccctgaccatgtttctcataactgagaacaagatctggggccgcaaaagctggcccatcaacgaggggatcatggccgtgggcatcgtatccattttgttaagctccctgctgaaaaacgacgttccgttagcggggcccctcatcgccggcgggatgctgattgcctgctacgttatcagcgggagcagtgccgacctgagcctcgagaaggccgccgaggtgtcgtgggaagaggaggcagagcacagcggcacctcccacaacatactggtcgaggttcaggatgacgggaccatgaaaatcaaggacgaggagcgtgacgacactctcaccatactcctgaaagccaccctgctagccgtgtcaggtgtatatccaatgtcaatccccgccaccttattcgtgtggtacttctggcagaagaagaagcagcgcagcggggtgctatgggatacgccttccccgcccgaggtcgagcgggcagttcttgacgatggtatttaccgaatcctgcagcggggcttattagggagatcacaggtcggagtgggggtgttccaggatggcgtgttccacaccatgtggcacgtcacacgcggcgccgtgctcatgtaccagggcaagcgcctggagccatcatgggcgagcgtgaagaaagatttaatctcctatggcggaggctggcgtttccagggctcgtggaacacaggcgaagaagtccaggtgatcgccgtggaacccgggaagaacccaaagaatgtacagacgacccccggcacctttaagacccccgaaggtgaggtgggggcgatagcgctcgacttcaagcccggaacgtcggggtctccgatcgtgaaccgggaaggcaagattgtcggcctttacggcaatggcgtggtaacaacctccgggacctacgtcagcgccatcgcccaagccaaagcctcccaggagggccccttacccgaaatcgaggacgaggtcttcaaaaagcggaacctcacgatcatggacctgcaccccgggtccggcaagacccgtcgatacctgcccgcgattgtgcgcgaggccattaaacgcaagcttcgtaccctgatcttagcgccgacccgggtggtggccagcgagatggcggaagccctcaagggcatgcccatccggtatcaaacgactgccgtaaagtcagaacacaccgggcgcgaaatcgtagacttgatgtgccacgctactttcacaatgcggctcctttcgccagtgcgggtgcccaactacaacatgatcatcatggacgaagcccacttcaccgaccccgcgtccatagccgcacggggctacatcagcacccgcgtcgggatgggggaggccgcagcaatcttcatgacagccacgcccccggggtccgtggaagccttcccacaaagcaacgccgtgattcaggacgaagagcgcgacattcccgaacgctcatggaacagtggctatgactggatcaccgactttcccgggaagaccgtatggtttgtgccgtccatcaagagcgggaacgacatcgcgaactgcctccggaaaaatggcaagcgcgtgatccagctgtcccggaagaccttcgacacggagtaccagaagaccaagaacaatgactgggactacgtcgtcaccacggacatcagcgagatgggggcgaacttccgcgcggatcgcgtgatcgacccccgtagatgcctcaagcccgtcatcctgaaagacggccccgagcgggtgatcctggccgggccgatgccagtgacggtcgcctccgctgcccagcgtcgcggccgcatcgggcggaaccagaataaggagggcgaccagtacatctatatggggcagcccttaaataacgacgaggaccatgcacactggaccgaggccaaaatgctactggataacatcaacacgcccgaagggattatcccagccctttttgaacctgagcgcgagaagtccgcggccatcgacggcgagtaccggctgcgcggcgaagcgagaaaaaccttcgtggagttaatgcgcaggggggacctccccgtctggctttcctacaaggttgcctctgagggtttccagtactccgaccgtagatggtgcttcgacggggagagaaacaaccaggtgctggaagagaatatggacgttgagatttggacgaaggagggggagcggaagaagctccgcccgcgctggctggacgcccgtacctacagcgatccgctagcccttcgggagtttaaggaattcgccgctggtcgccgctccgtgagcggggacctgatcctggagatcgggaaactaccacaacacctgaccctgcgcgcccaaaacgcccttgacaacctggtgatgctgcacaacagcgagcagggcggcaaggcgtaccggcacgctatggaagaattgcctgacaccatcgagacattaatgctgctcgccctgatcgccgtcctgaccggaggagtgactcttttcttcctctctgggaaggggcttggcaagacctctatcgggctcctgtgcgtgatggcttccagcgccctgctctggatggcctccgtagagccccactggatagccgccagcatcatcctggaatttttcctgatggtgctcctgattccggaacccgatagacagcggaccccccaggacaatcagctggcgtatgtggtcatcggcctcttgttcatgatcttaacggtggccgccaacgaaatgggtctactagagaccaccaaaaaggatctgggtatcgggcacgtggctgctgaaaaccatcaccacgcgaccatgttagacgtagacctgcgcccggccagtgcatggacgctgtacgctgtcgccacgaccgtgatcacacccatgatgcgccatacgatcgagaataccacggcgaacatcagcctcaccgccatagccaaccaggccgccatacttatgggcctagacaaaggctggcccatcagcaagatggacataggggtgcccctactggcgcttggttgctacagccaagttaacccgctcacgctgacagcagccgtgctaatgttagtcgcccactatgctattattggtcccggactccaggccaaggccacccgggaggcccagaagcgcaccgcagccggtatcatgaagaaccccacggtggacggcatcgtcaccatcgatcttgaccccgtggtgtacgacgccaaatttgagaagcaactcggtcaaatcatgctgctgatcctctgcacctcccagatcctgctgatgcggaccacctgggccctctgcgagagcatcaccctggccaccggtccgctcacaacgctatgggaaggttccccggggaagttttggaataccacgatcgctgtgtccatggcgaacatctttcgcggctcctaccttgccggcgcagggctggcgttcagcctcatgaaatcactgggcgggggcagacgcgggaccggcgcccagggagagacgctgggcgagaagtggaagcggcagctcaaccagcttagcaagtccgaatttaacacctacaagcgcagcggcatcatggaagtcgaccgcagcgaggctaaggagggactgaagcgcggcgaaacgaccaagcacgccgtgtcccgggggacggccaaactgcgctggttcgtcgagcgtaatctcgtcaagccagagggtaaagtgatagatctgggctgcggtcgcggcggatggagctactactgtgccggcctgaagaaggtcaccgaggtcaagggctacactaaggggggccccggacacgaggagccaatacccatggcgacttatggctggaacctcgtgaaactgcactccggaaaggatgtcttctttacgccgcctgagaagtgcgatactctgctctgcgacattggggagagctcaccgaaccccaccatcgaggaggggcggaccctgcgcgtcctcaagatggtggaaccttggcttcggggaaaccagttttgcataaaaatactgaacccctatatgcccagcgtggtagagaccttagaacagatgcaacgcaagcacggcgggatgctcgtgcggaaccccctgtcccggaacagcacacacgaaatgtactgggtgtcgtgcggcaccgggaacatcgtctcagccgtgaacatgacatcccgcatgctgctcaatcggttcaccatggcccaccgcaagcctacatacgagcgggacgtggacctaggagccggaacccgccacgtcgcggtggagcccgaggtggctaacttggacatcatcgggcagcggatagagaacatcaaaaatgagcataagagcacttggcactacgacgaggacaacccgtataagacatgggcctatcacggctcctacgaggtcaaacccagtgggagcgccagctccatggtgaacggagtggtacgcctcctgacaaagccctgggacgtgatccccatggtcacccagatagcgatgaccgacaccacgccgtttgggcagcagcgagttttcaaagagaaggtagacacaaggacgccacgggctaaacgcgggaccgcgcagatcatggaagtcacggccaagtggctgtggggcttcctcagccggaacaagaagccccgcatatgtacccgggaggagttcacccgcaaggtgcggtctaacgccgctatcggggccgtctttgtcgacgagaaccagtggaatagcgccaaagaggccgtggaagacgagaggttctgggacctagtgcaccgggagcgcgagctgcacaaacagggcaagtgcgcaacgtgcgtctacaacatgatgggcaagagagagaagaaactcggcgagttcggcaaagctaagggatcacgcgcgatctggtacatgtggctgggcgctagattcctggagttcgaggccctcggtttcatgaacgaggaccactggttctctagagaaaactccctgtccggcgtggaaggcgagggcttacataagctcggctatatcctgcgcgatataagcaaaataccgggaggcaatatgtatgccgatgacacggccgggtgggacacccggatcacggaggacgacttacagaacgaagcgaagattaccgacatcatggagcccgagcatgcgcttctagctaccagtatcttcaagttgacctaccaaaataaggtggtccgcgtgcagcggccggccaaaagcggcaccgtgatggacgtaatatcccgccgggaccagcgcgggagcggccaggtgggcacctatggtttaaacacgttcaccaacatggaggtgcagttaatcagacaaatggagtccgaagggatcttcagcccctccgagctggagaccccgaaccttgccaagcgcgtactggattggctggaaaagcagggagcggagcggctcaagcgcatggccatcagcggcgatgactgtgtagtgaaacccatcgatgaccggtttgcaactgcccttacggcactgaacgacatgggtaaggtccgtaaggatatcccacagtgggaacccagcaagggctggaatgactggcagcaggtcccgttttgctcgcaccactttcaccagttgataatgaaggatggtcgggagatcgtagtcccctgccgcaatcaggatgagttggtgggacgggcgcgcgtgtcccagggcgccgggtggagcctccgggaaactgcctgcctcgggaagtcctacgcccagatgtggcagttaatgtacttccaccgccgggacttgcgccttgcggcgaacgccatctgcagcgcggtccccgtggactgggtacccaccagccgcaccacctggtccatacacgcccaccaccagtggatgacgaccgaggacatgctgagcgtatggaacagggtgtggatagaggaaaacccgtggatggaggacaagactcacgtgtctagctgggaggaggtcccctacctgggaaagcgtgaggaccagtggtgcggctccctcatcggcctgaccgcccgggccacgtgggccacgaatattcaggtggccatcaaccaagttaggagattgatcggtaacgaaaactacctcgattacatgactagcatgaagcgcttcaaaaatgagtcagaccccgagggggccctatggtga

SEQ ID NO: 24084 - RNA, 9879 nt, synthetic construct
  misc_feature 1..9879: note = derived and/or modified CDS sequence (opt11) from DENV-1__EU660390__SS-prME
  source 1..9879: mol_type = other RNA
tctgttaccatgctgctcatgctgatgcctaccgccctggccttccatctcaccacccgtgggggcgagccccacatgatagtgtcaaagcaggagcgcggaaagagcctactgttcaagacatcagcgggcgtcaacatgtgcaccctgatcgcaatggacctgggagagctttgcgaagacacgatgacatacaagtgtccccggatcacagaggccgagcccgacgacgtagactgctggtgcaacgccaccgacacgtgggtcacctacgggacatgtagccagaccggtgagcatcggcgcgacaagcggtccgtggcgttggcgccccacgtgggcctggggctggagacgagaaccgaaacgtggatgagctctgagggcgcctggaagcagatccagagagtagagacatgggccctccgccaccctggctttacggtgatcgccctgttcctggctcacgcaataggcaccagcatcactcagaaggggatcatcttcatcttgctgatgctggttacaccctcaatggccatgcggtgtgtgggcatcggcagtcgcgactttgtggagggactctccggcgccacgtgggttgacgtcgtgctagagcacgggagctgcgtgacgaccatggccaaggacaaacccaccctggacatcgagctgctgaaaacggaagtcactaatcccgcggtactgaggaaactctgtatcgaagcgaagatctccaacaccacgacggacagccgctgcccaacccagggggaagccacactggtggaggagcaggacgccaacttcgtatgccggcggacctttgtcgaccgtggctgggggaacggctgcgggctgttcggcaaggggtccttgatcacctgcgccaagttcaagtgcgtgaccaagttagagggcaaaattgtccagtacgagaacctgaagtacagcgttatcgtgaccgtacataccggcgaccagcaccaggtggggaacgagagcacagagcacgggaccaccgccaccatcacacctcaggctcccacaaccgagatccagctcaccgattacggggccctaaccctggattgctcgccccgtacgggccttgacttcaatgaaatggtactccttaccatgaaggagaaaagctggctcgtgcataagcagtggttcctggatctgcccctgccctggaccagcggcgccagcacctcccaggaaacatggaaccggcaagacctcttggtgacctttaaaaccgcccacgctaagaagcaggaggtggtggtgctgggcagccaggagggggcaatgcacaccgcccttacgggggcgaccgagatccagacttcaggcaccaccaccatcttcgctgggcatctgaagtgtcgcctcaagatggacaagctgacgctcaagggaatgagctacgtcatgtgcacagggtcattcaagttggagaaggaggtagcggagacgcagcacggcaccgtgctggtccagatcaagtacgaggggaccgacgccccctgcaaaatccccttctctacccaagacgagaagggggtgacgcagaatggccggctgatcacggccaacccgatcgtgactgacaaagaaaagccagtaaatatcgaggccgagccgccttttggggaatcctacatagtgatcggtgccggcgaaaaagccctgaaactcagctggttcaagaaggggtccagcatcggaaaaatgttcgaggccaccgcacgaggagcccgccgtatggcgatcctgggtgacaccgcctgggacttcggctctatcggcggggtgttcacgagcgtcgggaagctagtccaccagatctttggcaccgcttacggagtcctgttctccggagtaagctggacgatgaagatcgggatcggcgttttactcacgtggcttggcctcaactcccgtagcacctccctgtccatgacctgcattgccgtgggcctcgtcaccctgtatctgggcgttatggtgcaggcggacagtggttgcgtcattaattggaagggccgggaactcaaatgcggaagcggcatttttgtcacaaacgaggtgcacacatggaccgagcagtacaagttccaggcggacagcccgaagaggctatccgcggccattggaaaggcctgggaggagggggtctgtggcattcggtccgccacccggctggagaacatcatgtggaaacagatctccaatgagcttaaccacatattgcttgagaacgacatgaagctcaccgttatcgtgggggacgtggcgggcatcctgggacagggccgtaaaatgattcgcccccagcccatggagtacaagtacagttggaagtcctggggcaaggccaagatcatcggggccgacgcacagaatacaaccttcatcattgacggtccaaacacaccggaatgccccgacgaccagcgcgcgtggaatatctgggaagtggaggactacgggttcggcatcttcaccactaacatctggctaaagctccgtgactcgtatacacaggtatgcgaccaccggctgatgagcgccgccatcaaagacagcaaggccgttcatgccgacatgggctactggatcgagagcgagaagaatgagacctggaagctggcgcgcgcaagcttcatcgaggtgaagacctgcatctggcccaagtcccacacgttgtggagcaacggggtgctggagagcgagatgatcatacctaagatctatggcgggccgatcagccaacacaactaccggcctggctatttcacccagaccgccgggccgtggcacctgggcaagctcgagttagacttcgacctgtgcgagggtaccacagtcgtggtggacgagcactgtgggaaccgtgggccgtccctccggacaaccaccgtcaccgggaagattatacacgaatggtgctgccggagctgcacgctgccgcccctacggtttagaggtgaggacgggtgctggtatggcatggagatccggccagtgaaggagaaggaggagaacctcgtaaagtccatggtgagcgccggctcgggggaggtggactccttcagcctgggcctcctttgcatctcgatcatgatagaggaggtgatgcgcagccggtggtctcgcaagatgctcatgaccggcacacttgccgtgtttttcctcctgattatgggccagctgacttggaacgatctcatcagactctgcataatggtgggcgctaacgccagcgatcggatgggcatgggcaccacctatttggccctcatggcaaccttcaaaatgcggccgatgtttgcagtggggttgttatttcggcgcctgacctcccgggaggtgctgcttctcaccatcggattgagccttgtagcgtccgtggagctcccgaacagcctggaagagctgggcgacggccttgccatgggcattatgatcctgaagcttttaaccgacttccagtcacaccagttgtgggccactctgctcagcctcacgttcattaagacgacattttccctgcactacgcctggaagacgatggccatggtcctctcgatcgtctccctgttccccctgtgcctctcaacgaccagtcagaagaccacctggcttcccgtcctgcttggtagccttggctgcaagccgctgacgatgttcttgatcgccgagaataaaatttgggggcgaaaaagctggccgctgaacgagggcatcatggccgtaggcatcgtatcgatcctgctcagcagcctactgaagaacgacgtacccctggccggccccctggtggccggcgggatgctgatcgcgtgctatgttatcagcggctcgtctgccgacctctccctagagaaggctgccgaggtctcctgggaggaggaggctgagcattccggtgcgtcccacaacatcctggtggaggtgcaggacgacggcaccatgaagatcaaggatgaggagcgggacgacacgctcactatcctattaaaggcaaccttgctggccgtctctggtgtttatcccctgagcattcccgctactctgtttgtgtggtacttctggcagaagaagaaacagcgctccggtgtcctgtgggacacccccagcccgcctgaggtcgagcgggctgtgctcgatgatggaatctaccgaattatgcagcgagggctgctcggccgctcacaggtcggggtgggcgtgttccaggagaacgtcttccacaccatgtggcatgtgacccgcggggccgtgctgatgtaccagggaaagcgcctggaacctagctgggccagcgtcaagaaggacctgataagctacggcgggggctggcggctacgcgggagctggaacacaggcgaggaggtccaagtgatcgccgtcgaacccgggaagaatcccaagaatgtgcaaaccgccccgggaaccttcaagacccccgagggcgaggtgggcgccattgccctggacttcaagcctggcacgagcgggtcccccatcgttaaccgggagggcaagatcgtgggcctctacgggaacggtgtggtcaccaccagcgggacctacgtgagcgccatcgcacaggccaaggcgagtcaggagggcccgctccccgagatcgaggatgaggtgtttcgaaagcggaacctgacaatcatggacctccacccagggagcggcaaaacccgccggtacctgccggccatcgtccgtgaggccatcaagcgcaagctgcggactctcatcctggcccctaccagggtggtcgcctcagagatggcggaagccctgaaaggcatgcccatccggtatcagacgacagccgtcaagagcgagcacaccgggaaagagatcgtagacctcatgtgccatgccacttttacgatgagactgctgtctccggtgagagttccgaactacaacatgatcatcatggatgaagcacatttcaccgaccccagcagcatcgcggcccgcggctatattagcacgcgggtggggatgggcgaggccgccgccatcttcatgaccgcaacgccgcccgggtcagtggaggccttcccgcagagcaacgccgtaatccaggacgaggaacgcgacatccctgagaggtcctggaatagcggatatgagtggataaccgattttccaggcaagaccgtatggttcgtgccatccatcaaaagcgggaatgatattgccaactgcctacgcaagaacgggaagcgggtcatccagctgtcccgcaagaccttcgacacggaataccagaaaaccaagaataacgactgggactacgtagttaccaccgacatcagcgaaatgggcgcaaacttccgggcggatcgcgtaatcgacccgcgcagatgtttaaagcccgttatcctaaaagatggccccgagagggtgatcttagccggtcccatgcccgtcacggttgcttccgccgctcagcggcggggcaggattggcaggaatcacaataaggagggggaccagtacatatacatgggccaacccttaaacaatgatgaggatcacgcccactggaccgaagcaaaaatgttactggacaacattaacacaccggagggtatcatcccggccctgttcgagccggagcgggagaagtcggccgcggtggacggagagtaccgcctcaggggggaggcgcgcaaaaccttcgtagagctcatgcgccgcggcgacctgccagtgtggctgtcctacaaggtcgcatcagaaggcttccagtactctgaccgacgctggtgtttcgacggggagcggaacaaccaggtgctggaggaaaacatggacgttgagatctggacgaaggagggagagcgcaaaaagctgcgcccccgatggctcgatgcccggacctactccgaccccttagcactgcgcgaattcaaggaatttgcagccgggcgtcgctctgtctccggcgacctcatcctggagatcggaaaactaccgcaacacctcacccaacgggcccagaacgcgctggacaacctggtgatgctccacaacagcgagcagggcgggcgcgcgtaccgacacgccatggaggagctgcccgacaccatcgagacgctgatgctcttagccttaatcgccgtcctcacggggggcgtaacactctttttcctttccgggcgcggcctcggcaagacgagcatcgggctgctgtgcgttatggcctcatcagtactcctttggatggcgagtgtcgagccccactggatcgccgccagcatcatcctggagttcttcctcatggtactcctgatacccgagccggatcggcagcgcaccccgcaggacaaccagctcgcatacgtggtaatcggactcctatttatgatcctcacggtggccgcgaatgagatggggctgctggagacgaccaagaaggatctcggcatcgggcacgtggctgtcgagaaccaccaccacgctgccatgctcgatgtggacctacaccccgcgtccgcctggaccctctacgcagtggccacgaccatcatcacccctatgatgcgccacacgatcgagaacacgaccgccaatattagcctaaccgccatcgcgaaccaggccgcaattctgatgggccttgataaaggatggccgataagtaagatggacatcggagtccccctcctggccctcgggtgctacagccaggtgaaccccctaaccctgacggcggccgtgctcatgctggtagcccactacgctatcatcgggcctggcctgcaggccaaagcgacccgtgaggcccaaaagcgcacagccgcagggatcatgaaaaaccccactgttgacggtatcgtggccatagacctcgaccccgtcgtgtacgacgcgaaattcgagaagcaactgggccagatcatgttgctaattttgtgcacgtcccagatcctcctcatgcgtaccacctgggccctgtgtgagagcataaccctggcgaccgggcctctcaccaccctgtgggaggggtccccaggcaaattctggaacaccacaatcgctgtatctatggctaacatatttcgcggttcctacctggcgggagctgggctcgccttcagcctcatgaagtccctgggcgggggccggagagggaccggcgcccagggcgagaccctcggggaaaaatggaagcgtcagctgaaccaactgtccaagagcgagtttaacacgtacaagcgctccggcatcatggaggtagaccggagcgaggccaaggaagggttgaaaaggggtgagacgacgaagcacgcagtgtcccgagggaccgccaaactccgctggttcgtagagcggaaccttgtaaagcctgagggaaaggtgatcgacttgggctgcggtagaggcgggtggagctactactgtgcaggcttgaagaaggtcactgaggttaagggatatacgaagggcgggcccgggcacgaggagccaatcccgatggccacctatggttggaacctggtgaagctgcactccggcaaggacgtgttcttcatcccccccgagaagtgcgacaccctgctgtgcgatatcggtgaatcgtcccccaacccgacgattgaagaggggcggacgctgagggtcctcaagatggtggagccctggctgcggggcaaccagttctgcatcaagatcctgaacccctacatgccgagcgtggttgagacactcgagcaaatgcagcgcaaacacggcggaatgctagtgcggaacccgctgtccaggaacagcacccacgaaatgtactgggtctcttgtggcaccgggaacattgtgtcggccgtcaacatgacctcccgaatgttgctgaatcgctttacgatggctcaccgtaaacccacctacgagcgggacgtcgatctgggcaccgggaccagacacgttgccgtggaaccggaggtagccaacctcgacatcatcgggcaacggatcgaaaacatcaagcacgagcacaagagcacttggcactacgacgaggataatccctacaagacgtgggcttatcacggctcctacgaagttaagccgagtgggagtgcctcaagtatggttaacggcgtcgttaagttactcaccaagccctgggacgtaatccccatggttacccagatcgcgatgacggacaccacccccttcggccagcaacgcgtctttaaggagaaggtggacacccggacgccgaaggccaaacgaggtaccgcgcagatcatggaggtgacagcccggtggctgtggggctttttgtcccgcaacaagaagcctcgcatctgcacccgagaggaattcacgcggaaggtgcgtagcaacgcggccatcggggccgtgttcgttgacgagaatcaatggaactccgctaaggaagcggtggaagacgagaggttctgggatctagtgcaccgcgagagggaactccacaaacagggaaaatgtgccacctgcgtctacaacatgatggggaagcgcgaaaagaagctgggcgagttcggtaaagccaaaggctcccgggccatctggtacatgtggttgggcgcccgattcctcgagttcgaggcgctaggatttatgaatgaagaccactggttctcccgtgagaacagcctgtccggcgtggagggggagggcctccacaagttagggtacattctgcgcgatatctctaaaattcccggcggcaacatgtacgccgacgacaccgccgggtgggacacacgcatcacagaggatgacttgcaaaacgaagccaagataaccgatatcatggaacctgagcacgccctcctcgcgaaggcgatcttcaaacttacctaccagaacaaagtggtccgggttcaaagacctgccaaaaacggtacagtgatggacgtgatctccaggagagaccagcgaggttccggacaagttggcacgtatggcctgaataccttcacgaacatggaggcgcaactgattcgccagatggagtccgagggcatcttcagcccgtccgagctggagacaccaaacctggctgagcgggcgttagactggctcgagaagtacggtgtggagcgcttaaagaggatggccatctctggcgacgactgcgtagtgaagccgattgacgaccgcttcgccaccgccttgacggcactcaacgacatggggaaggtgaggaaagacatccctcagtgggagccctccaagggttggaacgattggcaacaggtcccattttgtagtcatcacttccaccagctgataatgaaggacggccgcgagattgtagtgccatgccggaaccaggacgagctcgttgggcgcgcgcgggtgagtcaaggcgccgggtggagcctccgcgagaccgcctgcctgggtaaaagctatgcccagatgtggcagctgatgtacttccaccggcgcgacctccggctggcggccaacgccatctgctccgccgtgcccgtcgactgggtgcccaccagccgcaccacgtggtccatacacgcccaccaccaatggatgacaacagaggacatgctgtccgtgtggaaccgtgtctggatcgaggagaacccctggatggaggacaagacacatatttcaagctgggaagacgtgccgtacctcggtaagcgggaggaccagtggtgcggctcccttatcggcctgactgcgcgagcgacctgggccactaacattcaggtggccattaaccaggtccggcgcttgataggcaatgagaactacctggattatatgacctccatgaagcgtttcaagaatgaatccgaccccgagggcgcgttatggtag

SEQ ID NO: 24085 - RNA, 9879 nt, synthetic construct
  misc_feature 1..9879: note = derived and/or modified CDS sequence (opt11) from DENV-1__EU660391__SS-prME
  source 1..9879: mol_type = other RNA
agcgtgaccatgctgctcatgcttatgccaaccgccctggccttccacctcacgacccggggcggtgagcctcacatgatagttagtaagcaggagcggggcaagagcctgctgttcaaaaccagcgcaggggtgaacatgtgcaccttgatcgccatggacctgggcgagttctgcgaagacaccatgacatacaagtgccccaggattaccgaggccgagccagacgatgtggactgctggtgcaacgccaccgacacgtgggtgacctatgggacgtgcagccagaccggcgagcaccggcgggacaaacggtccgtggccctggcgccccacgtggggctagggctggagacgcgcaccgagacctggatgtcttcagagggcgcttggaagcagattcagcgggttgagacctgggccttgcgtcaccccgggttcacggtgattgcactctttttagcgcacgccatcgggaccagcatcacccagaaggggatcatcttcattctgctcatgctggtaacaccctccatggccatgcggtgcgtaggcatcggcagccgggacttcgtggaggggctgtccggagccacgtgggtggacgttgtgttggaacacgggagctgcgttactacaatggccaaggataagccgaccctggacatcgagctgctgaagacggaggtcaccaaccccgcggtgctgcggaaactgtgcatcgaggccaagatcagcaacaccaccacggacagccgctgccccacccaaggcgaggccaccctcgtggaggagcaggacgccaacttcgtctgccggcgcaccttcgtagaccggggctgggggaacggctgcgggctgttcggcaagggatccctgataacgtgcgccaaattcaagtgcgttactaagctcgagggcaagatagtccagtacgagaacctgaagtacagcgtgatagtgaccgtccacaccggcgaccagcaccaggtggggaacgagtccacggagcacggcaccaccgctaccatcacaccacaggccccctcgacagagattcaactgaccgactacggcgccctcactctcgactgcagtccgagaaccggcctggacttcaacgagatggtccttctgactatgaaggagaaatcctggctggtgcacaagcagtggttcctcgacctgccgttgccctggacgagcggcgccagcaccagccaagagacatggaacagaaaggatctcctcgtgacgttcaagaccgctcacgctaaaaagcaggaggtcgtggtgctgggctcccaggagggcgccatgcacaccgccctgacaggggccacagagatccagacaagcggaaccaccacgatcttcgccgggcacctgaagtgtcgcctgaaaatggataagctcaccctgaagggcatgtcctacgtcatgtgcaccgggtcgttcaaactggaaaaggaggtggcggaaacccagcacggcaccgtgctcgtccagatcaagtacgaggggaccgacgccccatgcaagatccccttcagcacccaggacgagaagggagtgacccagaacggccggctcattacggccaacccgatcgtgaccgacaaggagaagcccgtcaacatcgaagccgagccacccttcggcgagagctacattgtgattggcgctggcgagaaggccctgaagctgtcctggttcaagaaggggagctccatcggcaagatgttcgaggccaccgctcgcggtgcacggcgcatggcaatcctcggcgacacggcctgggatttcgggagtataggcggcgtcttcacgtccgtcgggaaactggtgcaccagatctttggcactgcctacggggtgctgttcagcggtgtttcctggaccatgaagatcgggatcggcgtgctcctgacctggctgggactcaacagcaggtctacgagcctgtctatgacatgcatcgccgtggggctagtcaccctatacctgggcgtgatggtgcaggccgacagcgggtgcgtcatcaactggaagggccgggagctgaagtgcgggagcggaatctttgtgaccaacgaggtgcacacctggaccgagcagtacaagttccaggcggactcccctaagcgcctcagcgccgccatcggcaaggcctgggaggagggggtttgcggcatccggagtgccactcgcctcgagaacatcatgtggaaacagatttccaacgagctgaaccatatcctcttggaaaatgacatgaagttcaccgtggtggttggggacgtggcgggcatcctggcccagggaaagaagatgatccggccccagcccatggagtacaagtattcgtggaaatcctggggcaaagctaagatcattggcgccgatgttcaaaacaccacgttcattatagacgggcccaacaccccggagtgccccgacgaccagcgcgcgtggaacatttgggaggtcgaggactacggcttcgggatcttcacgaccaacatctggttaaaactgcgggactcctacacccaggtgtgtgaccaccgccttatgagcgccgcgattaaagattccaaggccgtgcacgccgacatgggctactggatcgagtcggagaagaacgagacctggaagctcgcgcgggcctcctttatagaggttaagacctgcatttggcctaaaagccacaccctgtggtccaacggcgtgctggagagcgaaatgatcatccccaagatctacggtggccccatatcccaacacaactaccgacccgggtatttcacgcagaccgctgggccctggcacctcggaaagctggagctggacttcgacctctgcgagggcaccaccgtggtggtggacgagcactgcggcaaccgcgggccgagcctgcgcactaccaccgtgaccggcaagatcatccacgagtggtgctgccggtcctgcacgctgccgcccctgcgctttaagggggaggacggctgctggtacgggatggagatccggcccgtcaaggaaaaggaagagaacctggtgaagagcatggtgtcagccggctcgggcgaggtagacagcttttccttagggctcctgtgcatcagcatcatgatcgaggaggtgatgcgctcccgatggagccgcaagatgctcatgacaggcaccctcgccgtgttcttcctgctgatcatggggcaactcacatggaatgacctgatccggctgtgcatcatggtcggcgcgaatgcctccgaccgtatgggcatgggcacgacctacctcgccttaatggccaccttcaagatgcgcccgatgttcgccgtgggcctcctgttcagacgactgacgagcagggaggtgctactcttgaccatagggctgtccctcgtcgctagtgtggagctgcccaattccctggaggaactaggcgatgggctggccatgggcatcatgatcctaaagttattaaccgatttccaaagccaccaactgtgggccaccctcctgtccctgacctttatcaagacgacattcagcctgcactatgcctggaagacaatggcaatggttttgtctatagtgagcctcttccccctctgcctgtccaccacgtctcagaagaccacctggctgcccgtgctcctgggttccctgggatgcaagcccttaaccatgttcctgatcgccgagaacaagatctggggccgcaagtcctggcccctgaacgaggggatcatggccgtcggcatagtgagtatccttctgtccagcctgctcaagaatgacgtgcccctagccgggcccctgatcgcaggaggcatgcttatcgcgtgctacgtcatttccgggagttccgccgacctgagcctagagaaggctgccgaagtttcatgggaagaagaggcggagcatagcggcgcgtcccacaacatcctagtggaggtccaggacgacgggacgatgaagatcaaggacgaggagcgtgacgataccctgaccatcctgttgaaggccaccctgctggccgtaagcggcgtgtaccccctctcaatacccgccactctgttcgtctggtacttttggcagaagaagaagcagcgaagcggggtgctgtgggacacgcccagcccgcccgaggtggagcgggccgtcctcgacgatggcatctaccgtatcatgcagcggggcctgctgggtcgcagccaggttggcgtgggcgtcttccaggagaacgtgttccacaccatgtggcatgtcacccggggcgcggtactgatgtaccaagggaagcgactagagccctcctgggccagcgtgaaaaaggacctgatctcctacggcggagggtggcggttacaggggagctggaacactggtgaggaggtgcaggtaatcgcagtggagcccggcaagaaccctaagaacgtgcagacggcccccgggactttcaagacgtccgagggcgaggtcggcgcaatcgcgctcgacttcaagcccgggacgtccggcagccccatcgtgaacagggaggggaagatcgtgggcctctacggcaacggggtcgtgacgacctcaggcacctacgtgagcgccatcgcccaggcgaaggcgtcccaggacgggcccttaccggagatcgaggacgaggtcttccggaagcgcaaccttaccatcatggacctacacccaggcagtgggaagactcggcgctatctgcccgccatcgtgcgggaggctatcaagcgcaagctccggacgctgatattagccccaacccgcgtggtcgcctccgagatggccgaggcccttaaaggcatgcccatccgctaccaaaccactgccgtaaagtccgagcacaccggcaaggagatcgtggacctaatgtgccatgccaccttcaccatgaggctgctttcccccgtccgcgtacccaactacaatatgatcatcatggacgaggcccacttcacggatccgagctcgatcgcggcccggggctacatcagcacccgcgtgggaatgggggaggccgcagccatcttcatgaccgcgacgcccccgggatccgtggaggccttcccccagagcaacgcggtgatccaggacgaagagcgggacatccctgaaagatcctggaacagcgggtatgagtggatcaccgacttccccggcaagaccgtatggttcgtcccatctataaagagtggtaacgacatcgccaactgcctgcggaagaatgggaagcgcgtcattcagctttcccggaagaccttcgacaccgaataccagaagacgaaaaacaacgactgggactacgtggtgaccaccgacataagcgaaatgggcgcaaatttccgcgccgaccgggtgattgacccccgcagatgcctcaagccggtgattctgaaagacgggcccgagcgcgttatcctagctggccccatgcccgtgaccgtagcctccgccgcgcagcgtcgcgggcggatcggtcgcaatcacaacaaggagggcgaccagtacatctacatggggcaaccgctcaacaacgacgaggaccacgcccactggacggaggccaagatgctgctggacaacatcaatacccctgaaggcatcatccccgccctcttcgaacccgagcgagagaagtccgccgcgatcgacggcgagtaccgcctccgcggcgaggcaaggaaaaccttcgtggagctgatgcgccgcggggacttaccggtgtggctgagctacaaggtcgcctcagagggcttccaatacagcgacagacggtggtgctttgacggcgagcgtaacaatcaggtgctggaagagaacatggacgtggagatctggaccaaggagggggagcggaagaaactgcgcccccggtggctggacgcccgcacatactccgacccgctggccctccgggagttcaaagagttcgccgccggccgccggagcgtctcgggagacctgatactggagatcggcaagctgccgcagcaccttacccaacgcgcccagaacgccttagacaatttggtgatgctgcacaacagcgagcagggtggacgggcctaccgccacgcgatggaggaactgcctgacaccatagagaccctcatgctgcttgcactcatagcggtgctgacgggcggggtcaccctgttcttcctctccggccgggggctgggcaaaaccagcatcggcctgctctgcgtgatggccagcagcgtgttactgtggatggcgtccgtagagccccactggatcgccgccagcatcatcctcgagttctttctgatggtactgctcatacccgagcccgaccgccagcggaccccgcaggacaaccagttagcctacgtggtcatcgggctcctctttatgatcctgaccgtggccgcgaacgagatgggccttctcgaaaccaccaaaaaagatctggggatcgggcacgtggccgtcgagaatcaccaccatgccgccatgctggacgtggacctccaccccgcttccgcttggacgttatacgccgtggccaccacgatcatcacccccatgatgcgccacaccatcgagaataccacggccaacatcagcctgaccgcgatcgcgaaccaggccgccatcctcatggggctggataagggctggccgatctccaagatggacatcggagtcccgctactcgccctggggtgttacagccaggtgaaccccctgaccctcaccgcggcggtgcttatgttggtggcccactatgccatcataggcccaggactgcaggccaaggcgacgcgggaagctcagaaacgcacagccgccggcatcatgaagaaccccacggtggacgggatagtggctatcgacctggaccctgtcgtatacgacgcgaagttcgagaaacagctgggccagatcatgctcctgatcctttgcacctcccagattctcctgatgcgcacgacctgggctctgtgcgagagcatcaccctcgccaccggcccgctgacgaccctgtgggaggggtcacctggcaagttctggaacaccactatcgccgtgtcgatggccaacatcttccggggctcgtacttggctggcgccggactggcattctccctgatgaagtcgctcgggggcggacgccggggcacgggggcccagggcgagacgctgggtgagaaatggaagcgacagctgaaccaattatccaagtccgagttcaacacctacaagcgatccggaataatggaggtcgaccgcagcgaggccaaggaaggcctgaagaggggggaaaccacgaaacacgcggtgtccagaggcaccgccaaactgcggtggttcgtggagcgcaacttggtcaagccagaggggaaagtgatcgacctgggctgcggccgcggcgggtggagctactactgcgccgggttgaagaaggtgaccgaggtcaagggatacacgaagggcgggcccggccacgaggagcccatccccatggccacgtacgggtggaacctggtgaaactccattccggcaaggacgtgttcttcatcccgcccgagaagtgcgatacgctactgtgcgatatcggagaaagcagtcccaatcccacaatcgaggagggccgcacccttagggtgttaaaaatggtggagccgtggctccgcgggaaccagttttgtatcaagatactcaacccctacatgccctccgtggtcgagacgctggagcaaatgcagcggaagcatggcggtatgctcgtacgcaacccactctcccggaacagcacccacgagatgtattgggtgtcctgcggtactggcaatatcgtttctgcggtgaacatgacgtcacgcatgctgctgaaccgcttcaccatggcgcatcgcaaaccaacctacgaacgcgacgtggacctcggggctgggacccggcacgtcgccgtggagcccgaggtggccaatttggacatcatcggccagcgcatagagaatatcaagtacgaacacaagagcacttggcactacgatgaggacaacccctacaagacctgggcctaccacggctcctacgaggtcaagccaagcgggagcgcctccagcatggtgaacggcgtagtgaagctgctcacgaagccgtgggacgtgatccccatggttacacagatcgccatgaccgacaccacgcccttcggacagcagcgggtgttcaaggagaaggtggacacccgcacccccaaggccaagcgggggacagcccagatcatggaggtcacggcgaaatggctgtgggggttcttatcccgcaacaagaagccacggatatgcacccgcgaggagttcacccggaaggtgcgtagcaacgcagccatcggcgccgttttcgtcgacgaaaaccagtggaactccgcaaaggaggccgtggaagacgagcggttctgggacctcgtgcaccgcgagcgggagctgcataagcagggtaaatgtgcaacctgcgtctataacatgatgggcaagagggagaagaagctgggggagttcggcaaggccaaggggagccgggcaatctggtacatgtggctcggcgcgcgcttcctggagtttgaggcattgggcttcatgaacgaggaccactggttctcccgggagaatagcctctcgggcgtggagggcgaggggctgcacaagcttggttacatcctccgcgacatcagcaagattccaggcggcaacatgtacgccgacgacacggccggctgggacacccggatcaccgaagacgacctgcagaacgaggccaagatcacagatataatggagccggaacacgctctcctcgccaagtccatcttcaagttgacgtaccagaacaaggtggtccgcgttcagcgcccggccaagaatgggacagtgatggacgtcatcagccgccgcgaccaacggggcagtggccaggtgggaacctatggcctcaacaccttcacgaatatggaggcgcagctcatccgccagatggagagtgaggggatcttctcccccagcgagctggagacccccaacctcgccggtagggtgctcgactggttagagaagcacggtgtcgagagactgaagcggatggcgatatccggtgacgactgcgtcgtgaagcccatcgacgaccgcttcgcgaccgccctcaccgcactgaacgacatggggaaagtccggaaggatatcccgcagtgggagcctagcaagggctggaacgattggcagcaggtccccttctgctcacaccactttcaccaactgatcatgaaggacggccgcgagatcgtcgtcccctgtcggaaccaggatgagctcgtcgggcgcgcccgtgtgtcccagggcgcggggtggtcactgcgcgagacggcctgcctgggcaagagctatgctcagatgtggcagttaatgtacttccaccggcgcgacctgcggctggccgcaaatgccatctgcagcgccgtcccagtggactgggttccaacctcccgcaccacctggagcatccacgctcaccatcagtggatgacgacagaggacatgctctctgtatggaaccgggtctggatcgaggagaatccgtggatggaggacaagacgcatatcagctcctgggaggacgtgccatacctggggaaacgcgaggatcagtggtgcggcagtctgatcggcctcaccgcccgggcgacgtgggctaccaacatccaggtcgccatcaaccaagtgaggcgcttaatcggaaatgaaaactacttagattacatgacctccatgaaacggttcaagaatgagagcgacccagagggtgccctctggtga

SEQ ID NO: 24086 - RNA, 9879 nt, synthetic construct
  misc_feature 1..9879: note = derived and/or modified CDS sequence (opt11) from DENV-1__EU660393__SS-prME
  source 1..9879: mol_type = other RNA
agcgttaccatgctgctcatgctgatgccgaccgccctcgccttccacctaacaacgcgaggcggggagccacacatgatcgtgtccaagcaggaacggggcaaaagcctcctgttcaaaacatccgcaggggtgaacatgtgcactctgatcgccatggatcttggcgagctgtgcgaggacaccatgacatataagtgtccccggatcactgagacggaacccgacgacgtggactgctggtgcaacgccacggacacctgggtgacctatggaacctgcagccagacaggcgagcacaggcgcgacaagcggtccgtagccttggctccccatgtggggctggggctggagacgagaactgagacctggatgagcagcgagggcgcgtggaagcagatccaacgggtcgagacgtgggccttgcgccaccccgggttcaccgtgatcgccctgttcctggctcacgcgataggcacctcgatcacccagaaagggatcatctttatcctcttaatgctggtgacgccctcaatggctatgcggtgcgtcggaataggctcacgcgattttgtggagggtctctcaggcgccacctgggtggacgtcgtcctggagcacgggagctgcgtgaccacgatggcaaaagacaaacccacactggacatcgaactcctgaagactgaggtgaccaaccccgccgttctgcgtaagctctgcatcgaagcgaagatatcaaacaccacgacagatagccgttgcccaacccagggagaagccaccctggtggaggagcaggacgccaattttgtctgccggcgcacgttcgtggaccggggctgggggaatggctgcggtctgttcggcaagggatcccttatcacgtgcgcgaaattcaaatgcgtaaccaagttggagggtaaaatcgtccagtacgagaacctgaagtactcagtgatcgtgaccgtccacacaggcgaccagcatcaggtggggaacgagtccaccgagcacgggactaccgccaccataacgccacaagcacccaccactgaaatccagctcaccgactatggggcgctgactctcgattgttcgccgcgcacaggccttgatttcaacgagatggtcctgttaactatgaaggagaaatcttggctcgtacacaagcagtggttcctggatttacctctcccatggacctcaggggcctcaacatcccaggaaacctggaaccggcaggacttgctggtcaccttcaaaaccgcccacgccaagaagcaagaagtggtggtgctgggcagccaggagggcgctatgcacacggccctgaccggagccaccgagatacagacctccggcacgacgaccatcttcgcagggcacctcaagtgtcgcctgaagatggataaactgaccctgaagggcatgtcttatgtcatgtgcactgggagcttcaagctcgaaaaggaggtggccgagacccagcacggcaccgtgctggtccagatcaagtacgagggcaccgacgcgccctgcaaaatacccttcagcacgcaggacgagaagggaatcacccagagcgggcggctgatcactgccaatccgatcgtgaccgataaggagaagcccgtgaacatcgaggcagaaccgccattcggggagtcatacatcattatcggcgccggcgagaaggccctaaagctatcctggttcaagaagggaagctccatcggcaaaatgttcgaggccactgcacgcggagcccggcgaatggccatcctgggggataccgcatgggatttcgggagcatcggaggcgtcttcacctccgtggggaagcttgtgcaccagatcttcggcactgcttacggggtgttgttctctggcgtgtcctggacgatgaaaatcggtattggcgtactgctgacctggctcggcctgaactcacgatccacctctctgtcaatgacctgcatcgccgtcgggctcgtgacgctgtacttaggcgttatggttcaggccgactctggttgtgtcatcaactggaagggccgggagttgaagtgcgggagcgggatattcgtgacaaacgaggtccacacctggactgagcaatacaagtttcaggccgactcgcccaagcgcctgtcagcagccatcggcaaggcctgggaggagggagtgtgcggcataaggtccgccacccgcctggagaatatcatgtggaagcagatttcgaacgagctcaaccacatcctgctggagaacgatatgaaatttacggtggtggtgggggacgtggccggcatcctcgcccaggggaagaagatgatccggccacagcccatggagtacaagtacagctggaagtcctggggcaaggccaagattatcggcgccgacgtccagaataccaccttcatcatcgacgggccgaacaccccggagtgccccgacgaccaacgcgcatggaatatctgggaggtcgaggactacggtttcggcatcttcacgaccaacatctggctgaaactgagggactcctacacccaggtatgcgaccaccgcctcatgagcgcggctatcaaggactccaaggccgtccacgccgatatgggctactggattgagagcgagaagaacgagacctggaaactggcacgggcgtcattcatagaggttaagacctgcatctggcccaaaagccacaccctgtggtcaaacggggtcctcgagagcgagatgatcatccccaagatctacggaggcccgatcagccaacacaactaccggcctgggtacttcacacagaccgccggcccctggcacctgggtaagctggagctagattttgacctgtgcgagggtacgaccgttgtggtagacgagcactgtggaaaccgagggccgagcctgagaaccaccaccgtcaccggcaaaattatccacgaatggtgctgtcggtcatgcaccctgccgcccctccgcttccgcggggaggatggctgctggtatggaatggaaattagacccgtgaaagagaaggaggagaacctggtcaagtccatggtcagcgccggttccggcgaggtggacagcttcagtttaggtctgctgtgcatcagtattatgattgaagaggtgatgcggtcccgatggagcagaaagatgctcatgaccggaacattggccgtcttcttcttgctgatcatgggccagttaacctggaatgacttaataagactctgcataatggtgggcgcgaacgcttccgaccgcatggggatgggcaccacctacctggcgctaatggcgactttcaagatgcggccgatgttcgctgtgggactcctgttccgacggcttaccagccgtgaggtcctccttctgacgatcgggctgtccctggttgccagcgtggagctaccaaattccctggaggagctgggcgacgggctggcgatgggcatcatgatcttgaagcttctgacggacttccagagccaccagctctgggccacgctgctgtccctcaccttcatcaagaccaccttcagcttacactacgcctggaagacgatggccatggtcctctccatcgtgagcctctttcccctgtgcctgtccaccaccagccaaaagacaacgtggctccccgtcctgctgggctccctcgggtgtaagccgctcacgatgtttctgatagcggagaacaaaatctggggccgccgcagctggcccctcaacgaggggatcatggcggtgggcatagtgagcatcctgttatcctctcttttgaagaacgacgtccccctggccgggcccctaatcgccggaggcatgctgatagcctgctatgtgatctccggtagctccgctgatctgagcctcgagaaggcagccgaagtgtcctgggaggaggaggccgaacacagtggtgcctcccacaacatcttagtcgaggtgcaagatgacgggaccatgaaaatcaaggacgaggaacgggacgatactctgaccatcttgctgaaggctaccttattagccgtgagcggggtataccctttgagcatcccggcgaccttgttcgtatggtacttctggcagaagaagaagcagcgtagcggggtgctttgggacaccccaagcccacccgaagtcgagcgagcggtgctggacgacgggatctacaggatcatgcagcgggggctgctggggcgcagccaagtgggagtcggcgtgttccaggagaacgtgttccacaccatgtggcatgtcacaagaggcgctgtgcttatgtatcagggaaagcgcctggagccaagctgggcgtctgtgaagaaggacctcatctcgtatggaggcgggtggcggctacagggcagctggaacaccggagaagaggtccaggtcatcgccgtggagccaggcaagaatccaaagaacgtccagaccgccccagggacgttcaaaacgccagagggggaggtaggagccatagcgctggacttcaagcccggaacttccggaagccccatcgtgaatcgcgaagggaaaatcgtcgggctgtatggcaacggggtggtgacgaccagcggcacgtacgtctcggcgatcgcccaggccaaggccagccaggaggggccgcttcccgagatagaggacgaggtgttccgaaagcgcaacctgactatcatggacttgcaccctggctccgggaagacgcggcgctacctcccggcaatcgtgagagaggctatcaagcgcaaactgcgcaccttaatcttggcccccacgcgggttgtggctagcgagatggccgaggcgcttaagggcatgcccattcgctatcagaccaccgcagtgaagtccgagcataccggcaaggagatcgtagatctgatgtgtcacgccacgttcaccatgaggctcctgagccctgtccgcgtcccgaactacaacatgatcattatggatgaggctcactttacggacccctccagcatcgccgcgcgggggtacatctccaccagagtcgggatgggggaggccgcggctatctttatgacggcaacgccgcccggcagcgtggaggcgtttcctcagtccaacgccgtgatacaggatgaagagagggacatacccgagaggagctggaactccgggtacgagtggatcaccgacttccctggcaagacggtgtggttcgtgcctagcatcaagtccggtaacgacatcgccaactgtctgcggaagaatgggaaacgcgtgatccaactcagtcggaagacgttcgataccgagtaccagaagacaaagaataacgactgggactacgtcgtgacaacggacatctctgagatgggcgccaactttcgcgctgaccgcgtcatcgacccgcgccggtgtctgaaacccgtcatcctgaaggacggtcccgagcgcgtaatcctcgcaggccccatgccggtgaccgtcgccagcgcggcccagaggcggggacggatcggccgcaaccacaacaaggaaggagaccagtacatctacatggggcagcccctgaacaacgacgaagaccacgcccattggacggaagccaagatgctactcgacaatatcaacacccccgagggcataatacccgccctctttgagcctgagcgggagaagtccgccgccatcgacggcgagtaccgtctgcggggcgaggcgagaaagacgttcgtggaactcatgcgcaggggagacctacccgtttggctgagctataaggtggcctcggaaggattccagtactctgacaggcgatggtgcttcgacggcgagcgcaacaaccaggtgctcgaggagaatatggacgtagaaatctggacaaaggagggggagcggaagaaactaaggccccggtggttggacgcccgcacctatagcgaccccttggccctgcgggagtttaaggagttcgccgctggccgccggtcagtgtcaggagacttaatcctcgagatcggaaagcttccgcaacacctgacgcagcgcgcccagaatgcactcgacaacctggtgatgctacacaactccgagcagggtggccgggcctaccgccacgctatggaggagctccccgacacgatcgaaaccctgatgctgctcgcgctaatcgccgtcctgaccggcggtgtgaccctcttcttcctgagcgggcgtggtctgggcaagacatccatcgggctactgtgtgtgatggcgtcgtcggtgctgctttggatggccagcgtggagccccattggattgcggcctccattatactggagttcttcctgatggtgctcctgatcccagagccggaccggcagcggactccccaagataaccagttagcgtacgtagtgatcgggctcctgttcatgatcttgacagttgccgccaacgaaatgggcctcttagagaccaccaagaaggacctggggatagggcacgttgcggtagaaaaccaccaccacgccgccatgctcgacgtggacctccatcccgccagcgcttggacgctatacgcggtcgccactactataattacgccaatgatgcgtcacacgatcgaaaatacgactgccaatatttccttaaccgccatcgccaaccaggccgcaatcctgatggggctggacaagggctggcccatctcaaaaatggacatcggcgtgcccctcttggccttaggctgctactcccaggtcaaccccctaacgctcaccgccgcggtactaatgctcgtggcccactacgccatcatcggcccggggctgcaggcgaaagccaccagggaggcgcagaagcggaccgccgccggcatcatgaagaatcctacggtagacgggatcgtcgccatcgacctggaccccgtcgtgtacgacgccaaattcgagaagcagctcggacagataatgctgctgatcctctgtaccagccagatcctactaatgcggaccacctgggcgctctgtgagtccatcacgctggccaccggacccctcaccaccctttgggaagggagcccgggcaagttctggaacactaccattgccgtctccatggccaacatctttcgggggagctacctggccggcgcgggcctggccttctcgctcatgaagtcgctcgggggcggtcggcgggggactggagcccagggcgagacgctgggggagaagtggaagcgccagctcaaccaattgagcaagtccgagtttaacacgtacaggcgctctgggattatggaggtagaccggtccgaggcaaaggaagggctgaagcgcggagagaccactaagcacgctgtgagccgaggcaccgccaagctacgctggttcgtcgaacggaacctggttaagccagaggggaaggtgatcgaccttggctgcggccgtgggggctggagttattactgcgccgggctgaaaaaagttacggaggtcaagggctacaccaaaggcggcccaggccatgaagagcccataccgatggccacctacgggtggaacctagtgaagctgcacagcggcaaagacgtcttcttcatccctccagaaaaatgcgacacactgctttgcgacatcggggagtccagccccaacccgactatcgaggagggccggaccctgcgcgtgctgaagatggtggagccctggctacgaggtaatcagttctgcataaaaatcctgaatccctatatgccgtccgtcgtggagacgttggaacagatgcagcgaaagcatgggggcatgcttgtgagaaacccactgagccggaactccacccacgagatgtattgggttagctgcggcactggcaacattgtgtccgccgtgaatatgacatcccgcatgctgctaaatcggtttaccatggcacaccgcaaacccacgtacgagcgggacgttgacctgggcgccgggacccgccacgtggccgtggagccagaggtcgccaatttggacatcatcggccagcggatcgagaacatcaagcacgagcacaagtcaacgtggcattatgatgaggacaacccttacaagacctgggcctaccacggaagctacgaggtgaagcccagtggtagcgcgagctccatggtgaacggggtcgtgaagctcctgaccaaaccctgggacgttatccccatggtgacgcagatcgccatgacggacacaacgcccttcggacaacagcgagttttcaaggagaaggtcgacacccggacgccaaaggcgaagcgcgggaccgcccagatcatggaggtaactgcgaagtggttgtggggtttccttagccggaacaagaagccccgcatatgcaccagggaggagttcacgcgcaaggtgcggtcgaacgcggccatcggcgcagtcttcgttgatgaaaaccagtggaattcagcgaaggaggcggtggaagacgagcgcttctgggacctcgtccacagggagcgcgagctacataaacaggggaaatgcgcgacctgtgtgtacaatatgatgggcaagcgtgaaaagaagttaggggagtttggcaaggccaaggggtcccgcgctatctggtacatgtggctgggcgcccggttcctagaattcgaggcactaggatttatgaacgaggaccattggttcagtcgcgagaactccctgagcggggtagaaggcgaagggctgcacaagctcggctatattctgagagacatctcaaagatcccgggtggtaacatgtacgccgacgacaccgcaggatgggacaccaggataacggaggacgatctgcagaacgaggcccgcataaccgatattatggaaccagagcacgctttactggccaagagcattttcaagctgacctatcagaacaaggtcgtgcgggtgcaacgtcccgccaagaacggcaccgtcatggacgtcatctcccggcgcgatcagcggggcagtgggcaggtggggacgtacggcctcaatacgttcaccaacatggaggcccaactgatacgacagatggagagtgaggggatcttcagcccgtccgagctggagacccccaacctggctgaacgggtccttgactggctggagaagtatggcgtggaacgcctcaagcggatggccatcagcggggatgactgcgtggtcaagccgatcgatgaccgcttcgccactgcactgacggccctgaacgatatgggaaaggtgcggaaggacatcccccaatgggagccctctaaggggtggaacgactggcagcaggtccccttctgcagtcatcattttcaccagctcatcatgaaggacggccgggaaatcgtcgtgccgtgccggaaccaggatgagctggttggccgtgcccgggtcagccaaggggccggctggtccctgcgcgaaaccgcgtgtctgggcaagagctatgcgcagatgtggcaattgatgtactttcaccggcgagacctgaggctagcggcgaatgcaatatgctccgcggtgcccgtcgactggatccctacctcccgcacgacctggtctatccacgcccatcaccagtggatgacaaccgaagacatgctctcagtctggaaccgcgtctggatcgaggagaatccttggatggaagacaagactcacatctcctcatggggcgatgtgccgtacctgggcaagcgggaggaccaatggtgcggctccctcatcggactgaccgccagagccacatgggcgaccaacattcaagtggccatcaaccaggtgcggcgcctgatcggaaacgaaaattacctcgactacatgacctccatgaagcggttcaagaacgagtccgaccccgagggcgccctttggtga

SEQ ID NO: 24087 - RNA, 9879 nt, synthetic construct
  misc_feature 1..9879: note = derived and/or modified CDS sequence (opt11) from DENV-1__EU660401__SS-prME
  source 1..9879: mol_type = other RNA
agcgttacaatgctgttaatgctgatgcccacagccttggccttccacctcaccacccggggcggggagccccatatgattgtcagcaagcaggagcgtggcaaatcgctgctgttcaagaccagcgccggggtgaacatgtgcacccttatcgcgatggacttaggggagctgtgcgaggatacaatgacgtacaagtgccccagaatcaccgaaaccgagcccgacgacgtggactgctggtgtaacgctactgacacctgggtcacctacgggacttgcagccaaacgggggagcaccggcgggataagcgctccgtggccctcgcgcctcatgtcggcctggggctggaaacccgcaccgagacctggatgtcatccgagggcgcctggaaacagatacagcgggtcgaaacgtgggccctaaggcaccccgggttcacagtgatcgcactgttcctggcccacgcgataggaacgagcatcacacagaagggcatcattttcatcctcctgatgctcgtaacgccctcgatggcgatgcgttgcgttggcatcggcagccgcgactttgtagagggtctatcaggcgcgacctgggtggacgtcgtgctggagcacggtagctgtgtcaccacgatggcgaaggacaagccaacgctggacatcgagctcctaaagactgaggtaaccaacccagccgtgcttcggaaactctgcatcgaagcgaaaatttcgaatacaacgaccgactcacgttgcccgacacagggtgaagctaccctggtggaagaacaggacgcaaacttcgtgtgccggcgcacgttcgttgacaggggttgggggaacggttgcgggctattcggaaaagggtctttaattacgtgtgctaagttcaagtgcgtgaccaagttagagggaaagattgtccagtacgagaatctgaagtattctgtgatcgtgaccgtacacaccggcgatcagcaccaggtaggcaacgagtccacagagcacggcacgacggctacgatcaccccccaggcgccaaccaccgagatccagctcaccgactacggcgccttaacccttgactgctccccaagaaccggtctcgactttaacgagatggtccttctgacaatgaaagagaagtcctggttagtgcataagcagtggttcttggacctgcccctcccatggaccagcggcgccagcacgagtcaggagacctggaaccgccaagacttattggtaacattcaagacggcccacgccaaaaagcaggaagtcgtggtcctcggcagccaggaaggtgcaatgcacaccgccttgaccggggcaacagagatccagacctccgggacgacgaccatcttcgcaggccatctgaagtgccgcctcaaaatggataagctgaccctgaagggtatgtcttacgtgatgtgtaccgggagcttcaagctcgaaaaggaggtcgcagagacccagcacggaacggtgctggttcaaattaaatacgagggtaccgacgcgccctgtaagatacccttctccacgcaggacgaaaagggggttacacagaacggccgcttaatcaccgctaacccgatcgtgaccgacaaggagaagcccgttaacatcgaggcggaacctcccttcggtgagtcctacatcattatcggggccggagaaaaggccctgaagctcagctggtttaagaagggttcaagcataggtaagatgttcgaggcaactgcccgcggagcccgtcgcatggccatcctgggagacaccgcttgggactttgggtccatcggtggcgtgtttacgagcgtggggaagctggtccaccagatcttcgggactgcctatggggtgctgttctccggcgtgagctggactatgaagatcggtattggcgtcctgctgacgtggctaggcctaaactcgcgtagcacctccctgtccatgacgtgcatagccgtgggcctcgtgacactgtatctgggcgtcatggtgcaggctgacagcggttgcgtgatcaactggaagggccgggagttaaagtgcgggagtggcatcttcgtcaccaatgaagtgcacacctggacagagcagtacaagttccaggccgactcgccgaagcgcctatccgctgccatcggaaaggcctgggaggagggcgtttgtgggattcgtagcgcaactcgcctcgagaacatcatgtggaagcagatcagtaacgaacttaatcacatcctgttggaaaacgacatgaagttcacggtcgtcgtaggggatgttgcaggcattctcgcgcaggggaagaagatgattcggccgcaaccaatggaatacaagtatagctggaagtcctggggcaaggcaaaaatcatcggcgcagacgtgcaaaatacaaccttcatcatagacgggcccaacacaccggagtgccctgacgaccagcgagcctggaacatctgggaggtggaggactatggcttcgggatcttcactaccaacatctggctgaaattacgcgacagccacacccaggtctgcgaccaccgactcatgtcggctgccatcaaggattcgaaggccgtacacgcagacatggggtactggatcgagtccgaaaagaatgagacctggaagctagcccgggcgagcttcatcgaagtaaagacgtgcatctggcctaaatcccacactctgtggagcaacggtgtactcgagtccgagatgattatacccaaaatctacggcggacctatcagccagcacaactacaggccagggtacttcacccagaccgccggcccctggcacctcgggaagctggaactcgactttgacctctgcgagggcacgaccgtggtcgttgatgaacactgcggcaaccgaggaccctccctgaggacgaccacggtgacgggcaagatcatacacgagtggtgttgccggtcctgcaccttaccccccctccgatttcgcggggaggatggctgttggtacgggatggaaatccgccctgtcaaggagaaggaggagaacctggtcaagtccatggtgagcgctggaagcggcgaggtcgactcgtttagccttggcctgctgtgcatttccattatgattgaagaggttatgcggagccgatggtctaggaagatgttgatgaccgggaccttagcggtgttttttctactgatcatgggccagctgacatggaatgacctgatccgcctctgtatcatggtgggcgccaacgcgagcgaccgcatgggcatgggtacaacgtatcttgcacttatggccacgtttaaaatgaggccgatgtttgcggtcggcttattattccgccggctgacatcccgcgaggttctcctgttgacaattgggttgagcctggtggcgagcgttgaactccccaacagcctagaggagctgggggatgggctggcgatggggattatgatcctgaagctgctgacagacttccagtcccatcagctctgggccacgctgctctccctcaccttcataaagactaccttcagcctgcattacgcttggaagacgatggctatggttctgtctatcgtgtccctattccccctgtgcctaagcaccacctcccagaaaaccacgtggttgccggtgctgctgggcagcctggggtgcaagccgctgactatgttcctcatcgctgagaacaagatctggggcaggaggtcctggcccctcaacgaagggatcatggcagtgggcatcgtcagcattctgctttcatccctcctgaagaatgacgtgcccttagcggggcctctgatcgccggaggcatgctgatcgcctgttatgtgataagcgggtcgagcgcagacctgagcctagaaaaggcggccgaggttagctgggaggaggaggcggagcactccggcgcgtcgcacaacatacttgtggaggtgcaagatgacggcaccatgaagatcaaagacgaggagagagacgacaccctgaccatactcctgaaagccacattactggccgtctctggagtatacccgctgtcgatccctgcaactctcttcgtgtggtacttctggcaaaagaaaaaacaaagatctggggtactctgggacacgcctagcccacccgaagtcgaacgagcggtgctggacgacggcatttaccgcatcatgcaaagaggtctgttaggtcgctctcaggtgggggtgggagtgttccaagagaacgtgttccatactatgtggcacgttacgcgtggagccgtgctcatgtaccagggtaagcgactagagccgagctgggctagtgtaaaaaaggaccttatcagttatggtggcggatggcggctacagggctcatggaacactggtgaggaggtccaggtgatcgccgttgagccagggaagaaccccaagaacgtacaaacagctcctgggaccttcaagacgcccgagggtgaagtaggtgcgatcgccctagacttcaagccaggtaccagcggcagtcccattgttaacagagaggggaagattgtgggactgtacggcaacggggtggtcaccaccagcgggacgtacgtgtctgcgatagcacaggctaaggccagtcaagagggtcctttacccgagatagaagatgaggtgttccggaagcgcaacctgaccatcatggatctccatcccggcagcggaaagacccggcgctaccttccggcaattgtccgggaggcaattaagagaaaactgcgaactctaatcctcgccccaacccgagtggtggcctccgaaatggccgaagctctgaaaggcatgcccatccggtatcagaccacagccgtgaagtcggagcacaccggcaaggagatcgttgacctgatgtgccatgccaccttcaccatgcgactcttgtcccccgtgagagtacccaactataacatgatcattatggatgaggcacactttacggatcccagctccattgccgcgcggggatacatttcgacacgcgtgggcatgggggaggcggctgccatattcatgacggcaacgccgccgggctccgtggaagcatttccgcagagcaatgccgtcatccaggacgaggagcgggacatcccagagcgctcgtggaacagcgggtatgagtggatcactgatttcccgggcaaaaccgtgtggtttgttccgagcatcaagagcggtaacgacatcgccaactgcttacgaaagaacggcaagagagtcatccaactctcacggaagaccttcgacaccgagtaccagaagacgaagaacaatgactgggactacgtggtcaccacagacatctcggaaatgggcgccaacttccgagcggaccgggtgatcgacccgcgaaggtgtctgaagcccgtcattctgaaagatgggccggaacgggtgatcctcgccggccccatgccggtcacggtggcttccgcggcccagcggcgagggcgtatcgggcgcaatcacaacaaggagggagaccagtacatctacatggggcagcccctgaataatgacgaggaccacgcgcactggaccgaagcgaaaatgctgctcgacaacatcaataccccagaggggattatccccgccctgtttgaacccgaacgcgagaagtccgccgccatcgatggcgagtatcggttgcgcggcgaagcgcggaagacgttcgtcgaactcatgcgccgtggggatctgccggtttggctgtcctacaaagtggccagtgaggggttccagtatagtgaccggcggtggtgctttgacggcgagcgcaacaaccaagtcctcgaggaaaacatggacgtagaaatttggaccaaggaaggtgagcgtaagaagttaaggccccggtggctggacgcccggacctattccgaccccctcgcattaagggagttcaaagagttcgccgcgggccgccggagcgtctccggagacctgatcctcgagataggcaagctgccgcaacacctcacccagcgcgcacaaaacgccctcgataaccttgttatgttgcacaactccgagcagggcggacgagcttaccgccatgctatggaggagctacccgacacgatcgaaactctgatgctccttgcattaattgcggtgctgaccggtggggtgacactctttttcctctccggccgtggcctgggaaagacctcaataggtctcctgtgtgtcatggcctccagcgtgctgctttggatggcatccgtggagccgcattggatcgccgcctcaatcattctggagttcttcctgatggtgctccttatccccgagccggaccgacagcgcacgccccaggataaccagctggcatacgtggttatcgggttactgtttatgatcctgaccgttgccgctaacgagatgggcctcttggagacaaccaagaaggacctcgggataggacacgtagcggtggaaaaccaccaccacgcagccatgttggacgtagacctccacccggcatcagcctggacgctgtatgcggtggcaaccaccattataacccctatgatgcgccacacgatagagaacaccacggccaacatcagcctaaccgcaattgcaaaccaggctgctattctgatgggacttgacaaaggttggcccatttccaagatggacatcggcgtgccgttactggcgctggggtgttatagccaggtaaacccattaacgcttacggccgccgtgctgatgttggtggcccactacgccatcataggcccggggctgcaggccaaggcaactagagaggcgcagaagagaaccgccgccggcatcatgaagaaccccacggtcgacgggatagtggcgatcgacctggacccagtcgtgtatgacgccaagttcgagaaacagttaggccaaatcatgctgcttattctctgcacctcccaaatcctgctgatgcgcaccacctgggctctgtgtgagtcaatcaccctggccacaggccctctgacgaccctctgggaggggtccccgggcaagttctggaacacgaccatcgccgtcagtatggccaatatctttcgcggttcttacctggccggagcgggcctggcattctcgctcatgaagagcctcgggggcggccgacggggaacgggagcgcagggggaaaccctgggtgagaagtggaaaaggcaattgaaccagctgagtaaatcagaattcaacacgtacaagcggtcagggataatggaggtggaccgtagtgaagccaaggagggcctgaagcgcggcgagaccactaagcacgcggtctcccgcgggaccgccaagctccggtggtttgtcgagcgcaacctggtgaagcccgaagggaaggtcatcgacctgggctgcggcagagggggttggagctattactgcgccggtcttaagaaagttacggaggtaaagggatacacaaagggcggccccggccatgaagaacccattccaatggccacctacggatggaatctcgtcaagttgcactccggtaaggacgtatttttcatccccccggagaagtgcgacacgctgttatgcgacatcggtgaaagctctcccaacccgacgatcgaagaaggccgcaccttgcgggttcttaaaatggtggagccatggctccgcgggaatcaattctgcatcaagatcctgaatccgtacatgccttccgtggtagagaccctggagcaaatgcagcggaagcacgggggcatgcttgtgcgcaaccccctgagtaggaacagcacgcacgagatgtactgggtgtcgtgcgggaccggaaacatcgtgtctgccgtcaacatgacctccagaatgctgctcaaccgcttcaccatggcgcataggaaacctacttacgagagagacgtggacctgggcgccgggactcggcacgtagccgtggagcccgaggtagctaatttagacatcataggccagcgcatcgagaacatcaagcatgagcacaaaagcacgtggcactacgacgaggataatccctacaagacttgggcgtaccacgggtcctacgaggtaaagccatctggcagcgcgagcagcatggtcaatggcgtagtgaaactcctcaccaagccatgggacgtgatccccatggtcacccagatcgctatgacggataccacgccgttcgggcaacagcgggtcttcaaggagaaggttgacaccagaacgccgaaagctaaacgagggacggcccaaataatggaggtgaccgccaagtggctctgggggtttctctctcggaacaagaaaccacggatctgcacacgcgaggaattcacgcggaaggtacgcagcaacgcggccataggcgccgtatttgttgatgagaaccagtggaactcagccaaggaggcggtcgaggatgagcggttctgggacctggtgcacagggagcgggaactacataagcagggaaagtgcgcgacatgcgtgtacaacatgatgggtaagcgcgagaagaagctcggagaattcggcaaggctaaagggtcgcgggcaatttggtacatgtggctgggagccagattcctggagttcgaggcactcggctttatgaacgaggaccactggtttagtcgagagaattccttatccggtgtcgagggcgagggcctgcataagcttggctatatcctgcgggatatcagcaaaatccccgggggcaacatgtacgccgatgacaccgccggttgggacaccaggataacggaagacgatctgcagaacgaggcccgcatcaccgacatcatggagccggagcacgccctcctggcgaaatccatcttcaagctgacttaccagaacaaggttgtgcgcgtccagcggccagcaaagaatggaaccgtaatggacgtgattagcaggcgggaccagagaggctccgggcaggtcggcacttatggcctcaacacctttacgaatatggaagctcagctgatccggcagatggagagtgagggaattttctccccgtcggagctcgagaccccaaaccttgcagagcgcgtgctcgactggctggagaagtacggggtagagagactcaaacgcatggccatatccggggatgactgcgtcgtgaagccgatcgacgatcggtttgctactgccctgacagcgctgaacgatatgggcaaagtgcgcaaggacataccacagtgggagccctcaaaaggctggaacgactggcagcaggtccctttctgctcccaccatttccaccaattaattatgaaggacggacgggaaatcgtggtgccgtgccgcaatcaggacgagttggttggccgcgcgcgtgtatcccagggagccggctggagcttgcgggagactgcgtgccttgggaagtcctacgcccaaatgtggcaactgatgtacttccaccgtcgggacctgcgcctagcggccaacgcgatctgcagcgccgtgcctgtcgactggatccctacctccagaacgacgtggtctatccatgcccatcaccagtggatgaccaccgaagacatgctatccgtttggaaccgcgtctggattgaggaaaatccctggatggaggataagacacacatcagctcgtggggcgacgtcccgtaccttgggaaacgcgaggaccagtggtgcgggtctctcatcggcctcacggctcgggccacctgggcgaccaacatccaagtggcgataaaccaggttcggcgactgattgggaatgagaactacttagactatatgacctcaatgaagcgattcaagaacgagggcgatcccgagggggccctgtggtaa

SEQ ID NO: 24088 - RNA, 9879 nt, synthetic construct
  misc_feature 1..9879: note = derived and/or modified CDS sequence (opt11) from DENV-1__FJ373305__SS-prME
  source 1..9879: mol_type = other RNA
agcgtgactatgctgttgatgctcatgcccaccgccctggctttccatcttaccacccgggggggcgagccccacatgattgtgtccaagcaggagcggggaaaaagcctgctgtttaagacctccgccggggttaacatgtgcactctcatcgccatggacctgggtgaactctgtgaagacaccatgacctataagtgcccccggatcaccgagacggaaccagacgacgtggactgttggtgcaacgctacggacacctgggtcacctacgggacatgttcccagacgggcgagcatcggcgtgacaagcggtccgtggctctggcgccccacgtggggctggggctggagacccgaacggagacctggatgagctccgagggcgcgtggaaacagatccagcgggtagagacgtgggcgctacgacaccccgggtttactgtgatagccctgttcctcgcccacgcaatcggcaccagcatcacccagaagggaatcatctttatcctactgatgctcgtcacaccctccatggccatgcggtgtgtcggcattggcagcagggacttcgtcgaagggctcagcggggcaacatgggtggatgtcgtgctggaacacgggagctgcgtaaccaccatggccaaagacaaaccgacgctggacatcgagctcttgaagaccgaggtcactaatcccgcggttctccggaagctttgtattgaagcgaagatctccaacaccaccaccgacagcaggtgcccgacccagggggaggccaccctagtagaggagcaggacgccaacttcgtgtgccggcgcaccttcgtggaccggggctggggtaacgggtgcgggctgttcggcaagggttccctcatcacgtgtgcgaagttcaagtgcgtaaccaagctagagggaaaaatcgtccagtacgagaacctaaagtacagcgtgatcgtgaccgtccatacgggagaccagcatcaggtcgggaacgagtcaaccgaacatggaaccaccgccacaattacccctcaggcgcccaccaccgagattcaattaacagattatggtgcgctgacgctggactgctcaccgcgcaccggactcgactttaacgagatggtgcttttaaccatgaaggagaagtcgtggctcgttcacaagcagtggtttctcgatctgcccctcccctggacctctggggcctcaacgtcccaggagacgtggaaccggcaggacctcctggtgaccttcaaaaccgcccacgctaagaagcaggaggtcgtggtgctaggcagccaggagggagcgatgcacacggccctgactggtgctacagagatacaaacctccggaacgaccaccatcttcgcaggccatctgaagtgtcgcctcaagatggacaagctaaccctgaagggaatgtcgtacgttatgtgcactgggagctttaaactggaaaaggaggtggcggagacacagcacggcacagtgctggtacagattaaatacgagggcaccgatgcgccatgcaaaatcccattcctgacgcaggacgaaaagggtgtgacccagaacggccggttgatcaccgccaacccgatcgttaccgataaggaaaagcccgttaacatcgaggccgaacccccctttggggagagctacattatcattggcgcgggcgagaaagcgttgaagctgtcctggtttaaaaagggtagctccataggcaagatgttcgaggccacggctcgcggggctcgacgcatggcgatcctgggcgacaccgcgtgggacttcggcagcatcggcggcgtgttcacctcagtaggcaaactcgtccaccagatcttcggcaccgcctacggggtgctgttcagcggcgtgtcctggacgatgaagatcggaatcggcgtcctactcacctggctgggccttaatagccggtccacgagcctctccatgacctgtatcgcggtggggttagttacgctgtacctcggcgtcatggttcaggccgactccgggtgcgtgatcaactggaagggccgggagttaaagtgcgggtcgggaatcttcgtcaccaacgaggttcacacctggacggaacagtacaagtttcaggccgacagccctaagaggctctcggcggccatcggcaaggcctgggaggagggtgtgtgtggcatccggtcggccacgcgcctcgagaatatcatgtggaagcagatatctaacgagctgaatcacatcttacttgagaacgacatgaagttcacggtcgtggtgggggacgtggctggtatactggcgcagggaaagaagatgatccggccccaacccatggagtataagtacagctggaagtcctgggggaaggccaaaattatcggcgccgatgtgcagaataccactttcattatcgatggtcccaataccccggagtgccccgatgaccagcgcgcgtggaacatctgggaggtggaggactatggcttcggtatcttcacaactaacatatggctgaagctccgggacagttacacgcaagtatgcgatcaccggttaatgagcgcggcgatcaaggactccaaggccgtacacgcagacatgggatactggatcgagagcgagaagaacgaaacatggaaactggcacgggcatcctttatcgaggtgaagacgtgcatttggccgaaaagccatactctctggagcaacggtgtattagagagcgagatgattatccccaaaatctacggaggcccgatctcccagcacaattaccgtcccggatacttcacccagaccgcaggcccgtggcacctgggcaaactagagttggacttcgatctgtgcgaaggcacgaccgtggtggtcgacgagcactgcggcaaccgggggccgtccctccgcaccacaacggtaactggtaagatcatacacgagtggtgctgccggtcctgcacccttcctcccctgcgcttccgcggggaggacggctgctggtacgggatggagatccgccccgtgaaggagaaggaggagaacctcgtcaagagcatggtgtccgcaggcagcggcgaggtggactctttctcactggggctgctctgcattagcattatcatcgaggaggtcatgcgcagccgctggagccggaagatgctcatgaccggtaccctggccgtgttcttcctcctgattatggggcaactgacctggaacgacctcatccgtctgtgcatcatggtgggcgcaaacgcttccgatcgcatggggatgggcactacttacctggcactcatggccacgttcaagatgcggccgatgttcgccgtgggcctgctgttccgccggctcaccagccgcgaggtgctcctgttaacgatcgggctgtcactggtggcgagcgtcgagctccctaactccctcgaggagctgggcgacgggctcgccatgggcatcatgatcctgaagttattgaccgactttcaaagccaccagttatgggccaccctgctaagtttgaccttcataaagaccacggtctccttgcactacgcctggaaaacgatggccatggtgctctcgattgtgagcctgttccccctgtgtctctccaccaccagccagaaaaccacctggctgcccgtgcttcttggctccctgggctgtaagcctttaaccatgttccttatcgcggagaataagatctgggggcggcgcagctggcccctgaacgaggggatcatggccgtcggcatcgtgtccatcttgttaagcagcctgcttaagaacgatgtccccctcgctggtcccttaattgcaggcggcatgttgatcgcctgctatgtcatctccggtagttccgcggacctcagcctggagaaggccgcggaggtgagctgggaggaggaagccgagcacagcggtgcctcgcacaacatcttggtggaggtacaggatgacgggaccatgaaaatcaaagacgaggagcgggacgacaccttaaccatcctgctgaaggcgacgctccttgcagtgagcggcgtataccccctgagcattcccgcgaccctattcgtctggtacttctggcagaagaagaagcagaggtcaggagtcctgtgggacacccccagcccacccgaggtggagcgcgccgtcttagatgacggcatctacaggatcatgcagcgtggcctgctcgggcgcagtcaggtaggcgtgggggtctttcaggagaatgtgttccacaccatgtggcatgtgactcggggcgctgtgttgatgtaccaggggaagcgccttgagccttcctgggcgagcgtgaagaaagatctcatctcctacggcggcgggtggcggctgcagggtagctggaacaccggggaggaagtgcaagtcatagcagtggaacccggcaagaaccctaagaatgtgcagacggccccagggacctttaagacgccggagggagaggtcggagccatcgccctagactttaagcccgggacctccggaagcccaatcgtgaaccgcgaggggaagatcgtgggcctctacggcaatggtgtagtgaccacctccggcacgtacgtgagcgccatcgcgcaggccaaagcgtcacaagagggaccactgcccgagatagaggacgaagttttccgtaagcgcaacctgaccatcatggacttacacccgggctccggtaagacccggcgctacctgccggctatcgtgagagaagcaatcaagcgcaagctacgcaccctcatccttgctcctacacgggtggtcgcgtcggagatggcagaagcgctaaagggcatgcccattcgatatcagacaaccgccgtcaagagtgaacacacaggaaaggaaatcgttgacctcatgtgccacgccacgtttactatgcggttactctcacccgtgcgcgtgccaaactacaacatgatcattatggacgaagcacactttaccgacccctcctcgatagccgctcgggggtacatcagtacccgcgtgggcatgggggaggccgccgcaattttcatgacggcgacaccacccgggagcgttgaggcgttcccgcaatccaacgccgtgatccaagatgaggagcgtgatatcccagaacgctcgtggaactccgggtacgagtggataaccgattttcccggcaagacggtctggttcgtccccagcatcaagtcaggcaacgacatcgccaactgcctccggaaaaatgggaagcgcgtgatccagctgtcgcggaagacgttcgataccgaataccagaaaaccaagaacaacgactgggattacgtggtaaccacggacatctcagagatgggcgcaaatttcagagctgacagagtcatcgacccacgccggtgcctgaaaccagtgatccttaaggatgggcctgaacgggttatcctggcaggccccatgccggtgacagtcgcctcggctgcgcagcggcgaggtcggatcggccgcaaccacaacaaggagggggatcagtacatttatatggggcaacccctaaacaacgatgaggaccacgcgcactggaccgaggccaagatgctcctagataacattaacacacccgaagggatcatccccgccctgttcgaaccggagcgcgagaagtccgccgccatcgacggggagtaccggctcagaggggaggcgcggaagacgttcgtagaactgatgcgccggggcgatctcccagtatggctctcatacaaggtcgcctctgagggcttccagtacagcgatcgacggtggtgtttcgacggcgagcgcaacaaccaggtgctggaggagaacatggacgtggagatctggaccaaggagggtgagcggaagaagttgcgccctcggtggctcgacgcgcgaacctacagcgacccactggctctgcgggagttcaaagaattcgccgcgggccgccggtccgtgagcggggacctcatcctggagatcggcaaactgccgcagcacttaacccagcgcgcccagaacgctctggacaacctggtgatgctacacaactcagagcagggcggtcgggcctatcgccacgcgatggaggagctgcccgacacgatcgagacattaatgctcctggcacttatagccgttctcacaggcggggtcacactcttcttcctgagcggcagggggctcggcaagacctctatcggtttgctgtgcgtgatggccagctctgtcctgctctggatggcgagcgtcgaaccccactggatcgcggcatccattattctagagttcttcctcatggtgctgttaatacccgagccggatcgccagcggacgccacaagacaaccaactcgcttatgtggtcatcgggctacttttcatgatccttacagtggctgccaacgagatgggactactggagacgaccaagaaggacttggggattggacacgtggccgtggagaaccaccaccatgctgcgatgctggacgtggacttgcaccccgccagcgcctggacactctacgcggtagccacgaccatcatcacaccaatgatgcgccacacgatcgagaataccaccgccaacatcagcctgactgccatagccaaccaggcagccatcctcatgggccttgataagggctggcccatctcaaagatggacatcggcgtccctcttctggccctcggctgttactcccaagtaaatcccctgaccctgacggccgctgtgcttatgctggtcgcgcactacgccatcataggcccggggctgcaggccaaggcgacgcgggaggctcagaagcggaccgccgctggtatcatgaagaaccccactgtcgacgggatcgtggccatcgacctcgatccagtcgtgtacgatgcaaaattcgagaagcagctgggccagataatgctgctgatcctgtgcacctctcagatccttctaatgagaactacctgggccctgtgtgagtcgattacgctggcgaccgggcccctcaccaccttgtgggaggggagcccgggcaaattctggaacacgacaatagctgtgtccatggccaatatcttccggggtagctatcttgcaggagcgggtctcgccttcagtctgatgaaatccctcgggggcggaagacgggggaccggggcacaaggtgaaaccttaggggagaagtggaagcgccagctgaaccagctgagcaaatcggaattcaacacatataagcgtagcgggatcatggaagtcgaccgctccgaagccaaggagggcttgaagcgcggggagaccaccaagcacgctgtgagccgtggcacagccaaactgcgatggttcgtggaacggaacctcgtaaagcccgaggggaaggtgatcgacttgggctgcggtcgcggagggtggtcctattactgtgccgggttaaagaaagtgacggaggtcaagggctacaccaagggaggccccggccatgaggaacccatcccgatggccacctacggttggaacctggtgaagttacatagcggcaaggacgtgttcttcatcccgcctgagaaatgcgacacgctcctgtgcgacatcggggagagttccccaaacccgacgatcgaggagggccgtactttgcgtgttttgaagatggtggaaccatggttgcgtgggaaccagttctgcatcaagatactgaacccttacatgccctcagtggtcgagaccttagagcagatgcagcggaagcacggcggcatgctggtacgcaatcccctgagccggaactccacccatgagatgtactgggtgtcttgcgggaccggcaacattgtatccgcagtgaatatgaccagccggatgttactgaaccggttcaccatggcccaccggaagcctacctacgagagagacgtggacttaggggccggaaccaggcacgtcgccgtggaaccggaggtggcgaacttggacatcataggccagcgcatagagaacatcaagcacgagcacaagtcaacgtggcactacgacgaggacaacccctataagacctgggcataccacggaagctatgaggtcaagccgtccggcagcgcgtccagcatggtgaacggggtcgtgaagctgctgacaaagccatgggacgtgataccaatggtcacgcagatcgccatgacggataccaccccttttggccaacagcgggtgttcaaggagaaagtggacacccgcactcctaaggcgaaacggggcaccgcccagatcatggaagtcaccgccaagtggctctggggcttcctgagtcgcaacaagaagcccagaatctgcacccgtgaggagttcacgcggaaggttcgctccaacgcggccatcggagccgtttttgtggatgagaaccagtggaacagcgcaaaggaggcggtggaggacgaaagattctgggatctggtccaccgcgagagagagctccacaagcaggggaagtgcgcaacctgcgtctacaacatgatgggtaagcgcgagaaaaagctgggggagttcggcaaggccaaggggtcccgggccatctggtacatgtggctgggcgcgcgcttcttagagtttgaggcgctggggttcatgaacgaggaccattggttctctcgggagaactccctgagcggtgtggaaggagaggggctacacaagttagggtacatccttagagacatctccaagatccccgggggcaacatgtacgccgacgacaccgcgggctgggacacccggatcactgaggatgaccttcagaatgaagcccgcataaccgacattatggaaccagagcacgccctgctggccaagagcattttcaagttaacctaccaaaataaggtggtccgcgtgcagcggcccgccaagaatggtaccgtaatggatgtgatctccaggcgcgaccagcgcggctctggtcaggtggggacatacggcctgaataccttcaccaacatggaggcccaactgatcagacagatggagtccgaggggatcttcagcccatccgagctcgagacccctaacctggccgagcgcgtgttggactggctcgagaagtacggcgttgagagactgaagagaatggcaatctccggggatgactgcgtagtgaagccgatcgacgaccgatttgcgacggccctcaccgccctaaacgacatgggaaaggtccgcaaggacatcccccagtgggagccgtccaaggggtggaacgactggcagcaggtccccttttgctcgcatcactttcaccagctgatcatgaaggacggccgggaaatcgtagttccctgccgcaaccaggacgaactggtcggccgggcccgcgtgtcccaaggggcgggctggagcctccgagaaaccgcgtgcttgggaaagtcgtatgctcagatgtggcagctgatgtatttccaccgccgggatctcagactagcagcaaatgccatatgctccgccgtccccgtcgattggatccccaccagccgaacgacctggtccattcatgcccaccaccagtggatgaccaccgaggacatgctgagtgtgtggaatcgcgtctggatcgaagagaacccgtggatggaagacaagacccacataagcagctggggtgatgttccgtaccttgggaaacgcgaggatcagtggtgcgggtccctgatcggtctgacggcccgggccacatgggcgacaaacatccaggttgcgatcaatcaagtccgtcgactcattggcaacgagaattaccttgactacatgaccagcatgaaacgcttcaagaacgagggcgaccccgagggggccctctggtga

SEQ ID NO: 24089 - RNA, 9879 nt, synthetic construct
  misc_feature 1..9879: note = derived and/or modified CDS sequence (opt11) from DENV-1__EU660402__SS-prME
  source 1..9879: mol_type = other RNA
agcgtgaccatgctgttaatgctgatgcccaccgcgctggcattccatctcaccacccggggtggggaacctcacatgatcgtgagcaagcaagaacgaggcaagagtctgctgttcaagacgagcgccggggtgaacatgtgcaccctcattgccatggatctgggcgagttctgcgaggacacgatgacatacaagtgcccccgcatcacggaggccgagcccgatgacgtagactgctggtgcaacgcaaccgacacgtgggtgacctacgggacctgcagccaaaccggcgagcaccggcgggacaagcggagtgtggccctggcgccccacgtaggtctcgggctggagacccgcacggagacctggatgagctctgagggcgcctggaagcagatacagcgggtagagacctgggctctgcgccaccctgggttcacggtcatcgccctcttcctggcacacgccatcggcaccagcatcacccagaagggaattattttcatcctgttgatgctggtaactccctcaatggccatgcggtgcgtcggcatcggctctcgcgatttcgtggaggggttatccggcgccacgtgggtggacgttgtgttggagcacgggagctgcgtgaccaccatggccaaggacaagcccactctggacattgagctgttgaagacggaagtgacgaatcctgcggtgctgcggaagctgtgcatcgaagccaagatatccaacaccaccacggacagccgctgcccgacccaaggcgaggctaccctcgtggaggagcaggacgccaacttcgtttgccggcgcacgttcgtggaccggggctgggggaacggttgtgggctgttcggcaaagggtcgcttatcacgtgcgccaagttcaagtgtgtgaccaagctcgaaggcaagatcgtccaatacgagaacctgaagtacagcgtgatagtgacagtccacaccggcgatcagcaccaggtagggaacgagtccacggagcatggcaccaccgcgacaatcacgccccaagccccctctacggagatccagctgaccgactacggggccttaacccttgactgctcaccccgcaccggattagacttcaacgaaatggtactcctgacgatgaaagaaaagtcctggctggtgcacaaacagtggttcttagacctgccgctgccatggaccagcggggcctccactagccaggagacctggaaccggcaggacctgctggtgacgttcaagaccgctcacgcgaagaagcaggaggtcgttgtgttggggtcccaggaaggcgccatgcacaccgccttaaccggggccacggagatccagaccagcggcaccaccacgatcttcgccggacacctgaagtgccgtctgaagatggacaagctcactctgaagggcatgtcctacgtcatgtgcaccggcagcttcaagctcgagaaggaggtcgcggagacccagcacggcacggtgctcgtccagatcaagtacgagggcatcgacgcgccttgtaaaatccccttctccacccaggacgagaagggagtgacccaaaatggccgactgatcaccgcgaacccgatagtaactgacaaggagaaacccgttaacatcgaggccgagccacccttcggggagtcatacatcgtaatcggtgcgggcgagaaggcccttaagctgtcctggttcaagaaggggagctccatcggcaagatgttcgaagccaccgcccgcggggcccggcggatggcgatcctcggcgatacagcctgggacttcggatcgatcggtggcgtgtttacctccgtcgggaagttagtgcatcagatcttcggcacggcctacggcgttctgttcagcggcgtctcctggaccatgaagatcggcattggcgtgctcctgacctggctgggcttaaacagccgttctaccagtctgtctatgacgtgtatcgccgttggactggtgaccctctacctgggcgtaatggtgcaggccgactctggttgcgtcattaactggaagggcagggaactgaagtgcgggagcggtatcttcgttacaaacgaagtacacacatggacggagcagtacaagtttcaggcggactcaccgaaacgcctcagcgctgccatcggcaaggcctgggaggagggtgtctgtggcattcggtcagcgacccgcctggagaacatcatgtggaagcaaatctctaacgagctgaaccatatcctccttgagaacgacatgaaactaaccgttgtggtcggagacgtggcgggcattcttgcccagggaaagaaaatgatccggccccagcccatggagtacaagtactcgtggaagatttggggtaaggcgaaaatcatcggcgccgatgtgcagaacaccaccttcatcatcgacgggcctaacacccccgaatgtcccgacgaccagcgcgcttggaacatctgggaggtagaggactacgggttcggtatctttactaccaatatctggcttaaacttcgggacagctacacccaggtatgcgaccaccgtctcatgtccgcagccatcaaagactcaaaggcggtccacgccgatatgggctattggatcgagtccgagaagaatgaaacttggaagctggcgcgagccagctttattgaagtgaagacctgcatctggcccaagtcccacacgctgtggagtaacggtgtgttagagtccgagatgattatccccaagatctatggcgggcccatctcccagcataactaccgccccggttactttacccaaacggccggcccgtggcacctggggaagttggagttggatttcgacctgtgcgagggcaccaccgtggtcgtggatgagcactgcggcaaccgggggccgtccctgcgcaccacgaccgttaccggcaagatcattcacgagtggtgctgccggagctgcacactaccaccccttaggttcaagggggaggacggctgctggtatgggatggagattcggccagtcaaggagaaggaggagaacctggtgaaatccatggtaagcgccggctctggcgaggtcgactctttcagcctcgggcttctgtgcatctccatcatgatcgaggaggtgatgcgatcccggtggtcgcgcaagatgctcatgacgggcacgctcgcagtattcttcttgctgataatgggtcagctgacctggaatgacctgatccggctctgcatcatggtcggcgcgaacgcctatgaccgcatggggatgggcacgacctacctggccctgatggccaccttcaagatgcgaccgatgttcgccgtgggcctactcttccggcgcctgaccagtagagaggtgctcctgctgaccatcgggctgtccctggtcgcgagcgtggagcttccgaactccctcgaggaattaggggacgggctggcaatgggcattatgatcctcaagctgctaacggatttccagtcccaccaactctgggctaccctgctgtccctaaccttcatacgcacaacgttctctctccattacgcctggaagaccatggcgatggtcctgtccatcgttagccttttccctctgtgcctgtccactaccagccagaaaaccacctggcttcccgtgctacttggctctctcgggtgcaaaccactgaccatgtttctgatcgccgaaaacaaaatatgggggcgtaagtcctggcccttaaatgagggaatcatggccgtcggcatcgtgtcaatcctgctgagcagcctcctgaagaatgacgtacccctggccgggcccctcatcgctggcggcatgctgatcgcgtgctacgtcatctccggctccagtgccgatctgagccttgagaaagccgccgaggtgtcctgggaggaggaggccgagcacagcggcgcatcccacaacatcctggtcgaagtccaggatgacgggaccatgaaaatcaaggacgaggagcgcgacgacacgctaaccattcttttgaaggctaccctgttggccgttagcggagtgtacccgctgtccatccccgcgaccttgttcgtctggtacttctggcaaaagaagaagcagcggagcggagtgctctgggacacacccagccctcccgaagtagagcgggcagttttggacgacggcatctacagaatcatgcagcgcgggctgctcggtcggagccaggtgggcgtgggggtcttccaagagaacgtattccacaccatgtggcacgttacccgcggcgcagtcctcatgtaccaagggaaacggctcgagccgtcttgggcctcggtgaaaaaggatctgatctcctatggcggcggttggcgcctacaaggcagttggaacaccggggaagaggtgcaggtcatcgccgtggagccaggcaagaaccccaagaacgtccagacggcgcccgggacattcaagacgtccgagggagaagtcggagccatcgctctcgattttaagcccgggacgagcggctcccccatcgtgaacagggaggggaagatcgtgggcctgtatggcaacggggtcgtgaccacctctggcacctacgttagcgctattgcacaggccaaggcttcccaggaggggccactcccggagattgaggacgaggtcttcagaaagcggaacctgacgatcatggatctgcaccccggcagcgggaagacccgccggtacctccccgccatcgtgagagaggccataaaaaggcgactgcgaacgctgatcttggcccctacccgagttgtcgcgagcgagatggccgaagccctgaagggcatgcccatccgctaccagaccaccgcagtcaagagcgagcacactggaaaggagattgtggatctgatgtgccacgccaccttcaccatgagactcctgtcccccgtccgcgtccccaactacaacatgatcatcatggacgaggcccacttcaccgacccgagctccatcgccgcccgggggtacatctccactcgcgttggaatgggggaggctgctgccatctttatgacagcgacgccccctggctccgttgaggccttcccccagagcaacgccgtaatccaagacgaggaaagagacatccccgagcgcagctggaacagcggctatgagtggatcaccgatttcccggggaagacggtctggttcgtcccctccatcaagtcgggcaacgatatcgccaactgcctgcgcaaaaacgggaagagagtaatccagctctcccggaagaccttcgacaccgagtaccagaaaacgaaaaacaatgactgggactacgtggtcacgaccgacatcagcgagatgggcgcgaacttccgcgccgaccgggtgattgacccccgccggtgcttaaagcccgtgatcttgaaggacgggcccgagcgcgtcatcttggccggccctatgcccgtgactgtagcctccgccgcgcagcggcgcgggcggatcggccgcaaccacaacaaggagggcgaccagtacatctacatggggcagccgctgaataacgacgaggaccacgctcattggaccgaggccaagatgctgctcgacaatatcaacacccccgagggaattatcccggccctgtttgagccagaacgcgagaagtctgccgcgatagacggggagtacaggctgcgcggcgaggcgcggaagacttttgttgagctcatgcgacgcggggacctgccggtgtggttatcccacaaggtcgcctccgagggctttcaatacagcgatcggcgttggtgcttcgacggcgagcgcaacaaccaggtcctcgaggagaacatggacgttgagatttggaccaaggagggggagcgaaagaaactgcgcccccggtggctggacgctcgtacctactccgaccccctcgccctgcgggagttcaaggagtttgcggcgggccggaggagcgtctccggggacctgatactcgaaatcggcaagctgccacaacacctgacgcagagagcacaaaacgcactcgataacctggtgatgcttcataacagcgagcaaggagggcgggcgtaccgccacgccatggaagaacttccggacaccatcgaaactcttatgctgctcgccctgatcgcggtgctgaccggaggggtcatgttgttcttcttgtccggtcgtgggctgggcaagacgagcataggcctcctgtgcgtgatggcctccagcgtgctgctttggatggcgtccgtcgagccccactggatcgccgcatccatcatcctggagttcttcctgatggttctcctgatccctgagcctgaccgccagcggactccgcaagacaaccagctagcctacgtagtcatcgggctcctgttcatgatcctgacagtcgccgcgaatgagatgggactcttggagactaccaagaaagatctggggatcggccacgtagccgtcgagaaccaccatcacgccgccatgcttgacgtagacctgcaccccgccagtgcgtggacgctgtatgccgtcgccaccaccataatcacccctatgatgcgacacaccatcgagaacactaccgccaacatatcgctcaccgccatagcgaaccaggccgccatcctgatggggctggataagggctggccgatctccaagatggacattggcgtccccctcctggctctgggatgctatagccaggttaaccccctcacgctgaccgcggccgtgctgatgctcgtcgcgcactacgccatcatcgggcccgggctgcaagcgaaggccaccagggaggcacagaagcggactgcagctggcataatgaagaacccgacggtggacgggatcgtagctatcgacctggatccagtcgtgtacgatgcgaagttcgagaaacaactcggccaaatcatgctgctgatcctctgcaccagtcaaatactgctgatgcgcaccacgtgggcgctctgcgagagtataacgttggccaccggacccttaaccaccctctgggaggggtcccccgggaagttttggaacacgaccatcgccgtctcgatggccaatatcttccggggctcgtacctggcgggcgccggcctcgccttcagcctcatgaagtccctcggcggcgggcgccgggggaccggggctcagggcgagacgctgggcgagaagtggaagcgccagctcaaccagttgtcaaagagcgagtttaacacgtacaagcggtccgggatcatggaggtcgatcgcagcgaagcgaaggaaggcctgaagcgcggggagacaaccaagcacgcagtcagtcggggcaccgccaaactccgctggtttgtggaacgaaatctggtcaaaccggaggggaaggtgattgacctgggctgtggccgcggcgggtggagctactactgcgccgggctgaagaaggtgacggaggtcaaggggtacacaaagggagggcccggccacgaggagcccatccccatggccacctacggatggaacctcgtcaagctgcactccggtaaggacgtgttcttcatcccgccagaaaagtgcgacactctgctctgcgacatcggcgagagttcccccaacccgacgatagaggagggacgcacgctgcgggtcctaaagatggtggagccatggcttcgcgggaaccaattctgcatcaagatcctgaacccgtacatgcccagcgtagtcgagaccctagaacagatgcagcggaagcacggcggcatgctcgtgcgcaatcccctgtcccggaactcaacacacgagatgtactgggtaagttgtgggacgggcaacatcgtcagcgcggtgaacatgacgtcccgcatgctcctcaaccgcttcacgatggcccaccggaagccgacctacgagcgcgatgtggacctgggcgccggcacccggcacgtcgccgtggagcctgaggtggccaacctggacatcattggccagagaatcgaaaatattaagcacgaacacaagagcacgtggcactatgacgaggacaatccctataaaacgtgggcgtaccacgggtcttacgaagtaaaacccagcggctccgccagcagcatggtgaatggggtcgttaaattactgaccaagccgtgggatgtgatacccatggtcacgcaaatcgccatgacggacaccaccccctttggccagcagcgggtgttcaaggagaaggtggacaccaggacgccgaaggccaagcgggggaccgcgcagatcatggaggtcaccgcgaagtggctgtggggcttcctatccaggaacaagaagcctcggatctgcaccagagaggagttcacgcggaaggtgcgcagcaatgcggccatcggcgccgtattcgttgacgaaaaccagtggaactcagcgaaggaagccgtggaggacgagaggttctgggacctggtgcaccgcgagcgggagctgcataagcagggaaagtgcgctacttgtgtctataatatgatgggtaagcgcgagaagaagctcggggagttcgggaaggctaaggggagccgggccatttggtacatgtggctgggcgcgcgcttcctggagttcgaggccctcggcttcatgaacgaggaccactggttctcccgggagaacagtctgtccggggtggaaggtgaagggctgcataagctcggctacatcctgcgcgacatcagcaaaattcccgggggcaacatgtatgccgacgacaccgccggctgggatacccgaatcacggaggacgacctgcagaacgaagccaaaatcaccgacataatggagcccgagcacgcgttgctggccaaatccatcttcaaactgacctaccagaacaaagtggtccgcgtacagcggccggccaagaacggtaccgttatggacgtcattagtcgtcgagaccagcgcggctccggccaggtgggaacgtacggcctcaacaccttcaccaacatggaagcccagctgatccgccagatggagtccgaggggattttcagtcccagcgagctggagacccccaatctagccggccgggtccttgattggctcgagaagcacggggtcgagcgccttaagcggatggcgatctccggcgacgactgcgtggtgaagcccatcgatgacaggtttgccacggccctgaccgccttaaacgatatggggaaggtccggaaagacatcccccaatgggagccttcaaaaggatggaacgactggcagcaggtccccttctgcagtcaccacttccaccagctcatcatgaaggacggacgcgagatagtcgtcccctgccggaaccaggatgagctggtcgggcgcgcccgggtgagccagggcgcggggtggagtctgcgtgagacggcatgtctcggcaagtcctacgcccaaatgtggcagctcatgtacttccaccggcgcgacttaagacttgcagcgaacgccatctgctccgccgtaccggtggactgggtgccgacctcccgcacgacctggagcatccacgcgcaccaccagtggatgacgacagaggacatgctgtcggtgtggaatcgggtgtggatcgaggagaacccctggatggaggacaagacgcacgtgtcatcctggggcgacgtcccgtacctgggcaagcgcgaggaccaatggtgcggcagcctcatcgggctcaccgctcgcgcgacctgggccaccaatatccaggtagccatcaaccaagtgcggcgcctgctaggcaacgagaactacctagattacatgacgagcatgaagcgttttaaaaatgagagcgacccggagggtgcgctatggtag

SEQ ID NO: 24090 - RNA, 9879 nt, synthetic construct
  misc_feature 1..9879: note = derived and/or modified CDS sequence (opt11) from DENV-1__EU660403__SS-prME
  source 1..9879: mol_type = other RNA
agcgtcaccatgctgctcatgctgatgcccaccgccctggccttccatttaactacgcgcggcggggaacctcatatgatcgtgtcaaagcaagaacgtggaaagagcctgctgttcaagacctccgcaggggtgaacatgtgcacgttgattgcaatggacctgggcgagctatgcgaggacaccatgacctacaagtgtcctcgcatcaccgagaccgagcccgatgacgtggattgttggtgtaacgccacggacacctgggtcacctacgggacgtgcagccaaacgggcgagcaccggagagacaaacggtcagtagccttagctcctcacgtaggtctgggtctagagactcggaccgagacctggatgtcatccgagggcgcgtggaagcagattcagagggtcgaaacgtgggccctccgccaccccgggttcaccgttatcgccctgttcctagcccatgcgatcggtaccagcatcacacagaaggggatcatattcatactcctgatgctggtgacacccagtatggccatgaggtgcgtaggcatcggtagccgcgacttcgtcgaggggctgtcaggcgccacatgggtggatgtcgtgctggagcatgggagctgcgtgaccaccatggccaaggacaagcccacgctggacatcgagctcttgaagaccgaggttaccaatcccgctgtgttgcggaaactctgcatcgaagcgaaaatcagtaacaccacgaccgacagccgctgcccgacccagggcgaggccaccctggtggaagaacaagatgccaatttcgtctgccggcgcacgttcgtggacagagggtgggggaatggttgcgggttattcggtaaggggtctcttataacgtgcgccaaattcaagtgcgtgactaagctggagggcaaaatcgtccagtacgagaacttaaagtactccgttatcgtgacagtccacacgggcgaccagcaccaggtggggaacgagtccaccgaacacggcaccaccgccaccataactcctcaggcgcccaccaccgaaatccagctaactgattatggggccctgacgttggactgctcaccccgcaccggcctggacttcaacgagatggtcctgcttactatgaaagagaagtcctggctcgtgcacaaacagtggtttctggacctgcccttgccctggacctcgggcgcaagtacctcccaggagacctggaatcggcaggatttgcttgtgaccttcaagaccgcccacgccaagaaacaggaggtcgtcgtgctaggcagtcaggaaggcgcgatgcacaccgccctgaccggggccaccgaaattcagacctcgggcactaccaccattttcgccgggcacctcaagtgccgcctcaaaatggacaagctgaccttgaagggcatgagctacgtcatgtgcacgggctccttcaagctcgagaaggaggtggcggaaacgcagcacggcaccgttctggtccagatcaagtacgagggtaccgacgcgccctgcaagatccccttcctaactcaggacgagaagggggttacccagaacggcaggctgataacggccaatccgatcgtgaccgacaaggagaagcccgtcaacattgaggcggagccgccctttggggaaagctacatcatcatcggcgccggcgagaaggcgctcaagttatcctggttcaaaaaggggagctccatcgggaagatgttcgaggcgacggcccgcggggcccgtcgaatggccatcctgggcgacaccgcctgggacttcgggagcataggcggggtcttcacctccgtgggcaagctcgttcaccagatctttggaaccgcttacggagtactgtttagcggcgtgagctggacgatgaagattgggataggcgtcctcctcacttggctgggtctgaactctaggtccacctctttgtccatgacctgcatcgccgtaggactggtgacgctgtacttaggcgtcatggtacaagccgacagcgggtgcgtgatcaactggaaaggccgggaactgaagtgcgggtccggaatcttcgtgaccaacgaggtgcacacttggaccgagcagtataaattccaggccgacagcccgaagcgccttagcgcagcaatcggtaaggcctgggaggagggggtatgcggcatccggtccgccacccgtctcgagaacatcatgtggaagcagatcagcaacgaactgaaccacatcttgctcgaaaatgatatgaagttcacagtcgtggtgggggacgtcgctggcatcctggctcaggggaagaaaatgatacggccccagcccatggagtacaagtactcctggaaaagctggggcaaggccaagattatcggcgcagacgtgcagaacacaaccttcattattgacgggcccaacacccccgagtgccccgacgaccagagagcttggaacatatgggaggtagaggactacggcttcgggatctttacgaccaacatatggctgaagctgcgggactcctacacccaggtctgcgaccacagactgatgagcgcggccataaaggactccaaggccgtgcacgccgacatgggctattggatcgagagcgagaagaacgagacctggaagctggcgcgggcctcatttatcgaggtgaagacgtgcatctggcccaagtctcacacactctggtcgaacggcgtcctagagagcgagatgatcatccccaagatctacgggggcccgatcagtcagcataactataggcccgggtacttcacacaaaccgccgggccctggcatctggggaagttagagctggacttcgacctgtgcgagggcacgacagtggtcgtcgacgagcactgcggaaaccgggggccgagcctccggaccaccacggtgaccggcaagatcatccacgagtggtgctgccggtcctgcaccctgccgccactgcgctttagaggggaagacggctgctggtacggtatggagatcagacccgttaaggaaaaggaggaaaaccttgtaaaaagcatggtgagtgccggtagcggcgaggtggacagcttctccctggggctgctctgcatcagcataatcattgaggaggtcatgcggtctcgctggtcccggaagatgttaatgaccggcacgctggctgtgttctttctccttataatgggtcagctcacgtggaacgacctcatccgtctgtgcatcatggtcggagccaacgcgtccgaccgcatggggatgggcaccacctacctggctctcatggcgacgttcaagatgcggccgatgttcgccgtaggcctgctgttccgccggctcaccagccgcgaggtgctgctactcactatcgggctgtccctggtggcctccgtcgaactccccaactcactcgaggagctgggggacggcctcgcgatgggcatcatgatcctgaaacttctcactgacttccagagccaccaactgtgggccacgctgttgtccttaaccttcatcaaaaccaccttcagcctgcactacgcttggaaaacgatggcaatggtgctctccatcgtctctctgttccccctgtgtctctccaccacctctcagaagaccacgtggctgcccgtgctgctcggctccttgggttgcaagccgctgactatgttcctcatcgcggagaacaagatctggggccgtcgcagctggccattaaacgaagggattatggccgtgggcatcgtctccatcctgctcagcagcctgctgaagaacgatgtgcccctggccgggcccctaatcgccggaggcatgctgattgcttgctacgtgatctccggatcctcggcggacttgagcctcgagaaggccgccgaggtctcctgggaagaagaggccgagcattcaggcgcgtctcacaacatccttgtggaggtgcaggatgatgggactatgaagataaaggatgaggaaagagacgacaccctcaccatcctgctgaaggcgacgctcctggccgtcagcggcgtgtacccgctgagcatccccgccaccctcttcgtgtggtacttttggcagaaaaagaagcaacgcagcggggtcctgtgggacaccccgagcccgcccgaggtggagcgggccgtcctggatgacggcatctaccgcatcatgcagcgggggctgctcgggcgcagccaggtcggggtaggggttttccaggagaacgtattccacacgatgtggcacgtgacgcggggcgccgtcttaatgtatcaggggaagcgcctggagccctcttgggcgagcgtcaagaaggatctcatctcatatggcggagggtggcggctgcagggctcatggaataccggggaggaggtacaggtgatagccgtcgagcccggcaagaaccccaagaacgtgcagacagccccagggaccttcaagacgcccgagggcgaggtcggcgcaatcgccctggatttcaaacccgggacgtccggcagccccatcgtcaacagggaagggaaaatcgttgggctgtacggtaacggcgtggtcacaacatccggcacgtacgtaagtgcgatagcgcaagccaaggccagccaagaagggcccctgcccgagatcgaggacgaggtcttccggaagcgcaacctgaccataatggacctccaccccggctccgggaagacccggcgatatctgccggcgatcgtccgggaggcaatcaagcggaagctgcgcaccctgattctggcgcccacgcgggtggtggcctccgagatggccgaggcgctgaaggggatgcccatccgctaccaaacaaccgcggtcaagtccgagcacacaggcaaggagatagtggatttaatgtgccacgccacattcaccatgcggctgttaagccccgtgcgcgtcccgaattacaacatgatcataatggacgaggcccacttcacggaccccagcagcatcgctgctcgcgggtacatctccacccgcgttggaatgggtgaagccgcggccatctttatgacggccacgccgcccggtagcgtagaggcgttcccgcagtccaatgccgtcattcaagacgaggagcgcgacatccccgaacgcagctggaactccgggtatgagtggatcactgacttccccggcaagaccgtgtggttcgtccccagcatcaagtcaggcaacgatatcgccaattgcctccggaagaacgggaagcgcgtcatccagctgtctcggaagacgttcgacaccgagtaccagaaaacaaagaacaacgattgggactacgttgtgaccactgacatatccgagatgggcgccaacttccgcgcggaccgagtcattgacccacgccgatgcctgaaacccgtcatcttaaaggacgggcccgagcgagtaatcctggccggacccatgcccgttaccgtggccagcgcagcccagcggagggggcggatcggacgcaaccacaacaaggagggcgaccagtatatttacatggggcagcccctgaacaacgatgaagaccatgcacactggaccgaggccaagatgctcctggataacatcaacacccccgaggggatcatcccggccctgtttgagccggaacgcgagaagtccgctgcaattgacggggagtacaggctcaggggcgaagcgcggaagacattcgtcgagctgatgaggcgcggggacctgccagtgtggctcagctacaaggtggcctccgaaggattccagtacagcgaccgccggtggtgcttcgacggcgagcgaaacaatcaggttctggaggagaacatggacgtagagatctggacgaaggagggggaaaggaagaagctgcgcccccggtggcttgacgcccgcacctactcagaccctctggccctgcgggagttcaaggagttcgcggcgggccgccggtccgtgtcgggcgacctcatcctcgagatcgggaaactgccacaacacctcacccagcgcgcccagaacgccctggacaacctggtcatgctccacaattccgagcagggcgggcgtgcctaccgacacgcgatggaggaactgcccgatacgatcgagaccctgatgctgctggcgcttatcgctgtcctcaccggtggggtgacacttttcttcctgagcggccgggggctcggcaagacctccattggacttttgtgcgtcatggccagcagtgtgctgctttggatggccagcgttgagccacactggatcgcggcctccatcatcctggagttctttctaatggtcctgctgatcccagagcctgacagacagcggacgccccaggataaccaactcgcctacgtggtgataggactgctgttcatgatcctgaccgtcgctgccaatgagatgggcctgctggagaccaccaaaaaggacctcgggattggtcacgtagcggtggaaaaccaccaccacgctgccatgctggacgtcgacctccaccccgccagcgcctggacactttacgctgtggccaccacaatcatcacgccgatgatgcgtcacacgatcgaaaatacaacagcaaacatcagcctgaccgcgatcgccaaccaggcggcgatcctgatggggctcgacaagggctggcccatcagcaaaatggacatcggcgtaccgttgctggccctagggtgctactcccaggtaaaccccctgactctgacggctgctgtcttaatgctcgtggcacactacgccatcatcggcccggggctgcaggcaaaggccacacgcgaggcccagaagcggaccgctgccgggattatgaagaaccccacggtcgacgggatcgtggccattgacttagaccccgtggtctacgacgcaaaattcgagaaacagctgggccaaatcatgctgctaatcctttgcaccagccaaatcctgctcatgcgcactacttgggcgctatgcgaatccatcacgctggccacgggcccgctaaccaccttgtgggagggcagcccggggaagttctggaacacgacaatcgccgtgtccatggccaacatattccgagggtcatatttagccggggctggcctcgccttctccctgatgaaatccctcggaggagggcgtcgggggaccggggcacagggcgagaccctaggcgagaagtggaagcgccagttgaatcagctgagcaagtcagagtttaacacgtacaaacggagtgggatcatggaggtggaccgctcagaagccaaggagggcctcaagcgcggggagaccaccaagcacgcggtcagccgcggaaccgccaagctgagatggttcgtggaacgcaacttagtgaagcccgaagggaaggtcatcgatctgggctgcggccgcggcgggtggtcctactactgcgccgggctcaagaaggtgaccgaagtgaaggggtacaccaagggaggccccggtcacgaggagcccatcccaatggccacgtatggttggaatctcgtaaagctacatagcggcaaggacgtgttcttcatcccgcccgaaaaatgcgacaccctcctgtgcgacatcggggagtccagccccaacccgacgatcgaggagggtcgtacgctgcgggtgctcaagatggtcgagccctggctgcgtgggaaccagttttgcatcaagatcctgaatccctatatgccctccgtagtggaaaccctcgagcagatgcaacggaagcacggaggaatgcttgtgcgcaacccgctcagccgaaattcaacccacgagatgtactgggtgagctgcgggaccggcaatatcgtgtccgccgtcaacatgacgtcccgcatgctcctgaaccgattcaccatggcgcaccggaagcccacgtacgagcgagacgtagacctcggggccggtactcggcacgtagccgtcgaacccgaagtcgccaacctcgacataatagggcaacggatagaaaatatcaaacacgagcacaagtccacgtggcactacgacgaagataacccctacaagacctgggcctaccacgggagctatgaggtaaagccttccggaagcgcgtcatcaatggtcaacggggtggtcaagttgcttactaaaccctgggacgtaatccccatggtgacccagatcgccatgacagacaccacgccttttggccagcagcgggtcttcaaggagaaagtcgacaccagaacgccaaaggccaagcgggggaccgcccagatcatggaggttaccgccaagtggctctggggcttcctgagccgcaacaagaagccccggatctgcacccgcgaggagttcacgcggaaagtccgctccaacgccgccatcggcgcggtgttcgtcgacgaaaaccaatggaacagcgctaaggaagcggtcgaggacgagcggttctgggacctagtgcaccgcgaacgggagctccacaagcaggggaagtgcgctacctgcgtgtacaatatgatgggcaaacgcgagaagaagctgggagagtttggcaaagccaagggatcccgggccatctggtatatgtggcttggagcccgcttcctcgagttcgaggccctgggcttcatgaacgaagaccactggttcagccgggagaactccctcagcggggtagaaggcgaggggctccacaaactgggatacatcctgcgcgacatcagtaagatccccggcggcaacatgtacgccgacgacaccgccgggtgggatacccgaatcacggaagatgacctccagaacgaggccaggatcactgacatcatggagccggagcatgccctgctggcgaagtcgatattcaaactgacctaccaaaacaaggttgtgcgcgtccagcgacccgccaagaacggtactgtgatggacgtaatcagccggcgggaccagcgcggctcagggcaggtcggtacgtacggcctaaacaccttcaccaacatggaggcacagctgattcggcagatggagtcagagggcatcttcagccccagcgagctcgagaccccaaacctagccgagcgcgtactggactggctagagaagtatggagttgagcggctgaagcgcatggccatcagcggtgacgactgcgtcgtgaagccgattgatgaccggttcgcgactgccctgaccgccctcaacgacatgggcaaggtacgcaaggacatcccacagtgggaacccagcaagggctggaacgactggcagcaggtcccattctgcagccaccacttccaccagttgatcatgaaggacggccgggaaatcgtggtgccgtgccgcaaccaggacgagttggtcggaagggcccgcgtgtcccaaggggctggatggagcttacgggagaccgcgtgccttggaaagagctacgcgcagatgtggcagctcatgtacttccaccggcgggacttacgcctcgccgccaacgcgatctgctctgcagtgcccgtcgactggatcccgacgagtcgcacgacctggagtatccatgcccaccatcagtggatgaccaccgaggatatgttaagcgtgtggaaccgcgtgtggatcgaggagaacccgtggatggaagacaagacgcacatctctagctggggtgatgtgccgtacctagggaagcgagaggaccagtggtgcggtagtctgatcggcctgaccgcccgggccacctgggcgaccaacattcaggtggctatcaaccaggtgcgccggctcattgggaacgagaattacttagactatatgaccagcatgaagcgctttaagaacgaaggggaccccgagggagccctgtggtga

SEQ ID NO: 24091 - RNA, 9879 nt, synthetic construct
  misc_feature 1..9879: note = derived and/or modified CDS sequence (opt11) from DENV-1__EU660397__SS-prME
  source 1..9879: mol_type = other RNA
agcgtaaccatgctactcatgctgatgcctaccgccctggcattccacctcaccactcgtggcggagagccccacatgatcgtgagcaagcaggagcggggcaagagcctgctattcaagaccagcgccggtgtgaacatgtgcaccctcatcgccatggatctgggggagctgtgcgaggacaccatgacctacaagtgcccccgcatcaccgagaccgaacccgacgacgtggactgctggtgtaacgccacggacacctgggtgacctatgggacctgcagccagacgggcgagcaccggcgcgacaagcgctccgtggccctcgcgccccacgtgggcctggggctggagacccgcaccgaaacctggatgagctccgagggcgcctggaagcagatccaacgagtcgagacatgggccctccgccaccccgggttcaccgtgatcgccctgttcctggcccatgcgatcggcaccagcatcacccagaaagggatcatcttcatattgctgatgctcgtgacgccttccatggccatgcggtgcgtcggcatcggcagccgcgactttgtggaagggctctccggcgccacctgggtggacgtcgtgctggagcacgggagctgcgtgaccactatggccaaagacaagcccacgctggacatcgagttgttaaaaacagaggtcaccaaccccgccgtgctgcggaagctctgcattgaggcgaaaatctccaataccacgacagactcacgttgcccgacacagggcgaggccaccctggtggaggagcaggatgccaacttcgtctgccggcgaacgttcgtagaccggggctgggggaacggctgcgggttgttcggcaagggatccctcatcacgtgcgccaagtttaagtgcgtgaccaagcttgagggcaagatcgtccagtacgagaacctgaagtacagcgtgatcgtaaccgtccacacgggggaccagcaccaggtggggaacgaatccaccgaacacggcaccaccgctaccatcacgccacaggcgccaacaaccgagatccagctcaccgactacggggcgctgacgctggactgcagcccgcgaaccggcctcgacttcaacgagatggtcctgctgacaatgaaggagaagtcctggctcgtgcacaagcagtggttcctggacctgcccctcccctggacctcgggggcctcgacgtcccaggagacctggaaccggcaggacctgctcgtgaccttcaagacggcccacgccaagaagcaggaagtcgtggtgctgggcagccaagagggcgcgatgcacacggctctgaccggcgccaccgagatccagacctccggcactactaccatcttcgccgggcaccttaagtgccgcctcaagatggacaagctcacgctgcgaggcatgagctacgtaatgtgtacggggtcctttaagctcgagaaggaggtggctgagacgcagcacggcaccgttctggtccagatcaagtacgagggcacggacgcgccctgcaaaatccccttcagtacgcaggacgagaagggggtcacccaaaacggccgcttaatcaccgccaacccgatcgtgaccgacaaggagaagcccgtcaacatagaggccgagccgccctttggcgaatcctatatagtgatcggcgccggcgagaaagcgctgaagctcagctggttcaagaaggggtccagtatcggaaagatgttcgaggccacggcccgcggggcccgccgcatggctatcctgggcgacactgcctgggacttcgggtcgatcggcggcgtgttcacctccgtagggaaactagtgcaccagatcttcggcaccgcctacggggtgctgttctccggggtcagctggacgatgaaaatcgggatcggcgttctgctgacctggctcggcctgaactcccggagcaccagcctgtcaatgacctgcatcgccgtggggttggttacgctgtacctgggcgtgatggtgcaggccgactccgggtgcgtcattaactggaaaggtcgtgagctcaagtgcggaagcggcatcttcgtgaccaacgaggtgcacacgtggaccgagcaatacaagttccaggccgattctccgaagcggctgtccgcggccatcggcaaggcctgggaggagggggtttgcggtatcagaagcgctacccggttggagaacatcatgtggaagcagatctccaacgagctcaaccacatcctgctggagaacgacatgaagttcacggtggtggtcggggacgtggccggcatcctcgcgcaggggaagaagatgatccgcccccagcccatggagtacaagtactcctggaagtcgtggggcaaggccaagatcatcggggccgacgtacagaacacaaccttcatcatcgatgggcccaacaccccggagtgccccgacgaccaacgggcctggaacatctgggaggtagaggactacggcttcgggatcttcacgaccaatatctggctgaagctgcgcgactcttatactcaggtatgcgaccatcggctcatgtctgctgccatcaaggacagtaaggccgtgcacgccgacatgggttactggatcgagtccgagaagaacgaaacctggaagctggctcgcgcgagctttatcgaggtcaagacgtgcatatggcccaaatcccataccctgtggtcaaacggtgtgctcgagtccgagatgatcatccccaaaatatacgggggcccgatcagccaacacaactacaggccggggtacttcacgcaaaccgccggcccctggcacttagggaagctggagctagacttcgacctgtgcgagggaacgaccgtggtcgtggacgagcactgcggtaatcgcggtccgtccctgagaactacgacggtgacgggcaagatcatccacgagtggtgctgtcgctcttgtaccctgccgcccctgcgtttccgcggggaggacggctgctggtacgggatggagatccgacccgtcaaagagaaggaggaaaacctggtgaagtccatggtgagcgccggaagcggcgaggtcgactcctttagcctcgggctgctgtgcatttccatcatgatcgaggaagtcatgcgcagccggtggtcccgcaagatgttaatgaccggcacactggccgtgttctttttgctcatcatggggcagctcacttggaatgacctgatccgcctctgcatcatggtcggcgccaacgccagcgatcggatggggatgggcaccacctacctggccctgatggcaacgttcaagatgcgcccgatgttcgccgtgggtctcctgtttaggcgcctcacctcccgggaggttctcctgttaaccatcgggctcagcctggtcgcctccgtggagctccccaacagcctcgaagagctgggcgacgggctggcgatgggcatcatgatcctcaagctgcttaccgatttccagagtcaccagctctgggccacgctgctgagcctaaccttcatcaagaccaccttctccttacactacgcctggaagacgatggccatggtcctgagcatcgtgagcctcttccccctgtgcttgagcaccacctcccagaagaccacatggctccccgtgctgctgggcagcctcgggtgcaagccgctgaccatgttcctgatcgcggagaacaaaatctggggccgacgttcctggccgctcaatgaggggatcatggctgtgggcatcgtgagcatccttctatcttctctcctgaagaacgacgtgcccctggctgggcccctcatcgccggcggcatgctgatcgcctgctacgtcatcagcgggtctagcgcggatctgtcactcgagaaggccgccgaggtgagctgggaggaggaggccgagcacagcggagccagccataacatcctggtggaggtccaggacgacggcactatgaaaatcaaggacgaggagcgcgacgacaccctgaccatcctcctaaaggcgacactgctagccgtgtccggcgtttatccgctcagcatccccgccaccctgttcgtctggtacttttggcagaagaagaagcagcggtcaggggtgttatgggacacccctagcccgcccgaggtggagcgcgccgtcctggacgacggcatctaccggatcatgcagcgcggcctgctggggcggagtcaggtgggcgtgggcgtcttccaggagaacgtgttccacaccatgtggcacgtgacgcgcggcgccgtactgatgtaccaggggaagcggctggagccctcctgggcgagcgtgaagaaggacctgatcagctacggcggagggtggcgccttcagggctcatggaacaccggggaggaggtgcaggtcatcgctgttgagcctggcaagaaccccaagaacgtgcagactgcgcccgggaccttcaagacgcccgaaggagaagtgggggccatagccctggacttcaagcccgggacctccggctcccccatcgtgaacagagaggggaagatcgtgggcctgtacggcaacggggtcgtgaccaccagcgggacttacgtgagcgcgatcgcccaggccaaggcctcccaggaggggccgctccccgagattgaggacgaggtcttccgtaagcggaacctgaccatcatggacctgcacccaggcagcgggaagacccgccgttacctcccggcgatcgttcgcgaggccatcaagcgcaagttacggactctgatccttgcccccacgcgcgtcgttgcctccgagatggcagaggcgctaaagggcatgcccataaggtaccagaccaccgccgtcaagagcgagcacaccggcaaggagatcgtggacctgatgtgccacgccacattcacgatgcgcctcctgtcccctgtccgagtcccgaactacaacatgatcatcatggacgaggcccatttcaccgacccctcgtccatcgccgcgagagggtacatctcgacccgggtgggcatgggggaggcggcggccatcttcatgactgccacgccgccgggctccgtcgaggcgttcccgcagagcaatgccgtgatccaggatgaggagcgcgacatccccgagcggtcctggaacagcgggtatgagtggatcaccgacttccccggcaagaccgtctggttcgtcccctccatcaaaagcggcaacgacatcgccaactgcttgcgcaagaacgggaagcgtgtaatccaactatcgcggaagacgttcgacaccgaataccagaagacaaaaaacaacgactgggactacgtggtcaccacggacatcagcgagatgggcgccaacttccgggcggaccgcgtgatcgacccgcggcgctgcttgaagcccgtgattttaaaggacgggcccgagcgcgtcatcctcgccggccccatgcccgtgaccgtagcctccgccgcccagaggcgggggcgcatcggccgcaaccacaacaaggagggcgaccagtatatatacatggggcagcccctgaacaacgacgaggaccacgcgcactggactgaagcgaagatgctgctcgataacatcaacacccccgagggcattataccggccctgttcgagccggagcgggagaaatccgccgccatcgacggagagtaccgcctccggggcgaggcgcgcaagactttcgtggagctcatgcggcgaggagaccttcccgtgtggctgtcatacaaggtcgccagcgagggcttccaatacagcgaccggagatggtgcttcgacggcgagcggaacaaccaagtgctcgaggagaatatggacgtagagatatggaccaaagagggggagcgcaagaagctgcggcctcgctggctggacgcccggacctactcggaccccctcgccctgcgcgagtttaaggagttcgcggcgggacgacgcagcgtctccggcgacctgatcctcgagatcggcaagttgccgcagcacctcacgcagcgggcccagaacgccctcgacaacctggtgatgttacacaacagcgagcaaggcggacgggcttaccggcacgcgatggaagagctccccgacacgattgagacgctgatgctgctcgccctgatcgccgttctgaccggcggggtcaccctcttcttcttgtccggccgcgggctgggcaagaccagcatcggccttctctgcgtcatggcctccagcgtgctgctctggatggcctccgtcgagccacactggatcgcagcaagcattattctggagttcttcctgatggtgctcctgatccccgagccggaccgacagagaacgccccaggacaaccagctggcctatgtggtaatcggtctcctgttcatgatcctgaccgtggccgccaacgagatgggcttgctggagaccaccaaaaaggatctggggatcggccacgtggcggtcgagaaccaccaccacgccgccatgctcgacgtggacctgcatcccgctagcgcctggacgctgtatgcggtggccacgaccatcatcaccccgatgatgcgccacacgatcgagaacacgaccgccaacatcagcctcaccgccatcgccaaccaagcagccatcctcatggggctggacaagggctggcccatctcaaagatggacatcggcgtccccctccttgccctggggtgctacagccaggtgaaccccttgacactgaccgccgcggtcctgatgctcgtcgcccactacgccatcatcggcccagggttgcaggcaaaggccacccgggaggcgcagaagcgcaccgccgctggcatcatgaaaaacccgacggtcgacgggatcgtggccatcgacctggaccctgtagtgtacgacgccaagttcgagaaacaactcggccagattatgttactgatcctctgcacctcccagatcctgctaatgagaaccacctgggcgctttgcgagagcattacgctggccaccggcccccttaccaccctctgggaggggtccccgggcaagttctggaacacgaccatcgccgttagcatggccaacatcttccgcgggtcctacctggccggcgcgggcctcgccttcagcctcatgaagtccctcggtggcgggcggcgcgggaccggggcgcagggcgagaccctgggcgagaagtggaagcggcagctcaaccagctctcgaagagcgagttcaacacgtacaagcgctcggggatcatggaggtcgaccggagcgaagccaaggagggactgaagcgcggggagaccaccaagcacgcggtgtcacggggcaccgccaagctccgctggttcgtggagcggaatctcgttaagcccgaggggaaggtgatcgacctaggctgcggccgcggtggctggagctactactgcgccgggctgaagaaggttacggaggtcaaaggctataccaagggcgggcccggccacgaggagcccatcccaatggccacctacggctggaacctcgtgaagctgcactccggcaaggacgtgttctttatcccgcccgagaagtgcgacaccctgctctgcgacatcggggaaagcagtcccaacccgacaatcgaggagggccggaccctgcgcgtcctgaagatggtggagccctggctccgggggaaccagttctgcatcaagatcctgaacccctacatgcccagcgtggtcgaaacgcttgaacagatgcagcgcaagcacggcggcatgttggtgcggaacccgctgtcccgcaacagcacccacgaaatgtactgggtgagctgcgggaccggcaacatcgtcagcgccgtgaacatgacgtcccgcatgctgctcaaccggttcaccatggcgcaccgcaagcccacctacgagcgggacgtggacttaggggctggcacccgccacgtcgccgtcgagcccgaggtggcaaaccttgatatcatcggacagcggatcgagaacatcaagcacgagcataagtccacgtggcactacgatgaggacaacccttacaagacctgggcgtaccacgggtcctacgaggtcaagccgtcaggctccgcttcaagcatggtaaacggggtcgtcaagttgctgaccaagccctgggacgtaatccccatggtcacccaaatcgccatgacggacaccacccccttcggccagcagcgcgtgttcaaggagaaggtagacacccggacgcctaaggccaagcgcgggaccgcccagatcatggaggtcaccgccaaatggctgtggggcttcctctcccggaacaagaagccccgcatctgcacccgggaggagtttacccgcaaggtgcggagcaacgcagccatcggcgccgtgttcgtcgacgaaaaccagtggaactccgccaaggaagcggtggaggacgagcgcttttgggacctcgtgcaccgggagcgggagctgcataagcaggggaagtgcgcgacctgcgtctacaacatgatgggcaagagagagaaaaagttgggggagttcggaaaggccaagggaagcagggccatctggtacatgtggcttggcgcccgcttcctggagtttgaggcgctgggcttcatgaacgaggaccactggttctcccgcgagaatagcttatccggggtggagggagaggggttacacaagctcggctacatcctgagggacatcagcaagatccccgggggcaacatgtacgcggacgacaccgccggctgggacacccgcatcacggaggacgacctgcagaacgaggcccgcattactgacatcatggaaccagagcacgccctcctggctaagtccatcttcaagctgacctaccagaacaaggtggtgcgggtgcagcgccccgcaaaaaatgggaccgtgatggatgtcataagccggcgcgaccagcgcggatccggccaggtgggcacttacggccttaacacgtttaccaatatggaggcccagctgattagacagatggagagcgaggggatcttctccccatcagagctggagacccccaacctcgccgaacgggttctggactggctggagaagtacggcgtcgagcgcctcaagcggatggccatttccggggacgactgtgtagtgaagccgatcgacgaccgcttcgccacggccctgaccgccctgaacgacatgggcaaggttagaaaggacataccccagtgggagcccagcaaggggtggaacgattggcagcaggtccccttctgctcgcaccacttccaccagctcatcatgaaggacggacgcgagatcgtggtcccgtgccggaaccaggacgagctggtgggtcgcgcccgggtgagccagggggccggctggagcctgcgcgaaactgcgtgcctcggaaagtcctacgcccagatgtggcagctgatgtactttcaccggcgcgacctgcggctcgccgccaacgcgatctgtagcgccgtccccgtggactggatccccacctcccgcacaacctggagcatccacgctcaccaccaatggatgactacagaggacatgctcagcgtctggaaccgcgtctggatcgaagagaacccctggatggaggacaagacgcacatcagctcctggggcgacgtgccgtacctcggaaagcgggaggaccagtggtgcggcagcctcatcggtctgaccgcccgcgccacttgggcgaccaacatacaggtggccatcaaccaggtccggcgcctgatcgggaacgagaactacctcgactacatgacctccatgaagcggttcaagaacgagagcgaccccgagggcgccctgtggtaa

SEQ ID NO: 24092 - RNA, 9879 nt, synthetic construct
  misc_feature 1..9879: note = derived and/or modified CDS sequence (opt11) from DENV-1__EU687247__SS-prME
  source 1..9879: mol_type = other RNA
agtgtgaccatgctgctgatgcttatgcccaccgccctggccttccacctcaccacgcggggcggagaaccccacatgatcgtgtccaagcaggagcgggggaagagcctgctgtttaagacctccgccggggtgaacatgtgcacgctcatcgccatggacttgggcgagttctgcgaggacactatgacctacaaatgcccgcgcatcacagaggccgagcccgacgacgtggattgttggtgcaacgccaccgatacgtgggtcacgtacgggacctgcagccagaccggggagcaccggcgggataagcggtcggtggctctggcaccacacgtgggcctcgggctggagacgcgcacagaaacctggatgagctctgaaggcgcttggaaacagattcagcgggtcgagacctgggccctgcgccaccctgggttcacggtgatcgccttgttcctggcgcacgccatcggcaccagcatcacacagaaggggatcatcttcattctgctcatgctggtgacccccagtatggccatgcggtgcgtcggcattggctctagagactttgtggaggggttaagtggcgcaacgtgggttgacgtcgtactcgagcacggaagctgcgtaaccaccatggccaaggacaaacccaccctggacatcgagcttctcaagacagaagtcaccaaccccgcggtgcttcggaagctgtgcatcgaggccaagatcagcaacaccaccacagactcgcgctgcccgacgcagggcgaggctaccctcgtggaggagcaggacgccaacttcgtttgccggcgcacctttgtggatcgcggctgggggaacggctgtgggctgttcggcaagggctccctgatcacgtgcgctaagttcaagtgtgttactaagctcgagggcaagatcgtccagtacgagaacctaaagtattcagtcatagtgaccgtccacacgggagatcagcaccaggtggggaatgagtccacggagcacgggaccacagcgaccatcacgccccaggctcccagcaccgagatccagctgaccgactacggggcgcttaccttagattgcagcccccgcaccggcctggacttcaacgagatggtcctcctgacgatgaaggagaaatcgtggctggtgcacaagcagtggttcctcgatctgccgctgccctggactagcggtgcctccacgtctcaggaaacttggaaccggcaggacctcctggttacattcaagaccgcccacgcgaagaagcaggaggtcgtagtgttaggctcccaagaaggcgccatgcacaccgcactcaccggggccacggaaatccagaccagcggcaccaccacgatcttcgccgggcacctgaagtgccgcctgaagatggacaaactcaccctgaagggcatgtcctacgttatgtgcaccgggagcttcaagcttgagaaggaagtggccgagacccagcacggcacggtactcgtccagattaagtacgagggcaccgacgccccctgtaagatccccttctctacccaggacgagaagggggtgacccagaacggccggttgattacagcaaacccgattgttaccgacaaggagaagcccgtcaacatcgaggccgagccgccctttggggagagctacattgtcattggcgcgggcgagaaggcactgaagttatcctggttcaaaaaggggtcaagcatcggaaagatgttcgaggccaccgcccgcggtgccagacgcatggcgatactcggcgataccgcctgggactttgggtcaataggcggcgtgttcacttccgtcgggaagctagtgcaccagatattcggcaccgcctacggggtgctgttcagcggcgtgagctggaccatgaaaatcggaatcggtgtgctcctgacctggcttggcttaaatagccgatccacgagcttgagcatgacctgcatcgccgtggggctggtcacgctctacctgggggtgatggtgcaggccgacagcgggtgcgtcatcaactggaagggccgggagctgaagtgcgggtcaggcatcttcgttaccaacgaggtgcacacgtggaccgagcagtacaagttccaggcggacagcccgaaaagactcagcgccgcaatcggcaaggcctgggaggaaggggtctgcggaatacggtccgcaaccagactggaaaacatcatgtggaagcagatcagcaatgagctgaaccacatcctcctggaaaacgatatgaagctgaccgtggtggtcggggatgtggcaggcatcttggctcaggggaagaaaatgatacggccccagcccatggaatacaagtactcctggaagatctggggcaaggccaaaatcatcggggccgatgtgcaaaacaccacgtttatcatcgacgggcccaacaccccagaatgccccgacgatcagagggcttggaacatctgggaggtcgaggactacggcttcgggatctttaccaccaacatttggctaaagttacgggacagctacacccaggtgtgtgaccaccgcctcatgtccgccgccatcaaggacagcaaggccgtgcacgccgacatgggttattggatagagtccgagaagaacgagacctggaagttagcgcgggccagcttcatcgaagtaaagacctgcatttggcccaagtcccacacactgtggagcaacggcgtactcgaatccgagatgatcatccccaagatctacgggggcccgatcagccagcacaactaccgcccagggtacttcacgcaaacggccggcccctggcacctagggaagctggagctcgattttgacctgtgtgaaggcactacggttgtcgtggatgaacactgcggcaaccgcgggccttccctgcgcacgaccaccgtgacaggcaagatcatccacgaatggtgttgcaggagctgcactttaccgccgctccgcttcaagggggaggacggctgctggtacgggatggagatccggcccgtcaaagaaaaggaggagaatttagtgaagtccatggtgagcgccggaagcggcgaggtcgactctttctctctagggctgctgtgtattagtataatgatcgaggaggtgatgcgatcccgatggtcccgaaagatgctcatgaccggcaccttagccgtgttctttctgcttatcatgggccagctgacctggaacgacttaatacggctctgcatcatggtaggcgcaaacgcgtcagaccgaatggggatgggaacgacctacttggccctgatggccaccttcaagatgcgcccgatgttcgccgtgggcctccttttccgccgactgacaagtcgggaggtgcttctactgactatcgggctcagcctagtcgcgagcgtggagctgcccaatagcctcgaagagctgggcgacgggctggccatgggcatcatgatcctcaagctgctgaccgacttccagtcccaccagctctgggccacacttctgtccttgaccttcatcaggacgaccttctccctgcactacgcatggaagaccatggcaatggtcctgagcatcgtgtccctcttccccctgtgcctgtcgacaacatcccagaagaccacgtggctccctgtgctgctggggagcttgggctgcaaaccactaaccatgttcctgatcgcggagaacaaaatctggggacggaagtcctggcccctcaacgaggggatcatggccgtcggcatcgtgagcatcttgctaagctccctactgaagaacgacgttcccctcgcgggtcctctcatcgccggcggtatgctgatcgcgtgctatgtcatcagcggttcgagcgctgatctgagcttggaaaaggccgccgaggtgtcctgggaggaggaggccgagcactccggcgcgagccacaacatcctggtcgaggtccaggacgacgggaccatgaagatcaaagacgaggagcgcgatgacaccttaaccatcctccttaaggccaccctgctcgccgtgagcggcgtgtacccacttagcatccccgctacgctgttcgtatggtacttctggcagaagaagaagcagcggtccggagtgctctgggacactccctctcctcccgaggtggagagagctgtcctggacgacggcatctaccggatcatgcagaggggtctgttggggagatcccaggtgggagttggcgtctttcaggaaaacgtgttccacaccatgtggcacgtgacccggggagctgtcctcatgtaccagggaaagcggctggagcccagctgggcctccgtaaaaaaggacttaatcagctacggcggtggctggcgtttacaaggctcctggaataccggggaagaggtccaggtcatagccgtggagcctggcaagaaccctaagaatgttcagacggcccccggcactttcaaaacaagcgagggcgaggtcggcgcgatcgcgctggacttcaagcccggtacctctggtagccctatcgtaaatcgggagggcaagatcgtagggttgtacggcaacggggtcgtgacgacgagcgggacctacgtctccgcaatcgcgcaggccaaggcgagtcaagaggggcccttgccggagattgaggacgaggtctttcgcaaacgtaacctgaccatcatggaccttcaccccggctccgggaagacgcgccggtatcttcccgccatcgtgcgcgaggccatcaagaggaggctgcgcaccctgatccttgccccaacacgggttgtggcaagcgaaatggcagaggccctgaaaggcatgcccatccgctaccagaccacggctgtgaagtccgaacataccggtaaggaaatagtggatttaatgtgccacgcgacattcaccatgcgcctcctgagccccgtccgcgtccctaattacaacatgattatcatggacgaggcccatttcacagacccgtcgtctatcgctgccagggggtacatcagtacccgcgtcggcatgggggaggccgccgccatctttatgaccgcaacgccgcctggcagcgtcgaggcctttccccagtccaacgcagtgatccaggatgaggagagagatataccggagcgcagctggaactccgggtacgagtggatcacggacttcccaggcaagaccgtgtggttcgtccccagcatcaagtccggcaacgatatcgccaattgtctacggaagaacggaaagcgggtgatccaactctcacgcaagaccttcgacaccgagtaccagaagacgaagaacaatgattgggactacgtcgtcaccacagacatctccgagatgggcgctaacttccgcgcggaccgggtgatcgatccgcgccggtgtctaaagccggtgattctgaaagacgggcccgagagggtcatcttggccggccccatgcccgtaaccgtcgccagcgccgcgcagcggcgcggccggataggtcgcaatcacaacaaagagggagaccagtacatctacatggggcagcccctgaacaacgacgaggatcacgcgcactggacggaggccaagatgctgctcgataatatcaatacccccgagggcatcatccccgccctattcgaacccgagcgcgagaagtccgccgcgatcgacggggagtatcgcctgcgtggtgaggcccggaagacattcgtggaactcatgcgccgcggggacctgcctgtgtggcttagctataaggtcgccagcgagggcttccagtacagtgatagacggtggtgctttgatggggagcgcaacaatcaggttctcgaggagaacatggacgtggagatatggaccaaggagggggagcggaagaagcttcgcccacgttggctggacgcccgcacttactcagatcccctcgccctgcgggaattcaaggagttcgcggcgggccgccgctcggtcagcggggacttaatcctcgagattggcaagcttcctcagcacttgacccagcgagcccagaatgcgctcgacaacctggttatgctgcacaactccgagcagggcggccgggcgtaccgccacgccatggaggagctccccgacaccatcgagacgttgatgctgctcgcccttatcgccgtgctgacgggcggggtgactctcttcttcctgagcggccgagggctggggaagacttcaatcggcctcctgtgcgtgatggcgagctcggtgctgctctggatggcgagcgtcgagccccactggatcgccgcgtccattatcctagaattctttctgatggtgctgctgatccctgaacccgatcgtcagcggactccgcaggacaaccagcttgcctatgttgtcatcggcttattgttcatgattctgaccgttgccgcgaacgagatgggcctcctggagacgaccaagaaggacctggggatcggccacgtagccgtcgagaaccaccaccacgctgccatgttagacgtggaccttcaccccgccagcgcgtggacactgtacgctgtggccaccacgatcatcaccccgatgatgcgccacacaatcgagaacaccacggccaacataagcttgacggccatcgctaaccaggccgccatactaatggggctggataagggctggccgatctcgaagatggacatcggcgtccccctccttgccttgggatgctactcccaagtaaatcctctcacccttacagcggccgtgctgatgctcgtcgcccactacgccatcatcggccccggcttacaagcgaaggcgacgcgcgaagctcaaaagcggaccgccgccggcattatgaagaacccgaccgtggacgggatcgtcgccatcgacctggaccccgtcgtgtacgacgcgaaattcgagaagcagctcggccagatcatgttgctaatcctctgcacgtctcaaatcctattgatgcgcaccacctgggcattgtgcgagtccatcactctggccaccggccccctgacgaccctctgggagggaagccccggcaaattctggaacaccacgatcgccgtgtccatggctaacatcttccggggaagctacttggcgggtgccgggctagccttcagcttaatgaagtccctagggggtgggcgccgggggacgggcgcacagggcgaaaccttgggcgagaaatggaagcgccagctcaaccagctgagcaagtccgagttcaacacctacaagcgtagcgggatcatggaggtagaccgctccgaggcgaaagaaggcttgaagcgaggcgagaccacgaagcacgccgttagccgcggcaccgccaaactaaggtggttcgtggagcgcaacctggtaaagccggagggcaaggtgattgacctgggatgcggtcgcggcggatggtcctactactgcgccgggctgaagaaggttaccgaagtcaaggggtacaccaagggcggtccaggacacgaggaacccatacccatggccacttacgggtggaacctcgtgaaactgcacagcggcaaagatgtgttctttatccctcccgagaagtgcgacacccttctgtgcgacatcggggagtctagccccaaccccaccatcgaggagggcagaaccctgagggtcctgaagatggtagagccgtggctgcgcgggaaccagttctgcatcaaaattctgaacccctacatgccctccgtggtcgagacgctggagcagatgcaacggaaacacggcggcatgctcgtacgcaaccccctgagccgtaactccacgcacgagatgtactgggttagctgtgggacgggcaacatcgtctccgctgtaaacatgactagccgcatgttactcaacaggttcactatggctcaccggaagccaacgtacgagcgcgacgtggacctgggggccggcaccaggcacgtcgctgtggagcccgaagtggccaaccttgacatcatcggtcagagaatagagaatatcaagcacgagcacaagtccacctggcactacgacgaagacaacccctacaagacctgggcgtaccacgggagctatgaggtcaagcccagcggaagcgctagctccatggtgaacggtgtcgtgaagctccttacgaagccgtgggatgtgatccccatggtcacacagatcgccatgacggacacgacaccgtttggccaacagcgggtgtttaaggagaaggtcgacacccgcaccccaaaggccaaacgtgggactgcccagatcatggaagtcacggcgaagtggctgtggggcttcctctctcgcaacaagaagccgcggatctgcaccagagaggagtttactcgaaaagtgcgctccaacgccgccatcggcgccgtgttcgtcgacgaaaaccaatggaattccgcgaaggaggcggtggaggatgagcggttctgggacctggtgcaccgcgaacgggagcttcataaacaagggaaatgcgccacctgtgtgtacaatatgatgggcaagcgcgagaagaagctaggggagtttgggaaggccaaaggatcgcgagctatttggtacatgtggctgggcgcacgcttcttagagttcgaggcgctcggctttatgaatgaagatcactggtttagcagggagaattccttgtcaggggtggagggcgaggggctacacaaattggggtacatcctccgcgacatctccaagatacccgggggcaacatgtacgccgacgacacggcgggctgggacacccgtatcaccgaggatgacctacagaatgaggccaagatcacagacatcatggagcctgagcacgctttactagccaaatccatctttaaactgacctaccaaaacaaagtggtgcgcgtgcagcgcccggcaaaaaacgggaccgtgatggacgtaatctcccgtcgcgaccagcggggcagcggccaggttggcacctacggcctcaacacttttaccaacatggaggcccaactcatccgccagatggagtccgaggggattttttctccgtccgagctggagactccaaacctcgccggccgggtgctgaactggctggagaagcatggggtggagcgcctcaagcggatggcgatcagcggcgacgactgcgtggtgaagcccatcgacgaccgattcgccaccgccctgaccgccctgaacgacatgggtaaggtccggaaggacatcccgcagtgggaaccctcaaaaggctggaacgattggcagcaagtccccttttgtagccaccacttccaccagctaataatgaaggacggtcgcgagatcgtggtgccctgcagaaaccaggacgagctggtggggcgcgcccgtgtgagccagggcgcggggtggtctctgcgcgagacggcctgcctcggcaagtcgtatgcccagatgtggcagctgatgtattttcaccggcgtgacctgcggctcgccgcgaacgccatatgctccgctgtcccggtggactgggtgcccaccagccggaccacctggtccattcatgcccaccaccaatggatgacgacggaagacatgctgtccgtatggaaccgtgtgtggatcgaggagaacccctggatggaggacaagacccacgtgtccagctggggcgatgtcccctaccttgggaagcgagaggatcaatggtgcggctccctcatcgggttaaccgccagggcaacgtgggccaccaacattcaggtggccatcaatcaggtgcgtcgcctcctgggcaacgaaaactacctggactacatgaccagcatgaaacggttcaaaaacgagtccgacccggagggggcactgtggtga

SEQ ID NO: 24093 - RNA, 9879 nt, synthetic construct
  misc_feature 1..9879: note = derived and/or modified CDS sequence (opt11) from DENV-1__EU660412__SS-prME
  source 1..9879: mol_type = other RNA
agcgtgactatgctgctcatgttaatgcccaccgcactggcgttccaccttaccacccgcggaggggagccccatatgatcgtgagcaagcaggagcggggcaagagcctgctgttcaagaccagcgcgggggtcaacatgtgtaccttaatcgccatggacctgggcgagctctgcgaagacacgatgacctacaagtgtccgcggatcaccgaggccgagcccgacgacgtggactgctggtgcaatgccaccgacacgtgggttacctacggtacctgcagccagaccggcgagcaccgtcgcgacaagcggtccgtggccttggcgccccacgtggggctggggctcgagacgcgcaccgagacctggatgagcagcgagggtgcctggaagcaaatccagagggtcgagacgtgggccctcagacaccccgggttcacggtgatcgccctgtttctcgcgcacgctatcggcaccagcataacccagaaggggatcatcttcatcttgctgatgctggtgaccccctccatggccatgcggtgtgtaggcatcgggagccgcgacttcgtggaggggctctctggcgccacgtgggtggatgttgtgctggagcacgggagctgcgtgaccaccatggctaaggacaagccaacactggacattgaactcctgaaaacagaggtcaccaaccccgcagtgttacggaagctctgcatcgaggccaagatctccaacaccaccacggatagccggtgtcctacgcagggcgaggctaccctggtagaggaacaggacgccaacttcgtgtgcaggcgcacctttgtcgaccggggctgggggaacggctgcgggctgtttggaaaggggtccctcatcacgtgcgccaagttcaaatgcgtcactaaactggagggaaaaatcgttcaatacgaaaacctgaagtacagcgtgatcgtgaccgtccacaccggcgaccagcaccaggtggggaatgaatccacggaacacggcaccacggccaccatcacgccccaggccccgaccacggagatacagctcactgactatggagccctgaccctggactgcagcccccgcacaggtctcgactttaacgagatggtactgctgaccatgaaagaaaagtcgtggctggtacacaagcagtggttcctggacctacccctcccctggaccagcggtgctagcactagccaggagacgtggaaccggcaagacttactggtgacctttaagaccgctcacgcgaagaagcaagaggttgtggtgttgggctctcaagagggcgcgatgcacacagccctgacaggtgctacggagatccagacctccgggaccacgaccatcttcgccgggcatctgaagtgccgtttgaagatggacaagctgacgctgaagggcatgagctatgtcatgtgcaccgggtccttcaagttagagaaggaagtggcggagacgcagcacggcaccgttctggtccagatcaaatacgagggcacggatgccccatgcaagattcccttcagcactcaggacgagaagggggtgacgcagaacggcagactgatcaccgccaacccgatcgtgaccgacaaagaaaagcccgtaaacatcgaggctgagccgcccttcggggaatcctacatagtgataggagcgggcgaaaaggccctgaagctcagctggttcaagaagggctccagtatcggcaagatgttcgaggcgactgcccgcggggcccggcgcatggccattctgggcgacacggcctgggacttcggttccataggcggcgtgttcaccagcgtcgggaagctggtgcatcaaatctttggcaccgcctatggtgtcttgttctccggcgtcagctggaccatgaagatcgggatcggggtgctactgacgtggctcgggctaaattcccgctcgacttccctgtctatgacgtgtatcgccgtcgggctcgttaccctgtacctgggtgtgatggtgcaggccgactccggatgcgtcatcaactggaaaggccgggagctcaagtgcgggagcggcatcttcgtgacgaacgaggtgcacacctggaccgagcagtacaagttccaggcggacagcccgaagcggctatccgccgctatcggtaaggcttgggaggagggggtctgcggtatccggagcgccacacggctagagaatatcatgtggaagcagatctcaaacgagctcaatcacattctgctggaaaacgacatgaagctcaccgtggtggtcggggatgttgcgggcatcctggggcaaggtaagaagatgatccggccacagcccatggagtacaaatacagttggaagtcctggggtaaggcgaagatcatcggggccgatgcacaaaacacgaccttcatcatagacggccccaataccccggagtgcccagacgaccagcgcgcgtggaacatatgggaggtggaggattacgggtttggcatcttcaccacgaacatctggctgaagctccgggactcgtacacccaagtctgcgaccatcgattgatgtccgcagccatcaaagacagcaaggccgtgcatgccgacatggggtactggatcgagtccgagaagaacgagacgtggaaacttgctcgggcctctttcattgaggtgaagacatgcatctggcccaaatcccacacgctctggagcaacggggtcctggaatccgagatgattatacccaagatctacggcgggccgatctctcagcacaattaccgccccgggtatttcacccaaacggccgggccgtggcacctgggcaagctcgagctagacttcgacctgtgcgagggtaccacggtcgttgtggacgagcactgcgggaatcggggccctagcctccggactaccaccgtgacggggaagatcatccacgagtggtgctgccggagctgcacgcttccgcccctgcgcttccggggagaagacggctgctggtatggcatggagatccggcccgtcaaggagaaggaagagaacctcgtaaaatccatggtttctgccggcagtggggaggtggactctttcagcctgggcctgctctgcatctccatcatgatcgaggaggttatgcggagccgttggtcccggaagatgctgatgactggcaccttggccgtatttttcctcttgatcatgggccaattaacgtggaacgacttaatccgcctttgcataatggttggggcgaacgccagcgaccgcatgggcatgggcaccacctacttggccctcatggccaccttcaaaatgcgcccgatgttcgccgtcgggctgctgttccgccggctcacatcccgcgaagtgctgttgttgaccataggcctcagcctggtggcatccgtcgagctaccaaacagtctagaggaactgggggacggactcgcaatgggaatcatgatcctgaagctgctcacggattttcaatcccaccagctgtgggccaccttactgagcctgacgttcatcaagaccacctttagcctccattacgcctggaagaccatggcgatggtgttgagtatcgtctccctattccccctgtgcctctcgactacctcccagaagactacctggcttcccgtgttgctggggagcctgggctgcaagccgttaacgatgtttctcatagccgagaacaagatctgggggcggaagtcctggcccctgaacgagggcatcatggccgtggggatcgtcagcatcctgctgagctccctgctcaaaaacgacgtccccctcgccggccctctgatagcaggcggaatgctgatcgcatgctacgtcatcagcggctcctcagccgacttatccttagagaaggccgccgaggtcagttgggaggaggaggctgagcactctggggctagtcacaacatcctggtggaggttcaggacgacggcaccatgaagattaaggacgaggagcgcgacgacaccctcacgattctgctgaaagccaccctgctggccgtcagtggggtgtacccgctgagcatccccgccacgttattcgtgtggtacttctggcagaagaagaagcaaagatccggcgtcctgtgggacacccccagccctcccgaggtcgaacgcgccgtgctggacgacggtatctaccgaatcatgcagcgcgggctgctcggcaggtcccaggtgggggtgggcgtgttccaggagaatgtgtttcacaccatgtggcacgttacaagaggggcagttctgatgtaccaaggcaaacggctcgagccctcctgggcttccgtcaagaaagacctgatttcctacggaggtggctggcgcttgaggggttcctggaacacgggcgaggaggtccaggtgatcgctgttgagccgggaaagaaccctaagaacgtgcagaccgcacccggaacttttaagacccccgaaggcgaggtgggggccatagcgttagactttaagccaggtaccagcgggtcccccatagtcaaccgcgagggcaagatagtgggcttatacgggaacggcgtagtgaccactagcggcacctacgtgagcgcgatcgcacaagccaaggcgtcccaggagggcccgctgccggagattgaggacgaggtgttccggaagcgcaacctgacgattatggatctccaccccgggtcggggaagacccggagatatctcccggccatcgtccgggaggccattaaacgcaaactccgtaccctcatactggcccccacgagagtggtcgccagcgagatggcggaagccctgaagggcatgcccatccgctaccagacgaccgccgtcaagagcgagcacaccgggaaggagatcgtggacctcatgtgtcacgccaccttcacgatgagactgctttcgcccgtccgtgtcccgaactacaacatgatcattatggatgaggcccacttcaccgacccaagctccatagcggccagggggtacatcagcacacgagtggggatgggggaggccgccgccatcttcatgaccgcgaccccgcccgggtccgtcgaggcattcccgcagagcaacgcggtcattcaggacgaggagcgcgacatccccgagaggtcctggaacagcggctacgagtggatcaccgatttccccggcaagaccgtgtggttcgtgccctcaatcaagagcgggaacgacatcgcaaactgcctccggaagaacggaaagcgcgtaattcagctgtcccggaagacattcgacacggaataccagaaaaccaagaacaacgactgggactatgtcgtcaccactgacatcagtgagatgggcgcgaacttccgcgccgaccgggtcattgacccaagacggtgcctgaagcccgtgattctcaaggacggacccgagcgtgtgatccttgccgggcccatgccggttacggtggcctccgccgcccagcgccgcggccggatcggccgcaaccacaacaaggagggggaccagtatatatacatgggccagcccctgaataacgacgaagaccacgcccattggacagaggccaaaatgttactggacaacatcaataccccagaagggatcatccccgcgctgtttgagccggagcgcgagaagtccgccgctgtagatggcgagtaccggctccgcggggaggcccggaagaccttcgtggagctgatgcgtagaggagacctgcccgtgtggctctcctacaaggttgccagcgagggcttccagtactcagatcgccggtggtgcttcgacggcgagagaaataaccaggtgctggaggagaacatggacgtggagatctggacaaaagagggcgaacggaagaagctgagaccccggtggctcgacgcccgcacctactccgaccccctggcactgcgggagttcaaggagttcgctgcggggcgccggagcgtcagtggcgacctcattctggagattggcaagctaccgcagcacctaacccagcgagcccagaatgccctggataacttggtaatgctccataacagcgagcagggtgggcgggcttaccgccatgccatggaggagctgcccgacactattgagacgctgatgctcctcgccctgatcgccgtgctaaccgggggtgtcactcttttcttcctgtcggggcggggcttgggcaaaacgagcatcgggctgctgtgcgtgatggcctcctcggtgctgctgtggatggcgtctgtcgaacctcactggatcgccgcctctataatcctggagttctttttgatggtgcttctgatccccgagccggacagacagcgaacaccccaagacaatcaactcgcctatgtggtcatcggcttactgttcatgatcctcacggtggccgccaacgagatgggccttctggagaccaccaaaaaggacctcggcatcgggcacgtggccgtcgagaaccatcaccacgccgctatgctggacgtagacctgcatcccgcctccgcatggacattatatgccgtcgccacgaccatcatcaccccaatgatgcgccacaccatcgagaacacgaccgcgaacattagcctgaccgcgattgccaaccaggccgccatccttatgggtctcgacaagggctggccgatcagtaaaatggacatcggcgtgcccctcctggcactcggctgctatagccaggtaaaccctctgactctcactgcggccgtcctcatgcttgtcgcccactacgccatcatcgggccgggcctgcaggccaaggcgacccgcgaggcccaaaagcgcaccgccgccggtatcatgaagaaccccacggtcgacggcatcgtagccattgacctcgaccctgtcgtctacgatgcgaagtttgagaagcagttagggcagatcatgctgctcattctgtgcacgtcccagatcctgctcatgcggaccacctgggccttatgcgagagcatcaccctggccacggggcctttgaccacactttgggaaggcagcccggggaagttttggaacacaactatcgccgtgagcatggccaacatcttcagaggctcctatctggcgggcgccgggctcgccttttccctgatgaagtccttaggcgggggccggcgggggacaggcgcccagggcgagaccctcggggaaaaatggaagagacaactgaaccagctgagcaagagcgagttcaacacctacaagaggtccggtataatggaagtcgaccgctcggaggccaaggaggggctcaagcggggcgagacgaccaagcacgcagtgtcccgcggaaccgccaagctacgttggttcgtggagcgcaatcttgtcaagcccgagggtaaggtgatcgatctggggtgcggccggggcgggtggagctactattgcgccggactcaagaaagtaaccgaggtgaaagggtacaccaagggaggccccgggcacgaggagcccatccctatggccacttatggctggaacctggttaagctacactccgggaaagatgtgttctttatcccgcccgagaagtgcgacaccctcctgtgcgatatcggcgaaagcagtcccaacccgaccatcgaggagggccgaactctgcgggtcctcaagatggtggaaccctggctgcgcggcaaccaattctgcatcaagatcctgaacccctacatgccctccgtagtcgaggcgctcgaacagatgcagcggaagcacggcggcatgctggtgcgtaaccccctgtcacggaacagcacccatgagatgtactgggtatcatgcggcacagggaacatcgttagcgccgtgaacatgaccagccgcatgctcctgaataggttcaccatggcccaccggaaaccgacgtacgagcgggacgtggacctaggcaccgggacccggcatgtcgcagtagagcccgaggtggccaatctcgacatcatagggcaacggatcgagaacatcaagcacgagcacaaatccacctggcactacgacgaggacaatccttacaagacgtgggcctaccatgggagctacgaggttaaaccgagcggctccgctagcagcatggtgaacggggtcgtgaagctgctcacaaagccctgggacgtgatccccatggtgacccagatcgcaatgaccgacacgacccccttcgggcaacagcgtgtgttcaaggagaaggtggacaccaggacccccaaggccaagcggggtaccgcccaaatcatggaagtcactgcgcgctggctctggggcttcctcagccggaacaagaagcctcgcatctgcaccagggaggagttcaccaggaaggtccgcagcaacgctgccatcggtgccgtgttcgtcgacgagaaccagtggaactccgcgaaggaagcggtggaggacgagcgcttttgggacttggtgcaccgggagcgcgagttgcacaagcagggcaagtgcgctacttgcgtctacaatatgatggggaagcgggagaagaagctgggcgagttcggcaaggccaaagggtcgagagctatctggtacatgtggctaggtgcccgcttcttagagtttgaggcacttgggttcatgaacgaagaccactggttctcccgcgaaaacagcctgtccggcgtggagggggagggtttacacaaacttgggtacattctgcgggacatctctaagattcccggcggcaacatgtatgccgacgacaccgccgggtgggacacccgcatcaccgaggacgacctccaaaatgaggccaagatcactgacatcatggagccggaacacgcgctcctggccaaggccatattcaaactcacctaccagaacaaagtggtgcgcgtgcagcggccagccaaaaacggcactgtgatggatgtcatctcccggcgggaccagcgcgggagcggccaggtgggcacctacgggctaaacacgttcaccaacatggaggcccagctgatccgtcagatggagtccgagggcatcttcagcccctccgagctcgagacccccaacctggccgagcgcgctctggactggctggagaagtacggggtagaaaggctgaagcggatggcgatcagtggcgacgactgcgtcgtgaagccgatcgacgaccggtttgctaccgcccttacggcgctcaacgatatgggaaaggtccgcaaggacataccccaatgggagccctccaagggctggaacgattggcagcaggtcccgttctgctcacaccatttccaccagctgatcatgaaagacggccgcgagatcgtggtgccgtgtaggaatcaggacgagcttgtcgggcgggcacgcgtgtcccagggcgccggttggtccctccgtgagaccgcctgcctgggcaaaagctacgcgcagatgtggcagttaatgtacttccaccgccgggaccttcgattggccgccaacgccatttgctctgccgtgcccgtcgattgggtgcctaccagccgaaccacctggtccatccacgcgcatcaccagtggatgaccaccgaggacatgctgagcgtgtggaaccgcgtctggatcgaggagaacccctggatggaggacaagacccacatctctagctgggaggacgttccctacctcgggaagcgcgaggaccagtggtgtggctccttaatcggcctgacggcccgggcgacctgggccacaaatatccaggtggcgatcaaccaggtacggcggctcatcgggaacgagaactatctggactacatgattagcatgaagcgcttcaagaacgaaagtgacccagaaggcgcgctgtggtga

SEQ ID NO: 24094 - RNA, 9879 nt, synthetic construct
  misc_feature 1..9879: note = derived and/or modified CDS sequence (opt11) from DENV-1__EU660418__SS-prME
  source 1..9879: mol_type = other RNA
agcgtaacgatgctcttaatgctgatgcccaccgcactggccttccacttaactacaaggggtggcgagccccacatgatcgttagcaaacaggagaggggtaagagcttacttttcaagaccagcgccggggtgaacatgtgtacccttatcgcaatggacctaggcgagttatgcgaggataccatgacatacaagtgcccccgcatcaccgaaaccgagcccgatgacgtggattgctggtgcaatgccactgacacctgggttacctacggcacctgtagtcagacgggcgagcaccggcgtgacaagcggtccgtcgccctcgcgccccatgtgggccttgggctagaaacccggaccgaaacctggatgagctccgagggcgcctggaaacagatccagagggtggagacgtgggccctccgccaccccgggttcacagtgattgcgctgttcctggcccatgcgatcggcaccagcatcacacaaaaagggatcatctttatccttctgatgctggtgacgccctccatggctatgcggtgcgttggtatcggcagccgcgatttcgtggagggactctccggcgccacctgggtggacgtagtgctggagcacgggtcctgcgtgacaacaatggccaaggataagccgactttagatatcgaactcctaaagaccgaggtaaccaatccagccgtgttacgaaagctctgcatagaggcgaagatctccaacacgacgaccgactctcgttgcccgacccagggcgaggccaccctggtagaggaacaggacgccaactttgtctgccggaggacgtttgtagaccgcggatgggggaacgggtgtggactgttcggcaaggggtctcttatcacgtgcgcgaaattcaaatgcgtgaccaagctcgagggcaaaatcgtccagtacgagaacctgaagtatagcgtgattgtaaccgtccacaccggcgaccagcatcaggtggggaacgagtctaccgaacacggcacaaccgcaaccatcacgccacaagcccccaccaccgaaatccagttaaccgattacggggccctgacgctagattgtagcccccggaccggtctggacttcaatgagatggtcctgttgaccatgaaggagaagtcgtggctcgtgcacaagcagtggtttcttgatttgcccctaccctggacttcgggggcctccacgagtcaagagacctggaataggcaagatctgcttgtaaccttcaagaccgcccacgcgaagaaacaagaggtcgtggtcctcggtagccaggaaggcgctatgcacaccgccctgacaggggccaccgagatccagacctctggaacgacaaccatctttgcaggccacttaaaatgccgcctcaagatggataaacttaccctgaaaggtatgagctacgtaatgtgcacaggctccttcaagctcgaaaaggaagtcgcagagacccaacatgggaccgtactggtccagatcaaatatgagggtaccgatgctccctgtaaaatccccttcagtacgcaagatgagaagggcgtcacacagaacggacggcttataacggctaacccgattgtaaccgacaaggagaaacccgtcaacatcgaagccgagccgcccttcggcgagtcatatatcgtgattggcgcgggcgaaaaggcgctgaaacttagctggtttaagaagggttctagcatcggcaaaatgttcgaggccacggcccgcggggctcggcgcatggcgatcctgggtgacacggcgtgggacttcgggtccattggcggtgtgttcaccagcgttgggaagctcgtgcaccagatcttcggcaccgcgtacggggtcctcttttccggggtcagttggacgatgaagatagggatcggcgtgctgttaacctggctcggactaaactctcgcagcacttccctaagcatgacatgtatagctgtgggactcgtcacgctgtacctgggtgtgatggtgcaggcggattccgggtgtgtcatcaactggaaaggccgggagctaaagtgcgggagcggcatcttcgtgaccaatgaggtgcatacgtggacagagcagtacaagttccaggcagacagcccgaagaggttatccgcggcaatcggcaaggcatgggaggaaggcgtctgcggcatccggtccgccacccgcctggagaatataatgtggaagcagatctcaaacgagctcaaccatatcctgctggagaatgacatgaagttcacggttgtagtcggggacgtcgcgggcatcctcgcacaggggaagaaaatgatccggccacagcccatggagtataaatatagctggaaatcctgggggaaagccaagatcatcggcgccgatgtccagaacaccacctttatcatcgacgggcccaacacgcctgagtgccctgacgaccagcgggcgtggaacatctgggaggtcgaggactacggctttgggatctttacgaccaacatttggctgaaattgcgggacagttatacacaggtatgcgaccacagactcatgagcgcggcgataaaagacagcaaggccgtccatgcagacatgggatactggatcgagtctgaaaagaacgagacctggaagctggcccgggccagctttattgaagtcaagacgtgcatctggcccaagtcgcacaccctgtggtccaacggggtgttagagtccgagatgatcatcccaaaaatatatggaggtcccatcagtcagcacaattaccggcccgggtacttcacccagaccgccgggccctggcacttagggaaattggagctcgacttcgatctttgtgagggcacgaccgtggtcgtggatgagcattgcggtaataggggtccgtccctgcgcaccacgacggtcaccggcaaaataatccacgaatggtgctgccggtcctgcaccctcccacccctccgcttccgcggcgaagatggctgctggtacgggatggaaatccgccctgtcaaggagaaggaagagaaccttgtaaagtcaatggttagcgcaggaagcggagaggttgattccttcagcctcgggctcctttgtatttccatcatgatcgaggaggtcatgcggagccgctggtcgcggaagatgctcatgaccggcacactggccgtgttcttcctgttgattatgggtcagctgacctggaacgatctcatcagactctgcatcatggtcggcgccaatgcgagtgatcgcatggggatgggtaccacctacttggcgttaatggcgacgtttaagatgcggcctatgttcgcggtgggcctccttttccgacggctgacatcgcgtgaggttctcttactgaccatagggctctcactggttgcctcggttgagctgcccaacagcctggaagaactgggggacgggcttgccatgggcattatgattctgaagctgttaaccgactttcaatcccatcagctctgggccacactgctgagcctaactttcatcaagactaccttcagtctgcactacgcctggaagacaatggccatggtcctgagcattgtgagcctcttccccctgtgcctgtctacaacgagtcagaaaactacatggctccccgtgcttctaggcagcctaggctgtaagcccctgaccatgtttctgatagcagagaacaagatctggggccggcgctcttggcccctaaacgagggtatcatggccgtaggcatcgtcagcatactgttaagctccctcctaaagaacgacgtgcccctggccgggcctttgatcgcaggaggcatgcttatcgcatgctacgttatcagcggttccagcgctgatctatccttagagaaagccgccgaggtcagctgggaggaggaggcagaacactcaggcgcaagccacaacattctggtggaggtccaggacgatggcaccatgaaaatcaaggacgaagaacgggacgacaccctgaccatactcctgaaggcgacgctgcttgccgtctcgggcgtgtatccgctgagtattccggcaacattgttcgtctggcacttctggcagaagaagaagcaacgcagcggggtactctgggacacgcccagcccgcccgaggtgggccgggccgtcctggacgatggaatctaccgcatcatgcagcggggtctgctgggccgctcccaagtgggggtgggggtcttccaggagaacgtgttccatacgatgtggcacgtgactcgcggggctgtcctcatgtaccagggtaaacgcctggagcccagctgggcgtcagtcaaaaaggatctgatatcgtacggagggggttggagattgcagggttcctggaacaccggcgaggaggtgcaagtcatcgctgtggagcccgggaagaatcccaagaacgtgcagaccgcccccggaaccttcaagacacccgagggcgaggtcggagccatcgccttagacttcaaacccggcaccagcggcagccccatcgtgaacagggaggggaagattgtggggctctacggaaacggagtcgtgacaacgagcgggacctacgtgagcgcgattgcccaggccaaagcctcacaggagggtccgctgcccgagatcgaggatgaggtcttccgtaagcgcaacctaaccatcatggacctccaccccgggtcgggcaagacccggcgctaccttccggcgatcgtccgggaggccatcaagcgcaagttacgtacccttattttagcacccacacgggtggtcgcctccgagatggctgaggcgctcaaggggatgcctatccgctaccagacgacggccgttaagtctgagcataccggcaaggagatcgttgatctgatgtgccacgccacgtttacaatgcggctactgtcccccgtacgtgtgccgaattacaacatgatcatcatggatgaagcccacttcacggatccctcctccatcgcggcgagaggctacataagcacccgcgtgggtatgggagaggcagccgccatcttcatgacggctacgccgcccggatcagtcgaggcgttcccgcaaagcaacgccgtgattcaggacgaggagcgggacatccccgagcgttcctggaacagcggctatgagtggattaccgactttcctggcaagaccgtgtggttcgtcccctccatcaagtcagggaatgatatcgccaactgtctgcggaagaacggtaaacgcgtcatccaattatcccggaagaccttcgacaccgagtaccagaagaccaagaataacgactgggactacgtggtcaccacggacatctcagaaatgggggccaacttccgcgcagaccgcgtaatcgatccgcgccggtgcctgaaacctgtgatactgaaggacgggcccgagagagtcatcttggccggaccgatgccagtcaccgtggcttccgccgcacagcggcgcggaaggattggccgcaaccacaacaaggagggggaccaatacatttatatgggccagcccctcaacaacgacgaggatcacgcgcactggaccgaagccaagatgctgctcgacaatatcaatacgcccgagggcatcatccccgccctgtttgagccagagcgcgagaagtccgccgctatcgacggcgagtacagactgcgcggggaagcacgcaagacgtttgtagagcttatgagacggggtgatcttcccgtgtggctgtcctataaggtcgcgagcgaaggcttccagtactcagaccgccggtggtgcttcgatggggaaaggaataaccaggtgttagaggagaatatggacgtggaaatctggaccaaggaaggcgagagaaagaaactacgcccccggtggctcgacgcgcgaacatattccgaccccctggccctgcgggagttcaaggagtttgcggctggacgccggagcgtatcgggagacctgatcctcgagatcgggaagctaccgcagcacctgacacagcgcgcccagaacgccctcgataacctggtcatgctgcacaacagcgagcagggcgggcgggcctaccgccacgcgatggaggaactgcccgataccatcgaaaccctgatgctgctcgctttgatagccgtcctgacgggcggcgtgacccttttcttcctttcgggtcggggcctgggcaaaaccagtattggattgctatgcgtgatggccagcagcgtgctgttatggatggcctccgtggagccccactggattgcggccagcataatcctggagttcttcctgatggtacttctaatcccagagccggacaggcaacgaactccacaggacaatcaactggcatacgttgtcattggcctcctgtttatgatcctgaccgttgccgctaacgaaatgggcctccttgagaccactaagaaggatcttggcattggtcacgtcgcggtcgagaatcatcaccacgccgccatgctagacgtggatctgcaccccgcctccgcttggacactgtacgcggtagccacgaccataatcacgcctatgatgcgtcacaccatcgagaacaccaccgccaacatctcgctaaccgccatcgccaaccaggcggctattctgatgggcctggacaaaggctggccaatctccaagatggacatcggggtcccccttctggcacttgggtgctacagccaggtgaaccctctcactctaaccgccgctgtgctgatgctagtcgcccactacgctatcatcgggcctggactgcaggccaaggccacccgcgaggcacagaaaaggaccgccgcagggatcatgaagaatcccactgtcgatggcatcgttgccatcgacctggaccccgtcgtgtacgacgccaagttcgaaaaacagctgggccagataatgctgctgatcctctgtacctcccagatactcctgatgcgcacgacgtgggctctctgcgagtcaatcacgctggcaaccggccccctcaccactctgtgggagggctctccgggaaagttctggaacacgactatcgccgttagcatggctaacatattccggggcagttatctggctggcgcggggttggccttcagcctcatgaagtccctgggcggcggacggcggggaaccggggcacagggcgagaccctgggggagaagtggaagcgtcagcttaaccaactgtccaagagcgagttcaacacgtacaagcggtccggaataatggaggtagaccgctcggaggccaaggaaggtctaaagaggggcgaaaccaccaaacacgcggtgtcccgcggtacggccaaactccggtggttcgttgagcgcaacctagtgaagcccgaggggaaggtcatcgacttaggctgcggaagaggcgggtggagctattactgcgccgggctgaaaaaggtgacggaagtcaaggggtacaccaagggcggccccgggcacgaggagcccataccgatggccacatacggctggaacttggtgaaactgcactccggcaaggacgtcttcttcatcccgccggaaaagtgcgatacgctgctctgtgacattggcgagagctccccaaaccccacgattgaagaagggcgcaccctgcgggtcttgaagatggtggaaccttggttacgggggaaccagttctgtataaagatcctgaacccttatatgccctcggtggtcgagacccttgaacaaatgcagcgaaaacacggagggatgctcgttcggaacccactgtcccgaaattcgacccacgagatgtattgggtcagttgcggcacggggaacatcgtatcggccgtgaacatgacctcacgcatgttactcaaccgcttcacgatggcgcaccggaaacccacgtacgagcgcgatgtcgaccttggcgccggtacccggcacgtcgcggtggagcccgaagtggccaatttggacatcatcggtcagcgaatcgaaaatatcaaacatgaacacaagagcacgtggcactacgacgaggacaatccctataagacctgggcctaccacggctcctacgaggtcaaaccgagcgggtccgcaagcagcatggtgaacggagtcgtcaagctcctgaccaagccgtgggacgtcatccctatggtcacccaaatcgcgatgacggacacaacccccttcgggcagcagcgcgtgtttaaagagaaggtcgacactaggacgccgaaggccaaacggggcaccgcgcaaatcatggaggtcacagccaagtggctgtgggggttcctctcccgcaacaagaagccgaggatctgcactagagaggagttcactcgcaaggtgcgaagcaacgcggccatcggggccgtgtttgtcgacgagaaccaatggaactccgccaaggaagctgttgaagacgagcggttctgggacttggtacaccgcgagcgggagctgcacaagcaggggaagtgcgcgacctgcgtctacaacatgatgggaaagcgtgagaaaaagctcggcgagttcggcaaggccaaagggtcgcgggccatatggtatatgtggctgggcgcccgtttcctggagttcgaggctctcggattcatgaacgaggaccactggttctcgcgggaaaacagtctttccggtgtggagggggagggcctgcataaactcggctacatcctgcgcgacatctcaaatatcccgggaggcaacatgtacgccgacgacaccgctgggtgggacacacggatcaccgaagacgacctgcagaacgaggcccgcatcaccgacatcatggaaccggagcacgccctccttgccaagagcatctttaagctgacataccagaacaaggtcgtacgagtgcagcgtccagcaaagaacggcaccgtgatggacgtcatcagtagacgggaccagcgtggttccggccaggtcggcacgtacgggctgaacaccttcaccaacatggaggcccagctcattcgccaaatggagtccgaggggatattttcgcccagcgagcttgagacccccaatctagcggagagggttctggactggttagaaaagtacggggtcgagcggctcaaacgcatggccatttcaggcgacgactgtgtggtgaagcctatcgacgacaggttcgcaactgcccttacagccctgaacgacatggggaaggtccgcaaggatatcccccagtgggagccgtcgaagggttggaatgattggcagcaggtcccattctgctctcaccactttcaccaacttatcatgaaagacggcagagagatcgtggtaccgtgcaggaaccaggacgaactggtggggcgcgcccgtgtgagccaaggagcaggatggagccttcgcgagaccgcgtgcctcggcaagtcctacgcccaaatgtggcagctcatgtattttcaccgtcgtgacttgcggctagccgccaacgcgatctgctcggccgttcccgtggactggatccccacttccagaaccacctggagcatccacgcccaccaccagtggatgaccactgaggacatgctgtccgtgtggaaccgcgtttggattgaggaaaacccctggatggaggacaagactcacatttcctcctggggtgacgtgccgtacctcggcaagcgcgaggaccaatggtgcggctctctcatcgggttaaccgctcgggccacctgggcgactaatatacaggtggcaatcaaccaggtcaggcggctgatcggtaacgaaaactacttagattacatgacctccatgaagcgcttcaagaacgagagcgacccagaaggagccttatggtga

SEQ ID NO: 24095 - RNA, 9879 nt, synthetic construct
  misc_feature 1..9879: note = derived and/or modified CDS sequence (opt11) from DENV-1__EU677151__SS-prME
  source 1..9879: mol_type = other RNA
agcgtgaccatgctgttgatgctgatccccactgccttggcctttcacctcaccaccagaggaggggagccccacatgattgtcagcaaacaggagcgggggaaaagcctgctgttcaagaccagcgcgggcgttaacatgtgcaccctcatcgccatggacctgggcgaactgtgcgaggacacaatgacgtacaagtgcccacgtataaccgaggtcgagcctgacgatgtcgactgctggtgcaataccaccgacacgtgggtgacttacgggacatgctcacaaacgggcgagcaccggcgggataagcggagcgttgccctcgcgccccacgtcggtctggggctcgagacccgagcggaaacctggatgagcagcgagggggcgtggaagcagatccaaaaggttgagacctgggctttgcggcatccaggatttacggtgatcgcccttttcctggcccacgccatagggactagcattacccagaaggggatcatattcattctccttatgctggtcaccccttccatggcgatgcggtgcgttggcatcggcagtcgggacttcgtggaggggctgtctggcgccacgtgggtcgacgtggtgctggagcacgggagctgcgtcacgacgatggccaaggataagcccaccctggacatagagctcctaaagacagaggtaaccaacccagcagtgctgcggaagctctgcatcgaggcgaagatatccaacaccaccacggattcacgatgccccacccagggcgaggccactctggtcgaggagcaggacgcgaatttcgtttgcaggcggacctttgtggataggggctgggggaacggttgcgggctgttcggaaaggggtccctcatcacgtgcgctaagttcaagtgcgtcaccaagttagagggcaagatcgtgcagtacgaaaacctgaagtacagcgtgatcgtcaccgtccataccggggaccagcaccaggtagggaacgagtccactgaacacggcaccaccgcaaccataacaccccaggcgcccactagcgaaatccaactcaccgactacggcgccctgaccctggactgctcaccgcggaccggcctcgactttaacgagatggttctgctgacaatgaaggaaaagtcctggctcgtccacaaacagtggtttttagacctgccactcccatggacctcgggagcctccacctcacaggagacctggaaccgccaggacctgctggtcacgttcaagaccgcccacgccaagaagcaagaggtggtggtcctcggttcccaggagggcgcgatgcacacggccctaaccggggccacagaaatacagacctctgggaccaccacgatctttgccgggcacctgaagtgccggctcaagatggacaagctgaccctgaagggcatgagttacgtgatgtgcactggttcctttaaacttgagaaggaagtggccgagacccagcacggcacagtcctggtgcagatcaagtacgagggcactgacgcgccctgcaagatcccattcagcacgcaagacgagaagggggtgacccagaacggtcgactgataacggcaaatccgatagtcactgacaaggagaagcccgtgaatatcgaggccgagccgccctttggcgagagctacatcgtgatcggtgccggcgaaaaggccttaaaactcagctggttcaaaaaggggtcatcaatcggtaagatgttcgaagccacagcccgcggggcccgccggatggccatcctgggcgacacagcgtgggacttcgggtcaataggtggcgtcttcacaagcgtgggtaagctggtgcatcagatcttcgggacggcttatggggtactcttctccggcgtctcctggactatgaagatcgggattggcgtgctgctgacctggctcggcctgaacagtcgctctacgagcttgtccatgacctgcatcgctgtgggcctcgtcacgctatatctgggcgtgatggtccaggcagacagcggatgcgttatcaactggaagggcagggagctaaagtgtgggagcggcatcttcgtgacgaatgaggttcatacgtggaccgaacagtacaagtttcaggccgattccccgaagagactgagcgcggccatcggcaaggcctgggaagaaggggtatgcggcatccgctccgccacaaggctggagaacattatgtggcgccagatcagcaacgagctcaatcacatactcctggagaacgacatgaagttcaccgtagtcgtgggggacgtcgtcggtatcctcgcacagggtaagaagatgatacgaccccagccgatggagcataagtattcttggaagtcctggggcaaagcgaagataatcggcgcagacgtacagaataccacctttatcatagacggacccaatacccccgagtgtcccgacgaccagcgcgcatggaatatatgggaagtggaagactacggcttcgggatcttcacaaccaacatatggctgaaactccgggacagctacacacaggtctgtgatcaccgcctcatgagtgccgcgataaaggacagcaaggccgttcacgcagatatgggctattggatcgagagcgaaaagaacgaaacctggaagctcgcccgggcttccttcatcgaggtgaagacctgcatctggcccaagagccacaccttgtggtctaacggcgttctcgagtctgagatgatcattccgaaaatatatgggggcccaatctcccaacacaactaccgccctgggtacttcacacagacagcgggcccctggcacctcgggaagctagagttggacttcgacctgtgtgagggcaccaccgttgtggtggacgaacattgcggcaacagaggtgccagcctgagaaccaccaccgtgaccggtaagatcatccacgagtggtgctgccgtagctgcacgctcccgccactaaggtttaagggggaggacggctgttggtacgggatggagatccggcccgttaaggaaaaggaggagaaccttgtcaagagcatggtgagcgcaggctccggagaagtggatagcttctccctcgggctattatgcatctcgattatgatcgaggaggtaatgcgatcgcggtggagccgaaaaatgctcatgaccggcacactggccgtgttcttcctgttgatcatggggcagctgacctggaacgacctgatccggtcctgcatcatggtgggtgccaacgcgtccgatcgcatggggatggggactacctatctcgccctgatggccaccttcaagatgcgcccaatggttgctgtgggcctgctgttccggaggctaacgtctcgggaggttctgctgctgacgatagggctttcgctcgtggcctcagtggagctgcctaacagcctggaggaactgggcgacgggctggccatgggcataatgatcctcaaacttctcactgacttccaatcctatcaactatgggctaccctcctgagtctaactttcatcaagacgaccttctcccttcactacgcctggaagaccatggctatggtgctgagcatcgtgtcactgctccccctgtgtctaagcaccacgtcccagaagaccacctggctgccagtcttgctgggatctcttggctgcaagcctctgaccatgtttctgatcgcggagaacaaaatctggggccgcaagagctggcctctcaacgaagggatcatggccgtcggcatcgtgtccatcttactgagctccctcttaaagaatgacgtgcccctggccgggcccttaatcgccggcggcatgctcatcgcatgctacgtcatcagcgggtccagcgcagacttatccctcgagaaggccgccgaggtgagctgggaggaagaagcagagcactctggcgcctcgcacaacatcctagtggaggtccaggacgacgggacgatgaagattaaggacgaggagcgtgacgacaccctgactattctgctaaaagcgaccctgcttgctgtgtccggcgtgtatcccctgagcatcccggccaccctgttcgtctggtacttttggcaaaagaagaagcagcgctccggggtgctctgggacacgccctcaccgcctgaggtagaacgggcggtcctggacgacggcatctaccgcatcatgcagagaggcctgttaggccgctcccaggtgggcgtgggcgtttttcaagagaacgtgtttcacaccatgtggcatgtgacccggggcgccgtactcatgtaccagggaaagcgtctggagccgagctgggcttccgtgaagaaagacctaatcagttatggcggcggctggcggctccagggctcatggaacactggggaggaagtgcaagtcatagccgtggagcctggcaagaaccccaagaacgtgcagaccgcccctgggaccttcaagacgcctgagggcgaggtcggtgccatcgccctggacttcaaacccgggacctccggcagccctatcgtgaacagagagggcaaaatcgtaggcctctacggcaacggcgttgtgactacctccggcacgtatgttagcgctatcgcccaagcgaaggccagtcaggaggggcccctcccggagattgaagacgaggtcttccggaagcgcaaccttaccatcatggacctccacccaggaagcgggaagacgcggcgttacctgcccgcgatcgttcgggaggcaatcaagcgcaaacttcggaccctgatcctcgccccgacccgcgtggtcgcgtccgagatggctgaagcgctgaaggggatgcccatccgatatcagactacggccgtcaaatcagagcacacgggcagagagatcgtggatttgatgtgtcacgccaccttcaccatgagactgttatcccccgtacgggtacccaactacaacatgataattatggatgaggctcacttcacagacccgagcagtatcgccgctcgcgggtacatcagcacccgggtaggcatgggggaggccgcagccatattcatgaccgctacgccacccgggtcagtcgaggcgttcccacagagcaatgccgtgatccaggatgaggaacgcgacatccccgaacggtcctggaacagcgggtacgagtggatcaccgacttccctggcaagaccgtgtggttcgtcccctcaatcaagagcggcaacgacatcgccaactgcctccgcaagaacgggaagcgggttatccaattatcccgcaaaacgtttgacaccgaataccagaagacaaagaacaacgactgggactacgtcgtgaccacagacatcagcgagatgggcgccaacttccgggcggaccgcgtgatcgaccccagacgctgcctgaagccggtgatcctgaaggacggccccgagcgggtgatcctcgccggacccatgcccgtgactgtagcctccgcggcccaacggcggggacggattggacggaaccacaataaagagggtgaccagtacatctacatgggccagccactgaataacgacgaggaccacgcccattggacggaggccaagatgctactcgacaacatcaatacccccgagggcatcataccggccctgtttgagcccgagcgcgagaaatccgccgctatcgacggggaataccggctgaggggcgaggcgcgcaagaccttcgtcgagctgatgcggcgcggggacctgccggtttggctgtcttacaaggtcgcttcagagggattccaatacagcgacaggcggtggtgcttcgatggcgagcggaataaccaggtgctcgaggagaacatggacgtggaaatctggacgaaggagggggagcgcaagaagctacgaccacgctggctggacgcccggacgtattccgaccccttagcactgcgcgagtttaaggagttcgccgcgggccgccgctccgtctccggagacctcatcctcgagatcgggaaactcccccagcacctgacccagcgggcgcaaaacgccctcgacaacctggtcatgctgcacaatagcgagcagggcgggcgcgcctaccggcacgccatggaggagctcccagacaccatcgagaccttgatgctgctcgccctgatcgcagtgctgaccggcggggtcactctcttctttttatcgggccgcgggctgggcaagaccagcatcggcctcttgtgcgtaatggcttccagcgccttgttgtggatggcgtcagtggaacctcactggattgccgccagcatcatcctagagttcttcctcatggtacttctgatccccgagcccgacagacagcgcaccccgcaggataatcaactggcctacgtggtcattgggctcctgttcatgatcctgaccgtcgccgcaaacgagatgggcctcctggagaccaccaagaaggacctcggtattggccacgtggccgtggagaaccaccaccacgccaccatgctcgacgttgaccttcaccccgcgtccgcctggactctgtatgcggtggccacaaccatcatcactcccatgatgcggcacacgatcgagaatactaccgccaacatcagtctcaccgccatcgccaaccaggcggccatactcatggggctggacaagggctggccgatctccaagatggacatcggcgtccccctcctggccctaggatgctacagccaggtcaaccccctcactctgacggcggccgttctcatgctagtggcccactacgcgattataggccccgggttgcaggcgaaggccacccgcgaagctcagaaacgcaccgcggccggcattatgaagaacccaaccgttgatggtatcgtggccatcgacctggatccggtggtctacgacgccaagttcgagaagcagctcggccagatcatgctgctgattctctgtacgtcgcagatccttctgatgcgaactacctgggcactctgtgagagcatcaccctggccactggaccactgacgaccttgtgggaggggagccccggcaagttctggaacaccacgatagccgttagcatggccaatatcttccgcgggtcctacttggccggcgccggactggcattctccctcatgaagtccctcggaggcgggcggcgtgggactggtgctcaaggagagaccctgggcgagaagtggaagcggcagctcaatcaactctccaaatcggagttcaacacatataaaaggtccggaattatggaggtggaccggagcgaggccaaggagggtctgcgccgcggggagacgaccaagcacgcggtctctcgcggcaccgccaagctccgttggttcgtggaacggaacctggttaagccggaaggcaaagtgattgatctgggctgcggacgtggcggttggagctactactgcgccgggctgaagaaggtgactgaagtcaagggttacacgaagggcgggcccggccatgaggagccaatccccatggcaacgtacgggtggaacctcgttaaactgcactccggcaaggatgtgttctttatcccgcccgagaagtgcgataccctgctctgcgacatcggggagagctcccccaaccccacgatcgaggagggacgcacgcttagagtactgaagatggtcgaaccgtggctccgggggaaccagttctgcataaagatcctgaacccatacatgccgagcgttgtcgagactctggagcagatgcagcggaagcacggcggcatgctcgtccgcaacccgctctcgcggaactcaacccacgaaatgtactgggtaagctgcgggacgggcaacatcgtgagcgccgtcaacatgacatcccgcatgctgctcaacaggtttacgatggcgcaccggaagccgacgtacgagcgcgatgtagatctgggggcgggtacccggcacgtggcggtggagccggaggttgccaacctggacatcatcggccagcgcatcgaaaatatcaagcatgagcataagagcacgtggcactacgacgaggacaacccctataagacatgggcgtaccacgggtcgtacgaggtcaaacccagcggctctgcgtccagcatggtcaacggcgtcgtgaaacttctgaccaaaccgtgggacgtaatcccaatggtgacccagatcgcaatgaccgacacaactccctttggacagcagcgtgtcttcaaggagaaggtggacacgcgcacacccaaagccaaacgggggaccgcacagatcatggaggttacggcccgttggctgtggggcttcctttctcggaacaaaaagcctcgtatctgtactcgagaggagttcaccaggaaggttcggagcaacgcagccattggagcagtgttcgtggatgagaaccagtggaactccgccaaggaggccgtcgaggacgagcgcttctgggacctggtacatcgggagcgcgagttgcacaagcagggaaagtgcgccacgtgcgtctacaacatgatgggcaagcgggagaagaagttaggcgagttcggcaaggccaagggcagccgcgccatctggtacatgtggctgggcgcacggttcctggagttcgaggcgctgggcttcatgaacgaggatcactggttctcgcgggagaacagcctaagtggtgtcgagggggagggccttcacaagctgggctacatcctgcgtgacatcagcaaaattcctgggggtaatatgtatgccgacgacacagccggctgggacaccaggatcacggaggatgacctgcagaacgaggccaagatcacggacatcatggagcccgaacacgcgctcctggcgacatccatcttcaagttaacctaccagaataaagtggtccgcgttcagcggccggcccgcaacgggacggtaatggacgtgatcagccggcgcgatcagcggggctccgggcaggtcggcacatacggcctaaacaccttcaccaacatggaggcccagctcatacgccagatggagagcgaggggatattcagccccagcgagctggagacccctaacttagccgagcgggtcttagactggttagagaagcacggcgttgagcgcctcaagcggatggccatctccggggacgattgcgtcgtaaagcccattgacgaccgcttcgcaacggccctgagcgccctgaacgacatggggaaggtacggaaagacattccccaatgggagcccagcaagggttggaacgattggcaacaggtccccttctgttcccatcacttccaccagctcatcatgaaggacggcagagagatcgttgtgccctgccggaaccaggacgagctcgtcgggagagcgcgggtgagccagggagccggctggtccttgcgtgagaccgcgtgcctcggtaagtcgtacgcccagatgtggcaattaatgtacttccaccgacgcgatctgcggctcgcggccaacgcaatctgttctgcggtacctgtggactgggtgccgacttcgaggaccacttggagcatccacgcgcaccaccaatggatgaccaccgaggatatgttgtcagtgtggaaccgggtctggatcgaagaaaatccctggatggaagacaagacccacataagcagctggggcgacgtcccctacctggggaaacgagaggatcagtggtgcggctccctcatcggcctgacggcccgcgccacatgggcgaccaacatccaggtggccatcaaccaggtccgcagattgataggcaacgagaactatctcgactacatgacgagcatgaagcggtttaagaacgagtccgacccggagggcgccctgtggtaa

SEQ ID NO: 24096 - RNA, 9879 nt, synthetic construct
  misc_feature 1..9879: note = derived and/or modified CDS sequence (opt11) from DENV-1__EU677152__SS-prME
  source 1..9879: mol_type = other RNA
agcgtgacgatgctgctcatgctcatgccaacggccctggccttccacctcacgacccggggcggggaaccccacatgatcgtctctaagcaggagcggggtaagagcctgttattcaagaccagcgcgggggtgaacatgtgtaccctcatagccatggatctgggcgagttctgtgaggacactatgacttataagtgccccaggatcaccgaggccgaacccgacgacgtggactgttggtgcaatgccactgacacgtgggtgacttacgggacatgctctcagaccggcgagcaccggagggacaaacgctccgtagccctggcgccgcacgtgggcctaggcctggagacgcgcaccgaaacatggatgtcgtccgagggggcatggaaacagatacagcgggttgagacgtgggctctacgccaccccggattcactgtgatcgcactcttcctggcccatgcaatcggcaccagcatcacccagaaggggataatattcatcttgctcatgttagtgacccccagtatggccatgagatgcgtcggcatcggctcccgcgacttcgtggaggggctgtccggtgccacgtgggtggacgtcgtgttggagcacgggagctgcgtgaccacaatggccaaagacaagccgacactggacatcgagctccttaagactgaggttaccaatccagcggtgctccggaaactgtgcatcgaagcgaaaatctccaacaccaccacggacagccgctgcccgacacagggcgaggccaccctcgtggaggagcaggacgccaacttcgtctgccggcgcaccttcgtggaccgggggtgggggaacggctgtggcctgttcggaaaagggtccctgatcacttgcgcaaagttcaagtgtgtgaccaaactcgagggcaagacggtccagtacgagaacctgaaatacagcgtgatagtcactgttcacacgggcgaccagcaccaggtgggcaacgagtccacagagcacggcaccaccgcgaccatcacaccccaggccccaagcaccgagatccagctgaccgactacggagcccttaccctcgattgtagcccccgtacgggactggacttcaacgagatggtactgctgaccatgaaggagaagtcctggctcgtgcataagcagtggttcctcgacctgccgctgccctggaccagcggggcctccaccagccaggagacgtggaaccggaaggacctcctggtgaccttcaagactgcccacgcgaagaagcaggaagttgtggtgctcggctcccaggagggcgccatgcacaccgccctcaccggggctacagagatccaaaccagcggcaccacaaccatattcgccgggcatctgaagtgtaggcttaagatggataagctcacactcaagggcatgtcctacgtcatgtgcaccggatcattcaagctggagaaagaggttgcggagacccagcatggcacagtgctcgtccagatcaagtacgaggggacggacgcgccctgcaagatccccttttcgactcaggacgagaagggcgttacgcagaacggtcggctgatcaccgccaacccgattgtcaccgacaaggagaagcctgttaacattgaggccgagccaccctttggggagagctacattgtgatcggcgcgggtgaaaaggccctgaagctgagctggttcaaaaaggggtcttcaatcggcaaaatgttcgaggcgacggcacgcggggcacggcgcatggcgatactcggcgatacggcttgggacttcgggagcattggcggcgtgttcacgtccgtcgggaaacttgtccaccagattttcggcaccgcttacggggtgttgttcagcggcgtctcatggaccatgaagatcgggataggcgtcctcttaacgtggctgggattgaatagccgctccaccagcctgtccatgacctgcatagccgtggggctggtaaccctctacctgggcgtgatggtgcaggccgacagcgggtgcgtcatcaactggaagggccgggagctgaagtgcgggtcaggcatctttgtgactaacgaagtgcacacttggaccgaacagtacaagttccaggcggattcccccaagcgcctgtctgctgccatcggcaaggcttgggaagagggcgtttgcggcatacgctccgcaacccgcctggagaacatcatgtggaagcaaataagcaacgagctaaaccacatcctactcgagaacgatatgaagttcacggtggtggtcggggacgtggcgggcatcctcgcccaagggaagaagatgatacggccccaacctatggagtacaagtactcctggaagagttggggtaaggcgaagatcataggcgccgacgtacagaacacaacattcattattgacgggccgaacacaccggagtgccccgacgatcaacgcgcgtggaatatctgggaggtcgaggactacggcttcggaatctttaccacgaacatttggctcaagctgcgggactcctacacccaggtgtgcgatcaccgcctgatgtctgccgcaatcaaagactccaaggccgttcacgccgacatgggctactggatcgagagcgagaagaacgaaacatggaaactcgcgcgggcctccttcatcgaagtcaagacctgcatttggcccaagagccacacgctgtggagcaatggcgtgctggaaagcgagatgatcatccccaagatctacggaggcccgatctcccagcacaattaccgccccgggtacttcacccaaaccgccggcccctggcacttagggaagctggagctggacttcgacctctgtgagggcaccacggtggtcgtggacgagcactgtggcaacagggggccgtccctgcgaacgaccaccgttacgggtaaaataatacacgagtggtgctgccgctcatgcaccctgccgcccctgcgcttcaagggggaggacggctgttggtacgggatggagatccggcccgtcaaggagaaggaggaaaacctggtcaaaagcatggtgtcggccggctccggcgaagttgacagcttttccctgggcctactgtgcatcagtatcatgattgaggaggtgatgagatccaggtggtcccgcaagatgctgatgacaggcaccctcgctgtgttcttcctactgattatgggccagctcacgtggaatgacctgatccgtttatgcattatggtaggagcgaacgctagtgaccgcatggggatgggaaccacatacctcgcactgatggccaccttcaagatgcgcccgatgttcgccgtagggctcctcttccggcgcctgacgagcagggaggtgctcctcctgacgatcggtctatccctcgtcgcgagcgttgagctgcccaactccctggaggagctcggcgacggcctggccatgggaatcatgatcttgaagctactaaccgacttccagagccaccagctgtgggccaccctcctgtcactgacgttcatcaagacgaccttcagcctccactacgcctggaagaccatggcgatggttctgtccatagtgagcttattccctctttgcctgtcgacgacaagtcagaagaccacatggctgcccgtgctcctgggttccctggggtgcaagccgctcacgatgttcctgattgcggagaacaagatctggggccgcaagtcctggcctctgaacgaggggataatggccgtcggcatcgtcagcatcctcctgtccagtttgctcaagaacgacgtgcccctagccgggcctctgatagccggcggcatgctgatcgcgtgttacgtcatctccggaagttccgccgacctgagcttggagaaggccgccgaggtgtcatgggaggaggaagctgagcacagcggggcctcccacaacatcctggtcgaagtccaggatgatgggaccatgaaaatcaaggacgaagaacgggacgacaccctgaccatcctgctcaaggccaccctgctcgccgtgagcggagtgtacccgctctcaattcccgccacgctgttcgtctggtacttctggcagaagaagaagcagaggtccggcgtcctgtgggacaccccaagccctcccgaggtggagcgggccgtcctggacgatggcatctatcgtataatgcagcggggcctgctggggcgcagccaggtgggggtgggtgtctttcaggagaacgtgtttcataccatgtggcacgtgacccggggcgcggtcctgatgtaccagggcaagcgcctcgagccctcctgggccagcgtgaagaaggacctgatcagttatggcggcgggtggagactgcagggcagctggaacacgggggaggaggtacaggtcatcgctgtggagccagggaaaaaccccaagaacgtgcaaaccgcccccgggacttttaaaacttccgagggtgaggtcggcgccatagcactcgacttcaagccggggacgagcggtagcccgatcgtgaatcgcgaggggaagatcgtgggcctatacggaaatggggtcgtgaccacctccggcacatatgtaagcgctatagcccaggccaaggccagccaggaggggcccttacccgagatcgaggacgaggtctttagaaagcgcaacctcaccatcatggacctgcatcccggaagcggaaagacgcggcgctacctgcccgctatcgtgcgggaggcgatcaagcgcaagctccggacactgatcctggcccccaccagagtggtagcctccgagatggcggaggccctcaaaggcatgcccatccgatatcaaacgaccgcggtcaagagtgaacataccggcaaggagatcgtagatctgatgtgccatgccaccttcaccatgcgactgctctccccagtccgcgtgcccaactacaacatgatcatcatggatgaggcccacttcacggacccgtcatccatcgcggcccgggggtacattagcacacgcgtaggcatgggggaggccgcagccatcttcatgaccgcaacgccgcccggcagcgtcgaggccttcccccagagcaacgccgttatccaggatgaggagagagacattccggagcgttcctggaacagcggatacgagtggatcaccgacttccctggcaaaaccgtgtggttcgtcccctccatcaagagcggcaatgacatcgccaattgcctgcggaagaacgggaagcgcgtgatccagctgtcccggaagaccttcgacaccgagtaccagaagaccaagaacaacgactgggactatgtggttaccaccgacatttcggagatgggcgcgaacttccgcgctgaccgggttatcgaccccagaaggtgcctaaagccagtaatcctgaaggacgggcccgaacgcgtaatcctagccggccccatgcccgtgacggtagcctccgccgcgcagcggcgcgggcggatcggccgcaaccacaacaaggagggcgaccagtacatatacatgggccagccgttgaacaatgacgaggaccacgcacactggacggaggccaagatgctgctggacaatattaacacccctgaaggcatcatacccgcactcttcgagcccgaacgggagaagtcggcggcgatcgacggggaatatcgcctgcgcggcgaggcccgcaagacgttcgttgaacttatgcgccgcggggacctcccggtgtggctgagctataaggtcgcctccgagggctttcagtacagcgaccgccggtggtgtttcgacggagagcggaataaccaagtgctggaggaaaacatggacgtggagatctggactaaggaaggcgagcggaagaagctccgcccgcgttggctagacgcacgcacctactccgacccccttgcactccgggagttcaaggagttcgcagctgggcgccggtcagttagcggggacctaatcctggagattggcaagctcccccagcacctgacccaaagggcccaaaacgccctggacaacctcgtaatgctgcacaactctgagcaagggggtcgtgcgtaccgccacgccatggaggagctgcccgataccatcgagacgttaatgctgctggccctcattgccgtgctaaccggcggggtcaccctgttcttcctatccggcagagggcttggtaaaacgagcatcggactgctctgcgtaatggcctccagcgtactgctgtggatggcgagtgtcgagccccactggatagccgccagcatcatcctcgagttcttcttaatggttctgctcattcccgagccagatcgccaaaggaccccgcaggacaaccagctggcttacgtggtcatcgggctcctcttcatgattctgacggtggccgcgaacgagatgggcttgctcgagaccacaaagaaagatctggggatcggccatgccgccgtagagaaccaccaccacgccgctatgctggacgtcgatctccaccctgcgtccgcctggaccctgtacgcagtggccacgaccatcataacgcccatgatgcgccacaccatcgagaacacgacggccaacatcagcctgaccgctatcgccaaccaggcggcaatcctcatgggcctggacaagggctggcctatctccaagatggacatcggggttcccctgctagcgctagggtgctacagccaggtcaaccccctaacgctcacggccgccgttctgatgctggtcgctcactacgccatcatcggacccggcctccaggcgaaagcaacccgggaggcccagaagcgcaccgccgccggcatcatgaagaaccctacggtcgatgggatcgtggctatcgatctggaccccgtagtatacgatgccaaattcgagaagcagctgggccaaattatgctcctgattctatgcacatcccagatccttctgatgcgcactacctgggccctctgcgagagcatcactctcgcgacaggcccgctgaccaccctgtgggaggggtcccccggcaaattctggaacaccacgatcgccgtgagcatggcgaacatcttccgggggagctacctcgccggcgcgggcctggccttttccctgatgaagtcgctcggaggagggagacggggcacgggggcgcaaggcgagaccctgggcgaaaaatggaagcgacagctgaaccagctctccaagtccgagttcaacacctacaaaagatccgggatcatggaggttgaccgcagcgaagccaaggaaggtctgaagcgcggggagacgaccaagcatgcagtctcccgcggcaccgccaaactgagatggttcgtcgagcgaaacctcgtaaagccggaggggaaggtcatcgatctgggctgcggccgcggcgggtggagctactactgcgcagggctgaagaaagtcactgaggtgaaggggtacacgaagggcgggcccggtcatgaggagccaatacccatggcgacctacgggtggaaccttgttaagctgcactccggcaaggacgtgttcttcatcccgcccgagaagtgtgacaccctgctttgcgacatcggggagtctagtcccaaccccaccatcgaggagggccgcactctccgtgtgctgaaaatggtcgagccgtggctgcgggggaatcagttctgcatcaagatcctcaacccatacatgccaagcgtggtagagacccttgagcagatgcagcggaaacacggcggcatgctcgtgcgcaaccccctctccaggaactcgacccacgagatgtactgggtgtcctgcgggacaggcaacatcgtcagcgccgtcaatatgacctcccgtatgctgctcaaccggtttacaatggcccaccgcaagcccacctacgagcgcgacgtggatctcggggccgggacccggcatgtcgccgtcgagcctgaggtggcgaacctggacatcatcggtcaacgcatcgagaatatcaagcacgaacacaagtctacctggcactacgacgaggataacccctacaaaacatgggcctatcacgggtcatacgaggtgaagcccagcggcagcgcgtccagcatggtcaacggggtggtcaagctgctcaccaagccgtgggacgtgataccaatggtcacgcagatcgccatgaccgatacgacccccttcggccagcagcgggtctttaaggagaaggtagacacgcgcacgcccaaagccaagcggggcacggcgcaaattatggaggtgacggctaagtggctgtggggcttcctgtcccggaacaagaagccacggatttgcacccgcgaagagttcacccggaaggtccgcagcaacgccgccatcggcgcggtcttcgtggatgagaaccagtggaacagtgccaaggaagccgtcgaagacgagagattttgggacctcgttcaccgcgagcgggagctgcacaagcaggggaagtgcgccacgtgcgtgtacaacatgatgggcaagcgcgagaagaagttaggggagttcggcaaggccaaaggcagcagggcgatctggtatatgtggttgggcgcccgcttcctagagttcgaggccctaggctttatgaatgaggaccattggttctcccgggaaaacagcctttccggggtcgagggcgagggtttacacaagctgggctacatcctccgcgacatcagcaagatcccaggtggcaacatgtacgccgatgacaccgccggatgggacacacggatcaccgaagacgacttacagaacgaggcgaagatcacggatattatggagcccgagcacgccctgctcgccaagtccatattcaaactgacgtaccagaacaaggtggtgcgcgtccagcggccggccaagaacggtaccgtgatggacgtgatcagcaggcgcgatcagcgcggcagcggacaggtcggtacctacggcttgaacacgtttaccaacatggaggctcagctaatccgtcaaatggagtcggaggggatcttctcccccagcgagctggagacgcccaacttggccggccgggttctcgactggctggagaagcacggggtggagcgcctgaagcggatggccatatctggcgacgactgcgtcgtgaaacctatcgacgacaggttcgcaactgcgctcacagccttgaacgatatggggaaggtgcggaaggacatcccgcagtgggaaccctcaaagggctggaacgactggcaacaagtccctttctgcagccaccactttcaccaactgataatgaaggacggccgggagatcgtggtaccctgccggaaccaggacgagttggtcgggagagcgagggtgtctcagggcgccgggtggtctctgcgagagaccgcctgcctgggcaagtcgtacgcccagatgtggcagctcatgtacttccaccgccgcgatctccggctggcggccaacgccatctgcagcgccgtgccggtcgactgggtacccacatcccgcaccacatggagcatccacgcccatcaccaatggatgaccaccgaggatatgctttctgtgtggaaccgggtttggatcgaggagaacccctggatggaggacaagacccacatctcgtcctggggagacgtgccctatctgggtaaacgggaggaccagtggtgcggaagtctgatcgggctcacagctcgagcaacctgggccaccaacatccaagtagccatcaaccaggtcaggcgcctgatcggcaacgaaaattatctagactacatgaccagcatgaagcgcttcaaaaacgagagcgacccagagggagccctctggtag

SEQ ID NO: 24097 - RNA, 9879 nt, synthetic construct
  misc_feature 1..9879: note = derived and/or modified CDS sequence (opt11) from DENV-1__EU677155__SS-prME
  source 1..9879: mol_type = other RNA
tcagtgaccatgctgctcatgttgatgcctacagcattagcctttcacctcactacccgtggcggcgagccccacatgatcgtgagcaagcaggaacggggcaagagcctgctgttcaagaccagcgctggggtgaatatgtgcaccctcatagctatggacttgggcgagctgtgcgaggacacaatgacctacaagtgcccacgaattaccgagaccgagcccgacgacgtggactgctggtgcaacgccaccgacacatgggtgacctacgggacctgcagccaaaccggcgagcacagacgggacaagcggtcggtggccctagccccgcacgtagggctagggttagagacccgcaccgagacctggatgagctcagagggcgcctggaagcaaatccagcgggtcgaaacgtgggccttacggcaccccgggttcaccgtgatcgccttgttcttagcccacgcgatcggtaccagcattactcagaaggggatcatatttatcttgctcatgctggtgacgccctccatggccatgcggtgcgtcgggatcggctccagagactttgtagaagggctctccggggctacctgggtagacgtcgtgctggaacacgggagctgcgttaccacaatggcgaaagacaaaccgactctggacatcgagctcctgaagaccgaggtcaccaaccccgccgtgctcagaaagctctgcatcgaggctaagatctccaataccaccaccgattctcgctgtccgacccagggcgaggccaccctcgttgaggagcaggacgccaactttgtttgccgacgcacgtttgtggatagaggctggggcaacgggtgcgggctgttcggcaagggttccctcatcacatgcgccaaattcaagtgcgtgacgaaactggagggcaagatagtccagtacgagaacctgaagtacagcgtgatcgtcacagtccacacgggagaccagcaccaggtgggcaatgaatccactgagcacggcaccaccgccacaatcacgccgcaggcgcctaccacagagatccagctcaccgactacggagccctgacgctggactgcagtccccgcacgggcttagacttcaacgagatggttctgctgaccatgaaggaaaagtcctggctcgtgcacaagcaatggttcttggacctgcccctaccctggacctctggcgcaagcacgtcccaggagacctggaaccgccaagacctgctggtgaccttcaagaccgcacacgctaagaaacaagaggtggtggtgctcgggagccaggagggcgcgatgcacacggccctgaccggggccactgaaatccagacgtccggcacgaccacgatcttcgccggccacctgaaatgccgcttgaagatggacaagctgaccctgaaaggcatgagttacgttatgtgcacggggagcttcaagctcgagaaagaggtggccgagacccagcacggcacagtgctggtccagatcaaatacgaaggcaccgatgcgccctgcaagatccccttcagcactcaagacgagaagggggttacccagaacggtcgccttatcaccgccaatcccatcgtgacagacaaggagaaacctgtcaacatcgaggccgagcctcccttcggggagtcctacatcgtgatcggcgccggcgagaaggcgctcaagttaagctggttcaaaaagggttcctctatcggtaaaatgttcgaggccacggcccgcggggcccggcgcatggcaatcctgggcgacactgcgtgggactttgggtctataggcggcgtgttcaccagcgtcggtaagctggttcatcagatcttcggcaccgcctacggggtcttgttctccggcgtcagctggactatgaaaatcgggatcggcgtcctgctgacatggctcggcctgaactctcgcagcacgtccctaagcatgacctgcatcgctgttgggctcgttacgctttatcttggagtgatggtgcaagccgactccgggtgtgtcataaactggaagggccgggagcttaagtgcgggagcggcatcttcgtgaccaatgaggtgcacacgtggacagagcagtacaagtttcaggcggatagtccgaagcgcctgtctgctgccattggcaaggcctgggaggagggggtgtgtggcatcaggagcgccacccgcctagagaacatcatgtggaagcagatctccaacgagctcaaccacatcctcctggaaaacgacatgaagttcacggtggtagtaggggacgtagccggcatattagcccaggggaagaagatgatccggccccagccaatggagtataaatactcgtggaagtcctggggtaaggccaaaatcatcggagcggacgtccagaatacgaccttcatcatagatgggcccaacaccccggagtgccccgacgaccaacgcgcgtggaatatatgggaggttgaagactacggcttcggcatattcacgactaacatctggcttaagctgcgggacagctacacccaggtgtgcgaccaccgcctcatgagcgcagcaattaaggacagcaaggccgtgcacgccgacatgggctactggattgaatccgagaagaacgagacgtggaaactggctcgtgcgagcttcatcgaggtgaagacctgcatctggcctaaatcccatacgctgtggagcaacggcgtgttggagtccgaaatgattatccccaagatttatgggggcccgatcagccagcacaactatcgcccagggtacttcacccagaccgccggtccctggcatctgggtaagttggagctcgatttcgacctgtgcgaaggcacgactgtggtcgtggacgaacactgcggcaatcgggggccatcactgcgcacaaccacagtgaccgggaagattatccacgagtggtgctgccggagctgcactctgccaccccttcgcttccgcggggaggacggctgttggtacgggatggagatcaggcccgtcaaagagaaggaggagaatctcgtaaagtccatggtcagcgccgggagcggggaggtcgactccttcagcttagggctcctatgcatctccatcatgatcgaggaagtgatgcggagccgctggtcccggaagatgctcatgaccggcacgctagccgtgttctttttgctcatcatggggcagctcacgtggaatgacctgatccgcctctgcatcatggtcggcgccaacgcgagcgaccgcatggggatggggaccacgtaccttgccctgatggcgacgttcaagatgcgaccaatgttcgcagtgggcctcctgttccgaagattaaccagtcgagaggtgctcctgctgacgatcggactcagcctggtcgccagtgtcgagctgccgaacagcctcgaggagctgggcgacggactggcgatgggcatcatgatcctcaaactgctgaccgacttccagtcacaccagctctgggcgacgctgctgtcactcaccttcataaagacgacgttctccctgcactacgcgtggaagacgatggccatggtcctatcgatagtgtcgctatttcccctgtgcctgagcaccacctcccaaaagaccacgtggttacccgtactgctgggcagcctcgggtgcaagccgcttaccatgttcctgattgcagagaacaagatttggggccgacgctcctggcccctcaacgaagggatcatggcggtcggcatcgtgagcatcctgctcagctcactcctgaagaacgacgtgcccctggccgggcccctcattgccggcggcatgttaatcgcctgttacgttattagtggttcctccgcggacctatccctggaaaaggcagccgaagtgtcatgggaggaagaagccgagcactccggcaccagccacaacatccttgtggaggtccaggacgacggaaccatgaaaatcaaggacgaggagcgggacgacactttgacgattctcctgaaggctactttactagcggtgtccggagtgtacccgctaagcatcccagctacacttttcgtttggtatttctggcagaagaagaaacagcgcagcggtgtcctctgggacacccccagcccgccggaggtggagcgggctgtccttgacgacggcatctaccgaatcatgcagcgtggcctactgggtcgcagccaagtgggcgtaggcgtgttccaagagaacgtgttccacacgatgtggcacgtaacgcgtggcgccgtcctaatgtaccaagggaagcgcctggagccaagctgggcctcagtaaaaaaagacttaatcagctatggcggcggttggcggctccagggctcctggaacactggggaagaggtgcaagtcatcgcggtggagccgggtaagaaccccaagaacgtgcagacagcccccgggacgttcaagacccccgagggcgaggtcggcgccatcgccctggactttaagcccgggaccagcggctcaccgatcgtgaaccgcgaggggaagatcgtcggtctgtacggcaacggggtcgtgaccacgagcggaacctacgtgtccgccatcgcgcaggccaaagcctcacaggagggaccgttgcccgagatcgaggacgaagtcttccggaagcgcaaccttaccatcatggacctgcaccccggaagtgggaagacccggcgctatctcccggccatcgtacgggaggcgatcaagcgaaagctgcgcacgctgatcctcgcgccaacccgtgttgtcgcctccgagatggccgaggccctgaagggcatgccgatcaggtaccagacgaccgcggtaaagagcgagcatacgggaaaggagatagtggatctgatgtgtcacgcgactttcacgatgcggctcctgtctcccgttcgcgtcccgaactacaacatgatcatcatggacgaggcccatttcacggacccaagttccatcgccgcccgcggatacatcagcacgcgagttggaatgggcgaggcggcagccatctttatgaccgccacgcctcccggtagtgtcgaggcattccctcagagcaacgcggtgatccaggacgaggagcgcgacatccctgagcgatcttggaactccggttacgagtggattaccgacttccctggcaagacggtctggttcgtcccatccataaagagcggcaacgacatagccaattgcctgcggaaaaacggaaagcgcgttatccagctctcgcggaagacattcgacaccgagtaccagaagacaaagaataatgattgggactatgtggtcacgaccgacatctcagagatgggcgccaactttcgcgcagatagggtgatcgatccgagacggtgtctgaagcccgtaatccttaaggacgggcccgaacgcgtcattctcgcgggccctatgccggtgaccgtcgcgtccgcagctcagcggcgcgggcgcataggccgcaatcacaacaaggagggtgaccagtacatctacatggggcagcccctgaataatgacgaggatcatgcccattggacggaagcgaaaatgctgctcgacaacatcaacacgcccgagggcatcatccctgccctgttcgagccggagcgcgagaagtccgccgctatcgacggggagtaccggctgcgcggcgaggccagaaagacctttgtcgaactaatgcgccggggcgaccttccggtgtggctgagttacaaggtagcttccgagggtttccagtacagcgaccgccgctggtgcttcgacggcgaacgcaacaaccaggtgctcgaggagaacatggacgtggaaatctggacgaaggagggggagcggaaaaagctacgcccccggtggcttgacgccagaacctactccgaccccctcgctctgcgcgagttcaaggaattcgccgccggacggcgaagcgtctctggggacctcatactcgaaatcggcaagctaccgcagcacctgacgcagcgcgcacagaatgccttggacaacctggtgatgctgcacaacagcgagcagggcggacgggcctaccgccacgccatggaggagctccccgacacaatcgagacccttatgctgctcgcgttaatcgccgtgctgaccggcggggtgacgctcttcttcctgtccggccgtgggctcggcaagactagcatcggcctcctgtgtgtgatggccagttcagtcctattgtggatggcctccgtcgagccccactggatcgcagcgagcatcattttggagttctttctgatggtgctcctgatacccgagccggaccgccaacggacgccacaggacaatcaactagcctacgtcgtaatcgggcttctgttcatgatcctgaccgtggcggcgaatgagatgggtctgctggagaccacgaagaaggacctggggattggccatgttgccgtcgagaaccaccaccacgcggccatgctagacgtggaccttcacccagcctccgcctggaccctgtatgctgtagcgaccacgatcatcacgccgatgatgcgccacacaatcgagaacaccacagccaatataagccttactgcaatcgccaaccaagccgccatactgatggggcttgacaaggggtggcctatctccaagatggatataggcgtcccccttctggccctggggtgctacagtcaggtaaaccccctgacgcttacggccgccgtactgatgctcgtcgcgcactatgccattatcggacccggactgcaagccaaagccacccgcgaagctcaaaagcggacggcggcaggcatcatgaagaaccccactgtggatgggatagtggccatcgatctggaccccgtcgtgtacgacgcgaagtttgagaagcagctcggacagattatgctgctgatcttatgtacctcccaaatactgctaatgcgcaccacgtgggccctctgcgagagtatcacattagcgaccgggccgctgactacactctgggaggggtcgcctgggaagttctggaacaccacaatcgccgtgagcatggcgaacatcttccggggatcctacctagccggcgccggcctggcattcagcctcatgaagtccctcgggggtgggcgcagaggaaccggtgcacagggcgagacgctcggcgaaaagtggaagcgccagttgaaccagttatccaagagcgagttcaatacctacaagcggagtggcatcatggaagtcgatcgctctgaggcgaaggagggcctgaagcgcggggaaaccaccaaacacgccgtgtcccgcggtacggctaagctccggtggttcgtggagcgcaacctggtcaagcccgaggggaaagtgatcgacctcggctgcggccgcggcggttggtcatactactgtgcagggctgaaaaaggtgaccgaggtcaagggctacactaagggtggcccgggccacgaggagcctatcccgatggccacctacggatggaatctcgttaagctgcactccggcaaggatgtgttcttcatcccgccagagaaatgcgatacactgttgtgcgacataggggagagctcccccaaccctaccatagaggagggccgcacgctgagagttctgaaaatggttgagccctggctccgtgggaaccaattctgcatcaagatcttgaacccctacatgcctagcgttgttgagaccctggagcagatgcagcggaagcacggcggcatgcttgtccgcaaccccctgtcccgcaactctacccacgaaatgtactgggtgtcctgtgggacggggaacatcgtgtcggccgtgaacatgacaagccgcatgctgctcaaccgttttaccatggcccatcggaagcccacctatgaacgcgacgtggatctgggggctgggactcggcacgtcgcagtggaacctgaggtggcgaacctggacatcatcggtcaacgcatagagaacattaaacatgagcacaagtctacctggcattacgacgaggacaacccctacaagacctgggcataccacgggtcatacgaggtcaagccgagcggctccgcctctagcatggtgaacggggttgtgaaactgctgacaaagccatgggatgtgattcccatggttactcaaatcgcgatgacagacaccacacccttcggccaacagcgggtcttcaaggagaaggtggacacgcgcaccccaaaggccaaacgcggcaccgcccagattatggaggtcaccgccaaatggctgtggggcttcctctcgcgcaacaagaagccgcggatctgcacacgcgaggaattcacgaggaaggtccgtagcaacgccgcgatcggcgcagtgtttgtcgacgagaaccagtggaactccgccaaggaggcggtggaagacgagcggttttgggacctggtccaccgcgagcgcgagctgcacaagcaggggaaatgcgcgacctgtgtctacaacatgatgggtaagcgcgagaaaaaactcggagagttcggcaaggccaagggtagccgggcaatctggtatatgtggctgggcgcacgcttcctggaattcgaggcgctcggctttatgaatgaggatcactggttctccagggagaacagcctgagtggggtggagggcgaggggctccacaagctcggctatatcctgcgcgacatcagcaagatacccggcggcaacatgtatgccgatgacaccgccggatgggatacgcgcataaccgaggacgacctacagaacgaggccaggatcaccgatatcatggaacctgagcacgccctactggccggttccatattcaagctcacctaccagaacaaagtagtccgcgtccaacggccggcgaagaacggcacggtgatggacgtcatctcccgcagagatcagcgtggctctggccaggtgggaacctatgggctcaacaccttcacaaacatggaagcacagttgatcaggcagatggagtccgagggcatcttctcccccagcgagcttgagacgcccaacttggcggagagagtgcttgactggctggagaagtacggtgttgagcggctcaagcgtatggcaatatccggggacgattgtgtggtgaagccgattgatgatcgtttcgccacggcgctgaccgccttaaacgacatgggaaaagttcgcaaggatattccccaatgggagcccagtaagggctggaacgactggcagcaggttccgttctgctcccaccacttccaccagctcataatgaaggacggccgggagatcgtggtgccatgccgcaaccaagacgagctggttgggcgtgcccgcgtgagccagggcgccgggtggagcctgcgggagaccgcctgcctcggcaagtcatacgcgcagatgtggcagctcatgtactttcaccggcgggatcttcgccttgccgccaacgctatatgcagcgcagtcccggtggattggattccaacttctcggaccacctggagcatccatgcccaccatcagtggatgaccacagaagacatgctgtccgtctggaatcgcgtgtggatcgaggagaacccctggatggaagacaagacacacatctcgtcctggggcgacgtgccgtacctgggcaaacgcgaggatcagtggtgtggatcactcattgggctgactgcccgggccacctgggccaccaacatccaggtggcgatcaatcaggtccgcaggttgatcggcaacgagaactacttagattatatgacgtccatgaagcgcttcaagaacgagagtgatcctgagggagccctgtggtag

SEQ ID NO: 24098 - RNA, 9879 nt, synthetic construct
  misc_feature 1..9879: note = derived and/or modified CDS sequence (opt11) from DENV-1__EU677157__SS-prME
  source 1..9879: mol_type = other RNA
agcgtgaccatgctactcatgttgatgcccaccgccctggccttccacctcaccacacggggcggcgagcctcacatgatagtgagcaagcaggagcggggcaagtccctgctattcaagaccagcgccggggttaatatgtgtacgttaatcgccatggacctgggcgagctgtgcgaggacaccatgacttacaagtgtccgcggatcacagagaccgagcccgacgacgttgactgctggtgcaacgccacggacacctgggttacctacgggacctgcagccagacgggcgagcaccggagggacaagaggtcagtggctctcgcgccccacgtaggcctgggactggagacccgcacggagacctggatgagcagcgagggcgcctggaaacagattcagcgggtagaaacgtgggccctccggcaccccgggttcaccgtgatcgccttgttcctggcccacgcgatcggcaccagcatcacccagaaggggatcattttcatcctcttaatgctggtgacgccctccatggccatgcggtgcgtcggcatcggcagccgcgacttcgtggaggggctctcgggcgccacctgggtggacgtcgtgctggagcacgggagctgcgtgaccaccatggccaaagataagcccacgctggacatcgagctgctgaagaccgaagttaccaaccccgccgtcctgcggaagttgtgtatcgaggcgaagatcagcaacacgacgaccgacagccgctgcccgacacagggcgaggccaccctcgtggaggagcaggacgccaacttcgtctgccggcgcacgctggtggatcggggctgggggaatggctgcggcttattcggtaaggggtccctgatcacttgcgccaaattcaagtgtgtcactaagctggaaggcaagatcgtccaatacgagaatctcaaatatagcgtgatcgtgaccgttcacacgggcgaccagcaccaggtagggaacgagtccaccgagcacggcacgaccgccaccatcacaccccaagcgcccacgaccgagattcagctgaccgactacggagccctgacgctcgactgcagcccccgcaccggcctggacttcaatgagatggtcctcctcaccatgaaggagaaatcctggctggtgcacaagcagtggtttctggacctccccctgccttggaccagcggggccagcacgagccaggagacgtggaaccggcaggacctgctcgtgaccttcaagacggctcacgccaaaaagcaggaggtcgtggttttaggaagtcaggagggtgcgatgcacacggccctgaccggggccaccgagatccagacctccggcactacaaccatcttcgcggggcacctcaagtgccgcctgaagatggacaagctgaccttaaagggcatgagctacgtcatgtgcacgggatccttcaagctagagaaggagctggccgagacccagcacggcactgtgctagtgcagattaagtacgagggcaccgacgcgccctgcaagatccccttcagtacacaagacgaaaagggggtcacccagaacggccggttaatcaccgccaacccgatcgtgaccgacaaagagaagcccgtgaacatcgaggccgagccgcccttcggcgaatcctacatcgtcatcggcgccggggaaaaggcgctgaagctgagctggttcaagaaggggtcctccatcggcaagatgttcgaggccacggcccgcggggcccggcgcatggccatcctcggtgacacggcgtgggacttcgggtccatcgggggagtgttcactagcgtggggaagctggtccaccagatcttcggcaccgcatacggtgtgctgttctccggcgtgagctggacgatgaagatcgggattggcgtcctcctgacctggctgggtctcaactcccgctcgacctccctgagcatgacctgcatagccgtggggctggtgaccctctacttgggcgtcatggtgcaggcggactccggttgtgtaataaactggaagggtcgggaactgaagtgcgggagcggaatattcgtcaccaacgaggttcacacctggaccgaacagtacaagttccaggccgacagcccgaagcgcctatcggcggccatcggaaaggcctgggaggagggggtgtgtggtatccggagtgcaacccgactggagaacatcatgtggaaacagatctccaacgagcttaatcacatcctcttagagaacgacatgaagttcacggtagtggtgggcgacgtcgccggcatcctggcgcaggggaagaagatgatacggccccagcccatggagtacaagtacagctggaagtcctggggcaaggcaaaaatcatcggcgccgacgtgcagaacaccacgttcatcatagacgggcccaacaccccggaatgccccgatgaccagagagcatggaacatttgggaagtagaggactacggctttgggatttttacgaccaacatctggctaaagctgcgggacagctacacccaggtttgcgaccatcgcctgatgtccgcggccatcaaggacagcaaggccgtgcacgccgacatgggttactggatcgagtccgagaagaacgagacctggaagctggcccgggcgagctttatcgaggtgaagacgtgcatctggcccaagagtcacaccttatggagcaacggcgtgctggaatccgagatgatcatccccaagatctacgggggcccgatcagccagcacaactaccgccccgggtacttcacacagaccgccggcccatggcacctcgggaagttggagttagactttgacctctgcgagggcacgaccgtggtagtcgacgagcactgcggcaaccgggggccgtccctgcgcacgacaacggtgactggcaagatcatccacgagtggtgctgtagaagctgcaccctgccacccctgcgcttcaggggggaggacgggtgctggtacgggatggagatccgccccgtaaaggagaaagaggagaacctggtcaagtccatggtgagcgccggcagcggcgaagtggactccttcagcctgggattgttatgcatctcgatcatgatcgaagaggtcatgcggtctcgctggtcccggaagatgctcatgaccggcacgctcgcagtgttcttcctgttaatcatggggcagctcacctggaacgacctgattcgcctgtgcatcatggtgggcgccaacgcgagcgaccgaatggggatgggcaccacctacttggccctgatggccacgtttaagatgcggccgatgttcgccgtcggcttgctctttcgccgactaaccagccgcgaggtgctgctcctgaccatcgggctgagcctcgtggcctccgtcgagttgcctaacagcctggaggagctgggcgacgggctggcgatgggcataatgatcctgaagctgctgacggacttccagtctcaccagttatgggccacgctcctgagcctgacgttcatcaagaccaccttctccttacactacgcctggaagacgatggccatggtcctgagcatcgtttccctgtttcccctctgcctgagcactacctcccagaagaccacgtggctgcccgtgctcctggggtcgctggggtgcaagccgctcaccatgttcctgatcgcagagaacaagatatggggccggcgatcatggcccctgaacgaggggattatggctgtaggcatcgtcagcatcctcctgagctccctgctcaagaacgacgtccccctggccgggccgctgatcgccggcggcatgctcatcgcctgttacgtgataagcgggtccagcgcggacctgtccctggagaaggccgccgaggtctcttgggaggaggaagctgagcactccggcgccagccacaacatcttggtggaggttcaggacgacggtacgatgaagatcaaggacgaggagcgggacgacacccttaccatcctgctgaaggcaacgctgctggccgtctccggcgtttatccgttgagcatccccgccacactgttcgtgtggtatttttggcagaagaagaagcagcgcagcggggtcctgtgggacacccccagcccgcccgaagtggaacgggccgtgctggacgatggcatctacaggatcatgcaacggggactcctggggcgctcccaggtcggcgtgggggtgttccaggagaacgtcttccacaccatgtggcacgtcactcggggcgccgtgctgatgtatcaggggaagcgcctcgagcccagctgggcgtccgtcaagaaggacctaatcagctacggcggagggtggcggctgcaagggtcctggaacacaggggaggaggtccaggtgatcgccgttgaacctggcaagaaccccaagaacgtgcagaccgcccctgggacctttaagactcccgagggtgaggtgggggccatagccttggacttcaagcctgggaccagcggaagccccatcgtcaaccgtgagggtaagattgtgggcctctacggcaacggtgtggtcacaaccagcggcacgtacgtgagcgcgatcgcccaggccaaggccagtcaggaggggccgttacccgagatagaggacgaagtgttccggaagcgcaacctcaccataatggatcttcatcccggcagcgggaagacgcgtaggtacctgcccgcgatcgtccgggaagccatcaagcgcaaactccgcacgctgatcctggcacccacgcgggtggttgcctccgagatggccgaagctctcaaaggcatgcccatccgctaccagaccaccgcagtaaagagcgagcataccggcaaggaaatcgttgacctaatgtgccacgccacgttcacgatgcggctgctctcacccgtgcgcgtcccgaactacaatatgatcatcatggacgaggcccacttcaccgaccccagctccatcgccgcgcgggggtatatctctacgcgcgtggggatgggggaagccgcagccatcttcatgaccgctacaccccccggctccgtggaggcgttcccgcagagcaacgccgtcatccaggacgaggagcgggacatacccgagcgctcctggaacagtggctacgagtggatcaccgatttccccggcaagaccgtgtggtttgtgccctctatcaagagcggcaacgacattgcgaactgcctgcggaagaacgggaagcgtgtcatccagctgtcccggaagacgttcgataccgagtaccagaagaccaagaacaacgactgggattacgtggtaacaacggacatcagtgagatgggcgccaacttccgcgctgaccgcgtcatcgacccccgacgctgtctcaagcccgtgatcctgaaggacgggcctgagcgcgtgattcttgccggccccatgccggtcaccgtggccagcgccgcccagagacgcgggcggatcggccgaaaccacaataaggagggggaccaatacatctacatggggcagccactcaacaacgatgaggaccacgcgcactggaccgaagccaagatgctacttgacaacattaacacccccgagggaatcatccccgccctcttcgagccggagcgcgagaagtccgccgctattgacggcgaataccggctgcgcggcgaggcccggaagacgttcgtcgagctgatgcgccgcggggacctccccgtgtggctgtcctacaaggtagccagcgagggattccagtacagcgaccgccggtggtgtttcgacggcgagcgcaacaaccaggtcttggaggagaacatggacgtggaaatttggacaaaagagggagagcggaagaagctacgccctaggtggctggacgcccgcacctactccgatcccctggcccttagggagttcaaagagttcgccgcgggccgccggagcgtgtccggggacctgatcctggagatcgggaaactcccgcaacacctgacgcagcgcgcccagaacgcgctggacaacctcgtcatgctacacaacagcgagcagggcgggcgggcctacagacacgcgatggaagagctgccggacacgatcgagaccctcatgttgctggccctaatagctgtgctgacgggcggggtgacactgttcttcctctctgggagggggctcggcaagaccagcatcggcctgctctgtgtcatggcttccagtgtgctcctgtggatggcctccgtggagccacactggatcgcggccagcatcatcctcgagttcttcctgatggttctgctcatcccggagcctgaccgccagcggacgccccaggacaaccaattagcctacgtcgtaatcgggctcctcttcatgatcttgaccgtcgctgccaacgagatgggcctgctcgagactaccaaaaaggacctggggatcggccacgtggctgtggagaaccaccaccacgccgctatgcttgacgtagacctccatcccgcctccgcctggactctatacgcagtagccactaccatcatcaccccgatgatgcgccatacgatcgagaacaccaccgccaacatcagcctgaccgccatcgccaatcaggcggccatcctcatgggcctggacaagggctggccgatctccaagatggacattggggtccccttattggccctgggttgctacagccaggtgaaccccctgacgctcacagccgcagtgctcatgttggtggcccactacgcaatcatcggcccggggctccaagcaaaggccacacgcgaggcgcagaagcggaccgccgctggcatcatgaagaacccaacggtcgacgggatcgtcgccatcgacctagaccccgttgtatacgacgcgaagttcgagaagcagctgggtcagatcatgttactgatcctctgcacctcccagatcctcctcatgcgcactacctgggcactgtgcgaaagtatcactctcgccaccggccccctgaccaccctttgggagggctccccaggcaaattctggaacacgaccattgccgtgagcatggccaacatcttccgggggtcctacctcgccggcgcgggcctggcgttcagcctgatgaagtccctcgggggagggcgccggggcaccggggctcagggcgagacccttggcgagaagtggaaaaggcagctgaaccagctctccaagagcgagttcaacacgtataagcggtcgggaatcatggaggtggaccgcagcgaggccaaggagggccttaagcgcggggagaccacgaagcacgcggtctcccgcggcaccgccaagctgcggtggttcgtggagcgcaatctggtgaaacccgagggcaaggtcatcgacctcggctgcggccggggcgggtggtcctactactgcgccgggctgaagaaggtgacggaggtgaaggggtacaccaagggcgggcccgggcacgaagagcccatcccgatggccacctacgggtggaacttggttaagctccacagtggcaaagatgtgttcttcatacctcccgagaaatgcgataccctgctctgcgacattggagagtcgtcccccaacccgacaatcgaggagggccgcaccctccgggtactcaagatggtcgagccctggcttcgcgggaaccagttctgcataaagatcctcaacccctacatgccgagcgtggtggagaccctggagcagatgcagaggaaacacggcggcatgttagtccgcaacccgctctcccggaacagcacccacgagatgtactgggtgtcctgcgggaccggaaacatcgtgagcgccgtcaacatgacgtcgcgtatgctgctgaaccgcttcacgatggcgcatcggaagcccacatatgagcgagacgtggatctcggggctggcacccgccacgttgcagtcgagcccgaggtggccaacctggacatcatcgggcaacgcattgagaacattaaacacgagcataagagcacgtggcactacgacgaagacaacccctataagacctgggcctatcacgggtcctacgaagttaagcctagcggctccgcgagcagcatggtcaacggggtagttaagctgctcaccaaaccttgggatgtgatcccgatggtgacccagatagctatgacggacactaccccgttcggccagcagcgcgtattcaaggaaaaggtggataccaggactccgaaagcgaagcgggggacagcccagatcatggaggttaccgccaagtggctatggggttttctgtcccggaacaagaagccccgaatctgcaccagagaggagttcacgcggaaagtacgcagcaacgcggccataggcgccgtgttcgtggacgagaaccagtggaactccgccaaggaagcggttgaggacgagcgcttctgggacctagtgcaccgcgagcgggaactccataaacaggggaaatgtgcgacctgcgtgtacaacatgatgggcaaacgcgagaagaagctgggagaattcggcaaagctaaggggagtcgtgccatctggtacatgtggctcggcgcccgcttccttgagttcgaggcgctgggcttcatgaatgaggaccattggttctctcgggagaacagcctatccggggtcgagggcgaggggttgcacaaactgggttacatcctccgcgacatcagcaagatacctgggggcaacatgtacgccgacgacaccgccggctgggacacccggatcacggaggacgacctgcagaacgaggcccgcatcaccgacatcatggaaccggaacacgcactgctcgcgaagtccatcttcaagctcacctaccagaacaaggtggtgcgcgtgcagcggcctgccaagaacgggaccgtgatggacgtgatcagcaggcgggaccagcgcggcagcgggcaggtcggcacgtacggcctgaacaccttcaccaacatggaggcccagctcattcggcagatggagagcgaagggatattctccccgagcgagctggagacccccaacttagccaagcgcgtgctcgactggctggagaagtacggcgtggagcggctgaagcgcatggccattagtggggatgattgcgttgtgaaaccgattgacgaccggttcgcgacggccctgaccgccctgaacgacatgggcaaagtgcgcaaagacatcccccagtgggagccaagcaaggggtggaatgattggcaacaggtccccttctgctcccaccactttcaccaactgatcatgaaggacggccgggagatcgtggtgccgtgccggaaccaggacgagttggtcgggcgcgcccgcgtgtctcagggggccggctggagcctgcgggagaccgcgtgtctggggaagtcctacgcccagatgtggcagttaatgtacttccaccgccgggatctgcgcctggccgcaaacgctatctgcagcgccgtgcccgtcgactggatcccgacatcccggaccacctggagcatccacgcccatcaccagtggatgaccaccgaggacatgctctccgtatggaaccgggtgtggatcgaggaaaacccctggatggaggataagacgcacatctcgtcctggggcgacgtgccgtacttggggaagcgcgaggaccagtggtgcggcagcctaattggcttaactgcgcgggccacctgggcaaccaacatacaggtggccatcaaccaggtgcgccggctgatcgggaacgagaactacctggactacatgacctctatgaagcgcttcaagaacgagagcgaccctgagggcgcgctctggtga

SEQ ID NO: 24099 - RNA, 9879 nt, synthetic construct
  misc_feature 1..9879: note = derived and/or modified CDS sequence (opt11) from DENV-1__EU677158__SS-prME
  source 1..9879: mol_type = other RNA
tcagtgactatgctgctgatgctcatgccgaccgctctggccttccaccttaccacacggggcggggaaccccatatgatcgtgagcaaacaggagcggggcaagagcctgttattcaagaccagcgctggtgtgaatatgtgcacgctcatcgccatggacctgggagagctatgcgaggacaccatgacctacaagtgcccccggataactgaaaccgagcccgacgacgttgactgctggtgcaacgcaacggacacctgggtcacctacgggacctgcagtcagaccggcgagcaccggcgggacaaacggagtgtagcgttggcgccccatgtgggcctggggctggagacacgcaccgagacctggatgagctccgagggcgcttggaagcagatccagcgggtcgagacgtgggccctacggcaccccgggttcaccgtgatcgccctgtttctggcccacgcgatcggcaccagcatcacccagaaggggatcattttcattctcctgatgctggtgacgccctccatggccatgcggtgcgtcggaatcggcagccgcgacttcgttgaggggctctccggcgccacctgggttgacgtcgtgctggagcacgggagctgcgtcaccaccatggcaaaggataagcccactctggacatcgagctcctgaagacggaggtcactaatccggccgtgctgcggaaactctgcatcgaggcgaagatctccaacacgacgactgacagccgctgcccgacccagggtgaggccaccttagttgaggagcaggacgccaacttcgtctgccggcgcacgttcgtagaccggggctggggaaacggttgcgggctttttggcaaggggtccctcatcacgtgcgccaagttcaagtgcgtgaccaaacttgagggcaagatcgtccagtacgagaacctgaagtacagcgtaatcgtgaccgtccacacgggcgaccagcaccaggtgggcaacgaatccaccgaacatggcaccacagcaaccataacaccccaagcgcccaccaccgagatccagctcaccgactatggggcccttacacttgactgcagccccaggaccggcctcgacttcaatgagatggtcctgctgacaatgaaggagaagtcctggctcgtgcacaagcagtggttcctggacttgccactaccctggacctcaggggccagcacctcccaggagacctggaaccggcaggacctgctggtgacgttcaagaccgcccacgccaagaagcaggaagtcgttgtgctcggctcgcaggagggcgcgatgcacacggcgctgaccggggccaccgagatccagacctcaggcacgaccaccatcttcgccggacacctgaaatgccggctcaagatggataaactgacccttaaggggatgagctatgtcatgtgcacggggtccttcaagctcgagaaggaagtggcggagacccaacacggcaccgtgctggtccagatcaagtacgagggcaccgacgctccatgcaaaatccccttcctaacgcaggacgagaagggtgtgacccagaatggccggctgatcaccgccaaccctatcgtgaccgacaaagagaaacccgtaaacatcgaagccgagccgcccttcggggagagctatattatcataggcgccggcgagaaggcgctaaaactatcatggttcaagaaagggagctccatcggcaagatgttcgaggccacggcccgcggggcgaggcgaatggccatcctgggcgacaccgcgtgggacttcgggagcatcggcggcgtgttcacctccgtggggaagctcgtccaccagatctttggcaccgcctacggggtgctgttcagcggcgtgtcatggacgatgaaaatcgggatcggcgtcttactcacctggctgggcctcaacagccgctccacaagcctcagtatgacctgcatcgccgtggggctggtgacgctttatctcggcgtcatggtgcaggccgacagcgggtgcgtgatcaactggaagggccgggaattgaagtgcgggtccggcatcttcgtcaccaacgaggtgcacacctggaccgagcagtacaagttccaggccgattccccgaagcgcctgagcgcggccatcggcaaggcttgggaggagggggtgtgcggcatccggtccgctactcgcctcgagaacatcatgtggaagcagatcagcaatgagctgaaccacatcttgctcgagaacgacatgaagttcactgttgtggtgggggacgtcgctgggatcctggcgcaggggaaaaagatgatccggcctcaacccatggagtacaagtactcctggaagagttggggcaaagccaaaatcatcggggcagacgttcagaacaccactttcataatcgacgggcctaacacgccggaatgccccgacgaccagcgcgcatggaacatctgggaggttgaggactatggctttgggatcttcacgaccaacatttggttaaagctgcgggactcctatacccaggtctgcgaccaccgcctcatgagcgcagcaatcaaggactccaaggccgtgcacgccgacatgggctactggatcgaaagcgagaaaaatgagacgtggaagctggcccgggccagcttcatcgaggtgaagacctgcatctggcccaaaagccacaccctctggtccaatggcgtcctggaaagcgaaatgataatccccaagatctacgggggcccgatctcccaacacaattacagacccgggtatttcacccagaccgccggcccctggcacctggggaagctcgagctggacttcgacctgtgcgaaggcacgaccgtggtggtcgacgagcattgcggcaaccgggggccgagcctccgcaccactaccgttaccggcaagatcatccacgagtggtgctgccggagctgtacactgcctccgctgcggtttcgcggggaggatggttgctggtacgggatggagatacggccggtgaaggagaaggaggagaacctggtcaagtctatggtgtctgccggcagcggcgaggtggacagcttctccctggggctgctctgtatcagcattatcatcgaggaggtcatgcggtcccgctggagcagaaagatgctgatgaccgggacgctggcggtgttcgtgctcctgatcatggggcaactgacgtggaacgacctcatccgcttatgcatcatggtcggcgccaacgcctccgaccgcatggggatgggcactacctacctggccctcatggccacgttcaagatgagaccgatgttcgccgtgggcctgctgttccggcgcctcaccagcagggaggttctgttgctcaccatcgggctttccctagtcgccagcgtggagctccccaactccctggaggagctaggcgatgggctcgcgatgggcatcatgatccttaagctgctcaccgacttccaaagccaccagctgtgggccacgctgttgtccctgaccttcatcaagaccaccttcagtcttcattacgcctggaagacaatggccatggttctctccatcgtgagcctgttccccttatgcctctccaccacctctcagaaaaccacgtggttgcccgtattactcggctccctcgggtgcaagccgttaactatgttcctcatagcggagaataaaatctgggggcggaggagctggcctctcaacgaaggtatcatggccgtaggcatcgtatccatcctgcttagcagcttactgaagaacgacgtgcccctcgccgggcccctgatcgccggagggatgttgatcgcctgctacgtcatctccgggagctccgcggacctcagcctagaaaaggcagcggaggtgtcttgggaagaggaagccgagcacagcggcgcctcccacaacatcctggtggaggtccaggacgacggtaccatgaagatcaaagacgaggagcgggatgatactcttaccattctgctaaaggcgactctcctggccgtgagtggtgtgtacccgctctccatccccgccaccctcttcgtctggtacttctggcagaagaagaagcaacgcagcggggtcctgtgggacacccccagccctccagaggtggagcgcgccgtccttgatgacggcatctaccgcataatgcagcggggcctccttggccgctcccaggtgggagtaggggtcttccaggagaacgtttttcacaccatgtggcacgtgacgcggggcgcagtcctgatgtaccaggggaagcgcttggagccctcctgggcgagcgtgaagaaggacctcatctcttacggcggcgggtggcggctgcagggtagctggaacaccggggaggaggtgcaggtcatcgccgtggagcccggcaagaaccccaagaacgtgcagacagcccccgggaccttcaagacgcccgagggcgaggtaggagccatagccctggacttcaaacccgggacctccggcagccccatcgtaaaccgagaggggaagatcgtgggcctctatggtaatggagtcgtgaccacctccggcacgtacgtaagcgcaatcgcccaagccaaggccagccaggaaggcccgctgcccgaaatcgaagatgaggtctttcggaagcgcaatctgacgatcatggatctccaccccggctccggaaagacccggcgctacctgccagctatcgtgcgggaggccatcaagagaaaattacgcaccctcatcctggcccccacgcgggtggtcgccagcgagatggccgaggcgctgaagggtatgcccatccgctaccagaccaccgccgtgaagtccgaacacaccggcaaggagatcgtggatctcatgtgccatgccaccttcaccatgcgcctgctcagccccgtccgtgtgccgaactacaacatgatcatcatggacgaggcccacttcaccgacccatccagtatcgcggcgcgtggctatatctccacccgcgtgggcatgggtgaggccgccgctatattcatgacggcaacgccacccggcagcgtcgaggcgttcccgcagtccaacgccgtcatacaggacgaggagcgggacatccccgagcgatcctggaacagtgggtacgagtggataacagacttcccaggcaagaccgtgtggttcgtccccagcataaagtccggcaacgacatcgccaactgcctccgaaagaacgggaagcgggtaatccagctaagccggaagacgttcgacaccgagtaccagaagaccaagaacaacgactgggattacgtcgtcaccacggacatctccgagatgggcgcaaactttcgggcggatcgggtgatagatccgcgccggtgtctgaagccagtgatcctcaaggacgggcctgagcgagtcattctggcgggccccatgccagtaaccgtagcgtccgctgcccaacgccgcgggcggatcggccgcaaccacaataaggagggcgaccagtacatctatatggggcagcccctgaacaacgacgaagaccacgcgcactggaccgaagccaagatgctcctggacaacatcaacacccccgagggcatcatccccgctctctttgagcccgaacgcgagaaatcggccgcgatcgatggggaataccggctccgtggggaagcgcggaaaacattcgtggaactgatgcgcagaggggacctgcccgtctggctcagctacaaggtcgcctctgaggggttccaatacagcgacaggcggtggtgtttcgacggcgagcgcaacaaccaggtgctggaggaaaatatggacgtcgagatctggaccaaggagggggaacgcaagaagctacgcccccggtggctcgacgcgcgcacatatagcgaccccctcgccctgcgggagttcaaggagttcgccgcgggccgcaggtccgtcagcggggacctcattctggagatcggcaagctgccgcagcacctcacccagagggcccagaatgcgctggacaacctcgtgatgctccataactccgagcagggcggacgggcttaccgccacgccatggaggagctgcccgatacgatagagaccctgatgttgctggccctgatcgccgtgctaaccggcggggtaaccctgttcttcctgagcggccggggtctcggcaagacatccatcggcctcctgtgcgtgatggccagctcagtgctactgtggatggctagcgtcgaaccccattggatcgcggcctctatcatcctggagttcttcttgatggttctgctgatccccgagcccgatcgccaacgtacgccccaggacaatcagctcgcctacgtggtcatcgggctgttgtttatgatcctaaccgtagccgcaaatgagatgggcctgctagagaccacgaagaaggacctcgggatcggtcacgtggcggtcgagaaccaccaccacgccgccatgctggacgtggaccttcaccccgccagcgcctggacgctctatgcggtcgccaccaccatcatcactcccatgatgcgccacacgatcgagaacaccaccgccaacatttccctgacagcaatcgccaaccaggctgcaatcctgatggggctcgacaagggctggcccatcagcaagatggacatcggcgttccactgctggcactaggttgttactcccaggtaaatcccttgacgctgacagccgcggtgctcatgctggtcgcccactacgccatcattggcccgggactacaagccaaggccacccgcgaggctcagaagcggaccgccgccggcataatgaagaaccccacggtggacgggatcgtagccatcgacttggaccccgtcgtgtacgacgccaagttcgagaagcagctgggccaaatcatgctgctcatactgtgcaccagccagatcctgctcatgcgcaccacctgggcactgtgcgagtcaatcacgctggccactggccccttgaccaccctctgggaggggagcccgggtaagttctggaatacaactatcgctgtgtccatggctaacatcttccggggaagctatctcgccggtgcggggcttgccttctccctgatgaaatccttaggtggcggccgccgggggaccggggcccagggcgagaccctcggcgagaagtggaagcgccagttgaaccagctgtccaagtccgagttcaacacctacaagaggagcgggatcatggaggtcgaccgctccgaggctaaggagggcctcaagcgcggtgagaccaccaagcacgcggtgagccgcggcaccgcgaagctgagatggttcgtggagcgcaacctggtaaagcctgaaggcaaggtgatcgacctgggctgtggccgcggcgggtggtcctactactgcgccgggctaaagaaagtaacagaggtcaaggggtacacgaagggcggccccggccacgaggagccaatcccgatggctacctacgggtggaatctggtgaagctgcacagcggcaaggatgtgttcttcatcccgccagagaagtgcgacactctcctgtgtgacatcggggagtcgagccccaacccgacgatcgaggaagggcgcacccttcgggtcctcaagatggtggagccctggctgcgcggaaaccagttttgcatcaagatcctgaatccgtacatgccgagtgtggtcgagactctcgagcagatgcagcggaagcatggcggcatgctggtgcgcaacccgctgtcgcggaactccacccacgagatgtactgggtaagctgcgggactggcaacattgtttccgccgtgaacatgacgagcagaatgctccttaaccgatttaccatggcgcatcgaaagcccacctacgagcgtgacgtggacctgggggctggcacacggcatgtcgccgtggagcccgaggtagccaacctcgacatcatcggccagcgcatcgagaacatcaagcacgagcacaagtcgacgtggcactatgacgaggacaacccctacaaaacctgggcttaccacgggagctacgaggtcaaaccgtctggctctgcgtcgagcatggtaaatggggtcgtgaagctgcttactaagccctgggacgtgatccccatggtcacgcagatcgcaatgacggacaccacccccttcggccagcaaagggtgttcaaggagaaggtggacacccgcacgccgaaggccaagcgtgggaccgcacagatcatggaggtcaccgccaagtggctctggggtttcttgagccgcaacaagaagccccgcatctgcacccgggaggagttcacgagaaaagtgcgctcaaacgcggccatcggcgcagtgttcgtcgacgagaaccagtggaatagcgccaaggaggcggtggaggacgagcggttctgggacctggtgcacagagagcgggaactccacaaacaggggaagtgcgcgacctgtgtctacaacatgatgggcaagcgcgagaagaagttaggggagttcggcaaggccaaggggtcccgggccatctggtacatgtggctgggcgcgcgctttctcgagttcgaggcgctgggcttcatgaatgaggaccactggttctcgcgggagaactcccttagcggggtggagggcgaagggctccacaaactgggctatatcctgcgcgatatcagcaaaatacccgggggtaacatgtacgccgatgacaccgccggctgggatacccgcatcacggaggacgacctacagaacgaggcccggatcaccgacataatggagccggaacacgcacttctggccaagagcatcttcaagctcacctaccagaacaaggtcgtccgcgtgcagcgccctgcgaagaacggaaccgtgatggacgtcatctcgcgccgggaccagcgcggctccggccaggtggggacgtacggcctgaacaccttcaccaacatggaggcccagctgatccgccagatggagtccgagggaattttctcaccctccgagctcgaaaccccgaacctggccgagcgcgtgttggactggctcgagaagtacggtgtcgaacggttaaagcgcatggctatcagcggggacgactgtgtggtgaagccgatcgacgacaggtttgcgacggctctgaccgccctcaacgacatgggcaaggtccgcaaggatatcccccagtgggagccctccaaggggtggaacgactggcagcaagtccccttctgctcgcaccactttcatcagttgatcatgaaggacggcagagagatcgtggtcccgtgccgaaatcaggacgaactggtgggtcgtgcacgagtctcccaaggggccggatggagcctccgggagaccgcatgcctgggcaagtcttacgcccagatgtggcagctgatgtacttccaccgccgggatctccgcctggccgccaacgcgatttgtagcgctgtcccagtggactggatccccacctcccggacgacctggtccattcacgcccaccaccagtggatgacaaccgaggatatgctgagcgtgtggaatcgcgtctggatcgaggaaaatccctggatggaagacaagacgcacatctccagctggggcgacgtgccataccttgggaagcgcgaggaccagtggtgcggctccttaatcggcctaacagcacgggccacctgggcgaccaatattcaggttgccatcaaccaggtccgccggctcatagggaatgagaactacttagactacatgaccagcatgaagcgcttcaagaacgagggcgatcccgagggggccctgtggtag

SEQ ID NO: 24100 - RNA, 9879 nt, synthetic construct
  misc_feature 1..9879: note = derived and/or modified CDS sequence (opt11) from DENV-1__EU677159__SS-prME
  source 1..9879: mol_type = other RNA
agcgttactatgctgctcatgctgatgcccacagccctggcctttcacttaaccaccagaggcggggagccccacatgatcgtgtccaagcaagaacgggggaagtccctgttatttaagacctcagcgggggtgaacatgtgcacgctcatcgccatggatctgggcgagctgtgtgaggacacaatgacctacaagtgcccacgcattaccgaggccgaacctgacgatgtggactgctggtgcaacgccaccgacacctgggtgacctatggtacgtgcagccagacaggggagcaccggcgcgacaaaagatcagtggcgctcgcgccccacgtgggcctggggctggagacgcgcacagagacctggatgagctcagagggagcctggaagcaaatccaacgggtcgagacgtgggcgctacgccacccggggtttacggtcatcgctcttttcctggcgcacgccattggcacgagcatcacacagaagggcatcatctttatactcctgatgctggtgaccccctccatggccatgcgctgtgtcggcatcggcagccgcgacttcgtggaggggttatccggcgcaacgtgggtggatgttgtgctggagcacgggagttgtgtgacaaccatggccaaggacaagcccacgctggacatcgagctcctgaagacggaggtcacgaacccagcggtgctgcggaagctctgtattgaggcgaagatttccaacaccaccacagacagccgctgtccgactcaaggcgaagccaccctggttgaggagcaagacgctaacttcgtctgccggcgcaccttcgtggaccggggctgggggaacggctgtggcctgttcggcaaggggtccctcatcacatgcgccaaattcaaatgcgtgacgaaactggagggcaagatcgtacagtatgaaaacctgaagtattccgtgatagttaccgtccacactggcgatcagcaccaggtggggaatgaatcgacggagcacggcacgaccgcaaccatcaccccccaggcccccacgacagagatccagcttaccgactacggtgcgctgactctcgactgtagcccacgcacgggcttagacttcaacgagatggtcctgcttacgatgaaggagaagagttggctcgtgcacaaacaatggttcctggacctacccttaccctggaccagcggtgcaagcacctcccaggagacgtggaaccggcaggaccttctggtgaccttcaagaccgcccacgcgaaaaagcaggaggtcgtggtcctcggcagccaggagggcgccatgcacacagccctgaccggggccaccgagatacagacctccgggaccacgaccatcttcgccgggcatctgaagtgtcgcctcaagatggacaagctcacactgaagggcatgagctacgtcatgtgtactgggtccttcaagctcgagaaggaagtggcggaaactcaacatggcaccgtgctggtacagatcaagtacgagggaaccgacgccccttgtaagattcccttctcaacccaggacgagaagggggtgacgcagaacggccggctgattaccgccaaccccatcgtcaccgacaaggagaagcccgtcaacatcgaggcggaaccaccctttggggagtcctacatcgtcattggtgccggggaaaaggcactgaagctcagctggtttaagaagggttccagcatcggcaagatgtttgaggctactgcccgcggggcccgccgcatggcgatcctgggggacacggcctgggatttcgggagtatcggcggcgtgttcaccagcgtcgggaagctggtccaccaaatcttcggcaccgcctacggagtacttttctccggcgtcagctggaccatgaagatcgggatcggcgtgctgctcacgtggctcgggctgaacagtcgcagcacctccctgagcatgacctgtatcgccgtgggtctcgtcaccctgtatctcggggtgatggtgcaggccgactccggatgtgtaatcaactggaagggaagggagctcaagtgcgggagcggcatcttcgtgactaacgaggtacacacctggaccgaacagtacaagttccaagcggacagccccaaacgcctgtctgccgccatcggcaaggcatgggaggaaggagtctgcggcatccggagtgccacgcgcctggagaacatcatgtggaagcagatctccaatgaattaaatcacattctgctggagaacgacatgaagctcaccgttgtggtcggggacgtggctggcatcttagggcagggcaagaagatgatacggccccagcctatggaatacaagtattcttggaaatcctgggggaaagccaagatcatcggggcagacgcccagaacacgaccttcatcatagacggcccgaacaccccggagtgccccgacgatcaacgcgcgtggaacatctgggaagtggaagactacgggttcggcatctttaccacgaatatctggctcaagcttagggacagctacacccaagtctgcgaccatcggctgatgtccgcggccatcaaagatagcaaggccgtgcacgccgacatgggctattggatagagtccgaaaagaacgagacctggaagctggcccgggctagcttcatcgaggtgaagacctgcatctggcccaagtcccacacgctctggtcgaacggggtcctggagagtgagatgatcatccccaagatctatggcggacccattagccagcacaactaccgccccggctacttcactcagaccgccgggccctggcacctgggaaagctcgagctggatttcgatctgtgtgagggcaccacggtggtggtcgacgagcactgtggaaaccgtggcccctcactccgcacaaccactgtgacggggaagataatccacgagtggtgctgccggagctgcacgttgccacccctgcgctttcggggtgaggacgggtgctggtacggcatggaaattaggccagtgaaggagaaggaggagaacttggtcaagtctatggtttctgccggcagcggggaggtggactccttcagcctgggcctgttgtgcatctccatcatgatcgaggaggtcatgcgcagccgctggtcccggaagatgttaatgacggggaccttggcagtgttcttccttctgattatgggccaacttacgtggaacgacctcattcgcctgtgcatcatggtgggggcgaacgcgagcgaccgcatgggcatgggcaccacctacctggccctcatggccaccttcaagatgcggccgatgttcgccgtgggccttctgttccgccggctcacgtcccgcgaggtgctgctgttgaccattggtctgagcctagtggcatccgtggaattacccaacagcttggaggagctgggggatggcctcgccatgggcatcatgatcctgaagctgttaaccgactttcagtcccaccagctgtgggccaccctactcagtctgacgttcatcaagactaccttctccctgcactacgcctggaaaaccatggcaatggtgctcagcatcgtctccctgttccccctttgcctctccacgacatcccagaagaccacctggctgcccgtattgctcgggagcctgggatgcaagccgctgacgatgttccttatcgccgagaacaaaatctgggggcggaagtcctggcccctgaacgaaggcatcatggccgtggggatcgtcagcatcctgctctcgagtctactgaagaacgacgtccccctcgcaggtcccctgatcgccggcgggatgctgatcgcttgctacgttatcagcggctccagcgcagacctctccctggagaaggcagccgaggtcagctgggaggaggaggccgagcattctggggcgagccacaacatcctggtggaggtgcaggacgacggcactatgaaaatcaaggacgaggagcgtgacgataccctcactatcctgctgaaggctaccctcctggcagtctccggtgtgtacccgatcagcatacccgccacgctgttcgtgtggtacttctggcaaaagaagaagcagcggtccggcgtcctctgggacaccccaagcccgcccgaggtggagcgcgccgtcttagatgacggcatctaccggatcatgcagcgagggctgctgggccggtcccaggtgggtgtgggagtcttccaggaaaacgtcttccacaccatgtggcacgtgacacgcggggcggtactaatgtaccaaggcaagcggttggagcccagctgggccagcgtcaagaaggacctgatatcgtacggcgggggatggcgcttgcgggggagttggaacacgggcgaggaagtacaggtgattgcagttgagcccgggaagaacccgaagaacgtccagacagccccgggcaccttcaaaaccccagaaggcgaggtgggggccatcgcgctggacttcaagcctggtacgagcggctcccccatcgtcaaccgcgagggcaaaatcgtcggcttatacgggaacggcgttgtcaccaccagcgggacctacgtgagcgccatcgcgcaggccaaagcgtcccaagagggtccgctccccgagatcgaggacgaagtattccggaaacgcaacttgaccatcatggacctgcacccgggaagcggcaaaacccgacgctacctcccagccatcgtccgggaggccatcaaacgtaagctgcgcaccctgatcctcgccccaacccgcgtggtcgcttccgaaatggcggaagccctgaagggcatgcccatccgctaccagacgacagccgtaaagagcgagcacaccgggaaggagattgtagacctgatgtgccacgccactttcaccatgcggctactgtcccccgtgcgcgtcccgaactacaacatgataatcatggacgaagcccacttcacagaccccagctccatagcggcccggggctacatcagcaccagagtaggtatgggtgaggccgcggcgatcttcatgacagcgaccccgcccgggagcgtggaggccttcccccagagcaacgccgtcatccaggatgaggagcgggacatccctgagcgctcatggaactctggttacgagtggatcaccgatttccccggcaagaccgtctggtttgtgccttccataaaaagcggtaatgacatcgcgaattgcttacgtaagaacggcaagcgagtcatccaactgtcccggaagaccttcgacacggaataccaaaagaccaagaacaacgactgggactacgtggtgaccaccgacatcagcgagatgggcgcgaacttccgcgccgaccgggtcatcgacccgcgccgctgccttaaacccgtcatcctgaaagatggtcccgaacgcgttatactcgccgggcccatgcctgtcacggtggcctcggccgcgcagaggcgcggccgcatcggcagaaaccacaacaaggagggggaccaatacatctatatgggacagcccctgaacaatgacgaggaccacgcacattggaccgaggccaagatgctgctcgacaacatcaatacccctgaggggatcatccccgccttattcgagccggagcgcgagaagtccgctgcggtcgacggtgaataccggctgcgcggcgaggcccggaagacgtttgtcgagctcatgcgccggggagacctgcccgtgtggctgtcttataaggtcgccagcgagggatttcagtactccgaccgccgctggtgcttcgacggcgagcgcaacaatcaagtcctcgaggagaacatggatgtggaaatctggaccaaggagggtgagaggaagaaactacgaccccggtggttagacgctcgcacctactctgaccctcttgccctgcgtgagtttaaggagttcgcggcgggtcgccggtccgtgtccggcgacctgatcctcgagattggcaaactgccgcagcatttaacccagcgcgcccagaatgcgctcgacaacctggtgatgctacacaactcggaacagggcgggcgggcctaccgacacgctatggaggagcttcccgacaccattgagacactgatgctgctcgccctaatcgccgtgctgaccgggggcgtcaccctcttcttcctgtctggtcgtggtctgggcaagaccagcatcggactcttatgcgtaatggcctccagcgttctactctggatggcctccgtcgagccacactggatcgccgccagcatcatccttgagttcttcctaatggtgcttctgattcccgagccggacagacaacggacgccccaggataaccagctggcatacgtagttatcggcctcctgttcatgatcctgacggtggccgcgaatgaaatggggctgctcgagacgaccaaaaaagacctgggcatcgggcatgtggccgtcgagaatcaccaccacgccgccatgctcgacgtagatcttcaccccgcctccgcgtggaccctctacgccgtcgcgacgacgatcatcaccccgatgatgcggcacaccatcgagaacacgacagccaacatcagcctcaccgccatcgccaaccaggccgccatactgatgggcctcgacaagggctggcccatctccaagatggacataggcgtccccctcctggccctgggctgctacagccaggtgaacccactcaccctgaccgcggccgtgctgatgctcgtcgcccactacgccatcatagggccgggcctgcaggcgaaggcgacccgcgaggcccagaagcggaccgccgcggggatcatgaagaacccaaccgtcgacggcatagtagcaattgacctggaccccgtcgtgtacgacgcaaagtttgaaaagcagctcggccagattatgcttttgatcctttgcacatcccagatcctgctgatgcgcaccacctgggcgctctgcgagtcgatcaccctggccactgggcccctgaccaccctctgggaaggctccccggggaagttctggaacaccacaatagcagtgtcgatggcaaacatcttccgggggtcctacctggccggcgccgggctggccttctcattgatgaagtccttaggcggtggccgccgggggaccggcgcccaaggcgaaaccttaggggagaagtggaagcggcagctcaaccagctgtccaagtccgagttcaacacctacaagcggtccggaatcatggaggtcgaccgcagcgaggcgaaagaaggactcaagcggggggagacgaccaagcacgctgtgtcccgcgggaccgccaagctccggtggttcgtggagagaaacttagtcaagccggagggaaaggtgattgacctgggctgtgggcggggcgggtggagttactactgcgccggcctgaagaaggtgaccgaggtcaaggggtacacaaaaggcggccccggccacgaagagccgatccccatggcaacctatggatggaacttggtgaagctgcactcgggtaaagacgtgttcttcatcccgcccgagaaatgcgacaccctgctctgcgatatcggtgagagcagccccaaccccaccattgaggaggggcgcacgctgagggtccttaagatggtggagccgtggctccgcggcaaccagttctgcatcaaaatcctgaacccctacatgcccagcgtggtagaggcgctggagcagatgcagcggaagcacggagggatgctcgtgcggaacccgctgtccaggaatagcacccacgagatgtattgggtgtcctgcggcaccgggaacatcgtctctgctgtgaacatgacctcccgcatgttgctcaaccgctttacaatggcccaccggaagcctacgtacgagcgtgacgttgatctgggcaccggcacgcggcacgtcgccgtggagcccgaggtggccaatctggacatcatagggcagcgaatcgagaacatcaagcacgagcacaagagtacctggcattacgacgaggacaatccgtacaagacttgggcgtaccatggcagttacgaggtcaagccgagcggatccgccagcagcatggtgaacggcgtcgtgaagctcttaaccaagccttgggacgtgatccctatggtcacccaaatcgccatgacggacacgacccccttcgggcagcaacgggtcttcaaggagaaggtggacactaggacccccaaggccaagcggggcacggcccagatcatggaggtgaccgcccgctggctgtggggattcctctcacggaacaagaagccccgtatctgcacacgggaggagttcacgcgcaaggtgagaagcaatgccgccatcggagctgtgtttgtagacgagaaccaatggaactcggcgaaggaagccgtggaagatgaacgcttttgggacctggtgcaccgggagcgcgagcttcacaaacagggcaagtgcgccacgtgcgtctacaacatgatggggaagcgggagaagaaactaggtgaattcgggaaggccaagggctcacgcgccatctggtacatgtggctgggcgcacgtttcctggagttcgaggcccttggattcatgaatgaggaccactggttctcccgcgagaacagtctgagcggcgtggaaggggagggactacacaagctcgggtatatcctgcgggacatcagtaagatccccgggggcaacatgtacgccgatgacactgccgggtgggacacccgtatcaccgaggacgacctgcagaacgaggccaagatcacggacatcatggagccggagcacgcgctcttagccaaggccatcttcaagctgacctatcagaacaaggtggtccgcgtgcagcggccggccaagaatggcaccgtgatggatgtaatctcccgccgggaccagcgcggttcaggccaggtgggcacgtatggactcaacactttcaccaacatggaagcccagctgatccggcagatggagtccgaaggcatcttcagcccctctgaactggaaacccccaacctcgcggagcgcgcccttgattggctggggaagtacggcgtggagcggctcaagcgaatggccatcagcggggatgactgcgtcgtgaagccgatcgatgacagattcgccaccgctctgacagcgcttaacgacatgggcaaagtgcgcaaggacatcccccagtgggagcccagtaagggctggaatgactggcagcaggtccccttctgctcccaccacttccaccagctcatcatgaaggacgggcgggagatcgtggtgccatgccgtaatcaggacgagctggtcggcagagccagagtgtcacagggggccggctggagtctgcgtgagaccgcgtgcctcggcaagagctacgctcaaatgtggcagctgatgtacttccaccgccgagacctgcgcctagccgctaacgccatttgtagtgccgtgcccgtagattgggtgcccaccagccgcacgacgtggtccatccacgcgcaccaccagtggatgaccaccgaggacatgctgagtgtgtggaaccgcgtctggattgaggagaacccctggatggaggacaagacccacatctctagctgggaggacgtgccttacctgggcaagagggaagaccaatggtgcggttccctcatcgggttaacggcccgggccacctgggccaccaatatccaggtcgccatcaatcaggtccgccggctgatcgggaacgagaactacctcgactacatgatcagcatgaagcgcttcaaaaatgagtccgaccccgaaggggctctctggtga

SEQ ID NO: 24101 - RNA, 9879 nt, synthetic construct
  misc_feature 1..9879: note = derived and/or modified CDS sequence (opt11) from DENV-1__EU677160__SS-prME
  source 1..9879: mol_type = other RNA
agcgtcacgatgctgttaatgctgatgcccacggccctggccttccatctcacaacgcggggcggtgaacctcacatgatcgtgagcaaacaggaacgcgggaagagcctcttgttcaagacgtctgcaggcgtgaacatgtgtacgcttatagccatggatctgggcgaattctgtgaggacacgatgacctacaagtgtcctcgcatcaccgaagccgaaccggacgatgtggactgctggtgcaatgcaaccgacacgtgggttacatacggaacatgcagtcagacgggggaacaccggcgggacaagcgatcagttgccctagcgccacacgtgggcctggggttagaaacgcggacggagacctggatgagctccgagggcgcatggaagcagatacagcgggtggagacctgggccctgcgccaccctggattcacggtcatcgccctcttcctggcgcacgccatcgggaccagcatcacccaaaaggggatcatcttcatcctgctcgtgctggtcaccccctccatggccatgcggtgtgtgggcattggctcgcgcgacttcgtggagggtctgtccggcgcaacgtgggtcgacgtggtgttagagcacggaagttgcgtaacgacaatggcaaaggacaagcccacattggacatcgaattgctcaagacggaggtgaccaaccccgcggtactgcggaagctgtgcatcgaggccaagatttccaataccaccacagacagccgctgtccgacacagggtgaggccaccctcgtcgaggaacaggacgccaacttcgtgtgtcgtcgtacgttcgtggatcggggctggggaaacggctgcgggctgtttggcaaaggatccctaatcacttgtgccaaattcaagtgcgtcaccaaactcgagggcaagaccgtacagtacgaaaacctaaagtactccgttatcgtcacagtgcacacaggcgaccagcatcaggtaggcaatgaatctaccgagcacggtaccaccgcgactataaccccccaggcccccagcaccgagatccaactaaccgactatggtgctctcacccttgattgcagtccccggacgggtctggacttcaacgagatggtgctgctgaccatgaaggagaagtcctggctggtgcataagcagtggttcctcgacctgcccttgccgtggaccagcggggcttccacaagccaggagacgtggaatcggaaggacttactggtcaccttcaagaccgctcatgcgaagaagcaggaggttgtggtcctcggctctcaagagggtgccatgcacaccgctcttacgggggcaactgagatccagacgtcaggcaccaccaccatcttcgccggacatttgaagtgtcgtctcaagatggacaagctcaccctgaagggcatgtcctacgtgatgtgcaccgggagcttcaagttagaaaaggaggtggctgagactcagcacggtaccgtgctcgtgcagatcaagtacgagggcaccgacgcaccctgcaaaatccccttctccacccaggacgagaagggggtcacgcagaacggtcgtcttatcactgcgaatccaatcgtcaccgacaaggaaaaaccagttaacatcgaggccgagccgcccttcggggagtcttatatagtgatcggcgctggcgaaaaggccttaaagctctcctggttcaagaaggggagctccatcggcaaaatgttcgaagcaaccgccaggggggcccgccgcatggcgatactcggcgacacggcctgggacttcgggtcgatcggaggagtattcacctccgttggtaagctagtgcatcagatctttggcacagcttacggtgtcttattcagcggagtttcctggaccatgaagatcgggatcggcgtgctcttaacgtggctgggcttgaatagtcgttcaaccagcttatccatgacctgcatcgccgtcgggctggtaaccctttatctgggcgttatggtacaagccgacagcggctgtgtgatcaactggaagggccgggagcttaagtgtgggagcggcattttcgtaacgaacgaagtccacacgtggaccgagcagtacaagttccaggcggactcccctaagcgtctcagcgccgctatcggcaaggcgtgggaggagggggtgtgcggcatacggagcgccacccgactggagaatatcatgtggaagcagatctctaatgagttaaaccatatcctcttggagaacgacatgaaatttacagtcgtcgtgggtgacgtggcaggcatactggcccagggcaagaagatgatcaggccccagcccatggaatacaagtactcgtggaagtcctggggcaaggccaaaatcatcggcgccgacgtccagaacacgaccttcatcatcgacggacccaacactcctgagtgccccgacgaccaacgcgcatggaatatctgggaggtggaggactacggctttgggatcttcaccaccaacatctggctcaagcttagagactcctacacccaagtttgcgaccaccgcctgatgagcgcagccatcaaggacagcaaggccgtccatgccgacatgggctactggatagagagtgagaagaacgagacttggaaactcgcgcgcgcctccttcatagaggtaaagacttgcatttggccgaagtcgcacacgctgtggtccaacggcgtgttagagtccgagatgatcatccctaaaatctatgggggcccgatctcccagcataactaccgccccgggtactttacacagaccgcaggaccctggcacctcggaaaactagaactggacttcgatctgtgcgagggcaccacggtggtagtggacgagcactgcggcaaccgaggcccaagcctgcgtacgaccaccgtcacgggcaaaataatacacgaatggtgctgccggtcctgcaccctgccgcccctgcgattcaagggagaggacgggtgttggtatgggatggagattcggcccgtgaaggagaaggaggagaaccttgtgaaaagcctggtctccgccggctccggcgaggttgacagctttagcttggggctgctgtgcatcagcataatgatagaggaagtaatgcgcagccggtggagcagaaagatgctcatgaccggcaccctggccgtcttcttcctgctcatcatggggcagctaacgtggaatgacttaatccggctctgcattatggttggcgcgaacgcctcagatagaatggggatgggaacgacttatctggccctaatggccacattcaagatgcgcccaatgttcgccgtgggtttactgtttagaagacttacgagccgggaggtcctcctgctgaccatcgggctctccctggtggcgagcgtcgagctgcccaactcgctggaggaactgggcgacggcttagccatgggcattatgatcctcaagctgctgaccgacttccagtctcaccagctctgggccacactgctgtccctcacttttatcaagaccactttcagcctgcactacgcgtggaagaccatggcgatggtcctgtccatcgtttcactttttcccctgtgcctgtccacgacgagccagaagaccacctggttgccggtacttctgggctcattagggtgtaagccgctaacgatgttcctgatcgccgagaacaagatctggggccgcaagagctggccgctgaacgagggtattatggctgtgggaatagtgagcattttgctgtcgagcctcctgaaaaacgacgtcccactggccgggcccctcattgcagggggcatgctgatcgcatgctacgtgatctccgggagctcagccgacctgagcctcgagaaggccgcggaggtgtcctgggaggaggaggccgagcacagcggcgcttcccataacattctagtcgaggtgcaggacgacggcaccatgaagattaaggacgaggaacgggacgacacactgaccattctcctgaaggccaccctgctcgccgtatctggcgtctacccgctatccatccccgcgacactgttcgtttggtacttctggcagaagaagaaacagcgcagcggggtgctctgggacacccccagcccgcccgaagtggaacgcgccgtactggacgatggaatctaccgcatcatgcagcggggcctgctaggccgcagccaggtgggggtcggggtgttccaggagaatgtgttccacactatgtggcacgtaactcggggcgccgtactcatgtaccaaggcaagcgcctggagccctcctgggcgtccgtgaagaaggacctgatctcgtacggaggcggttggaggttgcaagggagctggaatactggcgaggaggtccaggttatcgcggtggagcccggtaagaaccccaagaacgtccagactgcccccgggacgtttaaaacctcagagggcgaggtcggggctatagcgcttgacttcaagcccgggacaagcggtagccccattgtgaaccgcgagggtaagatcgttggactctacgggaacggggtggtgaccacgtcaggaacgtacgtcagcgctatcgcccaggccaaggcgagtcaggaggggcccctaccggagatcgaggatgaggtgtttcggaaacgtaacctgacgataatggatttacaccccggcagcggcaagacccgacgctacctcccggccatcgtgcgcgaagctatcaagcgcaagctgcggaccctcatcctcgcaccgacacgtgtcgtggcatccgaaatggcggaagccttgaagggtatgccgatacgctaccagactacggctgtcaagtctgagcataccggtaaggagattgtcgatctgatgtgccacgccaccttcacgatgcggttgctgtcccccgtgcgcgtacccaactataacatgataatcatggacgaggcccactttacggaccctagctctatagctgcccgggggtatatcagcacccgcgttgggatgggggaggccgcggccatcttcatgactgcgacgccacccggctccgttgaagcctttcctcagtctaatgccgtgatccaggacgaggaacgggacatccccgagcggtcctggaacagcggatacgagtggattaccgacttcccgggtaaaactgtctggtttgttccgagcatcaaatctggtaacgatatcgccaactgtctgcggaagaacggaaaacgagtaatccaactcagtcggaagaccttcgacacggagtatcagaagactaagaacaacgactgggactacgttgtgactaccgacataagcgagatgggcgcgaattttcgtgcggaccgggtgatagacccccgccggtgcctgaagcctgtcatcctgaaagacgggcccgagcgtgtaatccttgccggccccatgcccgtcaccgttgcctcggctgcgcagcggcgcggccggataggccgcaatcacaacaaggagggcgaccagtacatctacatggggcagccgctcaacaacgacgaggaccacgcccactggacagaggccaagatgctgctcgataacattaatacccccgagggcatcatacccgccctgttcgagcccgagagggagaaatctgcggccatcgacggggaataccgcctgcgcggggaggcccggaaaacgttcgtggagctcatgaggcgcggagatctgccggtctggctgtcctacaaggtggcctcggagggcttccaatacagcgatcgccgatggtgcttcgacggcgagcgaaacaaccaagttctggaggagaacatggatgtcgagatctggacgaaagagggggagcggaaaaagctccggccccgatggctggacgccaggacctactctgacccactcgccttacgagagttcaaggagtttgcagccggccgccggagcgtgtccggggacctgatcctagagatcggcaaactgccacagcacctgacccagcgcgcacaaaacgccctagacaatctggtgatgctacacaatagcgagcagggggggcgggcgtaccgccacgctatggaggagttaccggacaccatagagacgctgatgttgctcgccctgatcgctgtcctgaccggaggggtgaccctcttctttctctccggccgcgggttgggtaagacctcgatcggcctcctgtgcgtgatggcttccagcgtcctgctttggatggcgtcagtcgagccccactggatcgccgccagcatcatcctggagttcttcctgatggtcctcttaatccccgaacccgaccgccagagaacaccccaagacaaccagctggcctacgtcgtaatcggactcctattcatgatcctgacggttgccgcgaacgagatgggcctactcgagaccaccaagaaggacctgggcatcggccacgtggccgtggagaaccaccatcacgccgctatgctcgacgtagacttgcaccccgcctccgcgtggacactgtacgccgttgccacaaccatcatcacacccatgatgcgtcacaccatcgagaacacgacggccaatataagcctcaccgcaatcgcgaaccaggccgccatcctgatggggcttgataagggttggcccatatccaagatggacatcggcgtgcccttactagccctggggtgctatagccaggtgaatcccctcaccctgaccgcggccgtcctgatgcttgtggctcactacgccatcattggccccgggctgcaggccaaagcgacccgcgaggcccaaaagagaacagcggccggtatcatgaagaatccgacggtggacggaatcgtcgcaatagacctagaccccgtggtgtacgacgcgaagttcgaaaagcagcttggccagatcatgctgctgatcttatgcacgtcgcaaatccttcttatgcgcaccacgtgggccctctgtgagagcatcaccctggccacgggccccctaaccactctctgggaggggtcccctggtaagttttggaacaccaccatcgccgtaagcatggcaaacattttccgggggagctacctagctggcgccggcctagccttctccctaatgaagtccctcgggggtgggcgccggggtaccggggcccaaggagaaaccctgggcgaaaagtggaagcgccagctaaaccagctgtcaaaatctgagttcaacacctataagcggagcgggattatggaggtggacagatccgaggcgaaggagggattgaagcgcggggaaacgaccaagcacgccgtgtcccgaggtaccgcaaagctccggtggttcgtggagcgcaaccttgtaaagcctgaggggaaagtgatcgacctgggctgcggaaggggcggctggtcctactattgtgccggcctgaagaaggtaaccgaggtgaaggggtacacgaagggcgggcccggccacgaggagcccatccccatggccacctatgggtggaacttggttaagctgcattcaggcaaggacgtcttcttcattccgcccgagaagtgcgatacgctgctctgtgacatcggggagagctcacctaaccccaccatcgaggagggccgcacgcttcgggtgttaaagatggtggagccgtggctccgcggcaaccaattctgcatcaaaatcctgaacccctacatgccttcggttgtagaaacactggagcagatgcagcggaagcacggcggcatgctagtgcgcaatccgctgagccggaacagcacccacgagatgtactgggtctcatgtgggactggcaacatcgtgtcagcagtgaacatgacctccaggatgttactcaaccggttcaccatggctcaccgcaagcctacctacgagcgcgatgtagacctgggggcaggaacccgacatgttgccgtggagcccgaggttgccaacctggacatcatcggacaacgtatcgagaacattaagcacgagcacaaaagcacgtggcattacgacgaagacaacccctacaaaacatgggcgtatcatgggtcttacgaggtcaagccctcagggagcgcctccagcatggtgaatggggttgtgaaactcctgaccaagccgtgggacgtcatccccatggtgacccaaatcgccatgactgacacgaccccctttggtcagcagcgggtgttcaaggagaaggtcgatacgcgaacccccaaggcgaagcggggaacagcccagatcatggaggtaaccgcgaagtggctgtggggtttcctatcccgtaacaagaagccccggatctgcactcgtgaggagttcactcggaaggtgcgcagcaacgccgcaataggagcggtcttcgtggacgagaaccagtggaactccgcgaaagaggcagtggaagacgaacggttctgggacctcgtacatcgcgaacgggagctgcacaagcaagggaagtgcgccacgtgcgtctacaatatgatgggcaagcgcgagaagaagctcggggaatttggcaaagccaagggcagtcgagccatatggtacatgtggctgggcgcccgcttcctggagttcgaggcgctcggttttatgaacgaagaccattggttttcccgagaaaacagcctgtccggggtggaaggagaggggctccacaagctcggctacatcttacgcgacatctcgaagatacccgggggcaacatgtacgccgacgacactgccggctgggatacccggattaccgaggacgacctccagaatgaggctaagatcacggacatcatggagcccgagcacgcgctcctcgccaagtccattttcaaactcacttaccagaacaaagtagtacgcgtccaaaggccggccaagaacgggaccgtcatggatgtgatctcgcgccgagaccagcgggggtccggccaggttggcacctacggcctcaacacgttcacgaatatggaagctcagctgatccgtcaaatggagagcgaagggatcttctcccccagcgagctggagacccctaacctcgcccgacgcgtcctggactggctggagaagcacggcgtggaacggctcaagcggatggctatctcaggggacgactgcgtggtcaagccaatcgacgaccgtttcgccaccgccctgacagccctgaacgacatgggcaaggtgcgtaaggacatcccacaatgggagcccagcaaggggtggaacgattggcagcaagtccccttttgctcacaccacttccatcagctcatcatgaaagacggccgcgaaatagtcgtgccctgccgaaatcaggacgagctggttggtcgggcccgagtaagtcagggggctggctggagcttacgggagacagcctgtctgggtaaatcctacgcacagatgtggcagctgatgtacttccaccgccgggacctgcggctcgccgccaacgccatctgcagcgccgtgccggtcgactgggtccccacctcccggaccacttggagcatccacgcccaccaccagtggatgaccaccgaggacatgctgtccgtgtggaaccgcgtgtggatcgaggagaacccctggatggaggacaagacccacataagctcttggggcgatgtaccctacctggggaagcgggaggaccagtggtgcggctcgctcatcggcctgacggcccgcgcgacctgggccacaaacattcaagtggccatcaaccaggtgaggcggctcatagggaatgagaattacctcgactacatgaccagcatgaagcgcttcaagaacgagtcagatccagagggcgccctgtggtga

SEQ ID NO: 24102 - RNA, 9879 nt, synthetic construct
  misc_feature 1..9879: note = derived and/or modified CDS sequence (opt11) from DENV-1__EU677162__SS-prME
  source 1..9879: mol_type = other RNA
tcggtgaccatgttactcatgttgatgcccaccgccctggctttccacttgacaacgcggggcggggaacctcacatgatcgtgagcaagcaagagcggggcaagtctctgctgttcaagaccagcgccggtgtgaacatgtgcaccctgatcgccatggacctgggggagttctgtgaggataccatgacctataagtgccccagaatcaccgaggccgagcccgacgacgtggactgctggtgcaatgccaccgacacgtgggtgacgtacggtacctgcagccagaccggggagcaccggcgcgacaagcggtcagtcgcactcgcgcctcacgtgggcctcgggctggagacccgcaccgagacctggatgagctccgagggagcctggaagcaaatccagcgcgtggagacatgggcgctccggcaccctgggtttacggtcatcgctctcttcttggcgcatgcgatcgggacaagcattacccagaagggaatcatcttcatcctcctcatgctcgtcaccccctccatggccatgcggtgcgtaggcataggcagccgcgacttcgtggaggggctgtccggagccacatgggtggacgtcgttctcgagcacggcagctgcgtgaccaccatggccaaggacaagcctactctggacatcgagctgttgaagacggaggtcacaaaccccgcggtgctacggaagctgtgtatcgaggccaagatctccaacaccaccacggacagccgctgccccacgcagggagaggccactctagtagaggagcaggacgcgaacttcgtctgcagacgtaccttcgtcgacagaggctgggggaacggatgcgggctgttcggcaaagggtccctgatcacgtgcgctaagttcaagtgcgtgaccaagctcgagggtaaaatcgtacagtatgagaacctgaagtacagtgtgatcgtcaccgtccacaccggcgaccagcaccaagtggggaatgaatcaacagaacacggcaccaccgcgaccatcacgccgcaggctccctcaacggagatacagctgaccgactacggggccttaaccctcgactgcagccctaggaccgggctggacttcaacgagatggtcctcctgacgatgaaggagaaatcctggctggtgcacaagcagtggtttttggacttaccgctgccttggaccagcggggcctccacgagccaggaaacctggaatcggaaggacttgctagtcacattcaagaccgctcacgcgaagaagcaagaggttgtggtcttaggatcccaggagggtgccatgcacaccgccctcaccggggccacggagatccagaccagcggaaccaccacgatctttgccgggcacctgaagtgccggctgaagatggacaagcttacacttaagggcatgagttacgtaatgtgcaccgggagcttcaagctggaaaaggaggtggcggagacccagcacggtacggtgctcgtccagattaagtacgagggaacggatgccccctgcaagatcccgttcagtacacaggacgagaagggtgtgacccagaatggccggctgatcacggccaacccgatcgtgaccgacaaggagaagcccgtcaacatcgaggccgaaccgccattcggggagagctacatagtaatcggcgcgggagagaaggccctgaaactgtcctggttcaagaaggggagctccatcggccggatgttcgaagccaccgcccgcggggcccgcaggatggcgattcttggagatacagcctgggacttcgggtcaatcggaggcgttttcacgtccgtcggcaagttggtccaccaaatattcggcaccgcctacggcgtgctattttcgggcgtctcctggaccatgaagatcgggatcggcgtattgctgacctggctgggcctcaacagccgttccacaagcctgtccatgacctgcatcgccgtggggctggtcaccctttacctgggtgtgatggtgcaggcagacagcgggtgcgtcatcaactggaagggccgcgagctgaagtgcggaagcggcatcttcgtgactaacgaagtacacacttggaccgagcaatacaaattccaggcagacagtccgaaacggctcagcgccgccatcggcaaagcctgggaggagggggtctgcggcatcaggagcgcgacccgtttggagaacattatgtggaagcagatctcaaacgagctgaaccacatcctgctggaaaacgacatgaagttcaccgtggttgtcggggacgtagcgggcattctggcacaggggaagaagatgatccgcccgcaacccatggagtacaaatactcctggaagtcctggggcaaggcgaaaatcattggcgccgacgtgcagaacactacgttcattatagacgggcccaacaccccggaatgccctgacgaccaacgggcgtggaacatctgggaggtcgaggactacggcttcggcatcttcacaaccaacatatggctcaagctcagggactcctacacccaggtgtgtgaccaccggctgatgtcagccgctatcaaagactccaaggccgtgcacgccgacatgggttactggatcgagagcgaaaagaacgagacttggaaactcgcgcgcgcatccttcatagaggtcaagacgtgtatctggcccaagagtcacaccctgtggtcaaatggcgtactcgagagtgagatgatcatcccaaagatctacgggggcccaatctcccaacacaattatcggcctggatacttcacgcaaaccgccggcccctggcacctcggaaagctggaactggacttcgacctgtgcgagggcacgaccgttgtagttgacgagcactgcggtaacagggggcctagcttacgcacgaccactgtcaccggcaagatcatccatgagtggtgctgccggtcttgcacgctgccgcccctacggttcaagggtgaggacggctgctggtacggtatggagatccgcccggtaaaggagaaggaggagaacctggtcaagagtatggtgagcgccggctctggcgaagtcgacagcttctccctggggctcctgtgcatctcaatcatgatcgaggaggtcatgcggtcccgatggagccggaagatgctaatgacggggacactagccgtgttcttcctgttaatcatgggccagttgacctggaacgacctgatcaggctgtgcatcatggtaggcgcgaacgcctccgatcgaatggggatgggcacgacttacctcgccctgatggccaccttcaagatgcggccgatgttcgccgtaggcttgctgttccgccggctgaccagccgcgaagttctgctcctgacgatcgggttatccctggtcgctagtgtggagttgcccaactccctggaggagctcggcgacgggttggccatgggcatcatgatcctgaagctcctgaccgactttcaaagccaccagctttgggccaccctcctaagtctgaccttcattaagacgaccttcagcctccactatgcgtggaagacaatggcgatggtcctgtccatcgtatctctgtttcccctctgcctttccaccacgagccagaagaccacctggctgcccgttctcctgggctccctgggctgcaagccgctgaccatgtttctgatcgccgagaacaaaatctggggtcgcaagagctggccgctgaatgaggggatcatggccgtcggcatcgtgagcatcctcctttcaagcttgttgaagaacgacgtacccctggccgggcccctcatcgccggcggcatgctcatcgcctgctatgtcatctccggaagtagtgccgacctgagcctggagaaggccgccgaggtgagctgggaggaggaggccgagcacagcggtgcttctcacaacatactagttgaggtgcaagacgatgggacgatgaagatcaaagacgaggagagagacgacaccctgaccatcttattgaaagccaccctgctggccgtaagcggagtgtaccccctgtctatccccgcgacgctgttcgtgtggtacttctggcagaagaagaagcagcgcagtggggttctgtgggacacgccgagcccaccggaggttgagcgcgcagtactcgatgacggcatatatcggatcatgcagcgcggcctgttggggcggagccaggtgggcgtgggagtcttccaggagaatgtgttccataccatgtggcacgttacgcgcggcgcggtcctgatgtaccaggggaagcgactcgagcctagttgggccagcgttaaaaaggacctgatatcctacggaggtgggtggcgcctgcagggcagttggaacacgggggaagaggtgcaggtgatcgctgtggagccgggaaagaacccgaaaaacgtacagacggcccccgggactttcaagacctcagagggcgaggtcggcgcgatagcgctggactttaagccgggcacgagcggcagccccatcgtcaaccgggaggggaagattgtggggctctacggcaatggggtcgtgacgaccagtggcacctacgtgagcgccatagcccaggccaaagcttcccaagaggggcccctaccggagatcgaggacgaggtttttcggaagcgaaacttaaccatcatggatctgcatcccggcagcgggaagacgaggcggtacctgcccgcaatcgtccgcgaggcaatcaaacggaagcttcggaccctgatcctggcccccaccagggtggtcgccagtgagatggcggaagctctgaaaggcatgcccattaggtaccagaccacggccgtgaagagcgaacacaccggaaaggagatcgtggatctgatgtgccacgccactttcacgatgagactactctcccccgtccgggtacccaactacaacatgataattatggacgaggcccatttcacggacccgagcagcatcgcggcgcgaggatacataagcaccagagtggggatgggagaggctgccgccatcttcatgaccgcgacgccgcccggctccgtcgaggccttccctcagagcaacgccgtgatccaggacgaagaacgcgatataccggagaggtcctggaacagcgggtacgagtggatcacagacttccccggcaagaccgtgtggttcgtcccatccatcaagagcggcaacgacatcgccaactgcctccgcaagaacgggaagcgggttatccagctttcccgcaagaccttcgataccgagtaccagaagacgaagaacaatgactgggactacgtggtcaccacggatataagcgagatgggggcgaactttcgagccgatagggtgattgaccctcggcgctgcctcaagccggtgatactgaaggacggccccgaacgggtcattctggctggccccatgcccgtaacagtcgcctccgccgcgcagcgccgcgggagaatcggccgaaaccacaacaaggaaggcgaccaatacatttacatgggccagccgctcaacaacgacgaggaccacgcccactggacggaggctaagatgctgctcgacaacatcaatactcctgagggcatcatccctgcactctttgaacctgagcgcgagaagtccgccgcaatcgacggggagtatcgcctacggggggaggcgcgaaagaccttcgtggagctgatgcggcgtggggatctcccggtgtggctgtcttataaagtcgcttccgagggcttccaatacagcgaccgccgctggtgtttcgacggcgagcggaataaccaggtactggaggaaaacatggacgtggagatctggaccaaggagggggagcgaaagaagctccggccccgctggctggacgcgcggacttactccgaccccctggccctacgagagttcaaagagttcgcggcaggccggagatctgtttccggtgacctgatcctggagatcggcaaactccctcaacacctgacccaacgggcccagaacgccctagacaacctcgtgatgttacacaactcggagcagggtgggcgtgcttacagacatgccatggaggagctgccggacacgatagagaccttaatgctgttggccttaatcgccgtgctgacgggcggggtcaccctattcttcctctccggccgcgggctgggtaagacctccatcgggctgttgtgcgtgatggcctccagcgtcttactgtggatggcgtccgtcgagccccactggatcgccgcctcgatcatactcgagttcttcctgatggtactcctcatccctgaacccgatcggcagcgcacgcctcaagacaaccagctggcctacgttgtaatcggcttactgttcatgatcctgaccgtcgccgcgaacgagatgggcctgctcgaaacgaccaaaaaggacctggggatcggccacgtggccgtcgagaaccaccaccatgctgccatgctggacgtggatctccaccctgcatccgcgtggaccctctatgccgtggctaccacgattatcacgcccatgatgcggcacaccatcgagaacaccaccgccaacattagcctaaccgccattgcgaaccaagccgctatcctcatggggctggataagggctggccgatctcgaagatggacatcggcgtccccttacttgccctggggtgctatagccaggtgaaccctctaaccctaaccgcggccgtgctgatgctggtcgcccactacgcgatcattggacccgggctccaagccaaagctacgcgcgaggcccagaagaggaccgctgcgggtatcatgaagaatccgaccgtggatggaatagtggccatcgacctggaccctgtcgtatacgacgcgaagttcgagaagcagctgggccagatcatgcttctgatcctgtgcacctcccagatcctcctgatgcgtacgacctgggctctctgcgagagcatcaccctcgcgaccggtcccctgacgaccctgtgggagggatcccccggcaagttctggaacacgaccatcgcagtgagcatggccaacatctttcgtggtagctacctcgcgggcgccggcttggccttttcgctgatgaagtccttaggtggggggcggcgcggcacgggggcccagggcgagaccctgggcgagaagtggaagcggcagctgaaccagctctcaaaaagcgagttcaacacgtataagcgctctggaatcatggaggtcgatcgtagcgaggcgaaggagggcttgaagcgcggggagaccacgaagcacgccgtatcccgtggtaccgccaagttgcgctggttcgtggagcggaacctagtcaaaccggaggggaaggtaatcgacctgggctgcggccgagggggatggagctactactgcgccgggctgaaaaaagtaaccgaggtcaagggctacaccaagggcgggcccggccatgaggagcccatccccatggccacgtacgggtggaaccttgttaagctccactccggcaaggacgtgttctttataccgcccgaaaagtgcgacaccctgctgtgcgacatcggggagagctcaccaaatcccaccatcgaggagggacggaccctccgcgtcctcaagatggtggagccgtggctgcggggtaaccagttctgcatcaagatcctcaacccctacatgcccagcgtggtcgagacgctggagcagatgcagcgcaagcacggcggcatgctcgtgcggaacccactctcccgcaacagcacccacgagatgtactgggtgtcctgcggcaccggcaacatcgttagcgcggtgaatatgaccagccggatgctactgaaccgcttcaccatggcacaccggaaacccacgtacgagcgagacgtagacctcggggccggcacccgccacgtagccgtggagcccgaagtggccaatcttgatatcatcggccaacggatcgagaacatcaaacacgaacacaagagcacctggcactacgacgaagacaatccctacaagacgtgggcgtaccacgggtcctacgaggtaaagccttctggcagcgcctcgagcatggtcaacggggtcgtgaagctgctcacgaagccctgggacgtaattccgatggtcacccagatcgccatgaccgataccacgcccttcggccagcagcgcgtatttaaggagaaggtcgacacccggacccccaaggccaagcgcggaaccgcccagatcatggaggtcacggcgaagtggttgtggggattcctctcccggaacaaaaaaccgcgtatctgcacccgggaggagttcacgcgcaaggtgcggagcaacgccgccatcggggctgtattcgttgacgagaaccagtggaattccgcgaaagaggccgtggaggacgagcgcttctgggatctcgtgcaccgggagcgcgaactgcacaaacaagggaaatgtgccacctgcgtatacaacatgatgggcaagcgtgagaagaaactgggcgagttcggcaaagccaaggggagccgcgccatatggtacatgtggctaggagcacggttcctggagttcgaggccctgggcttcatgaacgaggaccactggttctcccgcgagaactcgctgtccggggtggagggcgagggcctccacaagctgggctacatcctccgggacatcagcaagattcccggaggcaacatgtacgccgacgacacggccggctgggatacacgcataaccgaagatgacctgcagaacgaggcaaagattaccgacatcatggaacctgagcacgccctgttagcgaagtccatattcaaactgacgtaccaaaacaaggtggtccgggtacagcgcccggccaagaacggcaccgtaatggacgtcatctcacgccgggaccagcgcggctccggccaggtgggaacgtacggcttgaacaccttcacaaacatggaggcacaattaatccggcaaatggaaagcgagggcatcttctccccgagcgagctggagacccccaacttagcaggccgcgtgctcgactggctggagaagcacggggtcgagcggctgaagcgaatggcgatctccggcgatgactgcgtggtgaagcccatcgacgaccggttcgccactgccctcaccgccctgaacgacatggggaaggtccgcaaggatatcccgcagtgggagcccagcaagggttggaacgattggcaacaggtacccttctgcagccaccacttccatcagctgatcatgaaggatggccgtgagatcgtggtcccctgccgcaaccaggacgaacttgtgggccgggcacgcgtgagtcagggcgcgggctggagcctacgggaaacggcttgccttggcaagtcctacgctcaaatgtggcagctcatgtacttccaccgccgggacttgcgcctggccgctaacgccatctgcagcgccgtcccggtggactgggtgcccacctcccggaccacatggagcatccacgcccaccaccagtggatgacgacagaggacatgctctccgtctggaaccgggtgtggattgaggagaacccctggatggaggacaagacccacattagctcttggggcgacgtgccctacctgggaaagcgggaagaccagtggtgcggctctctgatcgggttaaccgcccgcgcaacgtgggccaccaatatacaggtcgccatcaaccaggtgcgcaggctgatcggcaatgagaattacctggactacatgacgtccatgaagcgcttcaagaacgagagcgacccggagggggccctctggtga

SEQ ID NO: 24103 - RNA, 9879 nt, synthetic construct
  misc_feature 1..9879: note = derived and/or modified CDS sequence (opt11) from DENV-1__EU677164__SS-prME
  source 1..9879: mol_type = other RNA
agcgtgaccatgctgctcatgctgatgcccaccgctcttgcgttccacctcacaacccggggcggggagccccacatgatcgtgagcaaacaggagcggggtaaaagcctgttatttaaaacgtcagccggggtgaacatgtgcaccttaatcgccatggacctgggcgagttctgcgaggacaccatgacttacaaatgtcccaggatcaccgaggccgagcccgacgacgtggactgttggtgtaacgccaccgacacgtgggtgacatacgggacctgcagccagacaggtgagcatcggcgggacaaacggtccgtggccctggcgccccacgtgggactcgggctcgagacgcggacagagacctggatgtcatccgagggggcatggaagcagatccagcgggtggagacctgggccctgcgacaccccgggttcacggtgatcgcactctttcttgcgcacgcaatcggcacctcgatcacacagaaggggatcatcttcatcttactcatgctggttacaccttccatggcgatgcggtgcgtcggtatcggaagcagagacttcgtggagggtctgtctggcgcaacgtgggtggacgtcgttctcgaacacgggagctgcgtgaccaccatggccaaggacaagcccaccctggacatagaactactgaagacggaggtcaccaatcccgccgtgctgcggaaattatgcatcgaagccaagatcagcaataccacaacggatagccgctgcccgacccagggcgaagccaccttggtggaggagcaggacgccaacttcgtctgccgtcgcaccttcgtggaccggggctgggggaatggttgcggactgttcggcaaggggtccctgatcacctgcgccaagttcaaatgcgttaccaagctggagggcaagaccgtccaatatgaaaacctgaagtatagcgtaatcgtgaccgtccacactggcgaccagcaccaagttgggaacgagtccaccgagcacggcaccaccgcaacgatcactccccaggccccctccacggaaatacaacttaccgattacggcgctctcactcttgattgcagcccccgcacaggcctggactttaacgagatggtcctcctgaccatgaaggagaagagctggctggtgcacaagcagtggttcctggacctgccgcttccatggacctccggggcctccaccagccaggagacgtggaaccggaaagacttgctggtgaccttcaagacagcccacgcgaagaagcaggaagtcgtggtgctgggatcacaggagggcgccatgcacaccgccctcactggggccaccgaaatacagacgagcggcacgaccacgattttcgctggacacctgaagtgccgattgaagatggataaattgacccttaagggtatgtcctacgttatgtgcacagggtcttttaagctggagaaggaggtggcggagacgcagcacggcaccgtgctcgtccaaatcaaatacgaaggcacagacgccccctgcaagatcccctttagtacccaagacgagaagggggtgacgcagaacgggcggctaatcaccgctaaccccatcgtgaccgacaaggaaaaacccgtcaacatcgaggccgaaccgcccttcggggagagctacatcgtgatcggcgcgggcgaaaaggccctgaagctgtcttggttcaaaaaggggagctccatcggcaaaatgtttgaggcaaccgcgcgcggcgcccggcgcatcgcgatcttaggcgacaccgcctgggacttcggcagcatcggcggcgttttcacatcagtcggcaagctggtacaccagattttcggcactgcctacggggtgctgttttcaggcgtaagttggaccatgaagatcggtatcggggtgctcctgacatggctgggcctcaacagccgctccacatccctctccatgacatgcattgccgtggggctggtgaccctatacctgggcgtgatggtacaggccgattccggctgcgtgatcaactggaagggtcgggagctgaagtgcgggagcggcattttcgtgacgaacgaagtgcacacctggaccgagcagtataagttccaggcggactccccgaaacgcttatcagccgccatcggcaaagcctgggaagagggggtctgcggcatccgtagcgccacccgcctggagaacatcatgtggaagcagataagcaacgagttaaaccacatattattggagaacgacatgaagttcaccgtggtggtcggcgacgtggcgggcatcctggcccaggggaagaagatgatccggccccagcccatggagtacaagtactcgtggaagagttggggcaaggccaaaatcatcggagccgacgtgcagaatacgaccttcatcatcgacgggcccaacacaccagagtgtcctgacgaccagcgagcgtggaacatctgggaggtcgaggactacggcttcgggatcttcacgacgaatatctggctcaagctgcgcgactcctacacgcaggtgtgtgaccacagactgatgagcgccgccatcaaggactccaaggccgtccatgccgacatgggctactggatagaatcagagaaaaacgagacctggaagctcgcgagggcttccttcatcgaggtcaagacatgcatctggcccaaatcacacacgctatggtccaacggggttctggagagcgagatgatcatcccgaagaactatgggggccctatctcccagcacaactaccgccccgggtacttcacccaaaccgccggcccgtggcacctcgggaaattggagctggacttcgacctctgcgagggcaccacggtagtagtggacgagcactgcggcaatcgggggccgagcctgcgcaccaccacggtcacgggcaagattattcatgagtggtgctgccgttcctgcaccctgccgccactacgcttcaagggagaagacggctgctggtacggaatggagatccggcccgtcaaggagaaggaggagaacctagtcaagagcatggtgtcagctggctccggcgaggtcgacagcttctccctggggctcctgtgcatcagtatcatgatcgaagaggtgatgcgctctagatggtcaagaaagatgctgatgacaggcacactcgccgtgctgttcttactcattatggggcaactgacatggaacgatctgatccggctctgcatcatggtaggcgcgaacgcctccgaccgcatggggatggggaccacctacctggccctgatggccaccttcaagatgcgcccgatgttcgccgtgggcctactgtttcggcgcctgacgtcgcgggaggtgttactactgacgatcgggctctccctggtcgcgagcgtggagctgcccaactccctcgaggaactgggcgacgggctggccatgggaatcatgattctcaaattgctgaccgatttccagtcacatcagctctgggccaccctgctgtccctcacgttcataaagacaaccttcagcctgcactatgcctggaagaccatggcgatggtcctgtccattgtgagcctcttccccctgtgcctgtccactactagccagaaaaccacctggctccccgtgttactaggcagtttagggtgcaaaccgctcacgatgttcctgatagccgagaacaagatatggggtcgaaagtcgtggcccctcaacgaggggatcatggccgtcggcatagtgagcatcctgttgagtagcctcctgaagaatgacgtgcctctggccggccccctcatagccggcggcatgctgatcgcttgctacgtcatcagtgggagctccgcagacctgagccttgagaaggccgccgaagtctcctgggaggaggaggccgagcacagcggcgcgtcccacaacatcctggttgaggtccaggacgatggtaccatgaagatcaaagacgaggaacgggacgacacgttgactaccctactgaaggcaacgctactcgcggtgtcgggcgtgtaccctctgtccatacccgcgaccctgttcgtctggtacttctggcagaagaaaaagcagcgtagtggggtgctctgggacaccccgagcccgccggaagtagagcgggccgtcctggacgacggtatataccgcatcatgcagcggggccttctggggcgcagccaggtcggcgtgggggtcttccaggagaacgtgttccacacgatgtggcacgtgacgcggggcgccgtcctcatgtaccaagggaagagactcgagccttcctgggccagcgtgaagaaagacctaatatcctatggcggcggctggcgcctacaggggagctggaacaccggggaagaggtgcaggtcatcgccgtggagcccggtaagaacccaaagaacgttcaaaccgccccggggaccttcaagacgtccgagggtgaggttggagccatcgcattggacttcaaacccgggaccagcgggagtccaatcgtgaaccgcgagggaaagattgtgggactgtacggaaacggggtggtgaccacctccggcacctacgtgagcgccatcgcgcaggccaaagcctcacaggaggggcccctcccggagatcgaagatgaggtctttcggaagcgcaacctgaccatcatggacctgcaccccgggtcagggaagacccggcgctacctgcctgccatcgttcgtgaggccatcaaacgcaagctgcggaccctgatcctcgccccgacgagggtagtcgcctcggagatggcggaggccctgaaaggaatgcctatccgttaccagaccaccgccgtcaaaagcgaacacaccggaaaggaaatcgtagacctgatgtgccacgccacgttcaccatgcggctcctgtcccccgttcgcgtgccaaactacaacatgatcatcatggacgaggcccacttcaccgatccgtcatccatcgcggcccgagggtacatcagtacacgcgtgggcatgggggaagccgccgcgatattcatgaccgcgacaccccccggctccgtcgaggcctttcctcagtcaaacgccgtgatacaagatgaggaacgggacatcccggagaggtcctggaacagcgggtatgaatggatcacagatttccccggcaagaccgtatggttcgttccatccatcaagagcggaaacgacatcgcaaactgcctgcggaagaacgggaagcgcgtgatccagctctcccggaagacgttcgacaccgagtaccagaagaccaagaacaacgactgggattacgtggtaacaacggacataagcgagatgggagcgaacttccgcgccgaccgtgtgattgacccccgccggtgcctgaagccggtcatcctgaaggacgggccggagcgcgttatcctcgccggcccgatgcccgtgacggtcgccagtgccgcgcagcgaagggggcggataggccgcaaccataacaaggagggagaccagtacatctacatgggacagccgttgaacaatgacgaggaccatgcgcactggacagaagccaagatgctgctcgacaacattaatacccccgagggcattatccccgccctgttcgagcccgagcgggaaaagtccgccgcgatcgatggggaatataggctgcgtggcgaggcccggaagacgttcgtggagctcatgagacggggggatctgcctgtctggctatcatacaaggttgcctccgagggcttccagtatagtgaccgccggtggtgcttcgacggcgaacgcaacaaccaggtactcgaagagaacatggatgtggagatttggacaaaggagggggagcggaagaagctacgcccgcggtggctagacgcccgcacctactccgaccccctcgccctgcgcgagttcaaggagttcgcggccggacgccggagcgtctccggggacctgatcctcgaaatcggcaagctgccccagcacttaacccagcgcgcccagaacgcccttgataatctggtgatgctgcacaacagcgagcagggagggcgtgcgtaccgtcacgccatggaggagctaccggatacgatcgagaccctgatgttgctagccctgattgccgtgctgaccggcggagtcaccttattcttcctgtctggccgaggactgggcaagaccagcatcggcctcctgtgtgttatggcctccagcgtgctgctatggatggcgtccgtcgagccccactggatcgcagcctcgatcatcttagagttctttctcatggtgctcctgataccagagcccgatcgacaacggacgccgcaggacaatcagcttgcctatgtggttatcggtctcctgttcatgatcctgaccgtggccgcgaatgagatgggcctactggagacaaccaagaaggatctcgggatcggccacgtggccgtagagaaccatcaccacgccgctatgctcgacgtggatctgcaccccgcctccgcgtggacgctgtacgccgtggccacgaccatcatcacccccatgatgcgccacacaatagaaaacaccaccgccaatatcagcctcaccgcaatcgccaaccaggccgccatccttatggggctcgacaagggctggccgatttccaagatggatatcggcgtacccctcctggcgctggggtgttacagtcaggtaaaccccctcaccctgaccgcggcggtgctgatgctcgtcgcccactacgccatcatcggccccgggctccaggccaaggcaaccagggaggcccaaaagcgcacggccgccggcattatgaaaaacccgactgtggacggcatcgtggccatcgacctcgacccggtggtgtatgacgcgaagttcgagaagcagctcgggcagataatgctgctgatcctctgcacctcccaaatcctactgatgcgcaccacctgggcactctgcgagagcatcacgttagccacaggccccctgacaaccctctgggaggggtcccccgggaagttttggaatacgaccatcgccgtgagcatggccaatatctttcgggggagctacctggcgggcgcaggtctggccttctccctcatgaagtccctaggaggcggcaggcgggggaccggagcccaaggcgagaccttgggcgagaagtggaaacgccaactcaaccagttgagcaagtcggagttcaatacctacaaacggtcggggataatggaggtcgatcgctcagaggcgaaggagggcttaaagcgcggggagaccaccaagcatgccgtgtcgcgcggcaccgccaagctccgttggtttgtagagcgcaacctcgtaaagccggaggggaaggtgatcgacctgggctgcggacgcggcgggtggagctactactgtgccgggttgaagaaggtaacggaagtaaaggggtacaccaaggggggccccggccatgaagagccgatcccgatggctacctatgggtggaacctcgtgaagctgcacagtggcaaagacgtgttcttcatcccgccggagaagtgcgacaccctgctctgtgacatcggggagagcagccccaatccgacgatagaggagggccgcaccttacgggtactcaagatggtggagccatggttacgcgggaaccagttctgcataaaaatcctgaacccctacatgcccagcgttgtcgagaccttagagcagatgcaacggaagcacggcggcatgctcgttcgcaacccactgtcccggaacagcacccatgagatgtactgggtgtcctgcggaaccggtaacatcgttagtgcggtgaacatgacgtcccgcatgttgctcaaccgtttcaccatggcccaccgcaaaccgacttacgagcgagacgtagacttaggagcgggcacccgccacgtcgcagtggagccagaggtggcaaacctggacatcatcggtcagcgcatcgagaatatcaagcatgagcacaagtcaacgtggcactatgacgaagacaacccctacaagacctgggcatatcacgggtcctacgaggtgaaacccagtggcagcgcctcctctatggtaaatggggtagtcaagctcctgaccaagccgtgggatgtgatacccatggtcacgcagatcgccatgaccgatactacccccttcggccagcaacgggttttcaaagagaaggtggacacccgcacgcccaaggccaaacgggggaccgcccaaatcatggaggtcaccgcgaagtggttatggggcttcctctcacgcaacaagaagccgcggatctgcacccgcgaggaattcacgcggaaggtgcgtagcaatgccgccatcggcgccgtgttcgtcgacgagaaccagtggaactcagcgaaggaggcagttgaggacgagcgtttctgggacttggtgcaccgcgagcgggagctccataagcaggggaaatgcgcgacgtgcgtctacaacatgatgggcaagcgcgagaagaaactcggggagttcggcaaagccaaggggagccgtgccatctggtacatgtggctgggcgctcgcttcttagagttcgaggctctcggattcatgaacgaggaccactggttctcccgtgaaaacagcctgtctggggtggagggcgaggggcttcacaagctggggtacattttacgcgacatctctaagattccggggggtaacatgtacgccgacgacacagccggctgggacacacggatcacggaggacgacctgcagaacgaggccaagatcacagacatcatggagccagagcacgcgctcctagccaaatcaatcttcaagctgacctaccaaaataaggtcgtcagagtgcagagaccggctaaaaacggtaccgtaatggacgtcatcagtcgccgcgaccagcgtggatccggacaagtgggcacatacggactcaacacttttaccaacatggaggctcagctgatacgccagatggagagcgaggggattttctcccccagtgagctggagacccccaacctcgccggcagagtgctggactggttggaaaagcacggggtcgagcgcctcaagagaatggcaatctccggggacgactgcgtagttaagcctatcgacgaccggtttgctactgccttgactgccttaaacgacatggggaaggtccggaaagacatcccccagtgggagccgagcaagggatggaacgactggcagcaggtgcccttctgcagccaccacttccaccaactcatcatgaaggacgggcgcgagatcgtcgtaccctgccgcaaccaggatgagttggtggggcgtgcccgggtgtcccagggtgcaggatggagcctgcgcgagactgcctgcctcggtaagtcttatgcccagatgtggcagctgatgtacttccatcggcgcgatctgcggttagccgcaaacgccatatgtagcgcggtcccggtggactgggtgcccacctcccgtacgacctggagtattcacgcccaccaccagtggatgaccaccgaggacatgctgtccgtctggaaccgagtctggatcgaggaaaacccctggatggaagacaagacacacatcagctcgtggggagacgtgccctacctggggaagcgcgaggaccagtggtgcggcagcctaatcgggcttaccgcgcgggcgacgtgggccactaacatccaagtcgccatcaaccaggtgcgcaggctgatcggcaacgagaactacctcgactacatgacctccatgaagagattcaagaacgagagcgaccctgagggcgctctgtggtga

SEQ ID NO: 24104 - RNA, 9879 nt, synthetic construct
  misc_feature 1..9879: note = derived and/or modified CDS sequence (opt11) from DENV-1__EU677165__SS-prME
  source 1..9879: mol_type = other RNA
agcgtgaccatgctgctcatgctaatgcccaccgcgctggccttccatctcactacccggggtggtgagccgcacatgatcgttagcaaacaggagcggggcaagtcactgctgttcaagacctcggccggggtgaacatgtgcacgctcatcgccatggacttaggcgaactgtgcgaggacaccataacctacaagtgcccacgcatcaccgagaccgaacccgacgacgttgactgctggtgtaacgccactgacacctgggtcacctacgggacatgcagtcaaaccggcgagcaccggcgcgacaagcggtccgtggccctcgcgcctcacgtgggcctggggctggagacccgcaccgagacctggatgtcgtcagagggcgcctggaagcagatccagagagtagagacgtgggctttacgccaccccgggttcaccgtgatcgccctgttcctggcacacgcgatcggcaccagcatcactcagaaagggatcatcttcatcctcctaatgttagccactccctccatggcgatgaggtgcgtgggcatcggaagccgcgactttgtcgaggggctctcaggcgccacctgggtggacgtggtgctggagcacggaagctgtgtgaccacaatggccaaggacaaacccacactggacatcgagctcctgaagaccgaggtaaccaaccccgcggtcttacggaaactctgcatcgaggccaagatttccaacactacgaccgactccagatgcccgacgcagggcgaagccactctggttgaagaacaagacgccaacttcgtgtgcagacggacgttcgtcgaccgcggctgggggaacggatgcgggctgttcggcaagggctccctcatcacttgcgccaagttcaagtgtgtgacaaaactggagggcaagatcgtacagtatgagaacttgaagtacagcgtcatcgtgaccgtgcatacgggtgaccaacaccaggtcgggaacgagtccacggagcacggcaccactgcgaccatcacgccccaggctcccaccaccgagatccagctcaccgactatggagcccttacccttgactgctcccctcgcaccgggttagacttcaacgagatggtgttgctgaccatgaaggagaaatcctggctcgtccacaagcagtggttcctggacctgcccctcccctggacttccggcgccagcacttcccaggaaacgtggaaccgacaggacttgctggtcactttcaagaccgcccacgcgaaaaagcaggaagtcgtcgtgctcggcagccaggagggcgctatgcacacggcgctgaccggggcgacggagatccagacctccggcacgaccaccatctttgccgggcacctgaagtgccggctcaagatggacaaactgaccctgcgtggcatgagctacgtgatgtgcacgggaagtttcaagctcgagaaggaggtcgcagagacccaacacggcacggtgctggtgcagatcaagtatgagggaaccgacgccccctgtaagatccccttcagcacgcaggacgaaaagggggtcacccagaacggccgcctgatcaccgccaaccccatcgtgactgataaggaaaaacccgtgaacatagaggccgagccacccttcggggaatcctatattgtaatcggcgcgggcgagaaggccctgaagctaagctggttcaagaaggggagctcgatcggcaagatgttcgaggccacggccagaggggcacgccgtatggcaattcttggcgacactgcgtgggacttcgggtcgattggcggggtgttcacctcggtgggtaagttggtccatcaaatcttcgggacggcttatggggtgctcttctccggcgtgtcctggacgatgaagatcggtataggcgtcttgctgacctggctgggcctaaactcgcggagcacctccctgtcaatgacctgcatcgcggtcggactcgtgacgctgtacctgggcgtcatggtgcaggctgattccgggtgtgtgataaactggaagggtcgcgagctcaagtgcggctctggcatctttgtcaccaacgaggtacacacctggaccgagcagtataagttccaggcggatagtccgaagcggctgtccgccgccatcggtaaggcctgggaggagggggtctgcggcatccgcagcgccacgcggctggaaaacatcatgtggaaacagatatccaacgagctcaaccacatcctgctcgaaaacgacatgaagtttacggtcgtggtgggggacgtcgcgggaatcctcgcccaagggaagaagatgatccgcccccagcccatggaacacaagtactcatggaagtcctggggcaaggccaagattatcggtgccgacgttcagaataccaccttcataatagacgggcccaataccccggagtgccccgacgaccagcgtgcatggaacatctgggaagtggaggactacggcttcgggatcttcacgaccaacatctggctgaaactgcgcgacagctacacccaggtgtgcgatcacaggctcatgagcgccgccatcaaggacagcaaagccgtgcacgcagacatgggctactggatcgagagtgagaagaacgagacttggaagctggcgcgcgccagtttcatcgaggtgaagacgtgcatctggcccaaatcccacaccttgtggagcaacggagtcctggagtccgaaatgatcatacccaaaatctacggggggccgatctcgcagcacaactatagacccggttacttcacccagaccgccggcccctggcacctggggaaactggagctcgactttgacctatgcgagggcactaccgtggtggtcgatgagcactgcggcaaccgcgggccatccctgcggactacaactgtgaccggcaaaatcatccacgagtggtgctgccgcagctgcaccctgccgccgctccggttccgcggggaggacggctgctggtacgggatggagatccggcccgtgaaggagaaagaggagaacctcgtaaagtcaatggtgagcgcaggctccggtgaggtggactccttctcactcgggttgctatgcatctccatcatgatcgaggaagtcatgcgcagccggtggtcccggaagatgttgatgaccggcacgctggccgtgttcttcctgctcatcatgggccagttgacctggaacgacttaatcaggctctgtatcatggtgggcgcaaacgccagcgatcggatgggaatgggcaccacctacctagccctgatggccactttcaaaatgcggcccatgttcgcagtcggcctcctattccggcgactgacatcccgggaggtgctcctgctgacaatcgggctctcactggtggcatccgtcgagctgcccaatagcctcgaagagctgggcgacggtctggccatgggaatcatgatcttgaaactgctgaccgactttcaatcccaccagctatgggccaccctgctaagcctcaccttcatcaagaccaccttctccctccattacgcctggaagacgatggcgatggttctgtcaattgtctccctcttcccattatgcttaagcaccacctcccaaaagaccacgtggcttcccgtgctgctgggcagcctcgggtgcaagccgctgaccatgttcctgatcgctgagaacaagatctggggccgcagatcctggcccctcaacgaaggaatcatggcagtgggcatcgtcagcatcctgctgagctccctcctgaagaacgacgtgcccctggccggccccctgattgctggcggcatgttgatagcgtgctacgtgatcagcggatcgagcgccgatctgagcctcgagaaagcagccgaggtcagctgggaggaggaagccgagcactccggcgcgtcccataacatactggtggaggtccaggatgacgggaccatgaagatcaaggacgaagagcgggacgataccttaaccatcttgctgaaggccacgctcttggcagtctccggcgtttatccgctgagcataccagccaccctgttcgtgtggtatttctggcaaaagaagaagcagcggtccggtgtcctctgggacaccccgagcccgcccgaggtggaacgtgcagtacttgacgatggcatctatcggataatgcagcgcggactacttgggcgatcacaggttggggtgggcgtgttccaggagaacgtcttccacaccatgtggcacgtgacgagaggcgccgtgctcatgtaccaggggaagagactggaacccagctgggcatccgtcaagaaggacctcatatcttacggcggcgggtggcgcctgcagggttcgtggaacaccggggaggaggtccaggtgatcgccgtcgagcccggcaagaaccctaagaacgtgcaaactgccccgggtactttcaagactcccgagggcgaggtgggcgccatcgcgttggactttaaacccggaacctccggctcgcccattgtaaacagagagggtaaaatcgttggcctgtacggcaacggagtggtcaccacctcaggcacgtacgtgagcgccatagcgcaggccaaggcgtcgcaggaggggccgctccccgaaatcgaagatgaagtgttccgcaagcgtaatctgaccatcatggacctgcaccccggcagcgggaagacgcgtcggtacttgccggctatcgtccgcgaggcaatcaagcgcaagctgcgaacgctgatactcgcccccacgcgcgtggttgcatccgagatggctgaggccctgaaaggcatgcccatccggtaccagacaactgccgtcaagagcgagcacacgggtaaggagatagtggacctcatgtgccacgctacgttcaccatgcgattgctgtcccccgtgcgggtcccgaactacaacatgatcatcatggacgaggctcacttcaccgatcccagttcgatcgcagcccgcgggtacatatctacccgcgtgggcatgggcgaggccgccgccatcttcatgaccgcgacgccgcccggctccgtggaggccttcccgcagtccaacgcagttatccaggacgaggagcgcgacatcccggaacggtcgtggaactcagggtacgagtggatcaccgactttcccggcaagacagtatggttcgtcccaagcatcaagagcggaaacgatatcgccaactgtctgcgcaagaacgggaaacgggtgatacagctctcacgcaagacgttcgataccgagtaccagaaaaccaagaacaatgattgggactacgtggtgacaacggacatcagcgagatgggggcgaacttcagggccgaccgcgtgatcgacccgcgtcgctgcctgaagcccgtgatcctgaaggacgggccagagcgggtgatcctcgctggccccatgcctgtcaccgtggcctcggccgctcagcgaagggggcgcatcggaaggaaccacaataaggaaggagaccagtacatatatatggggcagcccctgaacaacgatgaggaccacgcccactggacagaggccaagatgctgttggacaacatcaacaccccagagggcatcattcccgccctgttcgagccggagagagaaaagtccgcagccatagacggcgagtaccgcctacggggcgaggcccgcaagacgttcgtggaactcatgcggcgaggggacctgcccgtctggttaagttataaggttgcctcagagggatttcaatacagcgaccggcgctggtgcttcgacggcgaacggaacaaccaggtcctagaggagaacatggacgtggagatctggacaaaagagggagagcgtaagaagctgcggccaagatggctggacgcacggacctactcggaccccttagctttgcgcgaattcaaggaattcgcggcgggcaggcgcagcgtgtccggggatctgatcctcgagatcggtaagctgccgcagcacttgacccaacgggcccagaatgcccttgataacctggtgatgctgcacaacagcgaacagggagggcgagcctaccggcacgccatggaggagctacccgatacgatagaaaccctgatgctgctcgccttgatcgccgtgctgaccggcggggtgaccctcttctttctgagtggccgcgggctgggcaaaaccagcatcggcctgctatgtgtcatggcctccagcgtgctgctctggatggcgagcgtggagccccactggatcgccgcctccatcatcttagagtttttcctgatggtcctcctgattcccgaacctgatcggcagaggacgcctcaggacaaccagttggcctacgtggtgatcgggctgttattcatgatcctgacagtcgccgcgaacgaaatgggactcctggagaccaccaagaaggatctggggatcggccacgtggccgtggagaatcaccaccacgccgccatgctcgatgtcgatctgcaccccgccagtgcgtggacactgtacgccgtagctaccacgatcatcacaccgatgatgcgccacacgatcgaaaataccaccgccaatatcagcctcaccgccatcgcgaatcaggcagcaattctgatggggctggataagggctggcccatctccaagatggacatcggcgtgcccttactggccctgggatgctactctcaggtcaaccccctcacccttaccgcggccgtgctgatgttggtggcgcactacgccatcattggtcctggactacaggccaaggcgacccgggaagcccagaaacgcacagccgccggcatcatgaagaaccccacggtcgacggcatcgtagcaatagatttggaccccgtagtgtacgacgcgaagttcgagaagcagctcggccagatcatgttgctgatcttgtgcacctcgcagatcttacttatgcggaccacctgggccctctgcgaaagcatcactctggccaccggaccccttaccaccctctgggaagggtccccgggcaagttttggaacacaaccatcgccgtgagcatggccaatatcttccgtgggtcctacctggcgggcgccggcctcgccttctcgctcatgaagtccttgggcggcgggcggagggggaccggagcccagggcgagaccctcggcgagaagtggaagcggcagctcaaccagctatccaagagcgagttcaacacttataagcgctccggtatcatggaggtagaccgaagcgaggcaaaagagggcctcaaacgcggggagaccaccaagcacgcagtctcccggggcaccgccaagctccgctggttcgtggagcggaacctggttaagcccgaggggaaagttattgacctggggtgcggccgcgggggatggagctactactgcgccggtctgaagaaagtaacggaggtcaagggttataccaagggcgggccaggccatgaagagcccattccgatggccacctatgggtggaacctcgtcaagctgcacagcggcaaggacgtgttcttcatacctcccgagaagtgcgacaccctgctatgcgacataggggaaagctcccccaacccgacgatcgaagagggccggaccctgcgcgtgctgaagatggtcgagccttggctccgggggaaccagttctgcatcaagatcctgaacccctacatgcccagcgtggtggagactctggagcagatgcagcgcaagcatgggggcatgttggttcggaacccgttgagccgcaactccacccacgagatgtactgggtttcctgcggtaccggcaacatcgtaagcgcggtaaacatgacgtcccgcatgcttttgaatcggttcaccatggctcatagaaagcctacctatgagcgggacgtggacctgggggccggcacccgacacgttgccgtcgagcctgaggtggccaatctggacatcatcggccaaaggatagagaacatcaagcacgagcacaagagcacgtggcattatgacgaagataacccatacaagacctgggcgtaccacgggtcctacgaggtcaagccgagcggctccgcctcaagcatggtcaacggggtggtcaagctcctgactaagccttgggatgtgatcccgatggtcacccagatcgccatgacggacaccacccccttcggacagcagcgcgttttcaaagagaaggtcgacacccggacgccgaaagctaagcgggggaccgcccagatcatggaggttacagcgaagtggctgtggggcttccttgcccgcaacaagaagcctcgaatttgcacccgggaggagtttacgcgcaaggtacggtccaacgccgccatcggcgcggtgttcgtagacgagaaccaatggaacagtgccaaggaagcagtcgaagacgaacgcttctgggacttagtgcaccgggaacgcgagctgcacaagcaggggaaatgcgctacctgcgtgtataacatgatgggcaagcgggagaagaagcttggtgagttcggcaaggccaaagggagtcgcgcgatctggtatatgtggctgggtgcccggttcttggagttcgaggccctaggcttcatgaacgaggaccactggttcagccgtgaaaactccctgtccggtgttgagggcgaggggctacacaagctcggctacatcctccgggacatctccaagatccccgggggcaacatgtacgccgacgacaccgcaggctgggacacccgtatcacggaagacgacctgcagaacgaggcgcgcatcaccgacattatggaaccggagcacgccctactagctaagagcatcttcaagctaacctaccagaacaaagtggtgagggtccagcgccccgccaagaacgggaccgtgatggacgtgatttcccggcgtgaccagcggggcagcggacaggttggaacctacggactcaacacattcaccaacatggaagcccagctgatccgccagatggagagcgagggcattttctcgccttccgagctggaaacccccaatctcgcggagcgcgtgctggactggctggagaagtacggcgttgagcgtttaaagaggatggcgatctctggggacgactgtgtagtgaagccgatagacgaccgcttcgccacggccctgacggccctgaacgacatggggaaggtacgtaaggatatcccacagtgggagccctccaagggctggaatgattggcagcaggtacccttttgcagccatcacttccatcagctcatcatgaaggacgggagggagatcgtggtcccctgccgaaaccaagatgagctggtcggccgcgcacgggtgtcgcagggggcgggctggtcgctgagagagactgcttgcctcggcaagtcctacgcccagatgtggcagctgatgtatttccatcgccgtgacttacggctcgcggcaaacgccatctgcagcgccgtacccgtcgactggatccccaccagccgcacgacctggtccatccatgcccaccaccaatggatgaccaccgaggatatgctgagcgtgtggaacagagtatggattgaggagaacccctggatggaggataagacccacatctccagctggggcgatgtcccctaccttggaaagcgggaggaccagtggtgcggctccttgatcgggctgaccgcccgcgccacctgggccaccaacatccaggtggcgatcaaccaggttcgacgcctgatcgggaatgaaaactacctggactacatgacgagcatgaaacgattcaaaaacgaatccgaccctgagggcgccctctggtga

SEQ ID NO: 24105 - RNA, 9879 nt, synthetic construct
  misc_feature 1..9879: note = derived and/or modified CDS sequence (opt11) from DENV-1__EU677140__SS-prME
  source 1..9879: mol_type = other RNA
tccgtgacaatgctgctcatgctgatgcccaccgcactggccttccacctcaccacccggggcggcgagccacacatgatagtgagcaaacaggagcggggcaagagtctgctgttcaagaccagcgccggggtgaacatgtgcaccctcatcgccatggacctaggcgagctgtgcgaggacaccatgacctacaagtgcccaagaatcaccgagaccgagcccgatgatgtcgactgctggtgcaacgccacggacacatgggtgacctacggcacgtgcagtcagacaggtgagcatcgccgggacaagcggtccgtagccctggcgccgcatgtgggattagggctggagacccgcaccgagacctggatgagctccgagggcgcctggaagcagatccagcgggtcgagacgtgggccctccggcatccagggttcaccgtgatcgcgctgttcctggcccatgcgatcggcaccagcatcacccagaaggggattatcttcatcctcctgatgctggtgacaccatcgatggccatgcggtgcgtcggaatcgggagccgcgatttcgtggaggggctttccggcgcgacatgggtcgacgttgtgctggagcacgggagctgcgtaaccaccatggccaaggacaagccaacgctggacatcgaactgctgaagaccgaagtcaccaaccctgccgttttacggaagctctgcatagaggcgaagatatcaaacaccactacggacagccgatgccctacccagggagaagctaccctggtggaggagcaggacgccaacttcgtctgtcgacgcacgttcgtggaccggggctgggggaacggctgcgggttatttggcaaggggtccttaataacgtgcgcaaagttcaagtgcgtgaccaagttggagggaaagatcgtgcagtacgagaacctgaagtacagcgttatcgtaaccgtgcacacaggggaccaacaccaggtggggaacgagtccaccgaacacggcaccacagccaccatcaccccgcaggcccccaccacagagatccaactcaccgactatggggccttaacgctcgattgtagcccgcgcaccgggctggactttaacgaaatggtcctgctgaccatgaaggagaagtcctggctcgtgcacaagcagtggtttttggacttgcccctcccttggactagtggcgccagcacgtcccaggagacgtggaaccggcaggacctgcttgtgaccttcaaaaccgcccacgccaagaagcaggaggtagttgtgttaggctcacaagagggcgcaatgcacacagcgctcaccggggccaccgaaatccagacctccggcacgaccaccatcttcgccgggcacctgaagtgccgcctcaagatggacaagctgaccttgaagggcatgagctacgtcatgtgcacggggtccttcaagcttgagaaggaggtggcggagacccaacacggcaccgtgctggtacagatcaagtatgagggcactgacgcgccctgcaaaatcccctttagcacgcaggacgaaaagggtgtaactcagaatggccggcttatcaccgccaacccgatcgtgacggacaaggagaaacccgttaatatcgaggccgagccgcccttcggggaatcctacatcatcataggcgccggcgagaaagcgctgaaattatcttggttcaagaaagggtctagcatcggtaagatgttcgaggcaaccgcccgcggggcccggcgcatggctatcctgggcgacaccgcgtgggacttcggatctatcggcggcgtgttcaccagcgtggggaagctggtccaccagatattcggcaccgcctatggggtgttgttttccggtgtgagctggacaatgaaaatcgggatcggagtcctgctaacctggctgggcctaaactctcgcagcacttccttgagcatgacctgcatcgccgtcgggcttgtgacgctgtacctgggtgtcatggtgcaagccgacagcgggtgtgtgatcaactggaagggccgtgagctaaagtgcggaagcggcatcttcgtcaccaacgaggtccacacctggaccgagcagtacaagttccaggctgacagcccgaagcgcctgtctgcagctatcggaaaggcatgggaggaaggagtgtgcggcatccggagcgccacccgcctggaaaacataatgtggaagcagatctccaacgagctcaaccacatcttgttagagaacgacatgaagttcacggtcgtggtgggggatgtcgcaggcatcctcgcgcaggggaagaagatgatacgccctcagcctatggaatacaagtatagctggaagtcctggggcaaagctaaaatcatcggcgccgacgtgcagaatacaaccttcatcattgatgggcccaataccccggaatgtcccgacgaccaaagggcttggaatatctgggaggtggaggactacggcttcgggatcttcacgaccaacatttggctcaagctgcgggactcccacacccaggtctgcgaccacagactcatgtccgctgctatcaaggacagcaaggccgtgcacgccgatatgggctactggatcgagtctgagaaaaacgagacctggaagctggcccgagcttcgttcattgaagtgaagacgtgcatctggcccaaatcccacaccctgtggagcaacggtgttcttgagtcggagatgatcatacccaagatatacgggggccctatcagccagcacaactaccgccccgggtacttcacccagaccgccggcccctggcacctggggaagctggagcttgacttcgacctgtgtgagggcacgaccgtggtggtcgacgaacactgcggcaaccgggggccgtccctgaggaccaccacggtgaccgggaagatcatccacgagtggtgctgccggagctgtaccctgcccccccttcgcttccgcggagaggacggctgctggtatgggatggagatccgtcccgtgaaggagaaggaggaaaacctggtaaagtccatggtcagcgccggctcaggcgaagtggattccttctccctggggctgctttgcatctcaatcatgatcgaggaggtcatgcggagccgctggtcccgcaagatgctcatgaccgggacgctggccgtcttcttcctgctgatcatggggcagctcacgtggaacgacctgatcagactgtgtatcatggtgggcgccaacgctagcgaccggatggggatgggcaccacctacctggccctgatggcaactttcaagatgcggccgatgttcgccgtcggtctcctgtttcgcaggctgacatctcgagaggtgctactgctgaccatcgggctcagcctagtggcctccgtcgaactgccgaacagcctcgaggagctgggggacgggcttgccatgggcatcatgatcctcaagctactgacagatttccagtcccaccaactctgggcgacccttttgagcctcaccttcatcaaaaccaccttttcactccactacgcctggaaaacgatggccatggtactgagcatcgtgtccctctttcccttgtgcctgagcaccacctctcagaaaacgacgtggctccccgttctgctgggcagcctcgggtgcaagccactgactatgttcttaattgcggaaaacaagatctggggacggcgctcctggccgctcaacgaggggatcatggccgtgggtatagtcagcatcctgctgtcgtccttgctgaagaacgacgtgcccctggccgggcccctcatcgccggtggcatgctgatcgcctgctacgtgatcagtgggtccagcgcggacctgtccctcgaaaaagccgcggaggtctcctgggaagaggaggctgagcactcaggagccagtcataatattctagtggaggtacaagacgacgggaccatgaagatcaaggacgaggaacgggatgacacgctcactatcctgctgaaggcgacgctgcttgccgtctccggcgtgtacccgcttagcatccccgctaccctgttcgtctggtatttctggcagaagaagaagcagcgctcaggagtcctctgggataccccgagcccgcccgaagtggaacgggcggtgctggacgacgggatctaccgcatcatgcagcgggggctgctggggcgctctcaagtcggagttggagtgttccaggagaacgtcttccataccatgtggcacgtgacccggggcgcagtgctcatgtatcaggggaagcgactggagcccagctgggcgtccgtaaagaaggacttaatcagctacggcggcgggtggcgtttgcaaggctcctggaacacgggtgaggaggtccaagtgatcgccgtcgagcccggaaagaaccccaagaacgtccagaccgccccagggaccttcaaaactcccgagggtgaggtaggcgccatcgccttagacttcaagcccggtaccagcggctcgccaatagtaaaccgcgaagggaagattgtcggcctgtacggcaacggagtagtcaccaccagcggcacgtacgtgagcgccatcgctcaggccaaggcctcacaggaggggccgttacccgagattgaggacgaggtgttcagaaagcgcaatcttaccatcatggacctacaccccgggagcggcaagacccggagatacctccccgcaattgtacgggaggccatcaaacggaagctacgcaccctgatcctcgcgcccacacgtgttgtggcctccgaaatggccgaagcgctgaagggaatgcccatccgctaccagaccacggccgtcaagagcgagcacactggtaaggagatcgtagacctgatgtgccacgccacgttcaccatgcggctcctgtcccccgtgcgcgtcccgaactacaacatgatcatcatggacgaggcccatttcaccgatccttcctccatcgccgcgagggggtacataagcacccgtgtaggcatgggggaagcggccgccatattcatgacggccacgccgcctggctccgttgaagcgttcccgcaatcgaacgccgtcatacaggacgaggagcgcgatatccccgagcgatcctggaacagcgggtacgagtggatcaccgattttccaggaaagacggtgtggttcgtgccatccataaaatcgggaaatgacattgccaactgcctgcggaaaaacgggaagcgagtcatccaactctcccggaagacgtttgacacggagtaccagaagaccaagaacaacgactgggactacgttgtcaccaccgacatcagcgaaatgggcgcgaatttccgcgcggatcgtgtcatcgacccgcgccggtgcctgaagcccgtgatcctcaaggacgggcccgagcgcgtgatcctcgcaggcccaatgcctgtgactgtggcctccgcggcccagcggcgcgggcggatcggacgcaaccacaacaaggaaggcgatcagtatatctatatggggcagccactgaacaacgacgaagaccatgcgcactggacagaggcaaagatgcttctcgacaacatcaacactcccgagggcatcattccggccctgttcgagcctgagcgcgagaagtcggccgccatagacggggagtaccggttacgtggcgaggcgcggaagacgttcgttgaactcatgcgccgcggtgacctgcctgtgtggctgtcctacaaggtggcgagcgagggcttccagtacagcgaccgtcggtggtgcttcgacggcgagaggaacaaccaggtgctcgaggagaacatggacgtggagatctggaccaaggagggggagcggaagaaactgcgcccccggtggctagacgcccgtacctacagcgaccccctcgccctgcgtgaattcaaggagtttgctgcaggccgccgtagtgtgtccggggatctgatcctcgagatcggcaagctgccgcagcacctgacccaacgcgcacagaacgcgctcgacaacctggtcatgctacacaactccgagcaagggggacgggcctatcgccatgccatggaggaactccctgacaccattgagacgctgatgttactcgccctcatcgccgttctgacgggcggggtgacacttttcttcctgtccggccggggtctggggaaaactagcatcggcctcttgtgcgtaatggcctccagcgtgcttctctggatggcctccgtggagcctcattggatcgctgcaagcatcatcctggagttcttccttatggtcctcttgatcccggagcccgaccgccaacgaacgccccaagacaaccagcttgcctatgttgttatcgggctcctgtttatgattttaaccgtcgcagctaacgagatgggcctcctcgagactaccaagaaggacctggggatcggtcacgtggcggtggagaaccaccaccacgccgcaatgctcgacgtcgacctacaccccgcatccgcctggacgctgtatgcggtggctacgaccatcatcaccccgatgatgcgtcacacgattgagaacaccacggccaacatcagcctcaccgccatcgccaatcaggccgccatcctgatggggctggacaagggctggcccatatccaagatggacatcggcgtgccgctcttggcgctggggtgctacagccaagtcaaccccctcacgctgaccgcggcagtgctgatgctcgtggcccattacgctatcatcggaccggggctccaggctaaggcgacccgcgaggcgcagaagaggaccgccgcaggcatcatgaagaaccccacggttgacgggatagtggccatcgatctggaccccgtcgtctacgacgctaagtttgagaaacaactcggccaaataatgttactcatcctctgcacctcccagattctgttgatgcgcaccacctgggccctctgcgagagcatcacgctggccaccggccccctgactacactctgggaggggagtccagggaagttctggaacacgactatcgccgtgagcatggccaatatcttcagggggtcctacctagccggcgctggccttgccttcagcctcatgaagtccctcggaggcgggcgccgcggcaccggggcacagggcgaaaccctgggggagaagtggaagcgccagctaaaccaattatccaagtctgaattcaacacctataaacgctccgggatcatggaggtggatcgcagcgaggccaaggagggccttaagcgcggagagacgaccaagcacgcggtctcccgcggcaccgccaagttgcggtggttcgtagagcgcaacctggtgaagcccgaagggaaggtcatcgacctgggatgtggccgggggggctggtcttactactgcgccgggctgaagaaggttactgaggtaaagggctacaccaaaggcggccccggccacgaggagcccatcccaatggccacctacgggtggaacctcgtcaagctgcactccgggaaggacgtgttcttcatcccccccgagaagtgcgacaccctgctctgcgacatcggggagagctccccgaacccgacaatcgaggagggccgcaccctgcgggttctgaagatggtcgagccctggctccgcggcaaccagttttgcataaaaatcttgaatccctacatgcccagcgtggtggagaccctggagcagatgcagcgcaagcatggcggaatgttagtgcgcaaccccctgtcccggaatagcacccacgagatgtactgggtgagctgcgggaccggcaacatcgtaagcgccgtcaacatgacgtcccgcatgctgctcaatcgcttcactatggcgcaccgtaagcccacctacgagcgcgacgttgacctgggtgccggcacccggcacgtggcagttgaaccggaggtggcgaacctggatatcatcggacaacgcatcgagaacatcaagcacgagcacaagagcacgtggcattacgatgaggacaacccatacaaaacatgggcctaccacgggtcctacgaggtgaagccgagcggctcagcgagcagcatggtcaacggcgtagtcaagctcctgactaagccctgggatgtaatccccatggtgacccagatcgccatgacagacaccacccctttcggccagcagcgtgtcttcaaagagaaggtggacactagaactccgaaggcgaagcgggggaccgcccagatcatggaggtgaccgccaagtggctgtggggcttcctctccaggaacaagaagcctcggatctgtacccgcgaggagtttacccggaaggttcgcagcaacgctgccatcggcgcagttttcgtggacgagaaccagtggaattctgccaaggaggcggtcgaggacgagcggttctgggacttggtgcaccgcgagcgggagctgcacaagcaggggaagtgcgcgacctgcgtgtacaacatgatgggcaagcgcgagaagaaactcggggagttcggaaaggccaaagggagcagagcgatctggtacatgtggttgggtgcccgcttcctggagttcgaagcgctagggttcatgaacgaggaccactggttctcccgcgagaacagcttatccggtgtcgagggcgaggggctgcacaagctcggctacatcctgcgcgacatctcaaagatcccgggtggcaacatgtacgcagacgacaccgccggttgggacactcggataaccgaggacgacctgcagaacgaggcccgcatcacggatatcatggagcctgagcacgccctcctggcgaagtccatcttcaaactaacctaccagaacaaggtggtgagggtgcaacggcccgccaagaacggtactgtaatggatgtgatctcacgccgggaccagcgcggctccgggcaggtcggcacctacggccttaacaccttcaccaatatggaggctcagttgatacggcaaatggaaagcgaagggatcttctccccctcagagctggagacgcccaacctcgcagagcgcgtcttggactggctgaagaagtacggcgtggagcgtctcaaacgtatggccatctccggggacgactgcgtcgtgaagcctatcgacgaccggttcgcgacagcactgacagccctgaacgacatgggcaaggtgcgaaaggacatcccccagtgggagcctagcaagggctggaacgactggcagcaggtccccttctgctcccatcacttccaccagcttataatgaaggacggccgggagatcgtggtgccctgccgcaaccaggacgaactagtcggccgggcccgcgtgtcacagggagccggctggagcctccgggagacggcgtgccttgggaagtcatatgcccagatgtggcaactgatgtatttccataggcgtgatctgcgactcgccgccaacgcaatctgtagcgccgtgcctgtcgattggatcccgacctcccggacgacctggagcatccacgcccatcaccagtggatgaccaccgaggacatgctttccgtgtggaaccgcgtatggatcgaagaaaacccgtggatggaggataagactcatatcagctcctggggggacgtcccatacctggggaagcgcgaggaccagtggtgcggcagcctcatcggtctaaccgctcgggccacatgggctaccaacattcaggtggccataaaccaggttagaagactgatagggaacgaaaattacctcgattacatgaccagtatgaagcgtttcaagaacgagggggaccccgagggagccctatggtga

SEQ ID NO: 24106 - RNA, 9879 nt, synthetic construct
  misc_feature 1..9879: note = derived and/or modified CDS sequence (opt11) from DENV-1__EU677166__SS-prME
  source 1..9879: mol_type = other RNA
agcgttaccatgctactaatgctgatgcccaccgccctggcctttcatctaaccaccagaggcggggaaccccacatgatcgtgagcaaacaggagcggggcaagagccttctgtttaagaccagcgcgggggtgaatatgtgcaccctgatcgcgatggaccttggggagctgtgcgaggataccatgacctataaatgcccccgcataaccgagaccgagccggacgacgtggattgttggtgcaacgccacggacacgtgggtcacctacgggacctgttcgcaaacgggcgaacaccggcgggacaagagatctgtggcactcgcgccgcacgtgggcctggggctggagacccgcaccgagacctggatgagctcggagggtgcgtggaagcaaatccaaagagtcgagacgtgggcccttcggcaccccgggttcaccgtaatcgcattattcctcgctcatgccataggcaccagtatcacccagaaggggatcatcttcatcttgctgatgctggttacgccctccatggccatgcggtgcgtcgggatcggcagccgcgatttcgtggagggcctttccggcgcaacgtgggtggatgtagtactcgaacacgggagctgcgttaccaccatggcgaaggataagcccacgctagacatcgagctcctgaagaccgaagtcacgaaccccgcagtgctgcgtaagctttgcatcgaggcgaagatctccaatacgacaacagactctcgctgcccgacccagggagaggccacgttagtggaggaacaggatgccaactttgtctgccgaagaactttcgttgacaggggctggggtaatggctgcgggctgttcggtaaaggaagtctcattacgtgcgcaaaattcaagtgcgtgaccaagttagagggcaagatcgtccagtacgagaatcttaagtactctgtaattgtgaccgtacacaccggcgaccagcaccaagtagggaatgaatctaccgagcacggaaccacggcgaccattactccccaggcgcccaccaccgagatccaactcaccgactacggtgcccttacgctggactgcagcccccgcaccggcctcgacttcaatgagatggtcctgttaaccatgaaagagaagtcgtggctcgtacacaaacagtggttcctggatctgcccctcccctggaccagcggggcatccacgtctcaagagacctggaatcggcaggacctgctagtcacgttcaagaccgcccacgccaaaaagcaggaggtcgtagtattgggcagccaggaaggggcaatgcatacggcactgaccggggccaccgagatccagacctctggcacgaccaccatcttcgcggggcatttgaagtgtcgcttgaaaatggacaaactgactcttaagggcatgagctatgtgatgtgcacggggtccttcaagctcgagaaggaggtggccgagacccagcacgggaccgtgctggtccagatcaagtatgagggaacggacgcgccatgcaaaatccccttcagcacgcaggacgagaagggggtgacgcagaacggccggttgatcaccgctaacccaatcgtgaccgacaaggagaagccggtcaatatcgaggccgagccgcccttcggggagtcctatattgtgatcggcgcaggcgaaaaagcacttaagctcagctggttcaagaagggaagttcgatcggaaagatgttcgaagccacggcccggggggccagacgcatggctatcctgggcgacactgcgtgggacttcgggtccatagggggggtgttcacgagcgtcgggaagctggtgcaccagatattcggtactgcatatggggtgctgttctccggcgttagctggactatgaagatagggatcggtgttttactgacgtggctgggcctgaactcccgcagcacctctctgagtatgacctgcatcgcggtcggactcgtaacgctttacttaggcgtgatggtccaggccgactccgggtgcgtcataaactggaagggtcgggagcttaaatgtggaagcgggatcttcgtaacgaacgaagttcatacctggaccgagcaatacaagtttcaggccgatagcccgaagaggctgtccgcggccatcggcaaggcctgggaagagggggtctgcggcatccggagcgccacccgtctggagaatatcatgtggaagcagatctcgaatgaactcaatcacatcctgctggagaacgacatgaagtttacggtggtggtgggggacgtggccggaatcctcgcgcagggtaagaagatgatcaggccccagcccatggagtacaagtacagctggaaatcctggggcaaagccaaaataatcggcgccgacgtgcagaacactaccttcatcatcgacgggcccaacaccccggaatgcccagatgaccaacgcgcctggaacatctgggaagtcgaggattacggcttcgggatcttcactaccaacatttggttaaaactacgggatagctacacacaggtctgcgaccaccgcctcatgagcgcggccattaaagatagtaaggcggtacacgctgacatgggctactggatagagtccgagaagaatgagacctggaagctggcccgtgcttcattcatagaggtcaagacgtgcatatggcccaagtcccacacgttgtggtccaacggcgtgctcgagtccgagatgatcatcccaaagatctacggggggcctatctctcagcataactaccgcccggggtacttcacacagacagccggcccatggcacctcggaaaattagagctcgacttcgacctgtgcgaaggcaccaccgtggtcgtggacgagcactgcggaaaccgggggccaagcctgcgcacgaccacggtgaccggcaagataatccacgagtggtgctgccggagctgcaccttgccgccactccgcttccgcggggaggacggctgctggtacgggatggagattcgccccgtcaaggagaaggaggagaatctggtcaagtcgatggtgagcgccgggagcggcgaggttgactccttcagcctggggctgctgtgcatctccatcatgatcgaggaggttatgcggagccgctggagcaggaagatgctcatgaccggcacgctggcagtgttcttcctactcatcatggggcagctgacttggaacgacttgattcgtctctgcattatggtcggcgccaatgcgagcgaccgcatggggatgggcaccacctacctggccctaatggccactttcaagatgcggcccatgtttgcagttggattactgttcagacggctgacctcccgcgaggttctcctcctaaccatcggcctctctctggtcgcctccgttgagctgcccaactctctcgaggagctgggggacgggttagcgatggggattatgatcctcaagctgttgactgacttccagtctcatcagctctgggccacgctgctgagcttgaccttcatcaagaccacgttttctctgcactacgcctggaagacgatggccatggtgctgagcatcgtatccttgttccccctgtgtctgagcaccaccagtcagaagaccacgtggctccccgtcctgttaggtagcctgggctgcaagcccttgaccatgttcctgatcgcagagaataaaatctggggccgccgctcctggcccctcaacgaggggatcatggctgtcggcatcgtgtctatactgctgagctccctcctgaagaacgacgtgccccttgcagggcccctcattgccggcggaatgctgatcgcctgctacgtaataagcgggtcctccgcggacctgtccctcgagaaagccgctgaggtgtcgtgggaagaggaagccgagcactccggcgccagccataatattcttgtggaggtccaggacgacgggaccatgaagatcaaggatgaggaacgggatgataccctgaccatcctcctaaaggcaacgttgctcgccgtctccggcgtgtatcctcttagcatccctgccaccttgttcgtatggtacttctggcagaaaaagaagcaaaggtccggcgtgctatgggatacccctagcccgccagaggtggagcgtgcagtactggatgacggcatctaccgcataatgcagaggggcttattgggccgctcccaggtgggcgtgggggtcttccaggagaacgtttttcacacgatgtggcacgtcacccggggcgccgtccttatgtatcagggcaagcgcttagagccaagctgggcgtcggtgaagaaagacctgatatcttacggcggggggtggcgactccaagggtcctggaacaccggagaggaggtacaggtaatcgccgtggagccaggtaagaacccgaagaatgtgcagaccgcccccgggacctttaaaacgcccgagggcgaggtcggagccatcgccctagacttcaagcccgggacatccggctcccccatcgttaaccgcgaggggaagatcgttgggctgtatggtaacggggtcgtgaccacctcaggaacgtacgtgagcgctatcgcccaggccaaggcatcccaagaggggccgctccccgagattgaggacgaagttttccggaagcggaacctgaccatcatggacctgcaccccggcagcgggaagacccggagatatctcccggcgattgtgagagaggccatcaagcgcaaactgcgcaccctgatcctcgccccaacgcgcgtagtcgcttccgaaatggccgaggcactgaagggcatgcccatccgctaccagacaaccgccgtcaaaagcgagcacacgggcaaggagattgtggacttgatgtgccatgccacgtttaccatgcgactcctgagcccggtgcgcgtgccgaactacaacatgatcatcatggacgaggcccacttcaccgacccgtcaagcatagctgcgcgggggtacattagcacacgtgtcggcatgggcgaggccgctgccatcttcatgactgcgacgccccccgggtccgtcgaggcgttcccgcaaagcaacgccgttatccaggacgaggaacgggacatccccgagcgcagttggaatagcgggtacgagtggatcacggatttcccgggcaagaccgtgtggttcgtcccatccatcaagagcggcaacgatattgccaactgcctgcggaagaacggaaagcgagtgatacagctctcccggaagacgttcgacaccgagtatcagaagaccaagaacaacgattgggactacgtggtaacaacggacatcagcgagatgggcgccaactttcgcgcggaccgggtgatcgacccacgccggtgcctgaaacccgtgatcctgaaggacggaccggagcgcgtcatattggccggccccatgccggtgacggtcgcgtccgccgcgcaacggagggggcggattgggcgcaatcataataaggagggagaccagtacatctatatggggcagcccctaaacaacgacgaggaccatgcgcactggaccgaggccaagatgctgctagacaacataaacacgcccgagggaattatcccagccttattcgagcctgagcgcgagaaatccgccgccatagacggggagtaccggctgcgtggcgaagcgagaaagacgttcgtggagctcatgagacgcggggacctgcccgtgtggctgtcctacaaggtagccagcgagggcttccagtatagcgaccgccggtggtgcttcgacggcgagcgcaacaaccaagtgctagaggagaacatggacgtggagatctggaccaaggagggggaacgcaagaagctgcgcccccggtggctggacgcccgcacctactccgaccccctcgcgctgcgggagttcaaagagtttgctgcggggcgccgctctgtctccggggaccttatactcgagatcggcaagctgccgcaacacctgacccaacgcgcccaaaatgcactcgacaacttagtgatgctgcacaacagcgagcagggtgggcgggcctatcgccatgcgatggaagagctccccgatacaatcgagacgctgatgctgctcgccctgatcgccgtactgaccggcggcgtaacattattcttcctgtccggaagggggctgggcaagactagcatcgggcttttgtgcgtgatggccagctcagtgctcttgtggatggcctccgttgaaccccactggatcgcggccagcatcatcctggagttcttcctgatggtgctcctgatccccgagccggaccgacagcggaccccccaggacaaccagctggcatacgtggtcatagggttgctgttcatgatcttgaccgtagccgccaacgagatgggcctcctcgagaccactaagaaggatttagggatcggccacgtggcggtagagaaccaccaccacgccgccatgctcgacgtagacctgcaccccgcctccgcctggacactctacgcagtggccaccaccataatcaccccgatgatgaggcatacgattgagaacaccactgccaacattagcctcaccgctatcgccaaccaggcggccatactgatgggtctggataagggctggcccatctctaaaatggacatcggcgtccccctccttgctctggggtgctactcccaggtgaatccccttaccctgactgccgcggtgctgatgctcgtagcccattacgccattattggtccggggctgcaggccaaggccactcgcgaggcgcagaagcgaaccgccgccggcattatgaagaatccgacggtagacgggatcgtggcaattgacctggacccggtcgtgtacgacgccaagtttgaaaaacagctcggacagatcatgctgctgattctctgcacctcacagattctgctcatgcgcaccacgtgggcgttatgcgaaagcatcacgctcgcaaccggcccactgactaccctctgggaaggtagcccgggcaagttctggaatacgactatcgccgtatccatggccaacatcttcagaggctcctacctggccggggcgggcctggcctttagcttgatgaaatcgctcggtggcgggcgccggggtaccggggcccagggcgagaccctgggcgagaagtggaaacggcagctgaatcagctgtcaaaatcggaattcaacacgtacaagcggagcggaatcatggaggtcgaccgcagcgaagcgaaggagggacttaaacgaggcgagaccaccaagcacgcggtgagccgaggcaccgccaaactccgatggttcgtggagcgcaacctggtcaagcccgaagggaaggtgatcgatctgggctgcggccgcgggggttggagctactactgtgcggggctgaagaaagtgacggaagtcaagggctataccaagggcggccccggccatgaagagcccatcccgatggccacctacggatggaacctggtgaagctgcactccggaaaagacgtgttcttcataccgcccgagaaatgtgacaccttactctgcgacataggggagagctcccctaacccgacgatcgaggaaggccgcacacttagggtgctgaagatggtcgagccctggctcagagggaaccagttttgcatcaaaatcctgaacccctacatgccctcagtagtcgagaccctggagcaaatgcagcgaaagcacggcggcatgctagtgcgcaacccgctgtcccggaattcaactcacgaaatgtactgggtttcctgcgggaccgggaacatcgtaagcgccgtgaacatgacttccagaatgctgctcaatcgcttcactatggcgcaccggaagccaacatacgagcgagacgtggatctaggggccggcaccaggcacgtcgctgtggagccggaggtggccaacctagatataatcggtcagaggatcgagaacattaagcacgaacataaaagcacttggcactacgacgaggataacccgtataagacgtgggcctaccacgggtcgtacgaagtcaaaccgtccggctccgccagctcgatggtgaacggggtcgtgaagcttctaactaagccatgggatgtgattcccatggtcacccagatcgccatgacggacaccacccccttcgggcagcaaagagtgtttaaggaaaaggtggacacccgcacgccgaaggccaaacgggggaccgctcagattatggaggtgaccgccaagtggctctggggcttcttaagtcgcaacaagaagccccggatctgcacccgtgaggagttcacccggaaggtgcgcagcaacgcggccatcggcgccgtgttcgtcgacgagaaccagtggaactccgctaaagaggcggtggaggacgagagattctgggacctggtgcaccgcgagagggagctgcataagcagggtaagtgcgcgacctgcgtctacaacatgatgggcaagcgagaaaagaagctcggggagttcggcaaggccaaggggtcgcgggctatctggtacatgtggctgggagcacgcttcctggaatttgaggcgctgggcttcatgaacgaggaccactggtttagtcgtgagaacagcctctcaggtgtcgagggcgaggggctgcataagctcggatatatattgagagacatttcgaagatccccggcggtaacatgtacgccgacgacacagccggttgggacacccggatcacggaggacgacctgcagaacgaggcccgcattactgacatcatggagccggaacacgccctcctagcgcgctccatcttcaagctgacctaccagaacaaggtagtccgggtgcaacggcccgccaagaacggcactgtaatggacgtcatcagccggagggaccagcgggggtcaggccaggtggggacctacgggctcaacaccttcacgaacatggaggcccagctcatccgccagatggagagtgagggaatcttcagcccttcggagctggagacccccaacctcgccgagcgggtgctggattggctggaaaagtacggagttgagcggctgaagcggatggccatcagcggggatgactgcgtggtcaaaccaatagacgatagattcgcgacggccctgactgccctgaacgacatgggcaaggtccggaaggatataccccagtgggagccgagcaagggctggaacgactggcagcaggtccccttttgctcccaccacttccaccagctcatcatgaaggacggccgcgagatcgttgtgccctgccggaaccaggatgagctggtgggccgtgcccgggtgtcacagggggccggatggagcctgcgcgagaccgcatgtctggggaagtcctacgcacagatgtggcagctgatgtactttcatcgccgcgacctgaggttggccgccaatgcgatctgctccgcagtcccagtgaactggatccccacctcacgaacgacctggagcatccatgcacaccaccagtggatgaccacggaggatatgctgtccgtgtggaaccgcgtctggatagaggagaacccctggatggaggacaagacgcacattagctcatggggcgacgtaccgtatctggggaagcgcgaggaccaatggtgcggatccctgatcggcctgactgcgcgcgccacttgggcaacgaacatccaggtcgccatcaaccaggtccggcgcctgatcgggaatgaaaactacctcgactacatgacctcgatgaagcgtttcaagaatgaaagcgaccctgagggcgccctgtggtag

SEQ ID NO: 24107 - RNA, 9879 nt, synthetic construct
  misc_feature 1..9879: note = derived and/or modified CDS sequence (opt11) from DENV-1__EU677170__SS-prME
  source 1..9879: mol_type = other RNA
agcgtgaccatgctgcttatgttgatgccgaccgcacttgcattccacctcaccacccggggcggggagccccacatgatcgtgtccaagcaggagagaggcaagagcctgttattcaagaccagcgccggggttaacatgtgcacgctcatcgccatggacttgggcgagttatgcgaggacaccatgacctacaagtgcccgcggattaccgagacggagccagatgacgtggactgctggtgcaacgccacggatacatgggtcacttacgggacctgcagtcaaacaggagagcaccggcgtgacaaacggagtgtagctctcgcgccccatgtgggcctggggctggagacccgcaccgagacctggatgagctcagaaggcgcctggaagcaaatccagcgggtggagacgtgggccctccggcaccccgggttcaccgtgatagcactgttcctcgcccacgcgatcggtacctcaatcacacagaaagggatcatatttatcttactgatgctggtgacgccctccatggccatgcggtgtgtgggcatcggcagccgcgacttcgtggaagggctatccggcgccacctgggtggatgtcgtgctggaacacgggagctgcgtgaccacaatggccaaggacaagccgacgctggatatcgagctactgaagaccgaggtcaccaacccggccgtgctgcggaagctctgcatcgaggcgaagatctccaacaccacgaccgatagccgctgccccacccagggcgaggccaccctggtggaggaacaggacgccaacttcgtctgccggcgcacgttcgtagaccggggctgggggaacggctgtgggctattcggaaagggctccctcatcacatgcgccaaattcaagtgtgtaaccaaactggagggcaagatcgtccagtacgagaacttaaagtacagcgtgatcgttacagtccacacgggcgaccagcatcaggtggggaacgagtccaccgagcatggcaccaccgccaccatcacgccccaggcgcccaccaccgagatccagctcaccgactacggggcgctgacgctggactgcagcccgaggaccggcctcgacttcaacgagatggtcctgctgaccatgaaggagaagtcctggctcgtgcacaaacaatggttcctggacctccccctcccatggacaagcggggctagcacgtcccaggaaacctggaacagacaggacctgctggtaaccttcaagactgcccatgccaagaagcaggaggtcgtggtgcttgggagccaggaaggcgcgatgcacacggctctgaccggagccactgagatccagacctccggcacgaccaccatcttcgccgggcacctgaagtgccgcctcaagatggataagctgacccttaaagggatgtcatacgtcatgtgcacggggtcattcaagctcgagaaagaagtggccgagacacagcacggcacagtgctggtccaaatcaagtacgaaggaaccgacgcgccgtgcaagatccccttctccacgcaggacgagaagggggtgacccaaaacggcagactgattacggccaacccgatcgtgacagacaaggagaagccggtcaatatcgaggccgaaccgccttttggggagtcctatatcgtgatcggtgccggcgagaaggccctgaaactcagctggttcaagaaggggtctagcatcggtaagatgttcgaggcgacagcacgcggggcacggcgcatggccatcctaggcgacaccgcgtgggacttcggctcaattggcggcgtattcacaagcgttggcaagttagtgcaccagatcttcggcaccgcctacggagttctattctccggcgtcagctggacgatgaagatcgggatcggcgtgctgcttacatggctcggcctgaattcgcgcagcacgtcattaagcatgacctgcatcgccgtcgggttagtcacgctgtacttaggcgtcatggtgcaagccgactctgggtgcgtcatcaactggaagggccgggagctgaagtgcgggagcggcatcttcgttaccaacgaggtacacacctggaccgagcagtataagttccaggccgacagcccgaagcgcctgtccgcggctatcggcaaggcctgggaggagggggtttgcggcattcggagcgccactcgcctcgagaacatcatgtggaagcagataagtaacgaactcaaccacatcctgctcgagaacgacatgaagtttacagtggtggtaggggacgtggccggcatcctcgcgcaagggaagaagatgatccggccacagcccatggagtacaaatacagctggaagtcatggggcaaggccaagatcatcggcgcagacgtgcagaataccaccttcatcatcgatgggcccaacaccccggagtgccccgacgaccagcgcgcgtggaacatctgggaagtcgaggactacgggttcgggatcttcactaccaacatctggatgaagctgcgcgactcatacacccaggtctgcgaccatcgcctgatgtccgcggccatcaaggacagcaaggccgtgcatgccgacatgggctattggatagagtccgagaagaacgaaacctggaagctcgcccgggcgtccttcatcgaggtcaaaacgtgcatatggcctaagtcccacaccctgtggagcaacggtgtgctggaatccgaaatgattatccctaagatctacgggggcccgatcagccagcacaactaccgccctgggtacttcacccagaccgccggcccttggcaccttggaaagctggagctggacttcgatctctgcgaggggacgaccgtggtcgtggacgagcactgcggcaaccgtgggccgtccctgcgcactacgacggtgaccgggaagataatccacgagtggtgctgtcggagctgcaccctgccgccgctgcgcttccgcggggaagacggatgctggtacgggatggagataagacccgttaaggagaaggaggagaacttagtgaaatccatggtgagcgcgggctccggcgaagtcgacagtttctctctggggctcctgtgcatctccataatgatcgaggaggtgatgcggagccgctggtcgcggaagatgctgatgaccggcaccctcgccgtattcttcctgctgatcatggggcagctcacctggaatgacctgatccgcctgtgtatcatggtcggggccaacgcgagcgaccggatggggatgggcaccacctacctcgccctgatggccacgttcaagatgcggcctatgttcgcagtgggcctcctcttccgccggctgacctcccgtgaggtgctgcttctgaccatcgggctgtcactcgttgcctccgtagagctgcccaatagcctggaagagttgggcgatggactggcgatgggcatcatgatcttgaagctcctgaccgactttcagtcccaccaactgtgggccaccctcctgagcctgaccttcatcaagaccaccttctctctccattacgcctggaagacgatggcaatggtcctgagcatcgtgtccctgttccccctctgcctgagcactacgtcccagaagacgacctggctgcccgtgctgctgggatcgctggggtgcaagcccctcaccatgtttttaatcgccgagaacaaaatctggggccggcgctcctggccactgaacgagggaatcatggccgtcggcatcgtgtcaatcctcttgagttccctgctcaagaacgacgttcctctggcaggtcccttaatcgccggcggcatgctgatcgcctgttacgtcattagcgggtcgagcgcggacctgtccctggagaaagccgccgaggtaagctgggaagaggaggccgagcacagtggcgccagccacaacatactcgtggaggtgcaggacgacgggaccatgaaaatcaaggatgaggagcgggacgacaccctgaccatcctgctcaaggctacgctgctggccgtgtccggcgtgtacccgctatctattcctgccaccctgttcgtatggtacttctggcagaagaagaagcagcgctccggtgtgctgtgggatacccccagcccgcccgaggtggagcgggcggtcctagacgacggcatttaccgaattatgcagcggggcctgctgggccgatcacaggttggggtgggggtcttccaggagaacgtattccacaccatgtggcacgttacgcggggtgccgtcctgatgtaccaggggaagcgcctcgagcccagctgggcatccgtgaagaaggacctaatctcatatggaggagggtggcggctccagggctcctggaacaccggggaggaggtgcaggtcattgccgtggagcccggcaagaaccccaaaaacgtgcagacggcccccgggacctttaagacgcccgagggcgaggtcggcgcaatcgcactcgatttcaagcctggcaccagcggctcccccatcgtgaaccgcgaggggaaaatcgtgggattgtacggcaacggggtcgtgaccaccagcggcacgtatgtgagcgcgattgcccaagcgaaggcctcccaggaggggccgctgcccgagatagaggatgaggtattccgaaagcgcaacctcacgataatggatctgcacccaggctccgggaagaccagacgctacctaccggctatcgtgcgggaggccatcaagcgaaagctcagaaccctgatcctggcccccacgcgggtggtagccagtgaaatggccgaggcgctcaagggaatgcctatcagataccagaccacagccgtcaagagcgagcacacgggcaaggagatcgttgatctgatgtgccacgccacgttcacaatgcgattgctctcgccagtccgcgttccaaactacaacatgatcatcatggacgaggcccatttcaccgaccccagctccatcgccgcgcgggggtacatctctactcgcgtgggcatgggtgaggccgccgcaatcttcatgactgccacgccgcccggatccgttgaggcattcccgcagagcaacgccgtgatacaggacgaggaacgggacatccccgagcgctcctggaatagcggctacgaatggatcaccgacttccccggcaagactgtgtggtttgtaccctccatcaagagcggaaacgacattgccaactgtctgcgaaagaacgggaagcgcgtaatccagctgtcccgcaagactttcgacacagagtaccagaagactaagaacaatgactgggactacgtggtcaccacggacatcagcgagatgggcgccaacttccgcgcggacagagtgatcgatccgaggcggtgtctcaaacccgtgatcctgaaggatgggcccgagcgcgtcatcctggccggacccatgccggttaccgttgcttccgccgcccagcggcgcgggcggattggccgcaaccacaacaaggaaggtgaccaatatatctacatggggcagcccctaaacaacgatgaggaccacgcgcactggacggaggccaagatgctgctggacaacatcaatacacctgagggcatcatcccggctctcttcgagccagagcgcgagaagtctgccgccatcgacggagagtatagactgcgcggcgaggctcgaaagacgttcgtggagctgatgcgcaggggggacctccccgtatggctgtcctacaaggtcgcgtcagagggcttccagtacagcgaccgtcggtggtgtttcgacggggaacgcaataaccaggtgttagaggagaacatggacgttgagatatggaccaaggagggggagcggaaaaagctccgccctcggtggttggacgcgcgcacctactccgatcccctggccttacgggagttcaaggagttcgccgcgggccgccggtccgtctccggggacctcatcctggagatcggaaagctcccgcaacacctaacccagcgcgcccagaacgccctggataacctcgtaatgctgcacaactctgagcaggggggacgcgcttatcgccacgcaatggaggagctgccggacacgatagagaccctgatgctgctggccctcatcgcggttctgaccggcggggttacactgtttttcttgtccggccggggactgggaaaaaccagcatcgggcttctctgcgtgatggccagcagcgtgctgctgtggatggcttccgtcgagccccactggattgcggccagcatcatcctagagttcttcctgatggtgctgctgatcccggagccggaccgccagcggaccccccaggataaccagctggcctatgtggtcatcgggctcttattcatgatcctgacagtggccgccaacgaaatgggcctgttagagaccaccaaaaaggacctgggtatcgggcacgtggcggtcgagaatcaccaccacgccgccatgctggacgtggacctacaccccgcaagcgcctggactctgtacgcggtggccactaccatcatcaccccgatgatgcgccacacgatcgagaacaccaccgccaacatcagcttaaccgccatcgccaaccaagcggccatcctcatgggactggataagggctggcccatctccaaaatggacatcggcgtcccgctgttagccctggggtgctacagccaggtgaaccccctgacgttaaccgcggcggttctgatgttggtcgcccactacgccatcatcgggccggggctccaggccaaggccacccgcgaggcacagaagagaaccgctgccggcatcatgaagaaccccacggtggacgggatcgtggccattgacttagaccccgtcgtgtacgacgccaagttcgagaagcaactgggccagatcatgctcctgatcctgtgtacctcccagattctcctaatgcgcaccacctgggcgctctgtgagagcatcacgctcgccaccggcccactcactaccctttgggaggggtcccccgggaagttttggaacacgaccatcgccgtgagcatggccaacatcttccgggggtcctacctcgccggcgcgggcctggccttcagcctgatgaagtccctcggtggcgggcgtaggggcacgggggctcaaggcgagacattaggtgagaagtggaagcgccagctgaaccaattatccaagagcgagttcaacacgtacaagcggtccgggatcatggaggtggaccgcagcgaggccaaggagggcctgaagcgcggggagaccaccaagcacgcggtgtcccgcggcacagctaagctgcggtggttcgtcgagcgcaatctcgtcaagccggaagggaaggtgatcgatctgggctgtggccgcggtgggtggagctactattgcgccgggctgaagaaggtgacggaagtcaaggggtacaccaaggggggccccggacatgaggagcccatccctatggccacctacgggtggaatctggtgaagttgcactccggcaaggacgtgtttttcatcccgcccgagaagtgcgacaccctgctgtgcgacatcggggagagctcgcctaacccgacgatcgaggaaggccgcaccctgcgggtcctgaagatggtggagccctggctgcgcgggaaccaattttgcatcaaaatcctaaacccctacatgccctctgtggtcgagacattggaacagatgcagcggaagcacggcggcatgctggtccgcaaccctctctccaggaacagcacccacgaaatgtactgggtgtcctgcgggactgggaacatcgttagtgccgtgaatatgacgtcgcgcatgctactgaaccgcttcaccatggctcaccggaagcccacctacgagagagacgtggacctcggggccggcacccggcacgtagccgtcgagcccgaggtggcaaacctggacatcataggccagcgcatcgagaacatcaagcacgagcataagagcacgtggcactatgacgaggacaacccctacaaaacctgggcctaccacgggtcctacgaggtcaagccgagcggtagcgcatccagcatggtcaacggggtagtgaaactgctcaccaagccctgggacgtgatccccatggtcacccagatcgccatgacggacaccaccccgttcggccagcagcgggtgttcaaggagaaggtagatacccgcacgccaaaggctaagcgggggaccgcccaaatcatggaagtcaccgccaagtggttgtggggattcctgtcccgcaacaagaagcctcggatctgcacccgcgaagagttcacccgaaaagtgcgcagcaacgcggcgatcggcgccgtgttcgtcgacgaaaaccagtggaactccgccaaagaggcggtggaggacgagcggttctgggacctcgtgcacagagagcgggagctgcacaagcaggggaagtgcgctacctgcgtctacaacatgatgggcaagcgcgagaagaagcttggggagttcggcaaggccaaggggtcccgggcgatctggtacatgtggctcggggcacggttcctggagttcgaggcgctgggcttcatgaacgaggaccactggttctcccgggagaattcactctccggggtcgaaggcgaggggctgcacaagctgggctacatcctccgcgacatcagcaaaattccagggggcaacatgtacgccgatgatacagccggctgggacacccggatcacggaggatgacctccagaacgaggcgaggatcaccgacatcatggagccggagcatgccctgctggctcgcagtattttcaagctgacctaccagaataaggtggtccgggtgcaacgccccgccaagaacggaaccgtgatggacgtcatctcgcgacgcgaccagcgtggctccggccaggtggggacttacggcctaaacacgttcaccaatatggaggcccagctaatacgccagatggagagcgagggtatcttctcccccagcgagctagagacccccatcctggccgagcgagtgctcgactggctggagaagtacggtgtcgaacgcctgaagcggatggcaatttccggggacgactgcgtggtgaagccgatcgacgaccgattcgcgaccgccctcaccgcgctgaacgacatgggcaaggtccgtaaagacatcccccaatgggagcccagtaagggctggaacgactggcagcaggtccctttttgctcccaccacttccaccagctgatcatgaaggacggacgcgagatcgtggtcccgtgccggaaccaggatgaactagtgggccgcgcccgcgttagccagggggccggctggagcctgcgcgagaccgcgtgcctggggaagtcctatgcccagatgtggcagctaatgtacttccaccggcgcgacctgcggctggccgcaaacgcgatctgctcggcggtccccgtggactggatccccacctcccgcactacctggagcatccatgctcaccaccagtggatgaccactgaggacatgctatccgtgtggaaccgcgtctggatcgaggagaacccgtggatggaggacaagacgcacattagctcctggggtgacgtgccgtacctggggaaacgggaggaccagtggtgcggaagcctaatcggccttaccgcccgggccacatgggcgaccaatatacaggtggccatcaaccaagtccggcgcctgatcgggaatgaaaactacctggactacatgacctctatgaagcggtttaaaaacgagagcgaccccgagggcgccctctggtga

SEQ ID NO: 24108 - RNA, 9879 nt, synthetic construct
  misc_feature 1..9879: note = derived and/or modified CDS sequence (opt11) from DENV-1__EU677171__SS-prME
  source 1..9879: mol_type = other RNA
agcgtgaccatgctgctcatgctgatgcccaccgctctggcattccacctcaccactcggggaggtgagccccatatgatagtgagcaagcaagaacggggcaagtcgctgctgttcaagaccagcgccggggtcaacatgtgtaccctcatcgccatggacctgggcgaactgtgcgaggacactatgacttataagtgcccccggatcacagaaaccgaacccgacgacgtggattgttggtgtaacgcaacggatacctgggtcacctacgggacctgcagccaaacgggcgagcaccggcgggacaagcggtccgtggccctagcgccccacgtgggcctggggctggagaccagaaccgagacctggatgtcatccgagggcgcctggaagcagatccagcgggtcgagacgtgggccctgcggcaccccgggttcaccgtgatcgcactgttcctcgcccacgcgatcggaacctcaatcacacaaaaggggatcatcttcatcctcctgatgctggtgactccgtccatggccatgcggtgcgtcggcatcgggagtcgcgactttgtagaggggctctccggggccacctgggtggacgtcgtgctggagcacgggagctgcgtgaccacgatggccaaggacaagcccacactggatatcgagttgctgaaaacagaggtcaccaaccccgcagtcctgcggaagctctgcatcgaggcgaagatctcaaacaccacgactgatagccgctgccctactcagggggaggccaccctggtggaggagcaggacgctaacttcgtctgccggcgtacgttcgtggaccgaggatgggggaacgggtgtggtttgttcggcaaggggtccctaatcacgtgcgccaagttcaagtgcgtgaccaagctcgagggtaagatcgtccagtatgagaacctgaagtacagcgtgatcgtgacggtccacacgggcgaccagcatcaggtggggaacgagtccactgagcacggtacgacagccaccatcacgccccaagcgcccaccacagagatccagctcaccgactacggagctctgaccctggactgctcaccccgcaccggcctcgacttcaacgagatggtcttactgacaatgaaggagaagtcctggctcgtgcacaagcaatggttcctggacttgcccctcccctggaccagcggcgccagcacatcccaggaaacttggaaccggcaggacttactggtgaccttcaaaaccgcccacgccaagaaacaggaggtagtggtgctcggcagccaggagggcgccatgcacacagccctgaccggggccaccgagatccagacctccggcacgaccaccatcttcgccgggcacttgaagtgccgcctcaagatggacaagctgaccctaaagggcatgagctacgttatgtgcaccgggtctttcaagctcgagaaggaggtggccgagacccagcacggcaccgttctggttcagatcaaatacgagggcaccgacgcgccctgcaagatcccattctctacgcaggacgagaaaggggtgacccagaacggccgactgatcaccgccaatccgatcgtgaccgacaaggagaagccggttaacatcgaggccgagccccccttcggggagtcctacatcgtgatcggcgccggcgagaaagcgctgaagttaagctggttcaagaaggggtccagcatcggaaaaatgttcgaggccacggcccgcggggcacgtcgcatggccatcctgggcgacacagcgtgggacttcgggtccatcggcggagtgtttaccagcgtcgggaagctggtgcaccagattttcggcacagcgtacggggtgctgttcagcggcgtcagctggacaatgaagatcgggatcggcgtgctgctgacctggctcggcctgaactcccgcagcacctccttgagcatgacctgcatagctgtcggattggtcacgctatacctgggcgtgatggtgcaggcggacagcgggtgcgtcatcaactggaagggccgggagctcaaatgtgggagcggcatcttcgtgaccaacgaggtgcacacctggacggagcagtacaagttccaggccgacagcccgaagcgattgtccgcggccatcggcaaagcctgggaggagggggtgtgcggaatccggagcgccacccgcctggaaaacatcatgtggaaacagatctccaacgagctcaaccacatcctgcttgagaacgacatgaagtttacggtggtagttggggacgtggccggcatactcgcgcaggggaagaaaatgatccggccccaacccatggagtacaagtacagctggaagtcctggggcaaagcaaaaatcatcggcgctgatgtacagaacaccacatttattatcgatgggccaaacactccggagtgccccgacgaccagcgcgcctggaacatatgggaggtcgaggactacggcttcgggatcttcacgaccaacatctggttgaagctgcgggactcatatacccaggtgtgtgatcaccgcctgatgtccgcggccatcaaggactctaaggccgttcatgccgacatgggctactggatcgagtccgaaaagaacgagacgtggaagttagctcgcgccagcttcatcgaggtcaagacgtgcatctggcccaagtcccacaccctatggagtaacggcgtactcgagtccgaaatgatcatccccaagatctacgggggcccgatctcacagcacaactaccggcccgggtatttcacccaaaccgccggcccctggcacctggggaagctggagttggacttcgatctgtgcgagggcacgaccgtggtagtggacgagcactgcggcaaccggggtccttccctccgcaccaccacggtgactggcaagatcatccacgagtggtgctgccgtagttgcacactgccgcccctccgcttccgcggggaggacggctgttggtacgggatggagatccgccccgtaaaggaaaaggaggagaatctggtcaagtccatggtgagcgccggaagcggcgaagtcgattccttcagcctcggcctgctttgcatatccatcatgatagaggaagtgatgcggagccgctggtcccggaaaatgctaatgaccggcacgttggccgtgttcttcctgctaataatggggcagctgacctggaacgacttgatccgcctctgcattatggtcggcgccaacgctagcgatagaatggggatgggcaccacctatctggccttaatggccacgttcaagatgcggccgatgtttgccgtaggcctcctgttccgccggctgacctcccgtgaagttcttctactgaccatcgggctcagcctagtcgcctccgtggagttgcccaacagcttagaggaactgggggacgggctggcgatgggcatcatgatccttaaactgcttaccgacttccagtcccatcagctctgggccacgctgctgagcctcaccttcatcaagaccacgttctccctgcactacgcctggaagacgatggcgatggtcctgagcatcgtgtcccttttcccgctgtgccttagcaccacctcccagaagaccacgtggctccccgtgcttctaggcagcctcggatgcaagccgctgaccatgttcctgatcgcggaaaacaaaatctggggccggcgctcctggccccttaacgaggggatcatggccgtcggcattgtgagcattctgctgagctccctattgaagaacgacgtacctctggcggggcccctcattgccggcggcatgctgatcgcctgctacgtcatcagcggatccagcgcagacctgtccctcgaaaaggccgccgaggtgagctgggaagaggaagctgagcactccggcgccagccacaacatcctggtggaggtacaggacgatgggaccatgaaaatcaaagacgaggaacgggatgacaccctgaccatcctcctgaaggcgacgctactcgccgtgtccggcgtgtacccgctaagcatcccagccacgctgttcgtatggtacttttggcagaagaagaagcagcgatccggggtgctctgggacacccccagcccgcccgaggtggagcgggccgtcctggacgatggcatttaccgtataatgcagcggggcctgctagggcggtcccaggtgggcgtcggggtgtttcaagaaaacgtattccacaccatgtggcacgtgacgcggggcgcagtcctcatgtaccaggggaagcgcttagagcctagctgggcgtccgtgaagaaggaccttattagctacgggggagggtggcggctccagggctcctggaacaccggggaggaggtccaggtaatagccgtggagcctggcaaaaaccccaaaaacgtgcagaccgcccccgggaccttcaagacacccgagggggaggtaggcgccatcgccctggacttcaagcccggtaccagtggctcccccatcgtgaacagggaggggaagatcgtgggcctgtacggaaacggtgtcgtgaccacgagcggcacgtatgtgagcgcgatcgcccaggccaaagcctctcaggaggggccgctcccggagatcgaggacgaggttttccggaagcgcaacctgaccatcatggacttacaccccgggtcggggaagacccggcgttacctcccggcgatcgtgcgagaggcaatcaagcgcaagctccgcaccctgatcctcgcccccacgcgggtggtcgcctccgagatggccgaggcgctgaagggcatgcccatccgctaccagaccaccgccgtcaagtccgagcacacaggcaaggaaatcgtcgatctgatgtgtcacgccacgtttaccatgcgtctcctgtcacccgtccgcgtcccgaactacaacatgatcatcatggacgaggctcacttcaccgaccccagctccatcgcggcgcgcgggtacatcagcacacgcgtcggtatgggggaggccgcagctatcttcatgacggccacgccgcccggctccgtcgaggcgttcccacagagcaacgccgtgatacaggacgaggagcgggacatccccgaacgctcctggaacagcgggtatgagtggatcacggacttcccgggtaagactgtgtggttcgtccccagcatcaagagcggcaatgacatcgccaactgccttcggaaaaacgggaagcgcgtgatacagctctcccggaagacattcgatactgagtaccagaagaccaagaacaacgactgggactacgtagtcactacggacatcagcgagatgggggccaacttccgagcggaccgggtgattgatccgcgccggtgcctgaaacctgtaatactgaaagacgggcccgaacgcgtcatattagctgggcccatgccggtgaccgtcgcctccgccgcgcaacggagggggcggatcggcaggaatcacaacaaagagggcgatcagtacatctatatggggcagcccctgaataatgatgaggaccacgcgcactggaccgaggcaaaaatgctgctcgacaacatcaacacccccgagggcatcatacccgccctgtttgagccggagcgcgagaagtccgctgcgatcgacggcgagtaccggctgcgcggcgaggctcggaagacgttcgtggagctcatgcgcagaggggaccttccggtgtggttgtcctacaaggtagccagcgagggcttccagtacagtgaccgccggtggtgcttcgacggcgagcgcaacaaccaggttctcgaggaaaatatggacgtggagatctggaccaaggagggagagaggaagaagctgcgccccagatggctggatgcacgcacctattccgaccccctcgccttgagagagttcaaggaattcgccgcgggccggcggtcagtcagtggggacctgatcctagagatcgggaaactgccgcagcacctgacacagcgagcccagaacgctctagacaatctggtcatgctgcacaacagcgagcagggcgggagggcctaccgccacgctatggaggagctcccagacacgatcgagaccctgatgcttctcgccctgatcgctgttctcaccggcggggtaaccctctttttcctgtccggaaggggtctaggcaagacctctattggcctcctgtgcgtgatggcttccagcgtcctgctgtggatggcttccgtcgaaccccattggatcgcggctagcatcatcttggagttcttcctgatggttctcctcatccccgagccggaccgccagcggaccccccaggacaatcagctggcatacgtggtcatcgggctcctgtttatgatcctgaccgtggccgccaacgaaatgggcctccttgagaccaccaaaaaggacctggggatcggccacgtggcggtcgaaaaccaccaccatgccgccatgctcgacgtagacctgcaccccgcctccgcctggacgctgtacgcggtggccaccaccatcatcaccccgatgatgcgccacacgatcgaaaacaccaccgccaacatcagcctgaccgccatcgccaaccaggcggccatactgatggggctggacaagggctggcccatcagcaagatggacatcggcgtccccctcctggccctggggtgctacagccaggtaaatcccctcacgctaaccgccgctgtgctgatgctcgtcgcccattacgccatcatcggcccggggctgcaggccaaggccaccagagaagcgcagaagcggaccgccgccggcattatgaagaaccccaccgtggacgggatcgtggcaatcgacctggaccctgtcgtttacgacgccaagttcgagaagcagctcgggcagataatgctgctgatcctctgcacgtcccagatccttctgatgcgtaccacctgggcgctctgcgagagcatcacgctggcaaccggccccctgaccaccctctgggaggggtccccgggcaagttctggaacacgaccatagcggtgagcatggccaacatattccgggggagttacctcgccggcgctggcctggccttcagcctcatgaagtccttggggggcgggcgtcgtgggactggagcccagggagaaacactgggcgagaagtggaagcggcagttaaaccagctgtccaagagcgagttcaatacgtacaagcgttccggaataatggaagtcgaccgcagcgaggccaaggagggcctgaagcggggggagaccaccaagcatgcggtgagccgcggcaccgccaagctccggtggttcgtggagcgcaacctggtcaaacccgagggaaaggtgatcgacctgggctgcggacgcgggggctggagctactattgcgccgggctgaaaaaggtgacggaagtcaagggctacaccaagggaggtcccggccacgaagaacccatcccgatggcaacctacgggtggaacttggtgaaactgcactccggcaaagacgtatttttcatcccccccgagaaatgcgacaccctgctctgtgacattggggagagctcccccaacccgacgatcgaggagggccgcaccctgcgcgttctgaagatggtggagccctggttgcgcgggaaccagttctgcatcaagatcctgaatccctatatgcccagcgtggtcgagacacttgagcagatgcagcggaaacacggcggcatgctcgtgcgcaatccgctgagtcgaaacagcacccatgagatgtactgggtgtcctgcggtaccggcaacatcgtcagcgctgtgaacatgacgtcccgcatgctgctcaaccgcttcaccatggcccaccgcaagcccacctacgagcgcgacgtggacctcggtgcgggcacccggcacgtcgccgtggagcccgaagtggcgaacctggacattatcggccagcgcatcgagaacatcaagcacgagcacaaaagcacgtggcattacgacgaggacaacccctacaagacctgggcctaccacggtagttacgaggtgaagcccagcggctcggcgagcagcatggtcaacggtgtcgtgaagctgctgacgaagccctgggacgtgatccccatggtcacccagatcgccatgactgacaccaccccgttcggccagcagcgggtgttcaaggagaaggtcgatacacgcacgccgaaggctaaaagagggaccgcccagataatggaggtaactgccaagtggctgtggggcttcctctcacggaacaagaagcccaggatctgcacgcgcgaagagttcacgcggaaggtgcgcagcaacgcagccatcggcgccgtgtttgtcgacgagaaccagtggaactccgccaaggaggctgtcgaggacgagcggttctgggacctggtccaccgcgagcgggagctgcacaagcaggggaagtgtgccacctgcgtttacaatatgatgggcaaacgcgagaagaagctcggggagtttggtaaagcgaaggggagccgggccatatggtacatgtggctgggcgcgcgcttcctggagttcgaggcgctcggcttcatgaacgaagatcactggttctcccgggagaatagcttgtccggcgtggagggcgaggggctgcacaagctgggctatatcctgcgcgacataagcaagataccagggggcaacatgtacgccgacgacaccgccggttgggacacacgaatcacggaggacgatctgcagaatgaggcccgcatcaccgatatcatggagccggagcacgccctcctggcgcgttccatcttcaaactgacctaccagaacaaggtggtccgcgtgcagcgtcccgccaagaacgggaccgtgatggacgtcattagccggcgcgatcagcggggctccggccaggtagggacatacggtctcaacacctttacaaacatggaggcccaactgatccgccagatggagagcgaggggatcttcagtccctcagaactggagacccccaacctagccgagcgggtgctggactggctggagaagtatggcgtggagcgcctcaaacggatggcgatctccggtgatgactgcgtggtgaagccaatcgacgaccgctttgcgacggccctgacggccctgaacgacatgggaaaggtccggaaggacatcccccagtgggagcccagcaaggggtggaacgactggcagcaggtcccgttctgctcccaccacttccaccaactcatcatgaaggacggcagagaaatcgtggtcccgtgcaggaaccaggacgagctggtgggccgtgcccgggtgagccagggggcaggctggagcttacgcgaaaccgcgtgcctcggtaagtcctacgcccagatgtggcagttaatgtacttccaccggcgcgacctgcggctcgcggccaacgcgatctgcagtgccgtccccgtggattggattcccacgtcccgcacgacctggagcatccacgcccaccaccagtggatgaccaccgaggacatgctgtccgtgtggaaccgggtctggatagaggaaaacccctggatggaggataagacccacatatcatcctggggcgacgtgccttacctggggaagcgagaggaccagtggtgtggcagtctcatcgggctgaccgcccgcgccacctgggcgaccaacatccaggtggccatcaaccaggtccggagactcatcgggaacgagaactacctcgactacatgacgtccatgaagcggttcaagaacgagagcgaccccgagggcgccctgtggtga

SEQ ID NO: 24109 - RNA, 9879 nt, synthetic construct
  misc_feature 1..9879: note = derived and/or modified CDS sequence (opt11) from DENV-1__EU677172__SS-prME
  source 1..9879: mol_type = other RNA
agcgtgaccatgctgctgatgctgatgcccaccgccctggccttccacctcaccaccaggggcggtgagccccatatgatcgtgagcaagcaggaacggggcaagagcctgctgttcaaaacaagcgccggggtcaacatgtgtacactcatcgccatggacctgggcgagctgtgcgaggacactatgacctacaagtgcccccgaatcaccgagaccgagcccgacgacgtcgactgctggtgcaatgcaaccgacacctgggtgacctacgggacctgcagccaaactggggaacatcgacgggacaagcggtctgtggccctcgcgcctcacgtgggcctgggcctggagacccgcaccgaaacctggatgagcagcgaaggcgcttggaaacagatacaacgggtcgagacgtgggccctccggcatcccgggtttaccgtgatagcactattcttggcccacgcgatcggcacgtcaataacccaaaaggggataatcttcattctcctcatgctggtcacgccctccatggcgatgcggtgtgtcggcatcgggtcgcgcgactttgtggaggggctctccggcgccacatgggtcgacgtcgtgctggagcacggctcttgcgtgaccactatggccaaggataagccaactctggacatcgagttgctgaaaaccgaggtcactaatcccgcggtgctgcgaaaattgtgcatcgaggcgaaaatcagcaacacaacgacggacagccgctgccccacccagggcgaggccaccctggtggaggaacaggacgccaatttcgtttgtcggcgcacgttcgtcgaccggggctggggcaacggctgtgggctgttcggcaaagggtctcttatcacgtgtgctaagttcaagtgcgtgaccaagctggagggcaagatcgttcagtacgagaacttaaagtattcagttatcgtgaccgtccacacgggcgaccagcaccaggtagggaacgagtctaccgagcacggcaccaccgccactatcacgccccaggcgcctaccaccgagatccagctcaccgactatggcgccctgacactggattgtagcccgcgcaccggcctcgatttcaacgagatggttctgctgacgatgaaggagaagtcctggctcgttcacaagcaatggttcttagacctgcccctcccgtggacgtcgggggcaagcacgtcacaggaaacctggaacaggcaggacctgctggtcaccttcaagaccgcccacgctaagaagcaagaggttgtggtgttaggctctcaggagggtgctatgcacactgcgttaaccggggccaccgagatccaaacgtccggcacgactaccatcttcgccgggcaccttaagtgccgtctcaagatggacaaacttaccctgaagggtatgagctatgtcatgtgcacgggatccttcaagttagagaaagagctcgccgagacccaacacggcacggttctggtgcagatcaagtacgagggaaccgacgcgccctgtaagatccccttctccacgcaagacgagaagggggtcacccagaacggccggctaatcacggctaacccgattgtgaccgacaaggagaagccagtcaacatcgaggccgagccgccatttggggagtcctacatcgtcatcggggcgggcgagaaggctttaaagttgagctggttcaagaaagggtcaagcatcggcaagatgttcgaggcgacggcccgcggggcccgtcgcatggcgatcctgggggatacagcatgggacttcgggtcaatcggcggtgtgttcactagcgtggggaaactcgtccaccagattttcgggactgcctacggggtactcttctctggcgtgagctggacgatgaagatcggcatcggcgtcctgttgacctggctgggcctgaactcccgcagcacttccctctccatgacctgcatcgccgtaggattggtgacgctttacctcggcgtcatggtgcaagctgattccggatgcgtgattaactggaagggccgggagctgaagtgcgggagcggcatcttcgttaccaacgaagtacacacatggaccgaacagtacaagttccaggccgactctccgaaacgcctatccgcggccatcggcaaggcctgggaggagggggtgtgcggtatccggagcgccacccgactcgaaaatatcatgtggaagcaaatctccaacgagttaaatcacatcctactcgaaaatgacatgaagttcacggtcgtggtgggggatgtcgccggcattctggcccaaggtaagaaaatgatccggccccagcctatggagtacaagtacagctggaagtcctgggggaaggccaagatcatcggcgcagacgcccagaatacgaccttcattatagacgggcccaacacccccgagtgccccgatgaccagcgcgcctggaatatctgggaggttgaggactacggctttgggatcttcactaccaacatctggctaaagctgcgggacagctatacccaggtatgcgaccaccgcctgatgtccgccgccatcaaggacagcaaagctgtccacgccgacatgggctactggatcgaatcggagaagaacgagacatggaagctcgcgcgggcttccttcatcgaagtgaaaacctgcatatggcccaagtcccacaccctctggagcaacggcgtgctcgagtccgagatgatcataccgaaaatatacggtggcccgatcagccagcataactaccgccccgggtacttcacccaaacagccggcccctggcatctggggaaattggagctggacttcgacctttgcgagggtactacggtggtggtggacgagcattgcggaaaccgggggccgtccctccgcaccacaacggtcaccggcaagatcattcatgagtggtgctgcagaagctgcaccctgccgcccttgcgcttcagaggggaagatggctgctggtacgggatggagatacgccccgtaaaggagaaggaagagaaccttgtgaagtccatggtaagcgccggcagcggcgaggtggactccttctctctggggctgctctgcatctccataatgatcgaggaggtgatgcggtccaggtggtcaagaaagatgctgatgaccgggacgctggccgtcttcttcttgctaacaatgggtcaactgacctggaacgacctcatccgcctgtgtatcatggtgggtgcgaacgccagcgatcgcatgggaatgggcaccacctacctggcactcatggccaccttcaagatgcggcccatgtttgccgtgggccttttgttccgccggctcacctcccgagaggtcctcctgctcacgatcggactgagcctggtcgcgtctgtggagctccccaactctctggaggagctgggcgacgggctggccatgggcatcatgatcctgaagctgctcacggacttccaatcccaccagctgtgggccaccttactcagcctgacgttcataaagaccactttctccctgcactacgcctggaagacaatggcaatggtcctctcaatcgtgtccttgttccccttgtgcctctcgaccacctcacagaaaacgacatggcttccagtcctgctcggtagcctggggtgcaaaccgctgactatgttcttgatcgccgagaacaagatctggggccgtcgctcttggcccctgaacgaagggatcatggcagttggcatcgtgtctatcctgttatcttccctcctgaaaaatgacgtcccgctcgctgggcccttaatcgcgggcggcatgctgattgcgtgctacgtaatctcagggtcgagcgccgacctttccctggagaaagccgcagaggtgtcgtgggaggaggaggctgagcattccggcgcgagtcataacatccttgtcgaagtacaggacgatgggaccatgaagatcaaggacgaggagcgggacgacacgttaacgatcctgctcaaggccaccctcttagccgtgtccggcgtctacccgctgagcatccccgccacccttttcgtatggtacttctggcagaagaagaaacagcgctccggggtcctgtgggacactccgagtccgcctgaggtggaacgggcggtgctagacgacggcatctaccgcatcatgcagcgggggctgctagggcgatcccaggtgggcgtaggagtgttccaggaaaacgtgttccacacgatgtggcatgtaactcgtggcgccgtcctgatgtaccagggcaaacgtctggaaccctcatgggcttccgtgaagaaggacttaatttcgtatgggggcgggtggcgacttcaggggtcctggaacaccggggaggaggtccaggtgattgcggtggagccaggaaagaaccctaagaacgtccagaccgccccggggactttcaagactcctgagggcgaggtgggggccatcgcgctggacttcaagccaggtacctctggttcccctatagtgaaccgcgaaggaaaaatcgtcggcctctacggtaatggggtagtgacgacgagcggcacctatgtaagtgcgattgcccaggccaaggcatcccaagaaggacccctacccgagatcgaggacgaggtgttccgtaagcgcaacctgaccatcatggatctccaccccggaagcgggaaaacccgccggtacctgccagccatcgtgcgcgaggccattaaacgcaagctgcgcacgctcatccttgcccccaccagagtcgtggcctccgagatggcggaggccctgaagggaatgccaatccgctatcagacaaccgctgtcaagagcgagcacacaggtaaggagatcgtagacctcatgtgccatgcgaccttcacgatgcgcctgctgagccccgtgcgagtgccgaactacaatatgatcatcatggacgaagcccattttacggaccccagctccatcgcggcacggggctacatcagcacgcgtgttggcatgggagaggccgccgccatcttcatgaccgcgacgccgccagggtccgtggaggccttcccgcagagcaatgccgttatccaggacgaggagcgggacattcccgagcgctcctggaatagcgggtatgagtggatcacagacttccccggcaagacggtctggttcgtgccatccatcaagagcgggaatgacatagctaactgtttgagaaagaacgggaagcgcgtgatccagctgtcccggaagaccttcgacaccgagtaccagaagaccaagaacaacgactgggactacgtcgtgacgaccgatatcagcgaaatgggcgcgaacttccgcgccgatcgggtaattgacccgcgccggtgtctgaagcccgtcatcctcaaagacgggcccgaaagggtgatcctagccggcccaatgccagtgacggttgcctccgccgcgcaacggcgcgggcggatcgggaggaaccacaacaaagagggcgaccagtatatctacatggggcagcccctcaataacgacgaggaccatgcccactggacagaggcgaagatgctcttggataacatcaacacgcccgaaggcatcatccccgccctgttcgagccggagcgcgaaaaatccgccgcgatcgacggtgagtaccgcctccgtggcgaggcccggaaaacattcgtagagctgatgcgccgcggggacctgcccgtctggctctcctacaaggtggccagcgaagggttccagtacagcgaccgccggtggtgcttcgatggcgagcgcaacaaccaggtactggaagagaatatggacgtcgagatctggaccaaggagggggagcggaaaaagctgcgcccgcggtggctggacgcccgcacctactccgacccgttggccctgcgggagtttaaggagttcgctgccggacgccggagcgtgtcgggggacctcatactggagatcggaaagctgccgcaacacctcacgcagcgcgcgcagaacgcccttgacaatctggtgatgctccacaactccgagcagggcgggcgggcgtaccgccacgccatggaggagctgcccgacaccattgagactttaatgctcctggccctgatcgccgtcctcaccggaggggttacgctgttctttctgtccggccgggggctcggcaagacgagtatcggccttctgtgcgtgatggcctcaagcgtcctcctatggatggcgtccgtggagccccactggatcgccgccagcatcatcctagagttcttcttaatggttctgctgatccccgagccggaccgtcaaagaacgccccaggacaaccagctcgcctatgtagtgatcgggctgctgttcatgatcctcaccgtggcagcgaacgagatgggcttgctggagacgacgaagaaggacctcgggatcggccacgtagctgtggagaaccaccaccacgccgcgatgctggacgtggacctgcaccccgccagtgcgtggaccctctacgccgttgccacgacgatcatcacgccgatgatgcgccataccatcgagaacaccaccgccaacataagcctcactgccattgcgaaccaggccgccattcttatggggttggataagggatggcccatcagcaagatggacattggcgtgcccctgctggccttgggttgctacagccaagtgaaccccctgaccttaaccgccgcggtcctcatgttagtggcccactacgccatcatcggcccggggctgcaggccaaggcgacacgcgaagcccagaagcggactgccgccggcatcatgaagaaccccacagtggacgggatcgtcgccatcgatctcgaccccgtggtgtacgacgctaagttcgagaagcagctgggccagatcatgctgctaatactgtgcacctcccagatactgctcatgaggaccacgtgggcactgtgcgaaagcataaccctggccaccggccccctcaccacgctgtgggaagggtcaccggggaagttctggaataccaccatagccgtctctatggccaacatctttcggggatcctacctggcgggcgccggcctggccttcagcctgatgaagtccttagggggcgggcgccgtggcaccggggcccagggcgagacgctcggcgagaagtggaagcgccagctgaaccagctttccaaatcagagttcaacacgtacaagcggtcaggaatcatggaggtggaccgaagcgaggcgaaggagggcctcaagcgcggggagaccacaaaacacgcggtgtcccggggcacggccaagttacgctggtttgtcgaacgcaacctggtgaaaccagaggggaaggtgattgacctgggctgcggccgcgggggctggagttattactgcgccgggctcaagaaagtaaccgaggtaaagggctacacaaagggcggcccaggccacgaggaacccatccctatggccacctacgggtggaatctggtcaagctgcattccggcaaggatgtcttcttcatcccgcccgagaaatgcgacaccctcctgtgtgacatcggggagagttctcccaacccgaccatcgaagagggtcgcaccctgcgggtactaaagatggtagagccgtggctgagagggaaccagttctgtatcaagatcctgaacccctacatgccgagcgtagtggagaccctggagcagatgcagcggaagcacggcggaatgctggtacgcaacccgctgtcccggaacagtacacacgagatgtactgggtgtcgtgcgggacgggcaatatcgtcagcgcggtgaacatgacctcccggatgctactgaaccgcttcaccatggcgcaccggaagcccacgtacgagcgcgacgtcgacctgggcgcaggcacgcggcacgtggcagtcgagcccgaggtcgccaacctcgatatcatcggccagcgcattgagaacataaagcacgagcataaaagcacctggcactacgacgaggacaacccctacaagacctgggcttaccatggctcctacgaggtgaaaccgtcagggtcagccagcagcatggtgaatggagtcgtcaagctgttaaccaaaccctgggacgttatacctatggtcacgcagatcgccatgaccgacactacccctttcggccagcagcgggtgttcaaggagaaggtcgacacacgcaccccgaaagccaagcgggggaccgcgcagatcatggaggtgaccgcgaagtggctctggggcttcctgtcccgtaacaagaagccccggatctgcaccagagaagagttcacacgcaaggtgcgcagcaacgcggctattggcgccgtattcgtagacgagaatcagtggaactccgcgaaggaggccgtggaggatgaacggttctgggaccttgtccaccgcgagcgcgagctccacaagcaaggcaagtgtgcgacttgcgtgtacaacatgatgggcaagcgcgagaagaagctgggggagttcggcaaggccaaggggagccgggccatttggtacatgtggctgggcgcgcgctttctcgagtttgaagccttagggttcatgaatgaggatcactggttctcccgcgagaatagcttgtccggggtggagggtgaggggctccacaaactgggctacatcctccgcgacatctcgaagatccctggagggaatatgtacgctgacgacaccgccggctgggacacgcgaataaccgaggacgacctccagaacgaggcccgaatcaccgatatcatggagcccgagcacgcgctgctggccaagtcgatcttcaagctgacctatcaaaataaggttgtgcgcgtgcaacggcccgcaaagaacgggactgtgatggacgtgatcagccgccgggaccagcgcgggtccggccaggtggggacgtacggtctgaataccttcaccaacatggaggcccaattgatccggcagatggaaagcgaaggaatcttcagccccagtgagctagagacgcccaacctcgcggagagggtcctggattggctagaaaagtacggcgtagagcggctcaagcggatggcaatctccggggacgactgcgtggtcaaaccgatcgacgatcggttcgccaccgccctgacagccctcaatgacatgggcaaggtgcgcaaggacataccacagtgggagccaagtaaggggtggaacgattggcagcaagttcctttctgcagccaccacttccaccaactgattatgaaggacggacgagagatagtcgtgccgtgtcgcaaccaggacgagctagtgggccgggcgcgcgtcagccagggggccggctggagcctccgggagaccgcctgcctggggaaatcctatgcccagatgtggcagctgatgtacttccatcgccgggatctccgtcttgccgcgaatgctatctgcagtgccgtgccggtggattggatccccacgagccgtaccacctggagcatccatgcccaccatcagtggatgaccaccgaggatatgctctctgtctggaaccgcgtgtggattgaggagaacccctggatggaggacaagacccatatcagctcctggggcgacgttccgtacctcgggaagcgagaggaccagtggtgcggcagcctgatcggactgaccgcccgcgcgacctgggccacgaacatccaagtcgccatcaatcaggtgagacggctcatcgggaacgagaactacctggactacatgacatccatgaagcgatttaagaatgagagcgatcccgaaggcgccctgtggtga

SEQ ID NO: 24110 - RNA, 9879 nt, synthetic construct
  misc_feature 1..9879: note = derived and/or modified CDS sequence (opt11) from DENV-1__EU677173__SS-prME
  source 1..9879: mol_type = other RNA
agcgtgaccatgctgctcatgctaatgcccaccgcccttgccttccacctcaccacacggggcggggagccccacatgatcgtcaccaagcaagagcggggcaaaagcctgctgtttaagaccagcgcgggagtaaacatgtgcaccctcattgccatggacctgggggagttgtgcgaagataccatgacctacaagtgcccccggatcaccgaagccgagcccgacgacgttgactgctggtgcaacgccaccgacacctgggtgacatacgggacctgctcccaaacgggcgagcaccggcgcgacaagagaagcgtcgccctcgcccctcacgtgggcctggggctggaaacgcgcacggagacctggatgtccagcgagggcgcctggaaacagatccagcgcgttgagacatgggccctccggcaccccgggttcaccgtgatcgccctattccttgcgcacgccatcggcacctccatcactcagaaagggatcatattcattctcctgatgctggtgacgccatcaatggccatgaggtgtgtcggtatcggctcacgcgacttcgtggaggggctcagcggcgccacatgggtggacgtcgtgctggagcacgggagctgcgtgaccacgatggccaaagacaagcctacgctggacatcgagctcttgaagaccgaagtaaccaaccccgctgttctgcgaaagctgtgcatcgaagctaaaatcagcaacactacgacagattcacgctgtcccacccaaggcgaggccaccctgatggaggagcaggatgccaacttcgtatgccggcgcacgttcgttgaccggggctgggggaacggctgcggtctatttggcaaggggagccttatcacgtgcgctaagttcaagtgcgttacgaagctggagggcaagatcgtgcagtacgagaacctgaagtactccgtcatcgtgaccgtgcacactggcgaccagcaccaggtcgggaacgagagcaccgaacacgggaccaccgcaaccattacgccccaggcgcccacctccgagatccagctcaccgactacggggccctgacactggactgtagcccccgcacgggcctcgactttaacgagatggtgctgctgactatgaaggagaagtcctggctcgtccacaagcagtggtttctggacctgccgctcccttggaccagcggggccaccacaagccaggagacctggaaccggcaggacttactggttaccttcaagaccgcccacgcgaagaagcaagaggtagtcgtgctcggctcccaggagggcgcaatgcacaccgcgctgaccggggctactgagatccagaccagcggaactaccaccatctttgccgggcatctgaagtgccgcctcaagatggacaagctgaccctgaagggcatgtcctacgtcatgtgtacgggtagcttcaagctcgagaaggaggtagcggaaacccaacacggaacggtactggtacagatcaagtacgaaggtaccgacgctccgtgtaagataccgttctccacgcaggacgaaaagggggtcacccagaatggccggctgattaccgccaacccgatcgtgacagacaaggagaagcctgtgaacatcgaggccgagccgcccttcggggagagctacatcgtgatcggcgcgggggagaaggcactgaagttatcctggttcaagaaggggagctccatcggcaagatgttcgaggccacggcccggggggcgcgtcgcatggcgatcctcggcgacactgcctgggacttcggcagcatcggcggcgtcttcacgtccgtggggaagctggtccaccagatctttggcaccgcctatggggtcctgtttagcggcgtgtcctggacaatgaagatcgggatcggcgtcttacttacctggctcggcctgaatagccgctccaccagcctgtccatgacctgtatcgccgtggggctcgtgacgctgtacctgggtgtcatggtccaggccgatagcggatgcgttataaactggaagggccgggagctcaagtgcgggagcggcatcttcgtcaccaatgaggtgcacacctggaccgagcaatacaagttccaggcggacagcccgaagcgattgtcggccgccattggtaaggcctgggaggagggtgtgtgcggcatccgatccgccactcgcctggagaatataatgtggaagcagattagcaacgagctcaaccacatcctgctggagaacgacatgaagttcacggtagtggtgggcgacgtcgtgggaatcctcgctcaagggaagaagatgatccgacctcagccaatggaacacaaatactcctggaagtcctggggcaaggccaagatcatcggcgccgacgtgcagaataccaccttcattattgatgggcccaacaccccggagtgcccggacgaccagcgcgcctggaacatctgggaggtcgaggattacgggttcgggatatttacgaccaacatttggcttaagctccgggactcctacacccaaatgtgcgaccaccgcctcatgagcgcggctatcaaagactccaaggcggtacacgccgacatgggctactggatagagagcgaaaagaacgagacctggaagttagcccgtgcgagcttcatcgaggtgaagacgtgcatctggcccaagagccacaccctgtggtcaaacggcgtcctcgagagcgagatgatcatacccaagatctacgggggcccgatctcccagcacaattacaggcccgggtacttcacccagacggccggcccctggcacttgggaaagctggagctcgacttcgatctgtgcgagggcacgaccgttgtggtggatgagcattgtggcaaccggggcccgagcctgcgcaccaccacggtcaccggcaagatcatccacgagtggtgctgtcggtcatgcaccctgccgcccctccggtttaagggggaggacggttgctggtatgggatggagattcggcccgtgaaggagaaggaggagaacctggtcaagagcatggtgtccgccgggagcggcgaggtggactctttctccttaggtctgttatgcatcagcatcatgatagaggaggtcatgagatccagatggagccgcaaaatgctcatgaccggtactctggccgtgttcctcctcctgattatggggcagctaacctggaacgacctcatccggctgtgcatcatggtgggggccaacgcctccgaccgcatggggatggggaccacctacctggccctcatggcgacctttaagatgcgccctatgttcgccgtcggcctgctgttccggcgcctcaccagccgggaggtcctgctgctcaccatcggcctgtccctggttgcctccgtcgagttgccaaacagtctggaagagctgggcgacgggctcgctatgggtatcatgatcttaaagctgctcaccgacttccagagccatcagctgtgggcaacactcctctcactgacctttattaagaccaccttaagcctccattacgcctggaagactatggccatggtgctgtccatcgtcagcctgttccccctctgcctgtccactacgagccagaagaccacgtggctgcccgtactcctgggctccctggggtgcaagccactcaccatgttcctgatcaccgagaacaagatttggggccgaaagagctggcccctgaatgaggggatcatggcggtgggcgtcgtgtccatcctcctgagctctttgctcaagaatgatgtgcccttggctgggcccctgatcgccggcggcatgctcatcgcctgctacgtcatctccggcagctccgccgatctgagcctggaaaaggcggccgaggtctcctgggaggaggaagccgagcacagcggcgcctcccacaacatactcgtggaggttcaagacgacgggaccatgaaaataaaggacgaagaacgggacgacaccctcacgatcctgctcaaagccaccctgttggcggttagcggcgtgtacccgctctccatccccgccaccctttttgtttggtatttttggcagaagaagaaacagcgctctggggtgctttgggacactcccagcccccccgaggtggagcgggccgtcctggatgacggcatctacaggatcatgcagagagggctcctcgggcgcagccaggtgggcgtgggagttttccaggagaacgtattccacacgatgtggcatgtgacccggggcgctgtcctgatgtatcaggggaagcgcctcgagccctcctgggccagcgtgaagaaggacctgatatcctacggcggcgggtggaggttgcagggcagctggaatgcgggggaggaggtgcaggtcatcgcggtggagcccggcaagaaccccaagaacgtgcagaccgccccgggcaccttcaagacgcccgagggcgaggtcggcgcaatcgccctcgacttcaagccgggaacttccggctctcccatcgtaaatcgcgaggggaagatcgtggggctgtacggcaacggggtcgtgaccacttccggaacgtacgtaagcgcgatcgcccaggccaaggctagccaggaggggcccctgcccgaaatcgaggacgaggtcttccggaagcgcaacttgacaattatggacctgcaccctggctcagggaagacacgccgctatctgccggcgatagtgagagaggccatcaaacgcaagttacggaccttgatattggcccctacgcgcgtggtcgccagcgagatggccgaggccctcaagggcatgcccatccgataccagaccaccgccgtgaagtccgagcacaccggcaaggagatcgtggacctgatgtgccatgccacgttcacgatgcggcttctgagccccgttcgcgtgccgaactacaatatgatcatcatggacgaggcccacttcaccgacccatccagcatagccgcgcgtgggtacatctcgacgcgcgtgggcatgggagaggccgccgccatcttcatgacggccacgccgcccggatcggtcgaggcgttcccacagagcaacgccgtgatccaggacgaagagcgagacatccccgagcgcagctggaatagcgggtatgagtggatcaccgactttcccggaaaaacagtgtggtttgtcccgagcatcaagagcggcaacgatatcgctaattgccttcggaagaacgggaagcgcgtcatccagctgagccgcaagacgttcgacaccgagtaccagaagacaaaaaacaacgactgggactacgtggtcaccacggacatatccgagatgggcgccaacttccgagcggacagagtgattgacccgcgcagatgccttaagcccgtgatcctgaaggacgggccagagcgggtcatcctggccggccccatgcccgtgaccgtcgccagcgcggcccagcggcgcgggaggataggcaggaaccataataaggagggcgaccagtacatatacatggggcagccgctcaacaacgacgaggaccatgcgcactggaccgaggccaagatgctacttgacaacatcaacaccccggagggtatcatccctgctctcttcgagccggagcgggagaagtccgccgccatcgatggggagtacagattgcgcggcgaggcgcggaagactttcgtggagctaatgcgccgcggtgacctgcccgtgtggctcagctacaaggtggcctccgagggtttccagtacagcgaccgccggtggtgtttcgacggcgagcgcaacaaccaggtgttggaggagaacatggatgtggagatctggacaaaggagggggagcggaagaagttgaggccccgatggctggacgcccgcacctacagcgaccccctggccctccgggagttcaaggaattcgccgcgggtagacggtccgttagtggggatctgattttggagatcggcaaactccctcagcacctgacccagcgcgcccagaacgccctggataacctggtgatgctgcacaattccgagcagggcggtcgggcctaccgccacgcgatggaagagctacccgacacaatcgagaccctcatgctgctggccctgatcgccgtgctgaccggcggggtcaccctgttcttcctcagcgggcgggggctgggcaaaacctctatcggcctcctctgcgtgatggccagctccgtactgctatggatggccagcgtcgagccccactggatcgctgcctccatcatcctagagttcttcctgatggtgctgttgatccccgagccggaccgccagcggacgccccaggacaaccagctggcctacgtggtaatcgggctcctcttcatgatcctgaccgtggccgccaacgaaatggggctgctcgagaccaccaagaaggacctggggatcggtcacgtggcggtcgagaaccaccaccacgcgacgatgctggacgtggacctccacccggcctctgcatggaccctgtacgcagtggcgactaccatcatcacgccaatgatgcgccacacgatcgagaacacgaccgccaacatttccttaacggccatcgccaaccaggccgcgatcctcatggggctcgataaggggtggcccataagcaagatggacatcggcgtccccctgctcgctcttgggtgctacagccaggtgaaccctctaactctaaccgccgcagtgctgatgctggtggcacactacgccatcattggtccggggctccaggccaaggccacgcgggaggcccagaagcgcacagcagccggcatcatgaagaaccccaccgtggacgggattgtggctatcgacctggatcccgtagtgtacgacgccaagtttgagaagcaactgggccagatcatgctcctaatcctgtgcacgagtcaaatcctcctaatgcgcactacgtgggcattatgcgagtccatcacgctcgcgaccggcccactaaccactctgtgggaggggagcccgggcaagttctggaacaccaccatcgccgtctcgatggccaacatctttcggggctcctacctcgctggcgccgggttggctttcagccttatgaaatccttggggggcgggcgccgggggaccggagcccagggcgagacgctgggcgagaagtggaaacgccagctgaaccagctcagcaaatccgaattcaacatctataagcggagcgggataatggaggtggaccgctctgaggccaaggagggcctgaagaggggcgagaccacccggcacgccgtgtcacgcggcaccgcgaagcttcgctggttcgtggaacgtaacctggtcaagcccgaggggaaggtgatcgacctcggttgtggccggggaggctggtcctactattgtgccgggttaaagaaagtgacggaggtcaaggggtacaccaaaggcgggcccgggcacgaggagcccatcccgatggccacttacgggtggaacctggtgaagcttcactccggcaaagacgtgttctttactccccccgagaagtgtgacacgctgctgtgtgacatcggagagtccagccccaacccgaccatcgaagagggccggaccctccgcgtcctgaagatggtggagccctggctgcggggcaatcaattctgtatcaagatcctcaacccctatatgccctccgtggtagagacactggaacagatgcagaggaagtacggcggcatgctggttagaaacccgctcagccgcaactcgacccatgagatgtactgggttagctgcgggaccggcaacatcgtctcggccgtaaatatgacttcccggatgctgttaaaccgtttcaccatggcccaccgcaagcccacttacgaacgggacgtggacctcggggcgggcaccaggcacgtcgccgtggagcccgaggttgccaacctggacatcatcgggcaacggattgagaacatcaagcacgagcacaagtccacttggcactacgacgaggacaacccctacaaaacctgggcctaccacgggagctatgaagttaagccgagtgggagcgcctcctccatggtgaacggggtcgtgaaactgttaaccaagccttgggacgtgatccccatggtcacccagatagcgatgaccgacaccactccctttggccagcaacgcgtcttcaaggagaaagtcgatacgcggaccccgaaggcgaaacgcgggaccgcccaaatcatggaggtcaccgccaggtggctgtggggcttcctgagccgcaacaagaagccccggatctgcactcgcgaggagtttacgcggaaggtgaggtccaatgccgcgattggcgcagtgttcgtcgacgagaaccagtggaacagcgctaaggaagccgtggaggacgaacggttctgggacctcgtgcagaaggagcgcgagctgcataagcaggggaaatgcgcgacctgcgtgtacaacatgatgggcaagcgggagaagaagctgggggaattcggcaaggccaagggctcccgcgccatctggtacatgtggctcggggcccggttcctggagttcgaggccctgggcttcatgaacgaggaccactggttcagccgcgagaactccctgagcggagtggaaggcgaggggctgcacaaactgggctacattctccgggacatatccaagatccccgggggcaatatgtacgcggacgacaccgccggttgggacacgcgcatcaccgaggatgacctgcaaaacgaggccaagattacagacatcatggaaccggagcacgcccttctcgccaccagcatcttcaagctgacgtaccagaacaaggtggtacgggtgcagcgaccagcgaaaaacgggaccgtgatggacgtcatctctcgccgggaccaacgcggcagcggtcaagtgggcacctacggcctgaacaccttcacgaacatggaggcccagctcatccgtcagatggagtccgaagggatcttcttacccagcgaactggagaccccgaacctcgccgaacgcgtgcttgactggctggagaagtacggcgtcgagcgactcaagcgcatggccatctccggggacgactgcgtggtaaagccgatcgacgatcggttcgccaccgcactgaccgccttaaacgacatgggcaaagtccgcaaagacatcccccaatgggagccctcaaaggggtggaatgactggcaacaggtccccttctgctcccaccacttccaccagttaatcatgaaagacggccgagagattgtggtcccgtgccgtaaccaggacgagttagtaggccgggcccgggtgagccagggcgccggctggtcccttcgggagacggcctgccttggcaagagctatgcgcagatgtggcaactgatgtacttccaccgccgggacctgcgcctcgccgcgaacgccatctgctcggccgtccccgtggattgggtgcccacctcccggaccacctggagcatccacgcacatcaccagtggatgacgaccgaggacatgctgtccgtctggaaccgcgtgtggattgaggagaacccctggatggaagacaagacccacgtgagctcttggggcgatgtaccctacttaggaaaacgggaggaccagtggtgcggcagccttatcggtctgacagcgcgagcaacctgggcctccaacatccaggtggcgatcaaccaggtgcgccggctgatcgggaacgagaactacctcgactacatgacgagcatgaagcgcttcaaaaacgagggtgaccccgagggcgccctgtggtga

SEQ ID NO: 24111 - RNA, 9879 nt, synthetic construct
  misc_feature 1..9879: note = derived and/or modified CDS sequence (opt11) from DENV-1__EU726779__SS-prME
  source 1..9879: mol_type = other RNA
tccgtgaccatgcttctcatgttaatgcctaccgccctggctttccatctcaccaccaggggtggggaaccccacatgatcgtaagcaagcaggaacggggcaagtctctgctgttcaagaccagcgctggggtgaacatgtgcactctgatcgccatggatttgggggaactctgcgaagacacgatgacctacaaatgcccacggatcaccgagactgaacccgacgacgttgattgctggtgcaacgccaccgacacctgggtaacctacgggacctgctcccaaacgggtgagcacaggcgcgacaagaggtccgtagccctagcgccccacgtgggcctcgggttagagacccgcaccgagacgtggatgagctccgagggggcctggaagcagatacagcgggtagagacctgggcccttcgccaccccggcttcaccgtgattgccctcttcctggcgcacgcaatcggtaccagcatcacacagaaggggatcattttcatcctcctgatgctggttactccctccatggccatgcggtgtgtgggtattggcagccgtgacttcgttgaggggctctccggcgcaacctgggtggacgtagtactggagcacgggtcctgcgttaccaccatggccaaggacaaaccaacgctcgatatcgagctcctcaagaccgaggtaaccaaccccgccgtgcttcgtaagctctgcatagaagcgaaaatttccaataccacgacggacagccgctgcccaacccaaggcgaggcaaccctggtcgaggagcaggacgccaacttcgtgtgccggaggacgtttgtcgaccgcggctgggggaacggctgcgggctctttgggaaggggtccctcatcacgtgcgccaagttcaaatgcgttaccaagctggagggcaaaatcgtacagtacgagaacttgaaatacagcgtcattgtgaccgtccacacgggcgatcagcaccaagtggggaacgaatccacagagcacggcaccactgccaccatcacgccccaggcgcccaccaccgagatccaattgaccgactacggagcccttactctggattgtagcccccgtacgggcctcgactttaacgaaatggtcctgctgaccatgaaggagaaatcgtggcttgtgcacaaacaatggttcctcgacctgcccctcccttggacctcaggggcgtccacgtcccaggagacctggaaccgtcaagacctgcttgtgacctttaagaccgcgcatgccaagaaacaagaggtcgtggtgctcggaagccaggagggtgccatgcatacggccctgacgggcgctaccgagatccaaacctctggcacgaccaccatattcgcagggcatctgaagtgccggttgaagatggacaagctgactctgaagggcatgagctacgtgatgtgcactgggtctttcaaacttgagaaggaagtggccgaaacccagcacggcaccgtgctggttcagatcaagtacgaggggactgatgcaccttgcaagatcccattcagcacgcaggacgaaaagggggtaacccagaacggacgcttgatcaccgctaacccaatagtaaccgataaagagaagcccgtcaatatcgaggccgaaccgcctttcggcgaatcgtacatcgtgattggtgcgggagagaaggctctgaagctcagctggtttaagaaagggagcagcatcggcaagatgttcgaggctacagccagaggggctcggcgcatggcaatactgggagacactgcatgggacttcgggtctatcggcggagtgttcacctcggtcgggaaactggtccaccaaatatttgggacagcttacggagtcttattctccggcgttagctggacgatgaagatcgggatcggtgtgctgctgacatggctcggcctgaactcacgaagcacctccttcagcatgacctgcatcgccgtgggccttgtaacgctctacctgggagtgatggtgcaagccgactctggttgcgtcatcaactggaagggccgggaattgaagtgcgggtcggggatcttcgtgacaaatgaggtgcacacgtggactgagcagtataagtttcaggctgacagtccgaagaggctatccgcagccatcggcaaagcctgggaggaaggagtctgcggtatccggagcgccacacgtctagagaatatcatgtggaagcagattagtaacgagttgaatcacatcctcctggaaaacgacatgaaattcacggtggtggtgggagacgtggcaggcatccttgcgcaggggaagaagatgattcggccacagcctatggagtacaagtactcctggaagtcctggggcaaggcgaaaataataggcgccgacgtccaaaacaccacttttatcatcgacgggccaaacacgcctgaatgcccagacgaccaacgtgcgtggaacatatgggaggttgaggactacggttttgggattttcacgaccaacatttggcttaaacttcgggatagctacacccaggtgtgtgaccaccgcctaatgtccgcggcgatcaaagattccaaagccgtgcacgccgacatggggtactggatcgagtccgaaaagaatgagacctggaagttggctcgggccagcttcatcgaggtcaagacgtgcatctggccaaagtcacacaccctgtggtctaatggggtgctggagagcgagatgataataccaaagatctacgggggccctataagccaacacaactatcgccccggatattttacccagacggcaggaccatggcacctggggaaacttgaactcgacttcgatctctgcgagggcacgacggtagtagttgatgagcattgcggcaacaggggcccgtccctacgcacgactaccgtgactggcaaaattatccacgagtggtgctgtagatcttgcaccctcccgcctctccgattcagaggggaggacggctgttggtatggcatggagatcagacccgtgaaggagaaggaggagaatctggtgaagtcgatggtaagcgccggcagcggggaggtcgactcctttagcctggggctcctgtgcatttccatcatgatcgaagaggtaatgcggagccgctggtcccggaagatgctgatgaccggtacgctcgccgtcttcttcctgctgattatgggacaacttacctggaatgacctgatacgcctttgcataatggtcggcgctaacgcttcagaccggatggggatggggaccacctaccttgcactgatggccacgtttaagatgagaccgatgttcgccgtaggcctcctcttccgccgactaacaagtcgtgaggtgctgctcttaaccatcgggctgtccctagtcgcatcagtcgagttgcctaacagcctggaggaacttggcgacgggctagcgatggggataatgatccttaagctcctcaccgattttcagtctcaccagctgtgggccacgctccttagtctgaccttcattaagaccacgttctccctccactatgcctggaagaccatggctatggtcctaagcatcgtttctctgttccccctttgtctgagcaccacgagtcagaagaccacgtggctgcccgttctcctgggatctctggggtgcaagccgctcacaatgttcctgatcgcggaaaacaagatatgggggagacgctcctggcccctcaacgaggggatcatggcagtcggtatcgtgagtattctcctgtcctcactcctcaaaaacgatgtgcccctggccgggccccttatagccggcgggatgcttatcgcctgctatgtaatctcggggagctctgcggacctttccctcgagaaagcggcagaggtaagctgggaggaggaggcggagcactctggcgcctcccacaacatcctagtagaggtacaggatgacgggaccatgaagattaaggatgaggagcgggacgacaccctgactatcctgctcaaagcgacgctgctcgcggtttccggcgtgtatcctctctcaatccccgcaactctgtttgtctggtacttctggcagaagaagaagcagcgttccggggtcctgtgggacaccccctcgccccctgaggttggccgtgccgtacttgatgacggaatctaccggatcatgcagcgcgggttgctaggccgcagtcaagttggcgttggagtctttcaggaaaacgtatttcataccatgtggcacgtcacgagaggggccgtcctgatgtaccaggggaagcgactcgagcctagctgggcatccgtcaaaaaggacctgatctcctacggagggggctggcgactgcagggttcatggaacactggggaggaagtgcaggtcattgcagtggagcctgggaaaaatcccaagaatgtgcaaaccgcgcccggtacctttaaaacgccagaaggcgaggtcggggccatcgccctggacttcaaacccgggacaagtgggtcccccatagtgaaccgcgagggcaagatcgttggactgtacgggaacggagtagtaacgacctcagggacctacgtatccgcgattgctcaggccaaagcgtcccaggagggaccgctgcctgaaatcgaggacgaagtgtttagaaaacgaaacctgactatcatggaccttcaccccgggagcgggaagacccgccgctacctgccggcgatcgtgcgcgaagccatcaaacgcaagctcagaacgctgatcctagcacccactcgcgtagtcgcctccgagatggccgaagcgttgaagggcatgcccatccgatatcagacaaccgctgtcaagtccgagcacacagggaaagagatagtggacttaatgtgccacgccacgttcacaatgaggttgctctcccctgtccgcgtgccaaactacaacatgataatcatggacgaggctcattttaccgacccctccagtatcgcagcacgggggtacatatcaacgcgcgtcgggatgggcgaggccgccgccatctttatgacagcgaccccgcctgggtccgtagaagcgtttccccagagtaacgctgtcatacaggacgaggaacgggacatcccggagcgatcttggaacagcggctatgaatggatcaccgactttcccggcaagacagtgtggttcgtcccctccatcaagtcagggaacgatatcgcgaattgtctgcggaagaacggcaagcgcgtaatccaactctcccggaagacattcgacaccgaataccagaaaaccaagaacaacgattgggactacgtcgtcaccacggacatcagcgagatgggggcaaacttccgcgccgacagagtgatagacccgcgccggtgccttaagccggtgatcctgaaggacggccccgagcgggtgattctggccgggcccatgcccgttactgtagcctccgccgcccagcgtcgcggacggatcggtcgcaatcataataaggaaggagatcagtatatctacatgggccaacccctcaataacgatgaggaccacgcgcactggaccgaggccaaaatgctgttagacaacatcaacaccccggaggggatcatccccgccctcttcgagccagaacgcgagaagtccgccgcaatcgacggtgagtaccgactgagaggggaagcgagaaagacgttcgtggagctgatgcgcaggggcgacctccccgtgtggctgtcctacaaagtcgcgagcgaggggttccagtatagcgacaggcggtggtgcttcgacggggagaggaacaatcaggtcctggaagagaacatggacgtcgagatctggactaaggaaggcgagcgcaagaaactacgcccgagatggttagatgcacggacctactccgacccactcgcactccgggagtttaaggagttcgccgcgggccggcgaagcgtgtcgggcgacctgattctggagatcggtaagctcccgcagcatctgacacagcgcgcacagaacgcactggacaatcttgtgatgttacacaacagcgaacagggcggccgggcctacaggcacgctatggaggagcttcctgacacgatcgaaaccctcatgctgctggccctgattgccgtgctcaccgggggcgtgactttattctttctctccgggcggggactcggcaagacctccataggcctgctgtgcgtgatggcctcctcagtgcttctgtggatggcctccgtcgagccgcattggattgcggcgagtatcatcctggagttcttcctgatggtgctgttaatcccggagccggaccgccagcggacgccccaagacaatcagctcgcctacgtggtcatcggcctcctgttcatgatcttaaccgtggcagccaacgagatggggttactcgagactactaagaaggacctgggcatcgggcatgttgctgtcgagaaccatcaccacgccgcaatgctagacgtcgacctccaccccgcctccgcctggactctttacgcagtagccaccactatcatcactccgatgatgcgccatacaattgagaacaccacggcgaacatctcgctgacggccattgccaaccaggcggccattttaatgggtctggacaagggctggcccatctctaagatggatatcggcgtgccactgctagccttaggctgctactctcaagttaacccccttacgctaaccgccgctgtgctgatgctggtcgcccactacgccataatcggccccggcttacaggctaaagccacacgcgaggctcagaagcgcaccgcagccgggatcatgaagaatcccacggtggatggcattgtggccatcgacctcgaccccgtcgtgtacgatgccaagttcgagaaacagctagggcagattatgcttctcattctgtgcacgtcccaaattctcctgatgcgcacaacatgggctctatgtgagagcattacactagccacagggcctctgacgacactgtgggagggctccccggggaagttttggaatacaaccattgcagtgagcatggccaacatcttcagaggctcctacctcgccggagccgggctggcttttagcctgatgaagtccttagggggcgggcgccgggggactggggcacagggagagacgctgggggagaagtggaagcgccagttaaatcagctcagtaagagcgagttcaatacctacaagcggtccggcataatggaggtcgacaggtcggaagccaaggaggggctgaagcggggcgagaccaccaagcacgcggtgtcacgcgggactgccaagttgcgatggttcgtggaaaggaacttggttaagcccgagggaaaggtgatcgacctgggatgtgggcgcggtgggtggagctactattgcgccggcctgaagaaggtgacagaggtcaaagggtacaccaaagggggacccgggcatgaggaacccatcccgatggccacctacggctggaacctggttaaactccattccgggaaggatgtgttcttcatcccacctgaaaagtgtgacacactgttgtgtgacatcggcgagtcctctcccaaccctaccatcgaggaggggcgcaccctccgggtcctaaagatggtagagccgtggctgcgcggcaaccagttctgcatcaagattctcaacccatacatgcccagcgtggtagaaactctcgagcagatgcagcgtaaacacggaggaatgcttgtaaggaacccgctctcgaggaacagcacccacgagatgtactgggtttcttgcgggacggggaacatcgtcagtgcagtgaacatgacctcccgcatgttattaaacaggtttaccatggcgcaccggaaaccgacgtacgagcgggacgtggacctcggtgccggcacgcggcatgtagccgtagagcccgaggtggccaatttggacatcataggacaacgtatcgaaaatatcaaacacgaacacaagagcacgtggcattacgacgaggataatccatataaaacctgggcctaccacggatcctacgaggtgaaaccgtccggctccgcaagcagcatggtgaacggagtagtaaaactgctcactaagccctgggacgtgatcccaatggtgacccagatagcgatgacagataccacgccgttcggtcaacagcgggtgttcaaagagaaagtggatacaaggacgccgaaggccaagcggggcaccgcccaaatcatggaggtgaccgccaagtggctgtggggattcctttcccgcaacaagaaaccccggatctgcacccgtgaggagttcacacgcaaagtgcgttccaacgcggccatcggcgccgtgttcgtcgacgaaaaccaatggaactcggccaaggaggcagtggaagacgagaggttctgggacctggtacacagagagagggagctgcataagcaagggaagtgcgcgacgtgcgtgtacaatatgatgggtaagcgcgaaaagaaactgggcgagttcgggaaggcgaagggttcacgcgctatctggtatatgtggcttggggcccgctttctggagttcgaagcgctaggattcatgaacgaggaccactggttctcccgggaaaatagcttgtccggcgtagagggggagggcctgcataagctcggatatattcttcgcgacatcagcaatatcccgggaggcaacatgtacgctgacgataccgccggctgggacacccggatcacggaggacgatctgcagaacgaagctcgtattaccgatatcatggagccggagcacgccctgctcgcaaagtcaatctttaagctgacctatcagaataaggtagtgcgtgtgcagcggccggccaagaacggcaccgttatggacgttatcagcagacgtgaccagcgcgggtccggacaggtgggaacgtacggactcaataccttcactaacatggaggcccagctcatcagacagatggagagcgagggcatattctctcctagcgagctggagacccccaacctggcggagagagtgctcgactggctggaaaagtacggggtcgagagactcaagcgtatggccatctccggcgacgactgcgtggtcaagcccatcgacgacaggtttgccacggccctcacggctctgaacgacatggggaaggttagaaaggacattccccagtgggagccctccaaaggatggaatgattggcagcaggtcccattctgctcccaccacttccaccaactgatcatgaaggacggcagggagatcgttgtcccgtgtaggaatcaggacgagctggtggggcgggcccgcgtgagccaaggcgcaggctggagcctgagagagaccgcgtgcctgggcaaatcttacgcgcagatgtggcagctcatgtattttcatcggcgtgacctgcgccttgccgcaaacgcgatatgctccgcagtgccagtagactggatcccgacttctcgtacaacctggtcaatccacgcccatcatcaatggatgaccaccgaggacatgctctcagtttggaatagggtctggatcgaggaaaacccctggatggaggacaagacgcacatcagctcttggggcgatgtgccttatctggggaaacgcgaagaccagtggtgtggcagcctgatcggcctcaccgccagggccacctgggcgactaatatacaggtagccatcaaccaggtgcgccggctgattggtaatgagaactacctggactacatgacctcgatgaagcgcttcaagaacgagtccgacccagagggggccctgtggtag

SEQ ID NO: 24112 - RNA, 9879 nt, synthetic construct
  misc_feature 1..9879: note = derived and/or modified CDS sequence (opt11) from DENV-1__EU677176__SS-prME
  source 1..9879: mol_type = other RNA
tccgtgactatgctgcttatgcttatgcccaccgccttggccttccatctcactacccgaggcggggagccccacatgatcgtcagcaagcaggagagaggcaagtcattactgtttaaaaccagtgccggtgtgaacatgtgcaccctgatcgctatggacctgggggagctgtgcgaggacaccatgacatacaagtgcccccgcatcacggaggtcgagcccgacgacgtggactgctggtgcaacaccaccgacacttgggtgacctacgggacgtgcagccagacgggcgagcatcggagagacaagcggtccgtggccctcgcgccgcacgtcgggctcgggctggagacccgcgcagagacttggatgtcgtccgagggcgcctggaagcaaatccagaaggtggaaacttgggcactccggcaccccgggttcactgtgatcgccctgttcctagctcacgcgatcggcacaagcatcactcaaaagggaatcatatttatactcttaatgctggtaaccccctccatggcgatgcgctgcgtaggcatcggcagccgggactttgttgaaggcttgtctggcgccacgtgggtcgacgtggtgctagagcacggaagctgcgtcaccaccatggccaaagacaagcctaccctagacatcgagctgctgaagacggaggtgactaaccccgcagttcttcgcaagctctgcatcgaagcgaagatctccaacaccaccacggacagcaggtgcccgacccaaggcgaggccaccctagtcgaggagcaggacgctaacttcgtgtgtcgcagaaccttcgtggaccgcggctgggggaacggctgcgggctgttcgggaagggcagtcttatcacctgcgccaagttcaagtgtgtaacgaagctggagggaaagatcgttcaatatgaaaatctgaagtactcggtaatcgttaccgtgcacaccggcgaccagcatcaagtcgggaacgagtccacggagcacggcaccaccgcaaccatcacgccccaggcgcccacgtccgagatacagctcaccgactacggggccctaaccctagactgcagccctcggaccggtctggatttcaacgagatggttctgttgacgatgaaggagaagtcatggctcgtacacaagcagtggtttttagatcttcccctcccctggacctctggggccagtacgtcccaggagacgtggaaccgccaggacctgctggtcacctttaagaccgcccatgccaagaagcaggaggtagtggtcctcggctctcaggagggggcgatgcacaccgccctgaccggggccacggagattcagaccagcggtaccaccacaattttcgccgggcatctgaagtgcaggttgaagatggataaactgaccttgaagggcatgtcctacgtgatgtgcaccgggctgttcaagctggagaaagaggtggcagaaactcagcacggcacggtcctggtgcagattaagtatgaagggaccgatgcaccctgcaagatccctttcagcacccaggacgagaagggagtgacccagaacggccgcctgatcacggccaatccgatcgtgacggacaaggagaagcccgtgaacatcgaagccgagcccccctttggggagtcctacatcgttatcggcgctggggagaaagcgctcaagcttagctggttcaaaaagggttccagtatcggcaagatgttcgaagccaccgcccgtggcgcccgacgaatggccatcctgggcgacaccgcgtgggatttcgggtctatagggggcgtcttcacgtctgtggggaagctcgtacaccagatcttcggcaccgcctacggggttctgttctccggcgtgagctggacgatgaagatagggatcggcgtgctgcttacatggctgggcttaaactcccgcagtacgtccctcagtatgacctgtatagccgtcgggctggtgaccctatacctcggcgtgatggtccaggccgactccgggtgcgtgataaactggaaaggtcgagagctaaagtgcggaagcggcatctttgtaacgaacgaagtccacacgtggacagagcagtacaagttccaggccgactctcctaagcggctatccgcggctatcggcaaggcctgggaggaaggcgtgtgcggtatccgctccgcaacccgtctcgagaatatcatgtggcgccagatctccaacgagctgaatcacatcctgctcgagaacgatatgaagttcaccgtggtcgttggggacgtggtcggcatcctggctcaagggaagaaaatgatccggccgcagcccatggagcataagtattcctggaagtcctggggcaaggcaaagatcatcggcgccgacgtgcagaacaccacgttcattattgacggacccaataccccagagtgccccgatgaccaacgcgcttggaacatctgggaggtcgaggattacggctttgggatctttactaccaacatctggctgaaactccgggacagctacacgcaggtatgcgaccaccgtctgatgagcgccgcaatcaaggacagtaaggcagtgcacgcagacatgggttactggatcgaatccgagaaaaacgagacctggaaactggctcgggccagttttattgaggtgaagacctgcatctggccgaagtcccacaccctctggagcaacggcgtactagagtccgagatgatcattcctaagatctacgggggtccgatcagccagcacaactaccgccccgggtactttacgcagaccgctggcccctggcaccttgggaagctcgagctggacttcgacctgtgtgagggcactaccgtggttgtggacgagcactgcggcaaccggggcccctccctccgcacgaccaccgtaaccggcaagataatccacgagtggtgctgtcggtcatgcacgctccctcccctgcgtttcaaaggggaggatggctgctggtacgggatggagatccgccccgtgaaggagaaggaggaaaacctagtgaagtccatggtgagcgcgggctcgggcgaggtggactcctttagtctggggctgctctgcatctccatcatgatcgaggaagtcatgagaagccggtggtcccgcaagatgctgatgaccgggaccctggccgtgttctttctactgatcatggggcagttgacctggaacgacctcattcggagctgcatcatggtgggtgccaacgcctccgaccgcatgggaatgggcacaacataccttgcgctgatggccaccttcaagatgcgcccgatgtttgccgtcgggttgctgttccggcggctgactagtcgggaggtgttactcctgacgatcggtttatccctggttgcaagcgtggagttgcccaactccctagaggagctgggagacgggctggccatgggcatcatgatcctcaaactgttgacagatttccagagctaccagctttgggctaccctcttatccttaacctttattaagactaccttcagcctgcattacgcctggaagaccatggccatggtgctgtccatcgtcagcctcctacccctttgtctctccacaacgagccagaagaccacctggttaccagtcctgctcggcagcttaggatgcaagccgttaaccatgtttctcatcgccgagaacaagatctgggggcgcaagtcatggcccctcaatgaggggattatggcggtgggcatcgtcagcattctgttgtccagcctgctgaagaacgacgtgcccctcgccgggcccctgatcgccggcggcatgctgatcgcctgttatgtgatctcaggtagctccgccgacctcagcctggagaaagcggctgaggtctcctgggaagaagaggccgagcacagcggcgcctcccacaatatactggttgaagtccaagatgacgggacaatgaagatcaaggacgaggagcgtgacgataccctcaccatcctgcttaaggcgaccctcctggccgtcagcggcgtgtacccgctgtcgatcccagcaactctcttcgtgtggtatttctggcagaagaaaaagcagcggagtggcgtcctgtgggacacgccctcaccgcccgaggtggaacgggccgtgctggacgacggaatctaccgcatcatgcagcgagggctgctagggcgctcgcaggtaggcgtaggggtgttccaggagaacgtattccatacaatgtggcacgtcacccggggtgcagtgctgatgtatcaaggtaagcgccttgagccctcctgggccagcgtcaagaaggacctcatcagttacggcggaggatggcggctgcaaggcagctggaatacgggagaggaagtacaagtcatcgcggtcgagcctggaaagaaccccaagaacgtgcagacagcccccggtaccttcaagacgcccgagggcgaggtaggagccatcgccctggacttcaagcccggaacctccggcagccccatagtgaaccgcgaggggaagatcgtgggattatacggcaacggggtcgtcacgaccagcggaacgtacgtgtccgccattgcgcaggccaaggcgagccaggaggggccgctgcccgagatcgaagacgaggtgttccggaagcgtaaccttaccatcatggatctccaccccgggtctgggaaaacaaagcggtacctgcctgcgatcgtccgcgaggcgatcaagcggaagttgcgcacgctgatccttgcccccactcgggtggtggcctcagagatggccgaagcattaaaaggaatgccgatccgatatcagaccacggcggtcaagtctgagcacactgggcgcgagatcgtggacctcatgtgccatgcgacattcacaatgcgcctattaagtcccgtgcgtgtcccaaactacaacatgatcatcatggacgaggcccacttcacggacccctccagcatcgccgcccgggggtatatctccaccagggtgggtatgggggaagcggccgcaattttcatgacggccacgccgccgggctccgtggaagccttcccgcagtccaacgccgtcatccaggacgaggagcgggacatccccgagcgctcgtggaactccgggtacgagtggatcacggacttccccggcaagaccgtgtggttcgtgcccagcatcaaatccggcaacgacatagccaactgccttcggaagaatgggaagcgcgtcatccagctgagccgtaaaaccttcgacaccgagtaccagaagacgaagaacaacgactgggattacgtggtgaccaccgacatctccgagatgggcgccaatttcagagccgaccgggtcatcgacccgcggcggtgcctgaagcccgtgatcctcaaggacggtcccgagcgcgtcatattagcgggcccgatgccggttaccgtggcctcagcggcccagcgccgtgggcgcatcggcaggaaccacaataaggagggcgaccagtacatctacatggggcagccccttaacaatgacgaggaccatgcgcactggacagaggcgaagatgttgttagataatatcaacacgcccgagggcatcatcccagcattgtttgagcctgagagggagaagagtgccgccatcgacggtgagtaccgcttgcggggcgaggcgcggaagactttcgtcgaactgatgagacgcggggacctgccagtctggcttagttataaggtcgccagcgagggcttccagtactccgaccgccggtggtgtttcgatggcgagcgcaacaaccaggtccttgaggagaacatggacgtggagatctggaccaaggagggtgagcggaagaagctgcgaccccggtggttggacgcccgcacgtacagcgacccactagccctgcgggagttcaaggagttcgctgctgggcgcaggtccgtcagcggggacctcattctggagatcggcaagctgcctcagcacctcacccagcgcgcgcagaacgccctggacaacctggtcatgctgcacaactccgagcagggcgggagggcctatcgccacgccatggaggagctgcccgacactatcgagactctgatgctcctggcgttaatcgcggtgctaacaggaggggtgaccctgttcttcctgtctgggcgggggctcggcaagacctccattgggctgttgtgcgtcatggcatcgtccgccctcctgtggatggcctctgtggaaccccattggatcgcggcgagtatcatcctggagttctttctcatggtgctgctgatccccgagccagaccggcagcggacgccccaggacaaccagctcgcctacgtcgtgatcgggctgttgttcatgatcctaaccgtggccgccaacgagatgggcctgctcgagacgaccaagaaagacctcggaatcgggcacgttgcagttgagaaccaccaccacgctaccatgcttgatgtggacctgcacccagccagcgcctggaccctctacgccgttgcgacaaccatcatcaccccgatgatgcgccacacaatcgagaacacgaccgcgaacatttctctgaccgccatcgccaaccaggccgcgatcctaatggggctcgataagggctggcccatcagcaagatggacatcggcgtgcccctgctggcgctcgggtgctactcccaggtgaaccccctgaccctgacggccgccgtgctcatgcttgtggcgcactacgccatcattggcccgggcctgcaggccaaggcaacccgggaggcccagaagcgcaccgcggccgggatcatgaaaaaccccacggtggacggtattgtcgccatcgacctggacccggtggtgtacgatgccaagttcgagaaacagctcggccagattatgctcctgatcctgtgcacgagtcaaatcttactcatgcgcaccacctgggccctgtgtgaaagcatcaccttggcgacgggcccactcaccaccctgtgggaggggagccctggcaagttttggaacacaacgattgctgtatctatggccaacatcttccgggggagctatctggccggcgcgggtctggcgttcagcctgatgaagtcccttgggggcggccgacgagggaccggggcccagggggagaccctcggcgagaagtggaagcgccagctgaaccagctgagcaagtcagagttcaatacgtataagcgaagcggtatcatggaggtagaccgctccgaggccaaggaaggcttacggcgcggggagacgaccaagcacgctgttagccggggcacggccaagctgcgctggtttgtcgaacggaacctggtgaagccggaggggaaggttatcgacctgggttgcggacgaggaggctggagctactattgcgccgggctcaagaaggttaccgaggtgaagggttacaccaagggcgggcccggacacgaggagcccataccgatggcaacctatgggtggaacctggtgaagctgcactccggtaaggacgtcttcttcatcccgcctgagaagtgtgacaccctgctgtgcgacatcggggagtctagccccaatccgaccatcgaagagggccggacgctccgcgtgttaaagatggtggagccctggctgagggggaaccagttctgcatcaagatcctgaatccctatatgcccagtgtcgtggagacccttgagcagatgcagcgcaagcacggcggcatgctggtgcggaacccactgagccgtaactccactcacgagatgtactgggtcagctgtggcaccggcaacatcgtatccgccgtgaatatgaccagccggatgctcttaaatcgcttcacgatggcccacagaaagccaacctacgaacgggacgtcgacctgggggcgggcacccgccacgtggccgtggagcctgaggttgccaacctggacatcatcggccagcggatagagaatatcaagcacgaacacaaatccacctggcattatgacgaagacaatccctacaagacgtgggcctaccacgggagctacgaggtgaaacctagtggcagcgcgagctcaatggtaaacggagttgtgaagctactgaccaagccctgggacgtcatacccatggtgacccagatcgcgatgaccgacacgacccccttcggtcagcagcgagtcttcaaggagaaggtagacacccggaccccgaaggctaaacgcgggacggcccagatcatggaagtgaccgcccggtggctgtggggcttcctgtcacgtaacaagaagcctcggatctgtacccgcgaggagtttactcggaaagtacgatccaacgcagcgatcggcgccgtctttgtggacgagaaccagtggaactcggccaaggaggccgtggaggacgagcggttctgggacctagtgcaccgcgagcgggagctccataagcagggcaaatgcgcgacgtgcgtgtataacatgatgggaaagcgcgagaaaaagctgggagagtttggcaaggccaaagggtcccgggccatctggtatatgtggctgggcgcccgcttcctcgagttcgaggcgctgggctttatgaacgaggaccactggttcagccgagagaacagcctgagcggggtggagggcgaggggctccacaagctaggctacatcctgcgtgacatctccaagatcccgggcggcaacatgtatgccgacgataccgctggctgggacaccagaatcaccgaggacgacttgcagaatgaggccaagatcacggacatcatggagccggagcacgccttgctggccaccagcatcttcaagctcacctaccaaaataaggtggtgcgcgttcagcgccccgcgcggaacgggaccgtcatggacgtgatttcacgacgggatcagaggggcagcggtcaagtcggcacgtacggccttaacaccttcaccaacatggaggcccagttaatcagacagatggagtccgagcgcatcttcagcccgagcgagctcgaaacacccaacctggccgagcgggtcctggactggctcgagaagcacggggtggaacgcctaaagaggatggccattagcggcgacgactgcgtggtcaagccgatcgacgaccgattcgccacggcgcttagtgccctcaacgatatgggaaaggtgcgcaaggacataccccaatgggaacccagcaagggctggaacgactggcagcaagttcctttctgtagccatcactttcaccagctgatcatgaaagacgggagagaaatcgtcgtgccgtgccgcaaccaggacgaactggtgggcagagcccgggtatcccaaggcgccggatggtcactccgcgagaccgcctgcctgggtaagtcctacgcgcagatgtggcaactgatgtacttccaccgccgcgacttgcgtctggccgcgaacgccatctgtagcgcagtgcccgtggactgggtgcccacctcccgcaccacgtggagcatccacgctcatcatcagtggatgacaaccgaggatatgctgtcagtgtggaaccgcgtttggatcgaggagaacccctggatggaggacaagacccacatcagcagctggggcgacgtcccttacctgggcaagcgggaagaccagtggtgcgggagcctgatcggactgacggcccgcgccacgtgggccaccaacattcaagtcgctattaaccaggtgcggcggctcatcggcaacgagaactatctggactacatgacctccatgaagcgattcaagaacgacagcgatcccgaaggggccctgtggtaa

SEQ ID NO: 24113 - RNA, 9879 nt, synthetic construct
  misc_feature 1..9879: note = derived and/or modified CDS sequence (opt11) from DENV-1__EU726780__SS-prME
  source 1..9879: mol_type = other RNA
tctgtgaccatgctgttaatgcttatgcccaccgccctggccttccatttgaccacacgtggtggggaaccccacatgatcgtaagcaaacaagaacgcgggaaaagcctgctctttaagacctccgctggggttaacatgtgtactctcatagctatggacctgggcgaactgtgtgaggacaccatgacgtacaaatgcccgcggataaccgagacggaaccagacgatgtggactgctggtgcaacgccacggacacctgggtcacctatgggacgtgcagccagacgggcgagcatcggcgagacaagcggagtgtggcgttagcgccccacgtgggcctgggtctggaaaccaggactgagacttggatgagctccgagggtgcctggaagcagatccagcgggtagaaacctgggccctgagacaccccgggttcactgtgatcgccttgttcctggcgcatgcgatcgggaccagcatcacccaaaagggcataatcttcatactcctgatgctagtcacgccctcgatggccatgcgatgtgtgggcatcgggagcagggattttgttgaggggctctccggtgccacctgggtggacgtcgttcttgagcacggtagctgcgttaccaccatggcgaaagacaagcccacgctggacattgagcttctgaagaccgaagtcaccaaccccgccgtcctccggaagctatgtatagaggcaaagatcagcaacaccacgaccgattcacgctgcccaacccagggcgaagccaccctggtggaggagcaagatgccaatttcgtgtgtaggcgcaccttcgtggaccgaggctgggggaacgggtgcggactatttggcaaggggtccctcattacgtgtgcaaagttcaaatgcgtgacgaagctcgagggcaagatagtgcagtacgaaaacttgaagtactctgtaatcgtaaccgttcacacgggcgaccagcaccaggttgggaacgagtctaccgaacacggcacgacagcaacgatcacaccccaggcgcccactacggaaattcagctcaccgattacggggctctgacgcttgattgctccccacggacaggcctggatttcaacgagatggtcctattgaccatgaaggagaaatcctggctagtgcataagcagtggtttctagacttacctctgccctggacaagcggggcatccacatctcaggaaacatggaatcggcaggacctgttggtgaccttcaagaccgcacacgccaagaaacaagaggtagttgtgctcggcagccaagaaggcgcaatgcatacggccctgaccggcgctacagagatccaaacctccggcactaccaccatcttcgctggccacttaaagtgccgtctgaagatggacaaactgaccctgaagggcatgtcttacgtcatgtgcacgggatccttcaagttagaaaaagaggtagcagaaacgcagcacggtacagtgctcgtccagatcaagtacgagggcacggacgcgccctgcaagatcccattctccacgcaggacgagaagggcgtcactcaaaacggacggttgatcaccgcgaatcccatcgtcaccgataaggaaaagcctgtcaacatagaggccgaaccgccattcggggaatcctacatcgtgatcggcgcaggggagaaaacgctaaagttgagctggttcaagaaaggcagtagcattggcaagatgttcgaggcaacggctcgcggggcgcggcgcatggccatcctgggcgacaccgcctgggacttcgggtcgatcggcggcgtgttcacctcagtagggaagctggtgcaccagattttcggcactgcatacggggtcttattctcgggtgtcagctggactatgaagatcggaatcggagtgctcctcacctggctcggactgaactcccgaagcacctctctgtcgatgacctgcatcgccgttggacttgtcaccctgtacctaggggtgatggtgcaagctgatagtgggtgtgtaatcaactggaagggacgggagctcaagtgcggtagcgggatcttcgtaaccaacgaggtccacacatggaccgagcagtataagttccaagcagactcaccgaagagactgtccgccgcgatcggcaaggcctgggaggaaggggtttgcgggattcgaagcgccacgcgcctagagaacatcatgtggaagcagatctctaacgagttaaaccacatcctgctggagaacgacatgaagttcaccgtcgttgtaggggacgtggccggcattctcgcccaggggaagaaaatgattcggcctcaaccgatggagtacaagtacagctggaaatcctggggcaaagcgaagattattggggccgatgtgcagaacaccaccttcattatcgacgggcccaacacgccggagtgtcccgacgaccaacgcgcctggaacatctgggaggtcgaggattacggcttcggaatcttcactaccaacatctggctgaagctccgggactcttatacccaggtgtgcgaccatcgcctgatgtcagctgcgatcaaggacagcaaagccgtccacgccgacatgggttactggatagagagtgagaagaacgagacgtggaaactagcgagagcctcttttatcgaggtcaagacatgcatatggcccaagtcccataccttgtggagcaatggcgtacttgagtccgagatgatcatccccaagatctacggaggaccgatctcgcagcataattaccgccctgggtacttcacacagacggcgggcccgtggcacctagggaagctggagctagactttgatctctgcgaaggcaccaccgtggtcgtggacgagcactgcgggaaccggggtccctccctacgcaccacgactgtgacgggcaagatcatacatgagtggtgctgcaggtcttgcaccctgccgcccttgaggttccgaggtgaagacggctgctggtacgggatggagatccgcccagtcaaggaaaaagaggagaacctggtcaaatccatggtgtcggcaggcagcggcgaggttgacagtttctcgcttgggctgttgtgcattagcataatgatagaggaggtcatgcggagccggtggtcccggaagatgctgatgacagggacattagccgtgttctttctgctcatcatggggcagctgacctggaacgatctgatacggttatgcatcatggtaggagcgaacgccagtgataggatggggatgggtaccacgtacctcgctctcatggccacatttaagatgcggcccatgttcgccgtcggactcctttttcgacgcctcacatcccgcgaggtgttgctactaaccattgggctgagcctggtagcttcagtggaactgcccaacagcctcgaggagctcggggatggcctagccatgggcatcatgatcttgaagctgctcacggacttccagagccatcaactttgggtcaccttattgagcctcactttcatcaagacaacgttctccctccattatgcgtggaaaaccatggctatggtcttgtcgattgtgtccctctttcccctgtgcctcagcactacaagtcaaaagacaacatggctcccagttcttctgggatcgcttggatgtaaacctctgaccatgttcctgattgccgaaaataagatttggggccgacgatcctggcccctcaacgaaggaataatggccgtcggaatcgtgtcaatcctgcttagctcgctcctgaaaaacgacgtgccgctggcggggcccctcatcgctggcggtatgttgatagcctgttacgtgatcagcgggagctcggccgatctgtccctcgagaaggcagcggaggtgtcgtgggaggaggaagctgagcactccggcgcgagccacaacatcctggtagaggtgcaggacgacggtactatgaagatcaaggacgaggagcgcgatgacacgctgacgatcctccttaaggcgaccttattggccgtgagtggcgtctacccccttagcatccctgcgaccctcttcgtatggtacttttggcagaagaagaaacagcgttccggagttctctgggatacgcccagcccgcccgaagtcgagcgggccgtattggacgatggcatctaccgcatcatgcagcgaggcctgcttggccgctcccaggtgggcgtcggggtcttccaggagaacgtattccacacgatgtggcacgtcacacgaggcgcagtgctcatgtaccaggggaaaaggctcgagcccagctgggcctcggtgaaaaaggacttgatcagctatggcggcggatggcgcctacaaggtagctggaacacaggggaggaggtccaggttatcgccgtggagccaggcaagaaccccaaaaacgtgcagaccgcgcccgggacattcaaaacgcccgagggagaggtgggtgccatagccctggacttcaagcccggcaccagcgggtctcccatcgtaaatcgcgagggcaagattgtcggtctctacggtaacggggtggttaccacgagcggaacgtacgtcagcgccatagcacaggcaaaggcttcacaggaagggccgctcccggagatcgaggacgaagtgttccgcaagcgcaacctgaccatcatggatctccaccccggcagtgggaagacgaggcgctacctcccggccatagtacgagaggcaattaagcgtaagctgcgcacgctgatcttggcgcccacccgggtcgtggcttccgaaatggccgaggcactgaagggtatgcctatccgataccagacaactgccgtcaagtctgagcacacgggtaaggagatagtcgacctgatgtgtcacgctacgtttacaatgagacttctctcccccgtgcgggtgcccaactacaacatgataatcatggatgaggcacactttaccgaccctagctccatcgccgcacggggatatatcagcacgcgcgtcggcatgggggaagccgcggccatattcatgaccgctacgcctcctggaagcgtggaagccttcccccagagcaacgccgtgatccaggacgaggagcgtgatatccctgagagatcctggaacagcggatacgagtggataaccgacttccccggcaagaccgtttggttcgtaccttccataaagagcggtaacgatatagcgaactgtctcaggaagaacggtaaacgagtcattcagttatcccggaagacctttgacactgaataccagaagaccaaaaataacgattgggattacgtcgtgacgacggacatctcggagatgggcgccaatttccgcgccgatcgggtgattgacccccgtcggtgcctgaagccggtgatcctaaaagacggcccggagcgcgtgattttagcagggccgatgccggttaccgttgcgtccgccgcgcagaggagaggacggatcgggcgcaaccacaacaaagaaggcgatcagtatatctacatgggacaacccctgaacaacgacgaagatcacgcccattggaccgaggcaaagatgctgcttgacaacatcaatacgcccgagggcatcattcccgcactgttcgagccggagcgcgaaaaatccgcagctatcgacggtgagtacaggctccgcggcgaagctcgcaagaccttcgtggagctcatgcgcagaggggacctgcccgtctggctgtcatataaggttgcttccgagggattccagtacagcgatcgacggtggtgctttgacggcgagcgcaacaaccaggtgctagaagaaaacatggacgtggagatatggactaaggaaggggagcgaaagaagctgcgtcctcggtggctggacgcccgcacgtactcagaccctctagctctgagagaatttaaggagttcgccgctggccgccggtccgtgtccggagacctgatctcagagatcggcaagctcccgcaacatctgacgcagcgcgcgcagaatgcgctggacaacttggtgatgttacataattccgagcagggcgggcgggcctatcgccacgccatggaggaactgcccgacaccatcgagaccctcatgttactggcactcattgcggtcttgaccggaggggtgaccctgttcttcctcagcggccgcgggctgggcaaaacatccatcggcctgctgtgcgttatggctagctcggtgctgttgtggatggccagcgtggaaccacactggatcgccgcttccatcatcctcgagtttttccttatggtgctgcttatccccgagccggaccgacaacggacgcctcaagataatcagcttgcgtacgtggtaattgggcttcttttcatgatactgaccgtggccgccaacgagatgggcttgttggaaaccaccaagaaagacctggggatcggccacgtcgccgtggagaaccaccaccacgccgcgatgctcgacgtggacttacaccccgcaagcgcatggaccctgtatgctgtggcgaccacaattataacgccgatgatgcgccacaccatcgagaataccactgccaacatctccctgacggccatcgccaaccaggccgcgatcctcatggggctggacaaaggctggcccatcagcaagatggacatcggggtgcccctccttgcgctcggatgttacagtcaggtaaaccccctgacactcaccgccgccgtcctgatgctggttgcccactacgctatcatcggcccggggctccaagccaaagctacccgggaagcacagaaacgtaccgccgctgggatcatgaagaaccccaccgtcgacggaatagtcgctatcgacctggaccccgttgtgtacgatgcaaagttcgagaagcagctgggccagatcatgctcttgatcctgtgtacctctcagatcctcctcatgcgcactacgtgggcactgtgtgaatccatcactctcgcgaccggcccgctgaccactctgtgggaagggtcgccgggcaagttctggaataccaccatcgccgtctccatggccaatatcttccgagggagctacctcgccggcgcagggctggcattctcgctcatgaaatctcttggcgggggacgcagaggcaccggtgcgcagggcgagaccttgggcgagaagtggaaacgtcaactcaaccaactctccaaatccgagtttaatacctacaagcggagcgggatcatggaggtggatcgctcagaggccaaggagggcctgaagcgcggggagacgactaaacacgctgtgtcacgagggaccgcaaagctacggtggttcgtcgagcgtaacctagtgaagcctgaagggaaggttatcgacctgggatgcggccgcggagggtggtcctactactgtgctgggttaaagaaggtcaccgaggtgaaggggtacacgaagggcgggcccgggcacgaagaacccattccgatggccacgtacgggtggaacctggtaaagctccactcaggaaaggacgtattctttattccgcccgagaagtgcgacacgctcctgtgcgacatcggggaatccagccctaacccgaccatcgaggaaggccgaaccctccgggtgcttaaaatggtagagccatggctccgcgggaaccagttctgtattaagatactcaacccctacatgccatccgtcgtagagaccctggagcagatgcaacggaagcatggtggcatgctggttagaaacccactcagccggaactccacccacgagatgtactgggtctcttgcgggacgggaaacatcgtaagtgccgtgaacatgaccagcaggatgttactgaatcgcttcaccatggcacaccggaaacctacctacgagagagacgtcgacctaggtgcaggcacgcggcacgtggctgttgaaccggaagtcgctaatttagacataataggccagcgcatagagaacatcaagcatgagcacaagtccacctggcactacgatgaggataacccgtacaagacctgggcttaccacgggtcgtacgaggtgaagccatccggcagcgcctccagcatggtcaatggggtggtgaagttattgaccaagccctgggatgtcatccccatggtgacgcagattgccatgaccgataccacacccttcggccaacaacgggtgtttaaagaaaaagtggatactcgcacccctaaggcgaagcggggtaccgcccaaatcatggaggtgaccgctaagtggctgtggggtttcctaagccggaacaagaagccccggatctgtacgcgagaagagttcacccggaaggttagaagcaacgccgctatcggcgcggtcttcgtggacgagaaccagtggaactctgcaaaagaggccgtggaagacgagaggttctgggacctggtccaccgcgaacgggagctacataagcaagggaagtgcgcgacttgcgtctacaacatgatgggcaaacgtgagaagaaacttggtgagttcggaaaggcaaaagggagccgggctatctggtacatgtggttaggagctcgcttcctggagttcgaggccctgggctttatgaacgaggatcactggttcagccgagagaactccctaagcggggtcgagggagaggggctgcacaaactgggctacatactacgagatatctccaagattcccggagggaacatgtacgcggatgataccgcgggttgggacacgcgaataactgaagatgatttacagaacgaagcccgcatcaccgacatcatggagccggagcacgccctacttgctaagagcatcttcaagttgacctaccagaataaggtcgtgcgcgtacagcggcccgctaagaacggtacggttatggacgtgatctcacgccgggatcagcgaggctcgggtcaagttgggacctacggcctgaataccttcacgaacatggaggcacagctcatccgacaaatggaatccgaggggatcttctcaccctcggagctcgagacgcccaacctggccgagcgggtcttggactggcttgagaaatacggcatcgagcggttgaagagaatggcaatcagcggggacgactgcgtggtgaaacctatcgacgaccgatttgctaccgctctcaccgcgctcaacgacatgggcaaggtacgaaaagatatccctcagtgggagccttccaagggttggaatgactggcagcaagtccccttctgcagtcaccatttccaccagttaatcatgaaggatggtcgggaaattgtggtcccgtgcaggaaccaggacgagttggtgggcagagcccgagtcagccagggggcgggctggagtctgcgggaaaccgcctgtttaggcaaaagctatgcccagatgtggcagctcatgtacttccaccgccgggacctgcgcttagccgccaatgcgatctgctctgccgtccccgtcgactggatccccacaagccggaccacgtggtctattcatgcgcaccatcagtggatgaccacggaggacatgttatcggtgtggaaccgcgtatggatcgaggagaatccctggatggaggacaagactcacatctcctcctggggcgacgtgccatacctgggcaagcgcgaagaccaatggtgcgggagtttaatcggccttacagcccgtgccacctgggccaccaacatccaggtggcgattaaccaggtccgccggctaatcggaaatgagaactatcttgactacatgacaagcatgaaacgcttcaagaacgagtccgaccctgaaggggcgctctggtaa

SEQ ID NO: 24114 - RNA, 9879 nt, synthetic construct
  misc_feature 1..9879: note = derived and/or modified CDS sequence (opt11) from DENV-1__EU726781__SS-prME
  source 1..9879: mol_type = other RNA
agcgtgaccatgctgcttatgctgatgccgacggccctagctttccatttgacgacccggggtggtgaaccccacatgatcgtgagtaagcaggaacggggcaagagcctgcttttcaagaccagcgcaggggtaaatatgtgcaccctcatcgccatggacttaggggaattttgcgaggacacgatgacctacaagtgtccacgaatcaccgaggccgagcccgatgacgtagactgttggtgcaacgcaaccgacacgtgggtgacctacgggacctgcagccagacaggcgagcaccggcgagataagcggtcagtagcgctggcgccccacgtgggccttggtctagagacacgaaccgagacctggatgagctcagaaggagcttggaagcagatccagcgagtggagacatgggccctgcgtcatcccggattcacggtaattgccttgttcctggcgcacgctatagggacctcgatcacgcagaaggggatcatcttcatcctactcatgctggtgacaccctccatggcaatgcggtgtgtcggcatcggctctcgcgacttcgtggaggggctgtccggggctacctgggttgacgtcgtactagagcatgggtcgtgcgtcacgactatggcaaaggacaagcccaccctggacattgagctccttaaaacggaagtcaccaacccagctgtgctgcgaaaactttgtatagaggctaagatctccaacaccacaacggacagccggtgcccgacccagggcgaggctacccttgtggaagaacaggacgccaactttgtctgccggcgcacattcgtcgaccgcggctgggggaacggctgcgggctgttcggcaaggggagtttaataacgtgcgcaaagtttaagtgcgtgaccaagctcgaaggcaagacggtacaatatgagaacctcaagtacagtgtgatagtgaccgttcacaccggcgatcaacatcaggtggggaatgaaagtacggagcatggcaccaccgcgaccatcactccccaggcgcccagcaccgagatccagcttaccgactacggggcattgaccctggactgcagcccccggacgggcctggatttcaacgagatggtcctcctgaccatgaaggagaagtcctggctggtgcacaaacagtggttcctcgatcttccgctcccctggaccagcggggcctcaacatctcaggagacatggaaccgcaaggacttgctggtgaccttcaagactgcccacgcgaagaaacaagaggtggtggtactgggctcccaagagggggcgatgcacaccgcccttacaggtgcaaccgagatccagacctccggcacgacgaccatattcgccgggcacctgaaatgccgccttaaaatggacaaactcacactgaaaggcatgtcctacgtcatgtgcaccgggagcttcaagctggagaaagaggtggcggagactcagcacggaaccgtgttggtccagataaagtatgagggaactgacgccccgtgtaagatcccctttagcacccaggacgaaaaaggggtgacgcagaacggcaggctgatcaccgccaacccgatcgtgaccgataaggagaagcccgtaaacatcgaggcagagccgcccttcggggaaagctacatcgtgatcggtgcgggagaaaaggccctcaagctgtcctggttcaagaaagggtcctccatcgggaagatgttcgaagccaccgcccggggtgcccgccggatggcgattctcggcgacacggcctgggacttcgggagcatcggtggcgtgttcacctcggtcggcaagttagtgcaccagatcttcggcaccgcttacggggtcctgttttcgggcgtatcctggaccatgaagattgggatcggagtgctcctcacttggctaggactcaacagccgatcaacctcactgtccatgacctgcatcgtggtaggactggtgacactctacctgggggtcatggtccaggccgacagcggctgcgtaatcaactggaagggccgggagctgaaatgcggtagcggcatttttgtgacgaacgaggtccacacttggaccgagcaatacaagttccaggctgactcccctaagcgcctctccgcggccataggcaaagcctgggaggagggggtgtgtggcatccggtctgccactcgcttagagaacataatgtggaagcagattagcaacgaactgaaccacatccttctggagaacgacatgaaattcaccgtggttgtgggggatgtggctggcatcctggcgcaggggaagaagatgatccggccacaacccatggagtacaagtacagctggaagtcctggggcaaggccaagataatcggtgccgacgtccagaacacaacattcatcatcgatggccccaacaccccggaatgccccgacgaccagcgcgcctggaacatatgggaggtagaggattacggcttcgggatcttcaccacgaacatctggttgaagctgagggacagctacacccaggtgtgcgaccacagactaatgagcgcggcgataaaagactctaaggccgttcatgcggatatgggatactggatcgagagcgagaagaacgagacttggaagctcgcccgagcgtccttcatcgaagtgaagacctgcatctggccaaagagccacacgctctggtccaacggagtactggaaagcgagatgatcatccctaaaaactatgggggcccgatttcccagcataactaccgccctggatacttcacacaaaccgccggaccatggcacctcgggaagctggagctggactttgacctctgcgagggcaccacggttgtggtggacgagcactgcggcaatagggggccgagcctgcggaccacgactgtcacagggaagatcatccacgagtggtgctgcagatcctgtaccctgccgccgctccgtttcaagggggaggacggctgctggtacgggatggaaattaggcccgtgaaggagaaggaggaaaatctcgtcaagagcatggtctcagccggctccggcgaggtggacagcttctcactgggactcctgtgcatctccattatgatcgaagaggtgatgcgctctcggtggagcaggaaaatgctgatgaccggtacactggccgtcctgttcctcctcatcatggggcagcttacgtggaatgacctaattcggctctgcatcatggtcggcgccaatgcgtccgatcgcatggggatgggtactacgtatctcgccctgatggccacgtttaagatgcgaccgatgttcgccgtaggtctactgtttcgtagactgacgtcgcgggaggttctcctgctgacaatcggcctcagtctggtagcctcagtggagctacccaactccctagaggagttaggcgacgggctggccatgggcatcatgatcctcaagctgctgaccgatttccagagccaccagttatgggccaccctgctgtccctcacgttcatcaaaaccaccttcagcctgcactacgcctggaagacgatggcgatggtcctgtccatagtgagcctcttcccattatgcctctccacgaccagtcagaaaactacctggctacccgtcttgttaggctccctcgggtgcaagccgctgacgatgttcctgatcgctgagaataagatctggggccgcaagagttggcccctcaacgagggcataatggccgtgggcatcgtgagcatactactgtcgagcctgctgaagaatgatgtccccctggccgggcccctcatagccggaggaatgctgatcgcctgctacgtaatctccgggagcagcgcggacctgagcctcgaaaaggccgccgaggtgagctgggaggaggaggccgagcatagcggagcctcccataacattctggtcgaggtgcaagacgacgggaccatgaaaatcaaggatgaggagcgggacgacaccctgaccatcctcctgaaggctaccctgctggcggtatctggcgtgtacccgctatccattcccgctacactcttcgtgtggtacttctggcagaagaagaagcagcgcagcggtgtgttgtgggatacacccagtcctcccgaggtcgagagagcagttttggacgacggcatataccgcatcatgcaacgagggctgctgggccgcagccaggtcggcgtcggagtattccaggagaacgtgtttcataccatgtggcacgtcacccggggcgcggtgcttatgtatcaggggaagcgcttggagccttcctgggcgtccgtcaagaaggacctaatctcgtacggcggcgggtggcggctccagggcagctggaatacgggggaggaagtccaggtgatcgcggtagaacccggcaagaaccccaagaatgtccagaccgccccggggacctttaagacttccgaaggagaggtgggcgccattgcactagacttcaagcccggcacaagcggcagccccatcgtgaaccgcgaggggaagattgtcggcctgtacggcaacggggtggtaaccacttccggcacatatgtctcggcgatagcccaggccaaggcctcacaggaaggccccttaccggagatagaggacgaggtgttccggaagcgcaacctgacgattatggacctacatcccggcagcgggaagacccgtcgctaccttccggctatcgtgcgggaggccattaagcggaagttacggaccctgatccttgccccgacgcgggtcgttgcgtccgagatggccgaggcgttgaagggcatgcccatcaggtaccaaacgaccgcggtcaagagcgagcacaccgggaaggaaatcgtcgacctgatgtgccacgccacctttactatgcggctcctgtcccccgtacgcgttcccaactacaatatgatcatcatggacgaggcccacttcaccgaccccagctccatcgccgctcgggggtatatcagcactcgtgtcggaatgggggaggctgccgccatctttatgacggccactccgcctggttccgtggaggctttcccccaatcaaacgccgtaattcaggacgaggaacgggacatcccagagcgctcgtggaatagcgggtacgagtggataacggacttccctggtaagaccgtatggttcgtccccagcattaaatcaggcaacgacatcgccaactgcttacggaagaacgggaagcgcgtgatccagctctcccggaagaccttcgacacggaataccagaagacgaagaataacgactgggactacgtcgtgacaaccgacatcagcgagatgggcgccaacttccgcgcagaccgcgtgatcgatccccgccggtgtctgaaaccggtcatcctgaaggacgggcccgagcgtgttatcttggccggccccatgcccgtcacggtggcatcggcagcccagcggcgtggaagaatcggccgcaatcacaataaggagggcgatcaatacatttacatggggcagcctctgaacaacgacgaggatcacgcgcactggaccgaagccaagatgctgcttgacaacatcaacacccctgagggcatcatcccggctctttttgagcctgagcgggaaaagtccgccgccatcgatggggagtaccgtctgcgcggcgaagcgcggaaaaccttcgtggagctaatgcgaagaggggatctacccgtctggttgagctacaaggtggcctccgagggcttccagtattcggaccgaagatggtgcttcgacggcgagcggaacaaccaggtgctcgaagagaatatggacgtagagatctggacgaaagagggggagaggaagaagctgcgcccccgttggctggatgcccgtacttattctgatccgctcgccctgcgggagttcaaggagttcgccgctggccgtcggagcgtgtccggggaccttatcctcgaaatcggaaaacttccgcagcacctaacccaacgtgcccagaatgccctcgataacctggtcatgctgcacaatagcgaacaaggagggcgcgcgtatagacacgccatggaggagctccccgacaccatcgagacgctcatgctgctcgccctgatagccgtcctgacaggcggggtaaccctgttcttcctgagcggcagaggactgggcaaaaccagtataggcctcctgtgcgttatggcctccagcgtcctactctggatggcttccgtcgagccccattggatcgcggccagtatcatcctggagttcttcctgatggtcctcttaatccccgagcccgatcgtcagcggacgccccaggacaaccagctggcctacgttgtaatcgggttgttattcatgatcctgacggttgccgccaacgaaatgggcctcctggaaaccactaagaaggacctcggaataggccacgtcgcggtggagaaccaccatcacgccgccatgctcgacgttgacctgcatcccgcctcagcctggacgctgtacgcggtcgctacgaccatcatcaccccgatgatgcgacacaccatcgaaaacacgactgcgaacatcagcctcacagccatagccaaccaagccgccatcttaatgggacttgacaagggctggccgatttcgaagatggatatcggcgtgcctcttctggccctggggtgctactcccaggtgaaccccctcaccctgacggccgcggtcctgatgctggtggcccactatgccatcatcggccccgggctgcaggccaaggcgacccgggaagcgcagaagcgcaccgccgccggcattatgaagaacccgaccgtggatgggatcgtcgcaatcgacctggaccccgttgtgtacgacgccaagttcgagaagcagctcgggcagattatgctgctgatcctctgcacgtctcaaatcctgctcatgcgcacgacctgggcgctctgcgagagcatcaccctggccacaggccccctgaccaccctatgggaagggtcccccggcaagttctggaacaccacgatcgccgtcagcatggccaatatattcaggggttcatatctggccggcgcgggcctggccttttctctcatgaagtccctagggggcgggcggcgggggaccggggcccaaggcgagactctgggcgagaagtggaaacggcagctcaaccagttgtccaagagcgagttcaacacctataagcggtcagggataatggaggtagaccgcagcgaggccaaggagggcctgaaacgcggcgagacgaccaagcacgcggtgagtcgcggcaccgccaagctccggtggttcgtcgagcgcaatctggttaagccagagggaaaggtgatcgaccttggctgcggccgcggcgggtggagctactactgcgccgggctgaagaaggtcaccgaggttaaggggtacacgaagggcggtcctggccacgaagaacccatacccatggcaacctacggttggaacctcgtcaagctgcacagtggcaaggacgtgttcttcatacctcccgagaagtgcgacactctgctttgtgacatcggggagagctcccctaatccgaccatcgaggagggccgcacgttaagggtgttaaaaatggtggagccttggctcagggggaatcagttctgcatcaagattctgaacccgtatatgcccagcgtggtggagacccttgagcagatgcagcggaaacacggaggcatgttagtgcgcaaccccttaagtcggaacagcacccacgagatgtattgggtatcctgcgggaccggcaacattgtgagcgcggtgaacatgacttcacgcatgctcctcaaccggtttaccatggcccaccgcaaaccgacttacgaacgcgacgtcgacctgggggccggtacccggcacgtggccgttgagcccgaggttgcaaacctggacattattggccagcgtatagagaacataaagcacgaacataagagcacctggcactacgatgaggacaatccctataaaacatgggcctaccacgggtcctacgaggtgaagcccagcggcagcgcgtcgagcatggtcaacggagtggtgaaactcctgaccaagccttgggacgtcatccctatggtgacccagatcgcgatgaccgatacgacgcccttcggccagcagcgagtgttcaaggaaaaggtcgataccaggacccctaaggccaagcgggggacggctcagatcatggaggtgaccgccaaatggctgtgggggttcttatcccgcaacaaaaagccgcggatctgcacccgcgaggagttcactcggaaggtgcgaagcaacgcggcaatcggcgccgtcttcgtggacgagaaccagtggaactctgctaaggaggcggtggaggacgagcggttttgggacctggtccaccgcgagcgcgagctacacaagcaggggaaatgcgccacgtgcgtgtataacatgatgggtaagcgggagaagaagctcggggagttcggcaaggccaaagggagccgtgccatatggtatatgtggctgggcgcgcgcttcctggagtttgaggcgctgggcttcatgaacgaggaccattggttctcccgagaaaatagcctctctggtgtggagggcgagggcctgcacaagctgggttatatccttcgcgacatctcgaagatccccgggggcaacatgtacgctgacgacacggcaggctgggacacccgaattaccgaagacgacctgcagaatgaggcaaagatcacggacatcatggagcccgagcacgcgctcttagcgaagtccatcttcaaacttacctaccaaaacaaggtcgtccgagtgcagcggcctgctaagaacgggacggtcatggacgtcatctccagacgcgaccagcggggttccggacaggtgggcacctacgggctcaacacgttcacgaacatggaggcccagttaatccgccagatggagtctgagggaatcttcagcccaagcgagctggagaccccaaatctcgccggcagagtgctggactggctggagaagcatggagtggagcgcctgaagcggatggctatctccggggacgactgcgtggtcaaacccatcgatgaccgcttcgcgaccgccctgacagccctgaacgacatggggaaggtccgtaaggatatccctcagtgggagcctagcaaaggatggaacgactggcagcaggtccctttctgcagccaccatttccaccagctcattatgaaagacggccgcgagattgtcgtgccctgccgtaaccaggacgagttggtggggcgcgcccgagtcagccagggcgccggatggagcctgagagagacggcgtgtttgggcaagtcctacgcgcagatgtggcagcttatgtacttccaccggcgcgacctacggttggcagccaacgcgatctgcagcgccgtgccggtggattgggtaccaacgtcccgcactacttggagcatccatgcgcaccaccaatggatgaccaccgaagatatgctttccgtgtggaaccgggtatggatcgaggagaacccctggatggaggataagacacacatctcttcctggggcgatgtcccctacctgggcaagcgcgaagaccagtggtgcggttcactcatcgggctgactgctagggccacctgggccaccaatatccaggtcgccatcaaccaggtccgccgcttgatcggcaatgaaaactatctcgactacatgaccagcatgaagcgcttcaagaacgagagcgaccctgagggggctctgtggtga

SEQ ID NO: 24115 - RNA, 9879 nt, synthetic construct
  misc_feature 1..9879: note = derived and/or modified CDS sequence (opt11) from DENV-1__EU726782__SS-prME
  source 1..9879: mol_type = other RNA
agcgttaccatgctgctgatgcttatgcccactgccctggccttccacctcacgactcggggcggggagccgcacatgatcgtgagcaaacaggaaaggggcaagagcctgctgttcaagacctccgcaggggtgaatatgtgtaccctcatcgctatggacctgggggagctgtgtgaggatacgatgacctacaaatgcccacggatcacggaaaccgagcccgatgacgtggactgctggtgcaacgccaccgacacctgggtcacctatgggacgtgcagccagaccggcgagcaccggcgggacaagcggtccgttgccttagcgcctcacgtaggcttagggttagaaacgcggaccgagacctggatgagctccgagggcgcctggaagcagatccagcgggtagaaacgtgggccctccggcaccccggcttcaccgtgatcgccttgttcttggcccacgcgatcgggacctcgatcacccagaaggggatcatattcatccttctgatgctggtgacgccctcaatggcgatgcggtgcgtcggcataggcagccgcgactttgttgaggggctctccggcgcgacctgggtagatgtcgtgctagagcacgggagctgcgtgacaaccatggccaaagacaagcccacgctagacattgaattgctgaaaaccgaggtaacaaacccagcggtgctgcggaaactctgcatcgaggcgaaaatctccaatactacgacagactccaggtgccccacccagggcgaggccaccctggtagaggagcaggatgccaacttcgtctgccgtcgaacctttgtggatcggggctgggggaacgggtgcggactcttcggcaaggggagcctcatcacgtgcgccaaattcaagtgcgtgaccaagctagaaggcaagatcgtgcagtacgagaatctgaagtacagcgttattgtgaccgtccacacgggcgaccagcaccaggtggggaacgaatccaccgagcacggcaccactgccaccatcacgcctcaggctcccacaacagagattcagctcacggactacggggctttaacactggactgcagcccccgcaccggtctcgactttaacgagatggtcctgctgaccatgaaggagaaaagttggttagtgcacaagcagtggtttctggacctgcctttaccatggacctcgggtgcctccaccagtcaagagacatggaatcggcaggacttgctggttaccttcaaaacggcccacgcgaagaagcaggaggtcgtggtgctcggttcgcaggagggcgcgatgcacacggctctgacaggagccaccgaaatccaaacctctggcacgaccaccatttttgccgggcacctgaagtgtcgcttaaagatggacaaacttacgctgaagggcatgagctacgtcatgtgcacggggagcttcaaactcgagaaggaggtggctgagacccagcacggaacggttctggtccagatcaagtatgagggcaccgatgcgccttgcaaaatacccttccttacccaggacgaaaagggggtcacccagaacggccgtctaatcaccgccaacccgattgtgaccgacaaggagaagcccgtcaacatcgaggccgagccgcccttcggggagtcgtacatcataattggcgctggtgaaaaggcgctgaagctctcctggttcaagaaggggtcttccatcggaaagatgttcgaggccactgcccgcggggctcggcgcatggccatcctaggggacaccgcgtgggacttcggaagcatcggaggcgttttcacgagtgtggggaagctcgtccaccagattttcggtaccgcgtacggggtgctgtttagtggcgtgtcatggacgatgaagataggcatcggtgtcctactgacgtggctgggtctgaacagccgcagtacaagcctctccatgacgtgcatcgcggtgggcctggtgacattatacctcggcgtcatggtacaggccgacagcggatgtgttatcaactggaagggcagggaactgaagtgcggatccggtattttcgttacgaacgaggtgcacacctggaccgagcagtacaagttccaggccgacagcccaaagcgcctcagcgcggccataggcaaagcctgggaggaaggagtatgcggcatccggtccgccacccgcctcgagaacataatgtggaagcagatcagcaacgagctgaatcacatcctgcttgagaacgacatgaagttcacggtagtcgtgggggacgtcgccggaatcttagcgcagggcaagaaaatgatcagaccacagcccatggagtacaagtactcctggaagtcctggggcaaggctaagatcatcggcgccgacgtgcagaacaccacctttatcatagatgggcccaacaccccggaatgccccgatgatcagagagcctggaacatttgggaggttgaagactacggcttcggcatcttcacgaccaacatctggctgaaactcagagactcctacacccaggtctgcgaccaccgccttatgtctgcggcaataaaagacagcaaggccgtacacgccgatatgggctactggatcgagagcgagaaaaacgagacgtggaagctggcccgagcttccttcatcgaggtgaagacgtgcatatggcccaaaagccacaccctctggagtaacggggtcctcgagtcagagatgattatccctaaaatctatgggggaccgatatcccaacacaactatcggcccgggtacttcacccagacggccggcccctggcacctgggcaagctggagctcgactttgacctgtgcgaaggcaccaccgtagttgtcgacgaacactgcggaaacagggggcccagcctacgcaccaccacggtcaccggcaagatcatccacgagtggtgctgcagatcctgcacgctacctcccctgcgtttccgcggagaggacggctgctggtacgggatggagatccgccctgtgaaggaaaaagaggaaaacttggtcaagagcatggtttccgccggcagcggggaggtggacagcttttcgctggggctgctttgcataagcataatcatcgaggaagtcatgcggtcccgctggagccggaagatgttgatgaccggcaccctggccgtcttctttctgctcataatggggcagctgacctggaacgacctcatccgcttgtgcataatggtgggagccaacgcgtcggaccgtatggggatgggcacgacatacctggctctgatggccacattcaaaatgagaccgatgttcgccgtcggcctgctgttccgccggctgaccagcagggaggtgctgctgctcaccatcggcctcagcctcgtggccagtgtagaactacctaactcgcttgaggagctgggcgacgggttggcgatgggcatcatgatcctgaagctgctcactgatttccagagtcaccagctgtgggccacgctcctctctctgaccttcatcaagaccaccttctcactgcactatgcctggaagactatggccatggtgctctccattgtctcgctattccccctgtgcctgtccaccacaagccagaaaaccacgtggctgcccgtactcctcggctccctggggtgcaagccgctcacaatgtttctaatcgcagagaataagatatggggacgtcgctcttggccccttaacgaggggatcatggccgtggggatcgtctctatcctgctctccagcttactgaagaacgatgtgccactagccgggcccctcatcgccggcgggatgcttatcgcctgctatgtgatttccgggagcagtgcggacctcagcctggaaaaggcagcagaggtaagctgggaggaggaggctgagcacagcggagcgtcccataatatcctagttgaggtgcaagacgacggaaccatgaagatcaaagacgaagaacgggacgatacgctcaccatcctgttgaaggcgacgctactggcggtcagcggagtgtacccgctgagtatcccggccaccctcttcgtgtggtatttctggcagaaaaagaagcaacgcagtggtgtcctgtgggacaccccctccccgccagaggttgagcgggccgttctggacgacggcatttaccgaatcatgcagcgtggcctactcggcagatctcaggtcggtgtgggagttttccaagagaacgtcttccacaccatgtggcacgtgacacggggagccgtgctgatgtaccagggtaagcgcctggagccgtcctgggcaagcgtgaagaaagatctcattagctacggtggcggatggcggttgcaggggtcgtggaataccggggaggaggtccaggtgatcgccgtagagcccggcaaaaaccccaagaacgtccaaacagccccggggacattcaagacgcccgagggcgaggtgggcgccatcgccttggacttcaagcccggtacctccggctcccccatcgtcaaccgggaaggcaaaatcgttggcctctacggcaacggcgtggtcaccacctctggcacgtacgtgtccgccattgcccaggccaaggccagccaggaaggacccctgcccgagatcgaggatgaagttttcaggaagaggaatctaaccatcatggatctccaccccggctcggggaagaccagacgctatttgcccgccatcgtgagggaggccatcaagcgcaagctgcgcaccttaatcctggcccccactcgggtagtggccagcgagatggccgaggcgctgaagggcatgcccatccgctatcagaccacagcagtcaagtccgagcacaccggtaaggagattgtggatctcatgtgccatgcaacgttcaccatgcgtctgttaagcccagtgcgcgtcccgaattacaacatgatcatcatggacgaggcccatttcactgacccatcctcaatcgccgcgcgggggtacatctccacccgcgtgggcatgggggaagcggcggccatcttcatgaccgccacgcctcccgggagtgtggaggcgttcccacagtccaacgcggtcatccaggacgaggaaagagacatacccgagcgaagctggaactccgggtacgagtggatcacagatttccccggcaagaccgtgtggtttgtgcccagcatcaaatccggcaacgacattgccaattgcttaaggaagaacgggaagcgcgtcatccagctgagccggaagaccttcgacacagagtaccagaagaccaagaacaacgactgggattacgtggttaccacggacatttcggagatgggcgcaaactttcgtgcggatcgagtcatcgatccgcgacggtgcctgaagccagtgatcctcaaggacgggcccgagcgcgtcatcctggcgggaccgatgccggtcaccgtggctagcgccgcacagaggcgcggccggatcggccgcaaccacaacaaagagggtgaccagtacatctacatggggcagcccctaaacaatgacgaggaccacgcgcactggaccgaagccaagatgctcctggacaacattaatacccccgagggcatcatccccgccttgttcgaaccggagcgcgagaagtcggccgccattgacggggagtatcggctcagaggcgaggcacgcaaaacgttcgtcgagctgatgcgccgcggggacctgcccgtgtggctctcttacaaggtggccagcgagggcttccaatatagcgaccgccggtggtgcttcgacggggaacgcaacaatcaggtgttggaagaaaacatggacgtagaaatctggaccaaggaaggggagaggaagaaactaagacctcgatggctcgatgcacgcacttacagtgaccccctggccctgcgggagttcaaggagttcgccgcgggcaggcggtcggtaagcggggacctcatcctggagattggtaaactaccccagcatttgacccagcgggcccagaatgccctggacaacctggtcatgctacacaactccgagcagggcgggcgggcatatcgccacgcgatggaggagctacccgacacgatcgagaccctgatgctactggctctgatcgcagtgctcaccggcggggtgactttattctttctgagcgggcgcggactaggcaaaacatccatcggcctgctgtgtgttatggctagctcagtcctcctttggatggcctcagtggagccccactggatcgcggcctccatcatcctggagttcttcctcatggtcttgctgatccccgaacctgacagacagagaacgcctcaggacaaccagctcgcctacgtcgtgatcgggctgcttttcatgatcttgaccgtggccgccaacgagatgggcctgctggagacgaccaagaaggacctcggtatcggtcacgtcgcggtggagaaccaccaccacgccgctatgttggatgtcgaccttcaccccgcaagcgcgtggacactctacgctgtggcaaccactatcattaccccgatgatgcgtcacacgatcgagaacaccaccgctaatatctcattaaccgctatcgccaatcaggcggccattctgatggggctcgacaagggctggccaatcagcaagatggatattggggtgcccctgctcgcgctcggctgctattcgcaagtcaatcccctgacactgaccgccgcggtgctcatgttagttgcccactacgctatcattggccctggcctacaagccaaggccacccgcgaggcgcagaagaggaccgcagcagggatcatgaagaaccccacggtcgacggtatcgtagccatcgacctagaccccgttgtgtacgacgcaaaattcgaaaaacaactcggccagatcatgctgcttattctgtgcaccagccagatcctcctcatgcgtaccacctgggctctgtgcgagtccataacgcttgccaccgggcccctcactaccttgtgggaggggagcccgggtaagttttggaataccaccatcgccgtctctatggccaacattttccggggcagctatttagccggtgcgggtctcgccttctccctgatgaaatcactcggagggggtcgccgcgggacgggggcacaaggggagacactcggcgagaagtggaagcgccagttgaaccaacttagcaaatcggagttcaatacgtacaaaagatccgggataatggaggtggaccgctccgaggccaaggagggccttaagagaggggaaaccaccaagcacgcggttagccgcggaactgccaaactgcgatggttcgtggagcgtaacctggtgaaacccgaggggaaggtcatcgaccttggctgcggccgcggcgggtggtcctactactgcgccgggcttaagaaagtgacggaggtcaagggatacaccaagggcggtcccgggcacgaggagcccatcccaatggccacctatggatggaacttggtgaagctgcatagcggcaaggacgtgttcttcatcccgcccgagaagtgcgacactctcctgtgcgacattggagagtccagcccgaacccgacgatcgaggagggcagaaccctgcgcgtactcaagatggtcgagccttggctgcgcggaaaccagttctgcataaagattctgaacccctacatgccgtccgtggtggagaccttggagcaaatgcaacggaagcacggcgggatgttagtccgcaatccgctgagccgaaactcaacccacgagatgtactgggtgagctgcgggaccggcaacatcgtaagtgccgtcaacatgactagccgcatgctcctgaaccgattcaccatggcgcatcggaagcccacctatgagcgcgacgtagacttgggggccggcacccgccacgtggccgtcgaacccgaggtcgccaatctcgacatcataggtcagcgtatcgagaacatcaagcatgagcacaagtccacatggcactacgacgaggacaacccctataagacctgggcttaccacgggagctacgaggtgaagccgagtgggagcgcgtcctctatggtcaatggagtagtcaaactgctcaccaagccctgggatgttatacccatggtgacacagatcgccatgacagacaccactcccttcggccagcagcgggtcttcaaggagaaggtcgacacccgcacgccaaaggccaaacgagggaccgcccagattatggaagtgaccgccaagtggctatggggcttcttatcgcgaaacaagaagccccggatctgcacccgcgaggagttcacgcggaaggtccgctcaaacgcggccatcggagccgtgttcgtagatgaaaaccaatggaatagcgctaaggaggcggtcgaggacgagcgtttctgggacctggtgcatcgggagcgagaactccataagcaagggaagtgcgcgacctgcgtttacaatatgatgggcaagcgcgagaaaaagctaggggagttcggcaaggccaaggggtcccgggcaatatggtacatgtggctgggggcccgcttcctcgagttcgaagcgctggggttcatgaacgaggaccactggttcagccgcgagaacagcctgagcggggtggagggagaagggcttcacaagctgggctacatcctgcgcgacatatccaagatccccgggggcaacatgtacgccgatgacaccgccggctgggacaccagaatcacggaggacgacctccagaacgaagcgcgcatcactgacatcatggagccggaacacgccctgcttgccaagagtatcttcaagctaacctaccagaacaaggtggtacgtgtccagcgtccagccaagaacgggaccgttatggacgtgatttcccgccgggatcagcgcggcagcgggcaggtcggcacctacggcttaaatactttcaccaacatggaagcccagctgatccggcagatggagtcagaagggatcttcagcccctcggagctcgagatccccaacttggccgaacgggtgctggactggctggagaagtatggggtggagcggctgaagcgcatggcgattagcggggacgactgcgtcgtcaaaccgattgacgaccggtttgcgactgccctgacggccctcaatgacatggggaaggtccgtaaggacatcccacaatgggaaccatccaagggctggaacgactggcaacaggtacccttctgcagccaccacttccaccaactgatcatgaaggacggccgggagatcgtggtgccgtgcagaaaccaagacgagctggtaggccgggcaagagttagtcaaggcgccggctggtcgcttcgtgagacggcgtgccttggcaagtcgtacgctcagatgtggcagctgatgtactttcatcgccgagacctccgcctggccgccaacgcgatctgctctgccgtccccgtcgactggatccctacgtcgcgcaccacatggtccatccacgcccaccaccaatggatgaccaccgaggacatgctttccgtgtggaatcgagtgtggatcgaggagaacccatggatggaggataagacccacatctcatcttggggcgacgtcccgtacctcgggaagcgcgaggaccagtggtgcggctccctgatcggcctgactgcccgcgcgacctgggcgacgaacatccaggtggccatcaatcaggtgcggcggctcatcgggaacgagaactacctggattacatgaccagcatgaagcgcttcaaaaatgaaggggaccccgagggagccctgtggtga

SEQ ID NO: 24116 - RNA, 9879 nt, synthetic construct
  misc_feature 1..9879: note = derived and/or modified CDS sequence (opt11) from DENV-1__EU677178__SS-prME
  source 1..9879: mol_type = other RNA
agcgtgaccatgttgctgatgcttatgccgaccgccctggcgttccatctcaccacacggggcggtgaacctcacatgatcgtctcaaagcaggaacgggggaaatccttactgttcaagacaagcgccggtgtgaatatgtgcaccctcatcgccatggacctgggagaactgtgtgaggacaccatgacctacaagtgcccccgcatcaccgagaccgagcccgacgacgtggactgttggtgcaatgccaccgacacctgggtgacttacggaacctgctcacagacgggagagcatcggcgggacaagcggtctgtagccctggctccccacgtcggactgggtctcgaaacgcgcaccgagacctggatgagctccgagggcgcgtggaaacagatacagcgagtcgagacgtgggccctccggcaccccggcttcaccgtgatcgccttgttcctggcgcacgcgatcggaacctcaattacccagaaggggatcatcttcatcctccttatgctggttacgccctcgatggcgatgcggtgcgttggcattggcagccgcgactttgtcgagggcctctcaggtgccacctgggtggacgtggttcttgagcacgggagctgtgtgaccacgatggccaaagataaacccacgttggacatcgagcttttgaagaccgaggtgacgaacccagccgtgctgcgtaaactctgcatcgaggcgaaaatttccaacactacgacagatagccgctgtccaacacagggagaagcaacgctagttgaagaacaagacgcgaatttcgtctgccggcgcacttttgtggatcggggctggggaaacggctgcgggctgttcggcaaggggtcactcataacgtgtgccaaattcaagtgcgtgacgaaattagaaggcaagatcgttcagtacgagaacctaaagtacagcgtaatcgtgaccgttcacaccggcgaccagcaccaagttgggaatgaaagcaccgaacatggaaccaccgccaccatcacgccccaggcgcccacgacagagatccaactcaccgactacggggctctgactctggactgctcccctcgcacaggcttggatttcaatgagatggtcctcctgaccatgaaggagaagtcctggctcgtgcacaagcaatggtttctggacctgcccctcccctggaccagcggggccagcaccagtcaggagacttggaaccggcaagacctgctggtgacctttaagacggctcatgccaagaagcaggaggttgtggtgctcggcagccaggagggcgcgatgcatacagccctgaccggtgccactgaaatccaaacctctggcacaaccaccatcttcgcaggccaccttaaatgccgattaaaaatggataagctgaccctaaaagggatgagctacgtcatgtgtacggggtccttcaagctcgagaaagaggtggcagagacccagcacggcacggtgctcgtccagatcaagtacgagggcacagacgcgccctgcaagataccctttctcacgcaggacgagaagggggtcacccaaaatgggcgattgataacagccaacccgatagtgacggataaggaaaaacccgtcaacatcgaggccgagccgcccttcggggagagctacattataatcggcgccggtgagaaggctctcaaattgtcttggttcaagaagggctcgagcatcggcaagatgtttgaggcaactgccagaggggcacggcgcatggccatactgggcgacaccgcgtgggacttcgggtctatcggcggcgtgttcaccagcgttgggaagctggtccaccagatatttggaactgcctatggggtactcttctctggtgtgtcctggacgatgaagatcgggatcggcgtactcctcacctggctaggcctaaacagccgatccaccagcctctcaatgacctgcattgccgttgggctagttacgctgtaccttggcgtcatggtacaagccgattccgggtgtgtcatcaactggaagggcagggaactaaagtgtgggtccggtatcttcgttaccaacgaggtgcacacctggaccgagcaatataaatttcaggctgactctcccaagcgtctgagcgcggccatcgggaaagcctgggaggagggggtctgcggcatccgttccgccacaaggctagagaacatcatgtggaagcagatttccaacgagctgaaccatatattactcgagaatgacatgaagtttacggtcgtggtaggggacgttgcgggcatcctggcgcaggggaagaagatgatccggccccagcccatggaatacaagtactcatggaagtcttggggcaaggccaagatcatcggcgccgacgtgcaaaacacaaccttcatcatcgacgggcccaataccccggaatgccccgacgaccagcgcgcgtggaacatctgggaggtggaggactacggattcgggatcttcacgacaaacatctggctgaagctcagagattcacatacccaagtctgcgaccaccgcctgatgagcgcggccatcaaggactccaaggctgtgcacgcagatatgggctactggatcgagagcgaaaagaacgagacctggaagctagctcgggcgtcatttattgaggtaaaaacgtgtatctggcccaagagccataccttatggtcgaacggcgtcctggaaagcgagatgatcatccccaagatttacggaggcccgatctcccaacacaactatcgccccggatacttcacccagacagccggcccctggcacctgggcaagctcgagctggacttcgatttgtgcgaaggcacgacggtggtggtcgatgagcactgtggcaaccgggggccgagcctccgcactaccactgtgacaggcaaaatcatccacgagtggtgctgcaggtcctgcacactaccaccccttcgcttccgcggggaagacggctgctggtacggaatggagatccgcccggtgaaggagaaagaggagaacctggtcaagagcatggtgtcagcgggtagcggcgaagtggactccttctctttagggcttttgtgtatcagcatcatgatcgaggaagtcatgcggtcccgctggagccggaagatgcttatgaccggcacgctagctgtgttcttcctcctgatcatggggcagctgacatggaatgacctaatccgcttatgtatcatggtaggcgccaacacttccgatcggatggggatgggcaccacatacctggcgctcatggccaccttcaagatgcgtcccatgtttgccgtaggcctgctgttccgcaggctcactagccgcgaggtgctgttgctgaccatcggactgtccctggtcgcaagcgtcgagcttcccaactccctggaggagctgggcgacgggctcgcgatgggcataatgatcctaaagctgctcacggacttccagagtcaccaactgtgggcgaccctactatccctcaccttcatcaagaccacgttctcactgcattacgcctggaagacgatggccatggtgctctccatcgtctcactgttcccgctgtgcctctccaccacaagccaaaagacaacatggttaccagtgctgcttggctccctggggtgtaagcccctcacaatgttcctcatcgcggagaacaagatctggggtagaagaagctggcccttgaacgaggggatcatggcggtgggcatcgtctctatactgctcagcagtctactgaagaatgacgtgcccctcgccgggccccttatagccggaggaatgctcatcgcatgctatgtgatctccggtagctccgctgacctttcacttgagaaggctgcagaggtgtcctgggaggaggaagccgagcacagcggggcatcccacaatatcttagtggaagttcaggacgatggcaccatgaagattaaggacgaagaacgggacgacaccttgaccatactgctgaaggccaccctgctggcggtcagcggggtgtatccgctgtcaattcccgccaccctcttcgtctggtacttctggcagaagaagaagcaacgcagtggggtcctctgggacacccccagtccgcccgaggtcgaacgggccgttctggacgacggtatctaccgcatcatgcagcgaggcctgctcgggcgctcgcaagtcggggtgggagtattccaggagaatgtattccacacgatgtggcacgtgactcggggcgccgtgctgatgtaccagggaaagagattggagccctcctgggcgagcgtcaagaaggatctcatctcctacggtggcgggtggaggctccagggaagctggaacaccggggaggaggtccaggtgatcgcagtagagccaggcaagaaccccaagaatgtgcaaacggcccccggtactttcaagacgcccgagggcgaggtgggtgccattgcccttgacttcaagcccgggaccagtggtagcccaatagtcaaccgcgaggggaagatcgtggggctttacggcaatggggtggttaccacgtccggcacctacgtgtctgcgattgcgcaggcgaaggctagccaagaggggccgctgcccgagatcgaagacgaggtcttccggaagcgcaatctgaccatcatggatctacaccccggctccggcaaaacccgtcggtacttgccggcaatcgtccgcgaggcgattaagagaaaactgcggacgctcatcttagcccccacccgggtggtggccagcgagatggccgaggccttgaagggtatgcccatccgctaccagaccactgctgtcaagtcagaacatacgggcaaagagatcgtggacctcatgtgccacgccacctttaccatgcggctgctgagccccgtgcgagtaccaaactataacatgattatcatggacgaggctcacttcaccgacccctccagtatcgcggccagagggtacatcagtacgcgcgtgggcatgggggaggcggctgccatattcatgaccgccacgcctcccggcagcgtggaggctttcccgcagtccaacgcggttatccaagacgaggagcgggatatcccggagcgcagctggaactcggggtacgaatggatcacggatttccctggtaaaacggtgtggttcgtgccctcaattaagtccggcaacgacatcgccaattgtctccgcaagaacggaaagcgcgtaatacagctgtcgcggaaaaccttcgacaccgagtaccagaagaccaagaacaacgactgggactacgtggtcacgaccgacatcagtgaaatgggcgccaacttccgcgccgaccgggtcattgaccctcgtcggtgcctgaaaccagtgatcctgaaggatgggcccgaacgagtcatcctggcaggccctatgccggtcacagtggcttccgccgcccagcggcgcgggcgaataggtaggaatcacaataaggaaggtgaccagtacatatacatggggcagcccctgaacaatgacgaggaccacgcacattggaccgaggcaaagatgttgctggacaacataaacacgcccgaaggtatcattcccgcacttttcgagccggagcgcgagaagtccgccgccatcgacggggagtatcgactgcgcggggaggcccggaaaacttttgtcgagctcatgagacgaggggacctgcccgtttggctctcgtacaaggtggcgtccgagggtttccaatactcggaccgccggtggtgcttcgatggagaaagaaacaatcaggtcctggaggagaacatggatgtggagatatggaccaaggagggagagcggaagaaactgcgcccccgatggttggacgcccgcacctacagtgacccactggcgctacgggagttcaaggagtttgccgccggcaggcggtctgtgagcggggacttaatcctggagatcgggaaacttccccagcacctcactcagcgcgctcagaatgccctggacaacctggtgatgctccacaacagtgagcaaggcggccgtgcctaccgccacgcgatggaggagttacccgacaccatagagaccttgatgctcctggcgctgatcgccgttttgactggcggggtcactctattcttcctgagtggccggggactgggtaagacgtccatcggccttctgtgcgtgatggccagctccgtgctcctatggatggcctccgtggagccccactggatcgccgccagtatcatcttagagttcttcctcatggtcctgctaatccccgaacctgaccgccagcgcacgccccaggacaaccagctcgcctacgttgtgatcggtctgctgttcatgatactcaccgtcgccgccaacgagatgggtctgttggagacgacgaagaaggacttggggatcggacacgttgctgttgagaatcaccaccacgcggccatgctggatgtcgacctgcaccccgccagcgcctggactctctacgccgtggccaccaccattattacaccgatgatgaggcacaccatcgagaacaccaccgccaacatcagcctgacggcaatcgccaaccaggccgcgatactgatggggttggacaagggatggcccatctccaagatggatatcggggtgcccttgctggcgctcgggtgttactcccaggttaaccccttaactctgactgcggcagtgcttatgctggtggcgcactacgccataatcggcccagggctgcaggccaaggcaaccagagaggctcagaagcggacggcggcgggcatcatgaagaaccctaccgttgacgggatagtggccatcgacctcgaccccgtggtttacgacgccaagttcgagaagcagctgggccagatcatgctcctaattctgtgcacctctcagattctgctcatgcgcactacgtgggctctgtgtgagtcgataaccctggcaacaggccccctcaccacgctgtgggaggggagcccgggcaagttttggaacactactattgccgtgtcgatggcaaacatcttccgggggtcatacctggccggcgccggcctagcgttctccttaatgaagtccctcgggggcggacgccgggggaccggagcccagggcgagaccttgggtgagaagtggaaacgacagctgaaccagttatcgaaatccgagttcaacacttacaaacggagcggaataatggaagtggaccggtccgaagccaaggagggcctcaagcgcggcgagaccactaagcatgccgtcagccgaggcacggcgaagctgcggtggttcgtggagcgcaacctggtgaagcccgaggggaaggtcattgacttgggctgcggtcgcggcggctggtcctactattgcgccgggcttaagaaggtcaccgaggttaagggttacactaaagggggcccgggccacgaggagcccatcccaatggccacgtacggctggaaccttgtaaaattacatagcggcaaggacgtcttcttcatccctcccgagaagtgcgacactctcctctgcgacatcggggagtccagccccaacccgacaatcgaggagggccgcaccctgcgtgtgctaaagatggtcgagccctggttgcgcggtaaccagttctgcataaagatcttgaatccctatatgccgtccgtggtggagaccctcgaacagatgcaacggaagcacggcggaatgctggtccgcaacccgctttcgcggaacagtacccacgagatgtattgggttagctgcggaacgggcaacatcgtgtccgcagtaaacatgacgtcgcgcatgctcttgaaccgcttcaccatggctcaccggaagcccacctatgagcgtgacgttgacctgggggcaggtacgcggcacgtggctgtcgagcccgagatcgcaaacttagacatcatcggccagcgcatcgagaacatcaagcacgaacacaagtctacctggcactatgacgaggacaatccatacaaaacgtgggcctaccacggaagctacgaagtgaagccgtccggtagcgcctcaagcatggtgaacggtgtcgttaagctgctaacaaaaccgtgggacgtgatccccatggtgacgcagatcgcgatgacggacaccacgcccttcggccaacagcgggtgttcaaggagaaggtcgatacgcgcacaccaaaggccaaaagagggaccgctcaaattatggaggtgaccgccaagtggctctggggcttcctgagccgcaataagaagccccgaatctgcactcgcgaggagtttacccgtaaagtgaggtccaacgccgcgatcggcgccgtctttgtggatgagaaccagtggaactctgcgaaagaggctgtggaggatgaacggttctgggacctggtccatcgcgagagggagctccacaagcaaggaaaatgcgcgacctgcgtgtataacatgatgggcaaacgcgagaagaagctgggggagttcggcaaggccaaggggtcgcgtgcaatctggtacatgtggctgggcgctcgcttcctcgagttcgaggccctgggattcatgaacgaggaccactggtttagccgggagaacagcctgagcggggtcgagggcgagggtctacacaaacttggatacatcctgcgcgatatctccaagattcctgggggcaatatgtacgcggacgacacagcaggttgggacacccggatcaccgaggacgaccttcagaacgaagcccgcatcaccgacatcatggagccggagcacgccctcctggccaagagcatctttaagttaacctatcagaacaaggtcgtgcgcgtgcagcggcccgccaaaaacggtactgtcatggacgtcatctcacgccgggaccaacgcggcagtggacaggtagggacctacggcctgaacaccttcacaaacatggaggcccagctgatccggcagatggagtcagaggggatcttcagcccctcggagctcgagactcccaatctggcagagcgggtgctggactggctcgagaaatacggcgtagagcggctgaaacgcatggccatcagcggcgatgactgtgtggtgaagccaatcgacgaccggttcgccaccgcgctgaccgcgctcaatgacatgggcaaggtgcgcaaggacatcccccagtgggagccctccaagggatggaacgactggcagcaggtacccttttgcagccaccacttccaccagctgatcatgaaggacggcagagagatcgtcgtgccgtgtcgcaaccaagatgagctggttggaagggcccgcgtctcccagggggcgggctggagcctccgggagacagcctgcttgggcaagtcatacgcgcaaatgtggcagctgatgtacttccaccgccgggatctccgcttggctgccaacgccatctgctccgcggtgcccgtggactggatacccacgagcaggaccacctggtccatacatgcccaccaccagtggatgaccacagaggacatgctaagcgtgtggaatcgcgtgtggatcgaggagaacccctggatggaggacaagacccacatatcctcctggggcgacgtcccgtatcttgggaagcgcgaagaccagtggtgcggatccctgatcggccttaccgccagggcaacctgggccaccaacatccaagtcgcgatcaaccaggtcaggagattaatagggaacgagaattacctagactacatgacctctatgaaacgcttcaaaaacgagggcgaccccgagggcgccctgtggtga

SEQ ID NO: 24117 - RNA, 9879 nt, synthetic construct
  misc_feature 1..9879: note = derived and/or modified CDS sequence (opt11) from DENV-1__EU687251__SS-prME
  source 1..9879: mol_type = other RNA
agcgtcaccatgctcttaatgctgatgcccaccgccctggccttccacctcaccacccgcggcggtgagccccacatgattgtgagcaaacaggagcgaggcaaaagcctcctattcaagaccagcgccggggtgaacatgtgcaccctcatcgccatggacctgggcgagctgtgcgaagataccatgacgtacaagtgcccccggatcaccgagaccgagcccgatgatgtggactgctggtgcaatgccacggacacctgggtcacctacgggacctgcagccagacgggtgagcaccggagggacaagagaagtgtggccctcgcgccccacgtaggcctggggctggagacccgcaccgagacttggatgagctctgagggcgcctggaagcagatccagcgcgtcgagacatgggccttgcggcaccccgggttcaccgtgatcgcgctgttcctggcccacgcgatcggaaccagcatcacgcaaaagggcatcatcttcatcctcttgatgctggttacaccctccatggccatgaggtgcgttggcatcggcagccgcgacttcgttgagggtctctccggcgccacttgggtggacgtcgtactggagcatggatcttgcgtgaccactatggccaaggataagcccactctggacatcgagttgctgaagaccgaggttacgaaccccgctgtgctgcggaagctctgcatagaggcgaagatctccaacaccacgaccgacagccgctgcccgacacagggggaggccaccctggtagaggaacaggacgccaacttcgtctgccggcgcacgttcgtagaccgggggtggggtaacggctgcgggctgttcggtaaaggttccctcatcacgtgcgccaagttcaagtgcgtgaccaagctggaggggaagatcgtccagtacgagaacctcaagtatagcgtgatcgtcaccgtccacacgggcgaccaacaccaggtggggaatgagtccaccgagcacggcaccaccgccacgatcacgccacaggcgcccactaccgaaatccaactcaccgactacggggccctgacgctggattgcagcccccgtaccggcctcgacttcaacgagatggtcctgctaacaatgaaggagaagagttggctcgtgcacaagcagtggttcctggacttacctctcccttggacctctggggccagcacgtcgcaggagacctggaacaggcaagaccttctggtgaccttcaagacggcccacgcgaaaaagcaggaggtcgtggtgctcgggagccaagagggagcgatgcacaccgccctgaccggggccaccgaaattcagacctccggcacgaccactatcttcgccgggcacctaaaatgccggttaaagatggacaagctgaccctgaaaggcatgagctacgtcatgtgcaccgggtccttcaagctcgagaaggaggtcgccgagacccagcacggcaccgtgctggtccagatcaagtacgagggcaccgacgcgccctgcaaaatccccttcagcacgcaggacgaaaagggggtcacccagaacggccgactgatcaccgccaatccgatcgtgacggacaaggagaagccagtaaacattgaggccgagccgcctttcggggaatcttacatcatcatcggggcaggcgagaaggcactgaagctctcgtggttcaagaaagggagctcaatcggcaagatgttcgaagccacggcccgcggagcccgccgcatggccatcctgggggacaccgcgtgggacttcgggtccatcggcggcgtgttcaccagcgtgggtaagttagtacaccagatcttcggcaccgcctacggggtgctgttctcaggcgtgtcatggaccatgaagatcgggatcggcgtactgctgacctggctcggcctaaactcccgcagcaccagtctgtctatgacctgcatcgccgttgggctcgttacgctgtacctgggcgtcatggtccaggcagactcggggtgcgtgatcaactggaagggcagggagctcaagtgcggcagcggcatctttgtgaccaacgaggtgcatacctggaccgagcagtacaagtttcaggccgacagcccgaagcgcctgtccgctgccatcggcaaggcctgggaggagggggtgtgcggcatccggagcgccacccgccttgaaaacatcatgtggaagcagatctccaacgaactcaatcacatcctgctggagaacgatatgaagttcacggtcgtggtgggggacgtcgccggcatcctcgcgcaggggaagaagatgatccgaccccagcccatggagtataagtatagctggaagagctggggcaaggcaaagatcatcggcgccgacgtgcaaaacaccaccttcatcatcgacgggcccaacaccccggagtgtcccgatgatcagcgcgcctggaacatatgggaggtggaggactacggcttcgggatcttcaccaccaacatatggctgaagctgcgggacagccacacacaagtctgcgaccaccgtctcatgtccgcggctatcaaggactcgaaggccgtgcacgcggacatgggctactggatcgagtccgaaaagaacgagacctggaagctggctagggcgagcttcattgaggtgaagacgtgcatctggcccaagtcgcataccctgtggagcaacggcgtcttggagtccgagatgatcatcccaaagatctacggcggccccatcagccagcataactatcgccccgggtactttacccagaccgccggcccctggcacctggggaagcttgagctcgatttcgacctgtgcgagggaacgactgtagtggtcgacgagcactgcggcaaccggggcccttccttacgtacaaccacagtgaccggcaagataattcacgagtggtgttgtcggagctgtacactgcctcccctccgcttccgtggggaagatgggtgttggtacggaatggagatccgccccgtgaaggagaaggaggagaacttagtcaagtccatggtgagcgccgggtcaggcgaggtggactccttcagcctcggcctgctgtgcatctccatcatgatcgaggaggtcatgcggagccgctggtcacggaagatgctcatgacaggcaccttagccgtgttcttcctgctaatcatggggcagctgacctggaacgacttaatccgcctctgcatcatggttggcgccaacgcctcggaccgcatggggatgggcaccacctacctggccttaatggccacattcaagatgcgaccgatgtttgccgtcggtctcctgttccgccgcctgacctccagagaggtgctcctgctgaccatcggactcagcctggttgcctccgttgagctgccaaactcactagaggagctgggcgacgggctggcgatgggcataatgatccttaagttgcttacggatttccaatcccaccagctctgggctacgctgctgagcctcaccttcattaagaccaccttctcactgcactacgcctggaagacgatggccatggtgctgtcaatcgtctcccttttcccattatgtctgagcaccactagccagaaaaccacgtggcttccagtgctgcttggctctttgggttgtaagccgctgaccatgttcctgatcgcggaaaacaagatctggggccggcgctcctggcccctcaacgaggggattatggctgtgggcatcgtctccatcctgctgagctccctcctgaagaacgacgtgccgttagcggggcccctcatcgccggcggcatgctgatcgcctgctacgttatctcaggttcgagcgctgacctatccctcgagaaggccgctgaggtcagctgggaagaggaagccgaacactccggcgccagccacaacatcctggtggaggtccaagacgacgggaccatgaaaatcaaggacgaggagcgggacgacaccctgaccatcctcctgaaggcgacgctgctcgccgtctcgggcgtgtacccgttgagcatccccgccaccctgttcgtgtggtatttttggcagaagaagaagcaacgctccggggttctctgggataccccctcgcctcccgaagtggaacgggccgtactcgacgacggcatctatcgcattatgcagcggggcctgctggggcgctcccaggtgggcgtgggcgtttttcaggagaacgtcttccacaccatgtggcacgtgacgcggggcgccgtgctcatgtatcaggggaagcgcctggagcccagctgggcgtccgtcaagaaggacctgatcagctacggcggcgggtggcggctccagggctcctggaacacgggggaggaagtccaggtcatagcggtcgagccgggcaagaaccccaagaacgtgcagaccgcccccgggaccttcaagacgcccgagggcgaggtgggggcaatcgccctggacttcaagcccgggacctctggctcccccatcgtcaatcgcgagggcaagatcgtgggcctgtacggcaacggcgtggtcacaaccagcggcacctacgtcagcgcaatagcccaggccaaggcttcccaggagggcccgctccccgagatcgaggacgaggtgtttcggaaacgcaacctaaccatcatggacctgcacccgggaagtgggaaaacacggcgctaccttccggcgatagtccgggaggccatcaagcgcaagctgcgcaccctgatcctcgcgcccacccgggtggtggcctctgagatggccgaggccctgaagggaatgcccattaggtaccagaccaccgccgtcaagtcggaacacaccggcaaggagattgtggacctgatgtgccacgccacgttcaccatgcggctactgtcccccgtgcgcgtcccgaactataacatgataatcatggacgaggcacacttcacggatcccagctccatcgctgctcgggggtacatcagcacccgcgtgggcatgggtgaggccgccgctatcttcatgacggccaccccacccggctctgtggaggccttcccgcagagtaacgccgtcatccaggacgaggagcgcgacatccccgagcgcagctggaacagcgggtacgagtggatcaccgacttccccggcaagacagtgtggttcgtgccctccatcaagagcggcaacgacatagcgaactgcctacggaagaacgggaagcgcgtcatccagctctcccggaagacgtttgacaccgagtaccagaagacgaagaataatgactgggactacgtggtgaccaccgacatcagcgagatgggcgcgaacttccgcgcggaccgggtcatcgaccctcgtcggtgcctgaagcccgtgatcctgaaagacgggcccgagcgcgttatcctcgccggccccatgcctgtcaccgtggcctccgccgcccagagacgaggccggatcggccggaaccacaacaaggaaggcgaccagtacatctacatggggcaacccctgaacaacgacgaggaccatgcgcactggaccgaggctaaaatgctgctcgacaatataaacacccccgagggcatcatcccggccctgttcgaaccggagcgagagaagtcagccgccatagacggggagtaccggctgcgcggcgaagcccgtaagacgtttgtcgaactcatgcgccgaggggacctgcccgtgtggctctcctacaaggtggccagcgagggcttccaatacagcgaccgccggtggtgcttcgacggcgagcgcaataatcaagtcctcgaggagaacatggacgtggagatctggaccaaggagggagagcggaagaagctgcgcccccggtggctggacgcccgcacctactccgaccccctcgccctgcgagagttcaaggagttcgccgcgggccgcaggagcgtgtccggggatctcatcctcgagatcggcaagctgccgcagcacctgacccagcgcgcccaaaatgcccttgacaacttagtcatgctgcacaacagcgagcagggcgggcgggcctaccgccacgcgatggaagagctccctgacacgatcgaaaccctgatgctgctcgccttgatcgccgtgctaaccggcggggtgaccttgttcttcctatccggccgggggctgggcaaaaccagcatcggcctcctgtgcgtcatggcttccagcgtgctgctctggatggcctccgtggagccccactggatcgcggcgtcgatcatcctagaattcttcctcatggttctactaatccccgagccggaccgtcaacggacgccccaggataaccagctggcctacgtagttatcgggctcctgttcatgatcttgacagtagccgcaaacgagatgggcctactggagacaaccaagaaggacctgggtatcggccacgttgcagtggaaaaccatcaccacgccgctatgctagacgtcgacctgcaccccgcctccgcctggacactgtacgccgtggccaccacaatcatcacgccgatgatgcgtcacacgatcgaaaacactactgccaatatcagccttactgccatcgccaatcaggccgccatcctgatggggctggacaaaggctggccgatctctaagatggatatcggcgtgcccctcttggccctggggtgctacagccaggtcaaccccctcacgttgaccgccgctgtgctgatgcttgtggcccactatgctatcatcggcccggggcttcaggccaaggccacccgcgaggcgcagaagcggaccgccgccggcatcatgaaaaaccccacggtcgacggtatcgtggccatcgacctggaccccgtggtctacgacgccaagttcgagaagcagctcggccagatcatgctgctgatcctctgcacctcccagatcctgctgatgcgcaccacatgggcgctctgcgagtcaatcacgcttgccaccggccccctgacgaccctctgggaaggaagcccgggcaagttttggaatactactatagcggtgtcaatggccaatatcttccggggctcctacctagccggcgcgggcttggccttcagcctcatgaagtccctcgggggcgggaggaggggaaccggggcccagggcgagaccctgggtgaaaagtggaagcgccaactcaaccagctgtccaaaagcgagttcaacacgtacaagcggagtgggatcatggaggtggaccgcagcgaggccaaggaggggctcaagcgcggggagaccaccaagcacgcagtctcccgcggcaccgccaagctccggtggttcgtcgagcgcaatctggtgaaaccagaggggaaagtcatcgacctgggctgcggccgggggggctggtcctactactgcgccgggctgaagaaagtcacggaagtgaagggctacactaagggcggccctggccacgaggagcccatcccgatggccacttacgggtggaaccttgttaagctgcattccggcaaggacgttttctttataccgcccgaaaagtgcgacaccctgttgtgcgacatcggggagtcaagcccgaaccccacgatcgaggagggccgcaccctgcgtgtgctgaagatggtggagccctggctcaggggcaatcaattttgcatcaagatcctgaacccctacatgccctccgtggtggagaccctggagcagatgcagcggaaacatggcggcatgctcgtccgcaacccgctgtcccgcaactctacccacgagatgtactgggtgtcgtgcgggacaggcaacatcgtgtccgccgtcaacatgacgtcccgcatgctgctgaaccgcttcacgatggcgcaccggaagcccacatacgagcgcgatgttgacctgggggccggcacccggcacgtggctgtcgagcccgaggtagccaacctggacatcatcggccaacgcatcgagaatatcaagcacgagcacaagagcacctggcactacgacgaggacaacccctacaaaacctgggcctaccacgggtcctatgaggtgaagccgagcggctccgcgtcgtctatggtcaacggggtggtcaagctcctgaccaagccctgggacgtgatccccatggtgactcagatcgccatgacggacaccacccccttcgggcagcagcgggtattcaaggagaaggtggacacgcgcacgccgaaggcgaagcggggaaccgcccagatcatggaggtgaccgccaagtggctgtggggctttctctcccgcaacaagaaaccccggatttgcacccgcgaggaattcacgcggaaggttcgaagcaacgcggccatcggcgccgtgttcgtggacgagaaccagtggaactccgccaaggaggccgtcgaggatgagcggttttgggacctagtgcaccgcgagcgggagctgcataagcagggaaagtgcgcgacctgcgtgtataacatgatggggaagcgagagaagaaactcggggagttcggtaaggcaaaggggagccgcgcaatctggtacatgtggctgggcgcccgcttcctggagttcgaggcactcgggttcatgaatgaggaccactggttctcccgggagaacagcttatccggggtcgagggcgagggtttacacaagctgggctacatattaagagacataagcaagatacccggcgggaacatgtacgctgacgacaccgccgggtgggacacccgcatcaccgaggacgacctgcaaaacgaggcccgcataaccgacataatggagccggagcacgccctcctggcaaagtctatcttcaagctgacctaccagaacaaggtggtgcgcgtccagcgacccgccaagaacgggaccgtaatggatgtgatcagccgccgggaccagaggggctccggtcaggtgggcacctacggcctcaacaccttcaccaacatggaagcccagctgatccggcaaatggaaagcgaggggatcttttccccaagcgagctggagacccccaacctcgccgagagagtgctggactggctgaaaaagtacggcgtggaacgcctcaagcggatggccatctccggggacgattgcgtcgtaaagcccatcgacgaccggtttgcgacggccctgaccgcgctcaacgacatgggcaaggtgcgcaaggatatcccccagtgggagcccagtaagggctggaacgactggcagcaggtcccattctgctctcaccacttccaccagttaatcatgaaggacgggcgggagatcgtagtgccatgcaggaaccaagacgagctggtcggccgagcccgcgtgtctcagggggctggctggtcgctccgggagaccgcttgcttggggaagagctatgcccaaatgtggcagctgatgtacttccatcgccgggacctccgcctcgccgccaatgcgatctgcagcgccgtgcccgtggattggatccccacctcccggacgacctggagcatacacgcccaccaccagtggatgaccacggaagacatgctgtcggtgtggaaccgcgtctggatcgaggaaaacccctggatggaggacaagactcacatcagcagttggggcgatgtaccgtacctggggaagcgggaggaccagtggtgcggcagcctcatcggcctgaccgccagagcaacctgggcgaccaacatacaggtcgccatcaatcaggtgaggcggctgatagggaacgagaattacttggactacatgacctccatgaaacgcttcaagaacgaaagcgaccccgagggcgccctgtggtag

SEQ ID NO: 24118 - RNA, 9879 nt, synthetic construct
  misc_feature 1..9879: note = derived and/or modified CDS sequence (opt11) from DENV-1__FJ024427__SS-prME
  source 1..9879: mol_type = other RNA
tcagtaacaatgctgctgatgctgatgcccaccgccctggccttccacctcacaacccgcggaggggaaccgcacatgatcgtaagcaagcaggagcggggcaagtcactgttattcaagaccagtgccggagtgaacatgtgcacgctcattgccatggacctgggcgaactgtgcgaggacaccatgacctacaagtgcccccggatcaccgagaccgagccagacgacgtggactgctggtgcaacgccacggacacctgggtgacctacgggacctgtagccagaccggcgagcaccggcgcgataagcggtccgtggccctcgctccccacgtgggcctggggctggagacgcgcaccgagacatggatgagctccgagggcgcgtggaagcaaatccagcgggtcgagacttgggcccttcgccatcccgggttcacagtgatcgccctgttcctggcccacgcgattggcacctcaataacccagaaggggatcatcttcatcctcctgatgctcgtcacgccctccatggctatgcggtgtgtcggcatcggcagcagagacttcgtggagggactatccggcgcgacttgggtcgacgtcgtgctggagcacggttcctgcgtgaccacgatggccaaggacaagcccacgctggacattgagctcctgaagactgaggtcacgaaccccgccgtgttacgcaagttatgcatagaggcgaagatcagtaataccacgaccgactcccgctgtcccactcagggcgaggccaccctcgtggaggagcaagacgccaacttcgtctgccggcgcacattcgtggatcggggctgggggaacggttgcggattattcggcaaggggtccttgatcacatgcgctaagttcaagtgcgtgaccaaactggaaggcaagatcgtccagtatgagaatctcaagtacagcgtgatagttaccgtccacacgggtgatcagcaccaggtgggaaacgagtccacggaacacggcaccaccgccactatcacgccgcaggcgccgaccaccgagatccagctcaccggctacggcgcactgacgctagactgcagcccccgcacagggttggacttcaacgagatggtcctgctgactatgaaggagaagtcctggctcgtgcacaaacagtggttcctggacctccccctcccctggacgagcggcgcgagcacaagtcaggaaacgtggaaccggcaggacctgttagtgacgttcaagaccgcccatgccaagaagcaggaggtagtggtcctcggctctcaggagggggcgatgcacacggccctgaccggcgccaccgagatccaaacttcagggacgaccaccatctttgcaggccacctgaagtgcagactcaagatggataaactgaccctcaaggggatgtcatatgtgatgtgcactggctcgtttaagctcgaaaaagaagtggccgaaacccagcacggcaccgtgctggtccagatcaagtacgagggagcggacgcaccctgcaagatccccttcagcacacaagacgaaaagggcataacgcagaacgggcggctgatcaccgccaatccgatagtgaccgacaaggaaaagcccgttaatatcgaggccgaaccgcccttcggagagtcctatatcgtcataggagccggggagaaggctctaaaactcagctggttcaagaaggggtccagcatcggcaagatgttcgaggctaccgccaggggcgccagacggatggcgattctgggtgacacggcctgggacttcggctccatcggaggagtgttcaccagcgtgggcaagctggtccaccagatcttcggcaccgcctatggtgtcctcttctcaggggtatcatggaccatgaagatcggtatcggcgtcctactgacttggctcggactgaactcccgctcgacctccctgagcatgacctgcatcgctgtgggcctagtgaccctgtaccttggtgtcatggtgcaggccgactccggatgcgtcatcaactggaaaggacgggaattgaagtgcggaagcggaatcttcgtcacgaacgaggtacacacctggaccgagcagtataagttccaggcggacagcccgaaacgcctgagcgccgccatcggaaaggcctgggaagagggcgtgtgcgggatcagaagcgccacacgcctggagaacatcatgtggaagcagatctctaatgagctcaaccacatactgctggagaacgacatgaaattcacggtggtggtgggcgacgtcgccggaatcctcgcgcagggcaagaagatgatccggccacagcccatggagtacaagtacagctggaagtcctggggcaaggccaagattataggcgccgacgtacagaacacgacctttatcatcgatggcccgaacactcccgagtgccccgacgatcagcgcgcgtggaacatctgggaggtggaggactacgggttcgggatcttcaccacgaacatctggctgaaactgcgggactcgtacacccaggtctgtgaccaccggctcatgtcggccgccatcaaggacagcaaggccgtccacgccgacatgggctactggattgagagcgagaagaatgaaacgtggaagctggcgcgagccagcttcatcgaggtgaaaacctgcatttggcccaagtcccacactctgtggagcaacggggttctcgagtccgagatgatcatcccaaagatctacggcggtccgatctctcagcacaactatagacccggttacttcacccagaccgccgggccctggcacctgggaaagctggagctggacttcgacctgtgcgagggcacaacggtcgtggtcgacgagcactgcggaaaccgggggccgtccctcagaacaaccaccgtgacgggaaaaatcatccacgaatggtgctgccgatcttgcacgcttccgcccctgaggttccggggtgaagatgggtgctggtacggcatggagattcgccccgtgaaggagaaggaagagaacctagtaaagtccatggtgagcgccggcagcggggaggtggactccttttcattaggtctgctctgcatctctatcatgatcgaggaggtcatgcgctcacgctggtcccggaagatgctcatgaccgggaccctggccgtgttctttctcctcatcatgggccagctgacttggaacgatctgatccggctctgcatcatggtgggggctaacgcgagcgaccgcatgggcatgggaaccacctacctggccctgatggccacctttaagatgcggccgatgttcgccgtcggcctcttgttccgccgactgacgtcccgcgaagtcctcctgctgaccatcggcctcagcctggtagcgtccgtcgaactgcccaactcgctcgaggaactgggggacggcctggctatggggatcatgatcttaaaacttctgacggactttcagtcccaccagctatgggccactttactaagccttacttttatcaagacgacctttagcctgcactacgcctggaagaccatggcgatggttctgagtattgtctccctcttccccctgtgcctgtcaactacttcccagaagaccacctggcttcctgtactgctggggtccctcggctgcaaacccctaacgatgtttctgatcgccgagaataagatctggggaagacgctcctggcctcttaacgaaggtattatggccgtcgggattgtctccatcctgctgagttccttactgaaaaacgatgtacccctggccggccccctcatagccggcgggatgttgatcgcctgctacgtgataagcggctccagcgccgacctgtccctagagaaggccgccgaggtatcatgggaagaggaagccgagcacagtggggctagccataacatcctggtggaggtgcaggatgacggcaccatgaagatcaaggacgaggagcgggacgacaccctgaccatcttgctgaaggccaccttgctcgcagtctccggggtgtacccgctgtcgatacccgccacgttattcgtgtggtacttctggcagaagaagaaacagcgctccggcgttctgtgggataccccctccccgcccgaggtggagcgggccgttctggatgacggaatctataggatcatgcagcgggggctgctgggtcgctcccaggtcggagtgggcgttttccaggagaacgtcttccacaccatgtggcatgtaacccgaggggcagtgcttatgtaccagggcaaacggctggagccgagctgggcctccgtcaagaaagaccttataagctacggcgggggctggcggctacaggggtcctggaatacgggcgaggaggtccaggtgatagcagtcgaaccgggaaagaaccccaagaatgtgcaaaccgcccccggcaccttcaagaccccagagggagaggtgggggccatcgcgctggacttcaagcccggcacgtcgggttcccccatagtgaaccgcgagggcaagattgtgggcctgtatggcaacggcgtggtcaccaccagcgggacctatgtgagcgccatcgcgcaagcgaaagcgtcgcaggaaggcccactacctgagatcgaagacgaggtgttccgcaagcgcaacctgacgatcatggatttgcaccccgggagcggcaagacccggcgctacctgccagccatcgtcagagaggccatcaagcggaagctgcgaaccctgattcttgctccaactcgggtggtggcctccgagatggcggaggccctgaagggcatgccgattcgctaccagacaaccgccgtgaaaagcgagcacaccgggaaggaaatcgtggatctcatgtgtcacgccacgttcacgatgcggctcctgtcccccgttcgcgttccgaactacaacatgatcatcatggatgaagcccacttcaccgaccccagctccatcgcggcccgtggctacatcagcacgcgcgtcgggatgggcgaggccgccgccatctttatgacggcgactccgcccggaagcgtggaggccttcccgcagagcaacgccgttatccaggacgaggaacgggacatccccgagcgctcctggaatagcggctacgaatggatcaccgacttccccggcaagaccgtgtggttcgtcccctccatcaagtcgggaaacgacattgccaactgtctacggaagaacgggaagcgcgtcatacagctctcccggaagaccttcgacaccgaataccagaaaaccaagaacaacgactgggactacgtggtgacgaccgatatcagcgagatgggcgcaaacttccgcgccgaccgcgtcatagatccgcgccgatgccttaagcccgtgatcctgaaggatggccccgagagggttatactcgccgggcccatgccggtcacggttgcctccgccgctcagcggcgcggccggatcggccgaaaccacaacaaggagggcgaccagtacatctacatgggccagcccctgaacaacgacgaagaccacgcacactggaccgaggctaaaatgctgctcgacaacatcaacacccccgagggtatcatccccgccctattcgagcccgagcgcgaaaagtccgctgctatcgacggcgagtaccggctgagaggggaagcccggaagaccttcgtcgaactcatgaggcggggcgacctgcccgtatggctttcctacaaggtggccagcgaggggttccagtacagcgatcgccggtggtgctttgacggggagagaaacaaccaggtcttggaagagaatatggacgtggagatctggacaaaggagggcgagaggaagaaactgaggccccgatggttagacgcccgcacctactccgaccccttggcacttcgggagttcaaggaatttgcggccggtcgccgctcagtttccggcgacctgatcctcgagatcggcaagctaccgcagcaccttacccagcgcgcccagaacgctctcgacaacctggtcatgttacacaactcagagcaaggtgggcgggcgtaccgccacgcaatggaggagctccccgacaccattgaaacgttaatgctgttggccctgattgcagtgctgacaggtggcgtgaccctcttctttttaagtgggaggggcctgggcaagaccagcatcgggctcctgtgcgttatggcctccagcgtgctcctctggatggcaagtgtagagccccactggatcgccgcctccataatcctggagtttttcctgatggtcctcctaatccccgagccggaccgccagagaactccccaggacaaccaactggcctacgtggtgatcggcctcctgttcatgattctgacggtggccgcgaatgagatgggcctcctagagaccaccaagaaggatctcggcattgggcatgttgccgtggagaaccaccatcacgccgccatgctcgacgttgacctacatcccgcttcggcgtggaccctctatgccgtggccacgaccatcatcacaccgatgatgcgccacaccatagagaatacgactgctaacattagcctcaccgctatcgcgaaccaggccgccatcctaatgggcctggacaaagggtggccaatctccaagatggatatcggcgttcccctcctggcgctgggttgctacagccaggtcaaccccctcacgctgacggcggcagttctcatgctcgtcgcccactacgccatcatagggccggggctgcaggccaaggcgacccgtgaggctcagaagcggaccgccgcagggataatgaagaaccccaccgttgacggcatcgtggccatcgaccttgaccccgtcgtctacgatgctaagttcgagaagcagctaggccagatcatgctgttgatcctctgcacatcccagatcctgctgatgcgaaccacgtgggctctctgcgagagcatcaccctagccacgggaccgcttacgacactctgggagggttccccgggaaagttctggaatacaacgatagccgtgtccatggccaacatctttcggggctcttacctggcgggcgctggtctggccttcagcctcatgaagtcactgggcgggggccgccgtgggacaggcgcccagggcgagacactgggtgaaaagtggaagcgacagctcaaccaactctccaagagcgaatttaacacctacaagcgctccgggatcatggaggtggaccgcagcgaggcaaaggaggggctgaagcggggcgaaacgaccaagcacgctgtgtctcgaggaaccgccaagttgcgatggtttgtggagaggaacctggtaaagcccgaaggcaaggtcatcgatctgggctgcggtcggggcgggtggagctactactgcgccggtcttaagaaggtgaccgaggtgaaggggtatacgaagggcggacccgggcatgaggaacccatcccaatggccacctatggctggaacctcgttaagttacactccgggaaggacgtgttcttcattccgccggagaagtgcgacaccctgctctgtgacatcggcgagagctcccccaacccgaccatagaagaagggcgaactctgcgcgtcttgaagatggtcgagccctggctccgcggcaaccagttctgcatcaagatcctgaatccttatatgcccagcgttgtggagacccttgagcagatgcagcggaagcacggagggatgctcgtgcgcaacccgctgtcgcggaacagcacgcacgaaatgtactgggtgtcctgcggcaccgggaacatcgtgtccgccgtcaacatgacttcccgcatgctgctcaaccgctttacgatggcccaccggaaacccacgtatgagcgcgacgtggacctgggcgccggcacccgccacgtggccgtggaacccgaggtggcgaacctggacattatcgggcagcgcatcgaaaacatcaagcacgagcataagagcacctggcattatgacgaagacaatccttacaagacgtgggcgtaccacggctcctacgaggtgaagccgagcgggtcagccagcagcatggtcaatggagttgtcaaactgctgaccaagccctgggacgtgatccccatggtgacccagatcgccatgaccgacacgacaccctttgggcagcaacgggtcttcaaggaaaaagtggacacccggaccccgaaagccaaacggggcactgcccaaatcatggaagtgaccgcgaagtggctgtgggggttcctctcgaggaacaagaaacccaggatctgcacgcgcgaggagttcactaggaaggtccgcagcaacgccgccatcggggccgtctttgtggacgaaaatcagtggaactccgcgaaggaggccgtcgaagatgagcggttctgggacctggtccatcgagagcgggagctgcacaagcagggcaagtgcgccacgtgcgtttataacatgatggggaagagggagaagaagctcggcgagtttgggaaggccaaaggcagccgggccatttggtacatgtggcttggcgcgcgctttctggagttcgaggccctcggattcatgaacgaagatcactggttcaaccgggaaaactccctgagcggagttgagggggaaggcttgcacaagctcgggtacatattacgcgacatttccaagatccccggcggcaatatgtacgccgacgatactgctgggtgggatactcggatcaccgaggacgacttacagaacgaggcacgcatcacggacatcatggagccggagcatgcgttgctggctaggagcatcttcaagctgacctaccagaacaaagtggtccgggtccagcgccccgccaagaacggcacggtgatggacgtgatctcccgacgggaccagcgtgggagcggccaggtcggcacctacgggttgaacacgttcactaacatggaggcacagctgatccgccagatggagtccgagggcattttctccccctccgagctggagacccccaacctcgccgagcgggtgctggactggctggagaagtacggggtggaacgcctcaagcggatggcgatcagcggcgacgactgtgtcgtgaagccgatcgacgatcgcttcgccaccgccctgacagctctgaacgacatggggaaggtgcggaaggacatcccccagtgggagccctccaaaggttggaacgactggcagcaggttcccttttgcagccatcatttccatcagctcatcatgaaggacggccgcgagatcgtggtgccttgccggaaccaggacgaacttgtcgggcgcgctcgggtatcccagggtgccgggtggagcttacgtgaaaccgcctgcctcggaaagagttatgcccagatgtggcagcttatgtacttccaccggcgcgatcttcggttggccgccaacgccatttgctcagccgttcccgtcgattggatccccaccagccgcactacgtggtccattcatgcacaccaccagtggatgaccaccgaggatatgttgtccgtttggaaccgcgtgtggattgaggagaatccgtggatggaggacaagacccacatctcaagctggggcgacgtcccgtatctaggcaaacgggaggaccagtggtgtggctccttgatcgggctgacggccagggcgacctgggccaccaacatccaagtagccatcaatcaggtcaggcgcctaatcggcaacgagaactacctagactatatgacgagcatgaagcggttcaaaaacgaatcggatcccgaaggggccctgtggtga

SEQ ID NO: 24119 - RNA, 9879 nt, synthetic construct
  misc_feature 1..9879: note = derived and/or modified CDS sequence (opt11) from DENV-1__FJ024428__SS-prME
  source 1..9879: mol_type = other RNA
agcgtgaccatgcttttgatgcttatgcccactgcccttgcattccacctcacaacccgtggtggggaaccccacatgatcgtgtcgaagcaagagcgagggaagagcctgctgttcaaaacctcggcaggggtgaacatgtgcaccctcatcgcaatggacctgggcgagctttgcgaggacaccatgacctacaagtgcccccgtataaccgaaaccgagccagacgacgtagactgctggtgcaacgccaccgacacctgggtgacctacggaacgtgtagccagacgggcgagcatagaagagacaaacgatccgtagcgctcgcgcctcatgtgggcctggggctggagacccgcaccgagacctggatgagctccgagggcgcctggaaacagatccagagagtggagacgtgggccctccggcacccggggttcacggtgacggcattgttcctagcccacgcgattggaaccagcatcactcaaaaggggataatctttatactcctgatgctggtaaccccttccatggccatgcggtgtgtaggtatcggtagccgcgactttgtggaggggctctcgggcgccacgtgggtggacgttgtgcttgagcacgggagctgcgtcaccacgatggccaaagataagccgaccctggacatcgaactcctgaagactgaggtcacgaatcccgccgtgctgcggaagctctgcattgaagcgaagatctccaacacgaccaccgactcgcgctgtccaacccaaggcgaagccacgctggtggaggagcaagacgccaacttcgtctgtcgccggacgttcgtagaccggggctgggggaacggatgcgggttattcggcaagggctcccttatcacgtgcgccaagttcaaatgtgtgacaaagctggaaggtaagatcgtccagtacgagaacctgaaatacagcgtgatcgtcactgtccacaccggcgaccagcaccaggttgggaacgagtccacagagcatggcaccaccgcgacgatcaccccccaggcgccgaccaccgaaatacagctcacggactacggggccctgacactggactgcagccctcgcaccggcctcgatttcaacgagatggtcctgctcaccatgaaagaaaagagctggctcgtccacaaacagtggttcttggacttgcccctaccctggaccagcggggcgagtacatcccaggagacctggaatcggcaggacctgcttgtgaccttcaagacggcccacgctaaaaagcaggaagtcgtggtgctgggcagccaggagggcgcgatgcataccgccctcactggtgccaccgagatccagacgagtggtaccactaccatcttcgccgggcacttgaaatgccgcctcaaaatggacaagctgacgctgaaaggcatgagctatgttatgtgcaccgggtccttcaagctcgagaaggagctggcagagacccagcacgggaccgtgttagtgcagatcaagtacgagggcacggatgcgccttgcaagatccctttcagtacccaggacgagaagggtgtcacccagaacggacggttgataaccgctaacccaatagtgacggataaggagaagcccgtgaatatcgaggctgagccaccgttcggggagtcctacatcgtcatcggtgccggcgagaaagctctgaagctgtcatggttcaagaaggggtctagcataggcaaaatgttcgaagccacagcacgcggggccagaaggatggccattctaggcgatactgcgtgggacttcggttccattggcggcgtgttcacctcagtggggaagttagtccaccagatcttcgggacggcgtacggggtactgttctccggcgtgagctggaccatgaaaattgggatcggcgtcctactcacctggctggggcttaactcccggagcacaagcctctcaatgacgtgcatcgccgtggggctggtaacactgtacctcggcgtcatggtgcaggccgactccgggtgcgttatcaactggaagggccgagaacttaagtgcgggtcgggcatattcgtaaccaacgaagtgcatacctggaccgaacaatacaagttccaggccgactcgccgaagcgcctgtccgcggccatcggtaaggcttgggaggagggggtatgcggcatccggtccgccacacgcttagagaacattatgtggaagcagataagtaacgagctgaaccacatcctgctagagaacgacatgaagttcaccgtcgtggtgggggacgtcgccggcatccttgctcaagggaagaagatgatacggccgcaacccatggaacataaatacagctggaagtcctggggcaaggctaagatcatcggcgccgatgtgcaaaatacgaccttcatcattgacgggcccaatacgccggagtgccccgacgaccagagggcctggaacatctgggaggttgaggattacggtttcgggatctttaccaccaatatctggttgaagctccgggacagctacacccaggtctgtgatcatcgcctgatgtccgctgccatcaaagacagcaaggccgtgcacgccgacatgggctattggatagagtccgagaagaacgagacgtggaaactggcccgggcgtctttcatcgaggtcaaaacctgcatatggccaaagtcccataccctctggtccaacggcgtcctggagtccgagatgatcatcccgaagatttacgggggcccgatcagccagcacaactaccgccccgggtacttcacccagacggccggtccttggcatctggggaagctcgagctggacttcgacctgtgtgagggcaccaccgtggtggtggacgagcactgtggcaaccggggtccgtccctccgcactacgaccgtgaccggcaagatcatccatgagtggtgctgccggagctgcacactgccgccactgcgattccgaggggaggacggctgctggtatgggatggagatccgtcccgtgaaagagaaagaggagaacctcgtcaagtccatggtgagcgcaggcagcggcgaagtggactccttcagtctggggctgctctgcatctccatcatgatcgaggaagtcatgcgcagccgttggtcccggaagatgctgatgacaggaactctggctgtgttcttcctcttaatagtggggcagctgacctggaatgatctaatccgcctgtgcatcatggtcggtgccaacgccagcgaccgaatggggatgggaacgacgtacttggctctcatggccaccttcaagatgaggccgatgttcgcggtggggctgctcttccgccggctcacctcacgcgaggtactgctactcactatcgggctgagcctcgttgcttccgtggagttacccaactcgctggaggagctgggtgacgggctcgccatgggcatcatgatcctgaagctgctcacggacttccagtcccatcagctgtgggccaccctgcttagcctcaccttcatcaagaccacgttctccctgcactacgcgtggaaaaccatggcgatggtcctcagtgtggtgagcctatttcccctgtgcctcagcaccaccagtcagaagactacctggttgcccgtcctgctcggctcactgggctgcaagccactgaccatgttcctcatcgcggagaataagatctggggccggcgatcctggcccctgaacgaggggatcatggcagtagggattgttagcatcctgctgagctcgctgctgaagaacgacgtccccctcgccgggcctctgatcgccggcggcatgctgatcgcctgctatgtaatctcagggtccagcgcagacctttctctggagaaggccgccgaggtgtcgtgggaagaagaggccgaacactccggcgcctcgcataacatcttggtcgaggttcaggacgacggcaccatgaagataaaagacgaggagcgggacgacaccctcacgatcctgctgaaggcgaccctcttagccgtgtccggcgtctacccgctgagcatacccgccacactttttgtgtggtacttctggcaaaagaagaagcagcgctcgggggtcctgtgggacacccccagcccgcccgaggtcgagcgagcggtgctggacgacggaatctaccgtatcatgcagcgggggcttctcgggcgctcccaggtgggggtcggagtattccaggagaacgtgttccacacgatgtggcacgtcacccggggcgcagttttaatgtaccaggggaagcgcctggagccctcgtgggcgtccgtgaaaaaggacctcattagctacggtggcggttggcggctgcagggctcctggaatacaggggaagaggtccaggtgatcgccgtggagcccggcaagaaccccaaaaacgtccaaaccgccccgggtacttttaaaacccccgagggcgaggtcggcgccatcgccctagacttcaagcccgggaccagcggctcccccattgtcaatcgcgaggggaaaatcgtcggattgtacgggaacggggtcgtgacaacgtcaggcacctacgtgagcgcgatcgctcaggcaaaggcctcccaggaggggccgctgcccgagatcgaggacgaggttttccggaagcgtaacctgaccatcatggacctccaccccggcagcgggaagacgagacgatacctgccggcgattgtacgggaggcgatcaagagaaagctgcgaacgctcatcctggcccccaccagagttgtggcatccgagatggcagaggcactgaagggcatgcccattaggtaccagaccactgccgtcaagagcgagcacacgggaaaggagatcgtcgatctcatgtgccacgctacctttaccatgcgtctgctttcgcccgtccgcgtgcctaactataacatgataatcatggatgaggcacacttcactgatccttcgtccatcgccgcgagaggttatatctccacgcgcgtcggcatgggggaggccgccgccatcttcatgacggccaccccgcccggcagtgtggaggcgttccctcagtcaaacgccgtgatccaggatgaggaacgggacatcccggaaaggtcctggaacagcgggtatgagtggataaccgacttccccgggaagacggtctggttcgtgccctccatcaaatccggaaacgacatcgcgaactgtctccggaaaaacgggaagcgcgtgatccagctgtcccggaaaaccttcgataccgagtaccagaaaactaagaacaacgactgggattatgtcgtgactaccgacataagcgagatgggcgccaacttccgcgcggacagagtgatcgatccgcgccggtgcctgaaacccgtcatcttgaaagatggccctgagagggttatcctggccgggcccatgcctgtcaccgtggcttccgccgcccagcggcgagggcggataggcagaaaccacaacaaggagggcgaccagtacatctacatggggcagcctctgaataatgacgaagaccacgcgcactggaccgaggccaagatgctacttgacaacatcaacacgccggagggtatcatccccgcgctgttcgagccggagcgcgagaagtccgcggccatcgacggggagtatcgactccgaggggaagcgcggaagaccttcgtggagctgatgcgcagaggggacctcccagtatggctcagttacaaggtggcctccgagggcttccaatacagcgacaggcggtggtgcttcgacggcgagcgtaacaaccaggtgctggaggagaacatggatgtcgagatctggacgaaggagggggagcgaaagaagttgcgcccccggtggctcgacgcgcgaacctactccgacccactcgccctgcgcgagttcaaggagttcgctgcgggccgccggagcgtgtccggggacctcatcttagagataggaaagttgcctcagcacctaacgcagcgcgcccagaacgcactcgataacttggtgatgctgcacaacagcgagcagggcgggcgggcctaccgccacgcgatggaggagctacccgacacgatcgagaccctgatgctcttagccctgatcgccgtattgaccggaggggtgacactgttcttcctgtccggccgggggctaggtaagactagcatcggtctcctgtgcgtgatggcctcaagcgtactcctttggatggcctccgtggaaccgcactggatcgcggccagcataatcctcgagttcttcttaatggtgctactgatccccgaaccggaccgtcagcggacgcctcaggataaccagctagcctatgtcgttatcggacttctcttcatgatcctcaccgtggcggcgaacgagatgggcttactggagaccacgaagaaggatctcgggatcggccacgtggcagtcgagaaccaccatcacgcggccatgctggacgtggatctgcacccggccagtgcatggacgctatacgctgtcgccaccaccatcatcacgccgatgatgcgccacacgatcgagaacaccaccgccaacatcagcctgacggctatcgccaaccaggcggccatcctgatgggattggacaaaggctggcccatctccaagatggacataggcgtgccccttctggccctcgggtgttatagccaggtgaaccccctgaccctcaccgccgcggtccttatgctggtggcccactacgccatcataggtccgggtctgcaggctaaggcaacccgcgaagcgcagaagcggactgccgccggcataatgaaaaacccaactgtggacgggatcgtcgccatcgacctcgaccccgtggtgtacgatgcaaagtttgagaaacagctgggacagatcatgctcctgatcctgtgcaccagccagatcctgctcatgaggacgacgtgggcgctgtgcgagagcatcaccctggccaccggccccctcactacgctgtgggaggggtcccccggcaagttctggaatacaactatagccgtcagcatggccaacatcttccgggggtcctacctggccggcgcgggcctcgcatttagcctgatgaagtctcttgggggaggtcgccgggggaccggcgcccagggcgagacgttgggtgagaaatggaaacgacagctgaatcagctatccaagagcgagttcaacacctataagcggtccgggatcatggaggtggatcgcagcgaggctaaggagggcttgaagcgcggggagaccaccaagcatgcggtgtcccgcggcacggcgaagctcagatggttcgtcgagcgcaatctggtgaagcccgaggggaaggtgatcgatctggggtgcggccgggggggctggagctattactgtgctgggctgaaaaaggtcacggaggtgaagggctacaccaagggcggccccggccacgaggaacccatcccgatggccacctacgggtggaacctggtgaagttacactccggcaaggacgttttctttatcccgcccgaaaaatgcgacacgctcctgtgtgacatcggggagagtagcccaaacccgactatcgaggagggccgcacactgcgggttctcaagatggtggagccctggctgcgagggaaccagttctgcattaagatcttgaacccttacatgcccagcgtcgtggaaaccctggagcagatgcagcggaagcacggcgggatgctggtgcgcaaccctctgtcccggaacagcacccatgagatgtattgggtctcctgcggcacaggcaatatcgtgtctgccgtcaacatgacctcccgcatgctcctgaaccgcttcacgatggcacacagaaaacccacctacgagcgcgacgtcgacctgggggccggcacccggcatgtggccgtggagcccgaagtcgccaacctcgatatcatcgggcaacgcatcgagaacattaagcacgagcacaagagcacctggcactacgacgaggataatccctacaagacctgggcctaccacggatcctacgaggtgaagcctagcggctccgcgagcagcatggtcaatggggtagtgaagctgctgaccaaaccctgggacgtcatccccatggtgacgcagatcgcaatgaccgataccacgcccttcggccagcagcgggtatttaaagagaaggtcgacacacgcacccccaaagccaaacgggggacggctcagatcatggaggtgaccgccaagtggctctgggggttcttatcccgcaataagaaaccccgcatatgcacgcgcgaggagttcacacggaaggtacgaagcaacgcagccatcggtgccgtcttcgttgacgagaaccagtggaattccgccaaggaggcggtggaagacgagagattctgggatctggtccaccgtgagcgagagctccacaagcaggggaagtgcgcgacctgtgtatacaacatgatgggcaagcgtgaaaagaagctgggggagttcggcaaggcaaaggggagccgggccatttggtacatgtggctcggcgccaggttcctcgaattcgaggcgctgggcttcatgaacgaggaccactggttttcccgggagaacagcctgtccggcgtggagggcgaggggctccacaaactgggctatatactgcgcgacatctctaagatccccgggggcaacatgtacgccgacgacacagcaggctgggacacgcggatcaccgaggacgacctccagaacgaggcccgcatcaccgacatcatggagccggagcacgccctgctcgcgaagtcgatctttaagctcacctaccaaaacaaagtcgtccgcgtgcagcggcccgccaagaacgggactgtgatggacgtcattagccgccgggaccagaggggctccggacaggtgggaacctatggcctgaacaccttcaccaacatggaggctcaactgatccggcagatggagagtgaggggatcttttctcccagcgagttggagactccgaacctcgccgagcgggtcctggattggctcgaaaagtacggcgtggagcgcttaaaacgaatggccatctctggggacgactgtgtggtcaagccgatcgacgaccggttcgcgaccgccctgacggccctcaacgacatgggtaaggtacgtaaggacatcccccaatgggagcccagcaaggggtggaacgactggcaacaggtccccttctgttcccatcacttccaccagctcatcatgaaggacggcagggagatcgtcgtgccgtgcaggaaccaggacgagctggtgggccgtgcacgggtcagccaaggcgccggatggagtcttcgggagaccgcgtgcctgggcaagagttacgcccagatgtggcagctgatgtacttccaccgccgggacctaagactggctgccaatgcgatctgttcagccgtgcccgtggattggatccccacgagtcggactacatggagcatccacgcccatcatcagtggatgaccacggaggacatgctgagtgtctggaaccgcgtgtggatcgaggaaaacccctggatggaggacaagacccacatcagctcctggggcgacgtgccgtatctagggaagcgcgaggaccagtggtgcggcagcctaatcggcctgacagcccgggccacctgggcgacaaacatccaggtcgccatcaaccaggtgcggcggctcattgggaacgagaactatctggactacatgacgtccatgaagcgcttcaagaacgagagcgatccggagggcgccctgtggtaa

SEQ ID NO: 24120 - RNA, 9879 nt, synthetic construct
  misc_feature 1..9879: note = derived and/or modified CDS sequence (opt11) from DENV-1__FJ024429__SS-prME
  source 1..9879: mol_type = other RNA
agcgtcaccatgctgctcatgctgatgcccaccgccctggcctttcacctcaccacccggggcggcgagccccacatgatcgtcagcaaacaggagcgggggaagagcctgctgtttaagaccagcgccggggtgaacatgtgtaccctgatcgccatggacttgggcgaactgtgcgaggataccatgacctataagtgtccacggataaccgaaaccgagcccgatgatgtggactgctggtgtaatgcgacggacacctgggtgacctatgggacctgcagccagacgggagagcaccgccgcgacaagcggagcgtggccctcgcgccgcacgtgggccttgggctggaaacccgaacggagacctggatgagctccgagggcgcgtggaagcaaatacaacgggtcgagacgtgggccctgcgccaccccgggttcaccgtgatcgccttatttctggcccatgccatcggcacgagcatcacccagaaggggatcatcttcatactcttaatgttagtaacaccctccatggcaatgcggtgcgtgggcatcggtagccgcgacttcgtagaggggttgtccggagcgacctgggtggatgtcgtgctggagcacgggagctgtgttaccaccatggccaaggataaacccacgctggacatcgagctcctgaagaccgaggtcaccaatcccgccgtgctgcggaagctctgcatcgaagcaaagatcagcaacaccacgacagacagccgctgcccgacccaaggcgaggccaccctggtggaggagcaggacgccaattttgtctgccggcgcacgttcgtcgatcggggctgggggaacggttgcgggctgttcggaaagggttccctaatcacgtgcgccaaattcaagtgcgtaaccaaactggagggaaaaatcgtccagtacgagaacctgaagtactctgtcatcgtgactgtccacacgggcgaccagcaccaggtggggaacgagtcgaccgagcacggcaccaccgccaccatcacgccgcaggcccccaccaccgagattcaactcactgactatggggccctgaccttagactgcagcccccgcaccggtctcgacttcaatgagatggtcctgctgaccatgaaggagaaatcttggctcgtgcacaagcagtggttcctggacctgcccttaccctggacctccggggccagcacgtcccaggaaacctggaatcggcaggacttactggtgacctttaagacggcccacgccaagaagcaagaggtagtggtgctcggcagccaggaaggcgcgatgcacacggccctgaccggggccaccgagatccagacctcgggtaccaccaccatcttcgccgggcacctgaagtgtcgcctcaagatggacaaactgaccctgaagggcatgagctacgtaatgtgcacgggatcgtttaagctcgagaaggagctggcggagacccagcacggaaccgtgttggtgcagattaagtacgagggcaccgacgcgccctgcaagatccccttcagtacgcaggacgagaagggagtgacacagaacggccgcctcatcaccgcgaacccgatcgtgaccgataaggagaagcccgtgaacatcgaggccgagccgcccttcggggagagctacatagtcatcggcgccggagaaaaggcgctcaagctgtcctggttcaagaagggttccagcatcggcaagatgttcgaggcgacagcccgcggggccagacgcatggctatccttggagacacagcttgggacttcgggtccatcggaggcgtgttcaccagcgtggggaagctcgttcaccagatcttcggcaccgcatacggggtgttgttcagcggcgtgagctggacgatgaaaatcgggatcggcgtcctcatgacttggctgggcctgaactccagaagtacctccctgtccatgacctgcatcgccgtggggctggtgactctgtacctgggagtcatggtgcaggcagactccgggtgtgtgattaactggaaaggacgggagctcaaatgcggaagcggcatcttcgtcaccaacgaggtgcacacctggaccgaacagtacaagttccaggccgacagccctaagcgcctgtccgcggccatcggcaaggcctgggaggaaggagtgtgcggcatccggagcgccacccgcctggagaacatcatgtggaagcagatctccaatgagctcaaccacatcctcctggagaacgatatgaaattcacggtagtggtgggggatgtcgccggcatcctcgctcaggggaagaagatgatccggccccagcccatggagcacaaatacagctggaagagttggggcaaggccaagattatcggcgccgacgtgcagaacaccacattcatcatcgacgggcccaataccccggagtgccccgacgaccagagagcctggaacatctgggaggtggaggactacggattcgggatctttacgaccaacatctggctgaagctgcgggacagctacacccaggtctgtgaccaccgcttaatgtccgcggccattaaggacagcaaggccgtgcacgccgatatgggctactggattgaatccgagaagaacgagacctggaagctggcccgagcctctttcatcgaggtgaagacatgcatctggcctaagtcacacaccctttggagcaacggcgtcctcgagtccgagatgattattcccaaaatctacgggggcccgatcagccagcacaattaccgcccgggttacttcacccagattgccggcccctggcacctggggaagctggagctcgacttcgacctgtgcgagggtaccacggtggtggtcgacgaacactgcggcaaccgggggccctccttaagaaccaccactgtgacgggcaagatcatccacgagtggtgctgccggtcgtgcaccctcccgcccctccgcttccgcggggaggacggctgctggtacggaatggagatccgacccgtgaaggagaaggaagaaaatcttgtcaagtccatggtgtcagcaggttcgggcgaggtggactcctttagcctcgggttactgtgcatatccatcatgatcgaggaggtcatgcggagccgctggtcccggaagatgctcatgacgggcaccctagccgtcttcttcctgctcatcgtggggcaactgacgtggaacgacctgatccgcctctgcattatggtcggtgccaacgcgagcgaccggatggggatggggaccacctacctggccctgatggcaaccttcaagatgcggccaatgttcgccgttgggctcctgtttcgaaggctgacgtcgcgcgaggtgctcctgctgaccatcgggctcagcctagttgcctccgtagagctgcccaacagcctcgaggagttaggcgacgggctggcgatgggcatcatgatcctcaagctcctgaccgacttccagtcccaccagctctgggcaaccctgctgagtctaactttcataaagacaaccttctctctccactacgcctggaagaccatggccatggtcctgagcgtggtgtccctcttccctctgtgtctgtcaacgacctcccagaagaccacctggctccccgtgctgctgggcagcctcgggtgcaagccgctgacgatgttcttaattgcggaaaacaagatctggggccggcgctcctggcccctcaacgaaggaatcatggctgtgggaattgtaagcatcctgctcagctccctcctgaagaacgacgtccccttagcagggcccctcatcgccggcggcatgcttatcgcctgttacgtgatcagcgggtccagcgcggacttatccctcgagaaggccgctgaggtgagctgggaggaggaggccgagcactccggcgcctctcacaacatcctggtggaggttcaagatgacgggaccatgaagatcaaggatgaggagcgggacgacaccctgacgatcctcctgaaggcgacactgctcgccgtgtccggcgtctacccgctcagcatccctgccacactatttgtttggtatttctggcagaagaagaagcagcgctccggggtgctctgggacacccctagcccgcccgaggtcgagcgggccgtcctggacgacggcatataccgcatcatgcagcggggtctgctgggccgctctcaagtgggggtcggggtgtttcaagagaacgtgttccacaccatgtggcacgtcacccgaggcgccgtgctcatgtaccaaggaaagcgcctggaacccagctgggcgtccgtgaagaaggacctgattagctacggaggtgggtggcggctacagggttcctggaacactggggaggaagtccaggttatcgcagtagagcccggtaaaaaccccaagaacgtccagaccgctcccggcacattcaagaccccagagggcgaagtgggcgctatcgccctggatttcaagcctgggacgagcggctctccgatcgtgaaccgagagcggaagatcgtcgggctgtacggcaacggcgtggtgaccacaagcgggacctacgtcagcgcgatcgcccaagccaaagcctctcaggagggccccctccccgaaatcgaggacgaggtgttccgcaaaaggaacctcacgatcatggacctgcacccagggtctggcaagacccgccgctacctcccggcgatcgtgcgcgaggccatcaagcgcaagcttcgaaccctgatcctcgcccccacccgcgtcgtggcctccgagatggccgaagcgctgaaggggatgccgattcggtaccagacgaccgccgtgaaaagtgagcacactggcaaggaaatcgttgacctgatgtgccacgccactttcacgatgcggctcctgtcccccgtgcgggtgcctaactacaacatgatcattatggacgaggcccacttcaccgaccctagctccattgccgcgcgcgggtacatctcaacccgcgtcgggatgggcgaggccgcggccatcttcatgacagcgacgccgccggggtccgtggaggccttcccgcagagtaatgccgtgatccaggacgaggagcgcgacatccccgagcggagctggaacagcggctacgaatggatcactgacttccccgggaaaaccgtctggttcgtgccttccatcaaaagcggcaacgacattgccaactgcctgcgcaaaaacggtaagcgggtcatccagctttcccgcaagaccttcgatacggagtaccagaagaccaagaacaacgattgggattatgtcgtgaccactgacatcagcgagatgggcgccaatttccgggcggaccgcgtgatcgacccgcggcgctgcctgaagcccgtcatcctgaaggacggccccgagcgggtgatcctcgccgggccgatgccggtcacagtggcctccgccgcccaacgacggggccgcatcggccgaaaccataataaggagggcgaccaatacatctacatgggccagcccctgaacaacgacgaggaccatgctcactggacagaggccaaaatgctgctggacaatatcaacacccccgagggtatcatccccgcccttttcgagcccgagcgggagaagtccgccgccatcgatggggagtaccgcctgcgaggggaggcccgcaagaccttcgtggagctcatgcggcgcggcgacctgccggtatggctgtcctacaaggtggccagcgaggggttccaatacagcgatcggcgctggtgcttcgatggcgagcggaacaaccaggtgctggaggagaacatggacgtcgagatctggacgaaggagggtgagcgcaagaagctgcggccccgttggctggacgcccggacctactcggatcccctcgccctgcgcgagttcaaggagttcgcggcggggcggcgcagcgtctcgggcgacctgatcctcgagatagggaaactgcctcagcacttgacccaacgcgcccagaacgccctcgacaatttggtgatgctgcacaacagcgagcagggcggacgcgcctaccggcatgcgatggaggagctacccgacaccatcgagacgttgatgctgctcgcgctgatcgcagtcctgaccgggggggtgaccctgttctttctatccgggcgcggcctggggaagacctcaattggcctcctgtgcgtgatggccagtagcgtcctactatggatggcctccgtggagccccactggatcgcggccagcatcatcctggagttcttcctgatggtgctcctgatcccggagccggaccggcagcgcaccccccaggataaccagctggcctacgtcgtgatcggcctcctgttcatgatcctgacggttgccgcaaacgagatggggctcctggaaacaaccaagaaggacctgggcatcggtcacgtcgcggtggagaaccaccatcacgctgccatgctcgacgtggacctgcaccccgcctccgcctggaccttatacgcggtcgccaccaccattatcacccctatgatgagacacaccatcgagaacacgactgccaacataagcctcaccgccatcgcaaatcaggcggccatcctcatgggcctggacaaggggtggcccatctccaagatggatataggcgtgcccctccttgccctgggctgctacagccaggtgaaccccctcaccctgacggcagcggtgctgatgctcgtggcccactacgcaataatcgggccgggactgcaagcaaaggccacccgcgaggcgcagaagagaaccgccgccgggattatgaagaatcccaccgtagatggcatcgtcgcgatcgacctggaccccgtcgtctacgacgccaagttcgaaaagcagctagggcagatcatgttactgatcctctgcacgtcccagatcctcctgatgcggaccacatgggcgctctgcgagagcatcaccctcgccacgggacccctgaccactttgtgggaggggtccccggggaagttctggaacacgacgattgcggtcagtatggccaacatcttccgcggctcctacctcgccggggcgggcctggccttcagtctcatgaagtccttgggcgggggccggagggggacaggcgcccagggcgagacccttggcgagaagtggaagcggcagctcaaccagctgtccaagagcgagttcaatacctacaagagatccggcatcatggaggtggacagaagcgaggccaaggaaggtcttaaaagaggcgagacgaccaaacacgcggtgagtcgtgggaccgccaaactcaggtggttcgtcgagcggaacctggtgaaacccgagggcaaggtgatcgacctgggatgcggccgcggcgggtggagctactactgtgctggccttaagaaggtaaccgaggtcaagggttacactaagggcgggccaggccatgaggagccgatcccgatggccacctatggctggaatctcgttaagctgcactccgggaaggacgtcttctttatccctccggagaaatgcgacaccctgctctgcgacatcggcgaaagctcccccaacccgaccatcgaggaagggcggacgcttcgcgtgctgaagatggtggagccctggcttcggggtaaccagttctgcatcaagatcctgaacccctacatgccctcagtcgtggagaccctggagcagatgcagcgcaagcacgggggcatgctagtgcggaacccgctgtcccgcaacagcacccacgagatgtactgggtctcctgcggcactgggaacatcgtgtctgccgttaacatgacctcaaggatgctgttgaaccggttcacaatggcgcaccgcaagcccacttatgagcgggacgtcgacctgggcgccgggacgcgccatgtggccgtggagcccgaggtcgccaacctcgacatcatcgggcaacggatcgagaacatcaagcacgagcacaagagcacctggcactacgacgaggacaacccttacaagacgtgggcctaccacggcagctacgaggttaaaccgagcggttccgcgagctccatggtaaacggtgtggtgaaactcctgacaaagccctgggacgtcatacccatggtgacacaaatcgccatgaccgacacgacgcccttcgggcagcagcgtgtgtttaaggagaaagtcgacacccggacacctaaggccaagcgcggcacggcccagataatggaggtaaccgcaaagtggctgtggggattcctctcccggaacaaaaagccccgcatctgcaccagggaagagttcactcgcaaagtgcggagtaacgctgccatcggcgccgtcttcgttgacgagaaccagtggaactccgccaaggaggcggtggaggacgagcgcttctgggacctggtccaccgggagcgcgagttgcacaagcaaggcaagtgtgccacgtgcgtgtataacatgatgggtaagcgggagaagaagctcggggagttcggaaaagccaagggctctcgcgccatctggtacatgtggctgggggcccgttttctggagttcgaggcgctcggcttcatgaacgaggaccactggttctcccgcgagaacagcctgtcaggcgtcgagggggaggggctgcacaaactcgggtatatcctgcgcgacatctccaagatacccggcgggaatatgtatgccgacgacaccgcaggctgggacacccgcatcacggaggacgacttgcagaatgaggcccgtataacggacatcatggaaccggagcatgccctcctggcgaaatccatcttcaaactgacatatcagaacaaagtcgtgagagtgcagcgccccgccaagaacggcaccgtaatggacgtaattagccggcgcgaccagcggggctccggacaggtggggacctacggcttaaataccttcaccaacatggaggcccagctgatacgacagatggagagcgaaggtatcttcagccccagcgagctggagacccccaacctcgccgagcgggtgcttgactggttggagaagtacggggttgagcgcctaaagcggatggcgatctctggcgacgattgcgtcgtcaagccgatcgacgaccgcttcgcgaccgcactgacggccctaaatgacatgggcaaggtgcgcaaagacatcccccagtgggagcccagcaagggatggaacgattggcagcaggtccccttctgctcccaccacttccatcagttaatcatgaaggacggacgcgagatcgtagtgccatgccggaaccaggacgaactggttggtcgcgcccgggtcagtcaaggcgccgggtggagcctgcgtgagaccgcctgcctcggcaagtcatacgcccaaatgtggcagctgatgtacttccaccgccgcgacctgcggctagccgccaacgcgatctgcagcgccgtgcccgtggactggatcccgacctctaggaccacgtggagcatccacgcccaccaccaatggatgaccaccgaggacatgctgtcggtctggaaccgcgtgtggatcgaggaaaacccttggatggaagacaagacccacatatcgtcttggggcgatgtgccgtatctgggcaagcgggaggaccagtggtgtgggtccttaattggcctgacggcccgcgccacctgggcgaccaatatccaggtggccatcaaccaggtgcgcagattaatcggcaatgagaactacttagactacatgacctcaatgaaacggttcaagaacgagtcagacccggagggggccctgtggtaa

SEQ ID NO: 24121 - RNA, 9879 nt, synthetic construct
  misc_feature 1..9879: note = derived and/or modified CDS sequence (opt11) from DENV-1__FJ024430__SS-prME
  source 1..9879: mol_type = other RNA
agcgtgaccatgctgctcatgctgatgcccaccgccttggccttccacctcaccacgcgtggtggtgagcctcacatgatcgtgtcaaagcaagaacggggtaagagcctgctgttcaaaaccagcgcaggggtgaacatgtgcaccctgatcgcaatggacctcggcgagttatgtgaggacaccatgacctacaagtgtccacgcatcaccgaaaccgagcctgacgacgtggactgctggtgtaacgccacggacacatgggtgacatacgggacctgttcacagacgggggagcaccgtcgcgataagcggtccgtggccctcgcgccccacgtgggtcttggcctggagacacgcaccgagacctggatgtccagtgagggtgcgtggaagcagatccagcgggttgagacgtgggcattgcgccaccccgggttcaccgttattgcacttttcctggcccacgcgatcggcacaagcatcactcaaaaggggattatcttcatcctcctgatgctcgtgacgcccagcatggccatgcggtgcgtgggaataggcagccgcgacttcgttgaagggcttagtggcgccacctgggtcgacgtcgtgttagagcacggcagctgcgttaccaccatggccaaggacaagcccacgctggacatcgagttactgaagaccgaggtgaccaaccccgcggtgctgcggaagctgtgtattgaggccaagatctcaaacaccacgactgatagccgctgtccgacccagggggaggctacactggtggaggaacaggacgcgaactttgtatgccggcgcacgttcgtggaccggggctgggggaacggctgcggtcttttcggcaaggggtccctcataacctgcgcaaagtttaaatgcgtgaccaagctcgaggggaagatcgtacaatacgagaacctgaagtatagcgttatcgttaccgtccatacgggcgaccaacaccaggtgggaaacgagtccaccgagcacggcaccacggccacgatcacgccccaggcgccgaccacagagatccaactcaccgactacggggccttgacgctggattgcagcccccgcaccggcttggacttcaacgagatggtgttacttaccatgaaggagaaaagctggctcgtgcacaagcaatggtttttagatttacccctaccctggaccagcggcgcctccacttcccaggaaacctggaatcggcaggacttactcgtcaccttcaagaccgctcacgccaaaaagcaggaggtggttgtgctcggcagccaggagggcgcgatgcacacggccttaaccggggccaccgagatccagacctccggcacgaccaccatcttcgcagggcacctcaagtgccgtctcaaaatggacaagctgacgctgaagggcatgtcttacgtaatgtgcacagggtcgttcaaactcgaaaaggaggtggcagaaacccagcacgggaccgtgctagtccagatcaagtacgagggcaccgacgcgccatgtaagattccgttcagcacgcaggatgagaagggggttacccagaacggacggctgatcaccgcaaacccgatcgtcaccgacaaggagaagcccgtcaacatcgaagccgaaccgcctttcggagagagttacattgttatcggcgccggcgagaaggcgcttaagctctcctggttcaagaagggttccagcatcggcaagatgttcgaggccacggcacgcggggctcggcgcatggccatcctgggggacaccgcgtgggacttcgggtccatcggcggcgtgttcaccagcgtcgggaaactggtgcaccaaatctttggcaccgcctacggggtcctcttttccggcgtctcgtggacgatgaagatcggaatcggcgtgctgctgacgtggcttggtctaaattcacgaagcacctccctgtccatgacctgcatcgccgtggggcttgtcacgctatacctgggggtaatggtgcaggccgactccgggtgcgtaatcaactggaaaggccgggagctcaagtgcggaagcggcatcttcgtgaccaacgaggtgcacacttggacggagcagtacaagttccaggccgacagcccaaaacgactatccgcggccatcggcaaggcctgggaggagggggtctgcggcattcggagcgccacccgcctggagaacatcatgtggaagcagatctccaacgagctcaaccacatcctgctggaaaacgacatgaagttcacggtggtggtcggggacgtggcaggcatcctcgcgcaggggaagaagatgatacggcctcagcccatggagtataagtacagctggaaatcctggggcaaggcaaaaatcatcggagccgacgtgcagaataccaccttcataattgacgggcccaataccccggaatgcccagacgaccagagagcatggaacatttgggaggtcgaggactacggcttcggtattttcacgaccaatatctggctgaagttgcgggacagctatacccaggtgtgcgatcaccgtctgatgtccgcggccataaaggactcaaaggctgttcatgccgacatgggctactggatcgagtccgagaagaacgagacatggaagctggcccgggcgtccttcatcgaggtcaagacgtgcatctggccaaagagccacacgttgtggagcaacggcgtgctagagtccgagatgattatacccaaaatctacgggggcccgatcagccagcacaattaccgtcccgggtacttcacccagaccgcgggcccctggcacctgggtaagctggagctcgacttcgatctatgcgagggcacgaccgtggtggtggacgagcactgcggcaaccgggggccgtcactgcgcaccactacggtgacaggcaagatcatccacgaatggtgctgccggagctgcaccctgccgcccctccgtttccgcggagaggatggctgctggtatgggatggaaatccgtcccgtcaaggagaaggaggagaacctggtgaagtccatggtgagcgccggcagcggggaggtcgactccttcagcctcgggctgctctgcatctccatcatgatcgaggaggttatgaggagccgctggtcgcggaaaatgttaatgaccgggacgctggccgtgttctttctgctcatcatgggacaactaacctggaacgacctcatcagactgtgcattatggttggcgccaacgcgtccgaccgcatggggatgggcacgacctacctggcattgatggccacgttcaaaatgcggccgatgttcgccgtggggctgctgttccgccgcttaacctcacgggaggtcttgctcctgactatcgggctcagcctggtcgctagtgtcgagctccccaatagcctcgaggagctgggcgatgggctggcaatgggtatcatgatcttgaagctgctgaccgacttccaatcccaccagttatgggccactctgttaagtctcacgttcatcaagaccaccttctcactgcactacgcctggaaaacgatggccatggtcttaagcatcgtgtccctcttccccctgtgcctctcgaccacctcccagaagaccacgtggctccccgtactgttgggctcactcgggtgcaagccgctgaccatgctgcttatagcagagaacaagatctggggtcggcgctcctggcccctgaacgagggtatcatggccgtcggcatagtgagtatcctgcttagctccttactgaaaaacgacgttccccttgccgggcccttaatagccggcggaatgctgatcgcctgctacgtcatcagtgggtccagcgctgccctctccttagagaaggccgctgaggtgtcttgggaggaggaggccgagcactctggcgcgagccacaacatcctggtggaggtccaggacgacgggacgatgaaaatcaaagacgaggagcgcgacgacaccctcaccatcctgctgaaggccacgttgctggctgtgtccggcgtgtacccgctgagcatccccgccaccctgttcgtctggtacttttggcagaagaagaaacagcgcagcggagtgctatgggacacaccgagcccgcctgaggtgggtagagccgttctggatgacggtatctaccgaatcatgcaaagagggctgctcggccgctcccaggtgggggtgggcgttttccaagagaacgtgttccataccatgtggcacgtgacgcgcggggccgtccttatgtaccagggcaagaggctggagcccagctgggcctccgttaagaaagacctcatcagctacggagggggctggcggctgcaggggtcctggaacaccggcgaggaggtacaggtgatcgccgtggagcccgggaagaatcccaagaacgtgcagaccgcgcccggcaccttcaaaacgcctgagggcgaggttggggctatcgcgctggacttcaagcctggcacatcggggtcccccatcgtgaaccgcgagggaaagatcgtgggcctctacgggaacggcgtcgttaccaccagcgggacgtacgtgagcgccatcgcccaggccaaggcgtcccaggagggcccgctgcccgagatagaggacgaggttttcagaaagcgcaacctaaccatcatggatctccaccctgggagcggcaagacccgtagatacctgccggcaatcgtcagggaggccatcaagcgcaaactgcgcaccctcatcctggcccccacgcgggtggtcgcgtccgaaatggcggaagcactgaagggcatgcccatacgctaccagaccacagccgtaaagagtgagcacaccgggaaggagatcgtggacctgatgtgccatgccaccttcaccatgcgactgctgtcccccgtccgagtaccgaactacaatatgatcatcatggacgaggctcacttcaccgatcccagctccatcgcggcccggggctacatatctacccgagtagggatgggcgaggccgccgccatcttcatgactgcgacgccgcccggatccgtcgaggccttcccgcagagtaatgccgtgatccaggacgaagaacgggacatccccgagcgcagttggaacagcggctacgagtggatcacggacttccccggcaagaccgtgtggttcgtcccatccatcaagagcgggaacgacatcgcaaactgcctgcggaagaacggtaagcgcgtgatccagctgtcacggaagacgttcgataccgaataccagaagaccaaaaacaacgactgggactacgttgtcacgacagacatcagcgagatgggggcgaacttccgcgcggatcgtgtgatcgacccgcgccggtgcctgaagcccgtaatcctcaaagacggccctgagcgcgtcatcctggctgggcccatgccggtgactgtcgcttccgccgcgcagcggcgcggccggatcggcaggaaccataacaaggagggggaccagtatatctacatgggacagccactgaacaacgacgaggaccatgcccactggaccgaggccaaaatgttgctggataacataaacacccccgagggcatcatccccgctctgttcgagccggagagagagaagtccgccgcgatagacggcgagtaccggctccggggcgaggcccgaaagacgttcgtggagctgatgcgcagaggggacctgcccgtgtggctaagttacaaagttgcctcggagggttttcagtacagcgacaggcgctggtgcttcgatggggagaggaacaaccaagtgctcgaggagaatatggacgtggagatctggacgaaggagggcgaaaggaagaagctgaggccccggtggcttgacgcacgcacgtactccgacccgctggccctgcgggagtttaaggagttcgcggccgggcgccggagcgtctccggcgacttaatcctcgagataggcaagctgccgcagcatctcacccaacgcgcccagaatgccctggataacctggttatgctccataacagcgaacagggcgggcgggcttatagacacgccatggaggagctgcccgacactatcgagaccctgatgctcttagctctgatcgccgtgctcaccgggggcgtaaccctgtttttcctgtcagggcggggcctcggcaagaccagcatcgggctgttgtgtgtgatggcctcaagcgtgctcctgtggatggcgtccgtcgagcctcactggatcgccgccagcataatcctcgagttcttcttgatggtgctgttgatccccgagccggatcgtcaacggactcctcaggacaaccagctcgcctacgtggtcataggactgctgttcatgattctcacagtggctgccaacgaaatgggcctgcttgagaccaccaagaaggacttgggcattgggcacgttgctgttgagaaccaccaccacgccgcaatgctggacgtcgacctgcaccccgcctcggcgtggacactctacgcggttgccaccacgatcattacaccgatgatgcgccacaccatcgagaacaccaccgccaacatttctctaaccgccatcgcgaaccaggccgccatcctgatgggcttggataagggctggcccatcagtaaaatggacatcggtgtcccccttctggccctcggctgttacagccaggtgaaccctctgacgctgacagcggccgtgctcatgctagtcgcccattacgccatcatcgggccgggcctgcaagcaaaggcgaccagggaggcccagaaaagaaccgccgccgggatcatgaagaatcccacggtcgacggcatcgtagccatcgacctcgacccggtcgtgtatgacgcaaagttcgagaagcagttgggccagatcatgctcctcatcctgtgcacctcccagatcctgctcatgcgcaccacctgggccctgtgcgagtcgataacgctggcaaccgggcccctcaccaccctgtgggagggctcgccagggaagttttggaacacgaccatcgccgtttccatggccaacatcttccgcggctcgtatctggctggcgccgggctcgcctttagtctaatgaagagtctgggcgggggccgccgagggacaggcgcgcaaggcgaaaccctcggggagaagtggaagcgccaattaaaccagctgtccaagtctgagttcaatacgtacaagcggtccgggataatggaggtcgaccgctctgaggctaaggaggggctcaagcggggcgagaccacaaagcatgctgtgtcccgcgggaccgccaaattgcggtggtttgtggagcgcaacctggtcaagcccgagggaaaggttattgacctgggctgcgggcggggcgggtggagctattattgcgccggcctgaagaaggttacggaggtcaagggctacactaagggcggccccggtcacgaggagcccatcccgatggccacttatggctggaacctggtgaagctgcatagtggcaaagacgtgttcttcatcccaccagagaagtgcgacaccctcctgtgcgatattggcgagagctcccccaaccccacgatcgaggaggggaggaccctgcgggtgctcaaaatggtggaaccctggctaagaggcaaccaattctgtataaaaatcctgaacccatatatgcccagcgtggtcgagaccttggaacagatgcagcgcaagcacggaggcatgctggtgcgcaaccctctctcccggaacagcacacacgagatgtactgggtatcctgtggcaccggaaacatcgtcagcgcggtaaatatgacgtcccgcatgctcctgaaccgcttcaccatggcccaccggaagcccacctacgagcgcgacgtggacctgggcgcagggacccggcacgtcgctgtggagcccgaagtggccaatctcgacattatcggacagcgcatagaaaacatcaagcacgaacacaagtcgacgtggcactacgacgaggacaacccctataagacatgggcgtaccacggctcctacgaggtcaagccgagcgggtccgcatctagcatggtcaacggagtagtgaagctgttaaccaagccgtgggacgtgatccccatggtaacccagatcgccatgacggacaccacccccttcgggcaacagagggtgttcaaggagaaagtggacacccgcacgccgaaggccaagcggggcaccgcccagatcatggaagttaccgcgaaatggctgtggggcttcctgtctcgcaataagaagccccgtatctgcacgcgcgaggagttcacgcggaaggtacgcagcaacgccgccatcggggcggtgttcgtcgatgagaaccagtggaactccgcgaaggaggccgtggaggacgagcggttctgggatctggttcaccgcgagcgggaactccacaagcagggcaaatgcgcgacgtgcgtctacaacatgatggggaagcgcgagaaaaagctgggcgagttcgggaaggccaagggcagccgtgccatctggtatatgtggttgggagctcgcttcctcgagttcgaagccctcgggttcatgaacgaggaccattggttctcgcgagagaactctctttcaggcgttgagggtgagggcctccacaagctgggttacattctgcgcgacataagcaacattccgggcggcaacatgtacgctgacgacactgcagggtgggacacccgaatcactgaagacgaccttcagaacgaggcccgcatcaccgatatcatggagcctgagcatgcgctgctggcgaagtctatcttcaagctaacctaccagaacaaggttgtccgcgtccagcggcccaccaagaatggaaccgtgatggacgtcataagccggcgggaccagcgcgggtctggacaggtgggcacctacgggctgaacactttcaccaatatggaagcccagttaatccggcagatggagagcgaaggcatcttttcgcctagcgagctcgagacgcccaacttggccgagcgagtgctagactggctcgagaagtacggggtggagcggctgaaacgcatggccatctccggcgacgactgcgtggtgaagccggtcgacgaccggttcgcgacggccctcaccgccctcaacgatatgggaaaggtgaggaaggacatcccccagtgggagccttcgaagggctggaacgattggcagcaggtccccttctgttcccaccacttccaccagctgatcatgaaggacggcagggagatcgtggtgccctgccgcaaccaggacgagctggtcgggcgggcccgcgtcagccagggtgccggatggagcctccgggagaccgcgtgcctgggcaagtcctacgcccagatgtggcagctaatgtacttccaccgacgggacctccgcctggccgctaacgcgatatgcagcgcggtcccagtggattggatccccacgagccggaccacgtggtccattcacgctcaccaccaatggatgaccactgaggacatgctgtccgtctggaatcgagtgtggatagaggagaacccgtggatggaggacaagacacacatctcttcctggggcgacgtgccgtacctcggcaaacgcgaggaccagtggtgcggaagcctgatcgggctgaccgcccgggccacctgggcgactaacatacaggtggccatcaaccaggttcgccggttgatcgggaatgagaactacctggactatatgacgtctatgaagcgcttcaagaacgagagcgacccggagggggccctgtggtaa

SEQ ID NO: 24122 - RNA, 9879 nt, synthetic construct
  misc_feature 1..9879: note = derived and/or modified CDS sequence (opt11) from DENV-1__FJ024433__SS-prME
  source 1..9879: mol_type = other RNA
tcggtgacgatgctactcatgctgatgccgaccgccctggcgtttcacctcactacccggggcggagagccccacatgatcgtgagcaagcaggagcgtggcaagagcctgctgttcaagaccagcgccggggtgaatatgtgcacccttatcgccatggacctgggcgaactgtgcgaggacaccatgacctataagtgccctcgcatcacagagacggagccggacgacgttgactgctggtgtaacgcgacggacacctgggtgacctacggtacttgctcacagacgggcgagcaccggcgtgacaagcggtccgtggcactcgcaccccacgtgggcctggggctggaaactcgtaccgagacctggatgagctcagagggtgcgtggaagcagatacagcgggtcgagacgtgggcactccgccatcccgggttcaccgtgatcgccctgttcctggcccacgcgatcggtaccagcatcacccagaaggggataatcttcatcctcctgatgttagtgacgccctccatggccatgcgatgcgtcggcatcggcagccgcgacttcgtcgaggggctctccggcgcaacttgggtggacgtcgtcctggaacacgggtcttgcgttacgactatggccaaggataagcccacactggatatcgagctcttaaagaccgaggttacgaaccccgccgtgctgcggaaactctgcatcgaggctaagatctccaacaccacgacggacagccgctgcccaacccaaggcgaggccacgctggttgaggagcaggacgcaaactttgtgtgccggcgcacgttcgtggatcggggctgggggaacggctgtgggctattcggcaaagggtccctcatcacgtgcgccaaattcaaatgcgtgacaaagctagagggcaagatcgtccagtacgagaacctaaaatacagcgtgattgtgaccgttcacacaggcgaccagcaccaggtcgggaacgagtccaccgaacacggtaccaccgccaccataacgccacaagcgcccaccaccgagatacagctcaccgactacggggccctgacgctagactgcagcccccgcaccggtttggacttcaatgagatggtactactgaccatgaaggaaaagtcctggctcgtccacaagcagtggttcctggacttaccgctcccatggactagtggggccagcatctcccaggagacgtggaaccggcaggacctgctggtgaccttcaaaaccgcgcacgctaagaagcaggaagtcgtggtcctcgggagccaggagggcgcaatgcacaccgccctaacgggggccacagaaatccagaccagcggcaccacgacaattttcgccggtcacctgaagtgccggcttaagatggacaagctgaccctccggggcatgagctacgttatgtgtaccgggtccttcaagcttgagaaggaggtggctgagacgcagcacggtactgtgttggtccaaatcaagtacgaaggaaccgacgcgccctgcaagatcccgttctccacgcaggatgagaagggggttacgcagaacggccgacttatcaccgccaacccgatcgtgacggacaaggagaagcccgtcaatatcgaggccgaaccgccctttggggagtcctacatcgtgatcggtgccggcgagaaggcgctgaagctcagctggttcaaaaagggtagtagtatcggcaagatgttcgaggcgaccgcacgcggggcccggcgcatggccatcctgggcgataccgcgtgggacttcgggtccatcggcggcgtgttcacctctgtcgggaagctggtgcaccagatcttcggcaccgcctacggggtcctgttctccggcgtcagctggaccatgaaaataggcatcggcgtcctcctgacgtggctcggcctgaacagccggtctacttccctgagcatgacctgcatcgccgttggccttgtcacgttatacctgggagtcatggtacaagcagattccgggtgcgtcattaactggaagggccgcgagctcaagtgcgggagcggcatctttgtgacgaacgaggtgcacacatggaccgagcagtacaagtttcaggccgacagcccgaagcggctcagcgcggccatcggtaaggcctgggaggagggggtttgcggcatcagaagtgccacccggctggagaacatcatgtggaagcagatatccaatgaattgaaccacatcctgctggagaatgacatgaagttcaccgttgtggtaggggacgttgccggaatcttagcgcaggggaaaaagatgatccgtccccagcccatggagcacaaatacagctggaagtcctggggaaaggcgaagatcatcggggccgacgtgcagaacacgacattcatcattgacgggccgaacaccccggagtgccccgacgatcagcgggcctggaacatctgggaggtcgaggactatggattcgggatattcaccacgaacatctggctgaagctgcgcgacagctacacccaggtgtgcgaccaccggttaatgtccgccgccataaaggatagcaaggccgtccacgccgacatgggttattggatcgagagcgagaagaacgaaacctggaagcttgcgcgcgcgagctttattgaggtcaagacttgtatctggcccaaatcccacacgctgtggagcaatggcgtgctcgagtcagagatgattattcccaagatttacgggggcccgattagccagcacaactaccggccgggatacttcacccagaccgccggcccctggcacctgggcaaactggagctcgactttgacctgtgcgaaggcaccactgtggtcgttgacgagcattgcggcaaccgcgggccgtccctgcgcaccaccaccgtgacggggaagatcatccacgagtggtgctgccgcagctgcactctgccgcccctgcggttcagaggggaggacggctgctggtacgggatggagatccggcctgttaaggaaaaggaagagaaccttgtgaagtctatggtgagcgccggcagcggcgaggtggattccttcagcctcgggctgctgtgcatctccatcatgatcgaggaggtgatgcgcagccggtggagccggaagatgcttatgaccggcacgctggccgtgttctttctgctaataatgggacagctgacgtggaatgacctgatccgcctatgcataatggtaggcgccaacgcgagcgaccggatggggatgggcaccacgtacctggccctgatggccaccttcaagatgcgcccgatgttcgccgtagggctcctgttccggcgcctgacgtcccgagaggtactcttgctgacgatcgggctctcacttgtcgcatccgtggagctgcccaacagcctcgaggagctgggcgacgggctagcgatgggcatcatgatcctcaagcttctgaccgacttccagagccaccaactctgggccacccttttaagcctcacgttcattaagaccaccttctccttacactacgcctggaagactatggccatggtgctgtctatcgtgtccctcttcccgctatgcctgagtacgacctcccagaagaccacctggctccccgtgctgcttggcagcttgggatgcaagccgttgactatgttccttatcgcggagaacaagatctggggtcgccgtagctggccactcaatgaggggataatggctgtcggcatcgtttcaattcttctgtcgtcactcctgaaaaacgacgtgcccttggccggtccccttatcgccggcggcatgttgatcgcatgctacgtcatcagcgggtcaagcgcggacctgtccctcgagaaggccgccgaggtgtcctgggaggaagaggccgagcactccggggccagccacaacatcctggtggaggtccaggacgacgggacgatgaagatcaaagacgaggagcgcgacgataccctgacgatcctcctgaaggcgaccctgctcgccgtctccggcgtctacccgctgagcatccccgccacgctgttcgtctggtatttctggcaaaagaaaaagcagcggtcgggggtgctctgggacacccccagcccgcccgaggtggagcgcgccgtcctggacgacggcatctaccggatcatgcagcgcggcctgctggggcggtcacaggtgggcgtgggcgtattccaggaaaacgtgttccacaccatgtggcacgtgacccgcggagccgtactcatgtaccagggtaagcggctggagcccagctgggcgtccgtgaaaaaagacctgatctcttacggaggcggatggcgcctccagggatcctggaataccggggaggaggtgcaggttatcgccgtagagcccggcaagaaccccaagaacgtgcaaaccgcccccgggaccttcaagacccccgagggcgaggttggtgcaatagccttagacttcaagcccgggacgagcgggtcccccatcgtgaaccgggaggggaagatcgtgggcctgtacggcaatggggtcgtgactaccagcggcacctatgtgagcgcgatcgcccaggccaaggcctcccaagaggggccgctccccgagatcgaagatgaagtcttccgcaaaaggaacctgacgatcatggacctgcaccccggctctgggaagacccgccggtatctgccggcgatagtgcgggaggctatcaagaggaaactgcgcaccctaatcctcgccccaacccgcgtggtcgcctccgagatggccgaggccctcaagggcatgcccatacggtaccagacgaccgccgtcaaaagcgagcacaccggcaaggagatcgtcgacctgatgtgccatgccaccttcacgatgcgcctcctgagtcccgtccgggttcccaactacaacatgataatcatggacgaggcacatttcaccgaccctagctccatcgccgcgagagggtacatctccacccgggtggggatgggagaggccgccgccatattcatgaccgccactccgcccggttccgtcgaggcgttcccgcagagcaacgccgtgatccaagacgaggagcgcgacatcccggagcgatcatggaactcagggtacgagtggatcaccgatttccccggcaagaccgtgtggttcgtcccctccatcaagtccggtaacgacatcgccaactgccttcgaaagaacggtaagcgggtgatccagctctcgcgcaagaccttcgacacggagtaccagaagaccaagaacaacgactgggactacgtggtcaccaccgacatcagtgagatgggcgcgaacttcagggcagaccgcgtaatcgacccgcgtcgctgtctgaagcccgtgatcctgaaggatgggcccgagagagtcatcttagccggccccatgcccgtgaccgtcgcctccgccgcccagcgtcgtggacgcatcggacgcaaccacaacaaagagggcgaccagtacatctacatgggccagcccctgaacaacgacgaggaccacgcacactggaccgaggccaagatgctgctcgacaacatcaataccccggaaggcatcatccccgccctgttcgagcctgagcgggagaagagcgccgccatcgacggggagtaccgcctgcggggcgaggcgcgcaagacatttgtggagctaatgcggagaggggatctgcccgtctggttgtcctacaaggtcgccagcgagggatttcagtacagcgacagacgctggtgcttcgacggcgaacggaataaccaggtgctcgaggaaaacatggacgtggagatctggacgaaggagggggagcggaagaagctgcggccacgctggcttgacgcccggacctactcggaccccctcgccctgcgcgagtttaaggagttcgccgcgggccggcgaagcgtctccggtgacctgatcctcgagatcggcaagctgccgcagcacctgacccagcgggcccagaacgccttggataacttggtaatgctgcacaacagcgagcagggcgggcgcgcctatcggcacgcgatggaggagctccctgataccatcgagacgctaatgttgctggccctgattgccgtgttaaccggcggggtcaccttattcttcttatccggccgtggcctgggcaagacaagtatcggcttgctgtgcgttatggcctcaagcgtgctcctctggatggcctccgtcgagccccactggatagcggcatcgatcatcctggaattcttcctgatggtgctcctgatccccgagccggacagacagcgtacgccccaggataatcaactggcctacgtggtcatcgggctcctattcatgatcctgacggtggccgccaacgagatgggcctcttagaaaccaccaagaaggatcttgggatcggccacgttgcagtcgaaaatcaccaccacgccgccatgctcgatgtggatctgcacccagcctccgcttggaccctttacgcggtagccacgaccatcatcaccccaatgatgcggcacaccatcgaaaacacgaccgccaacatcagcctcactgccatcgccaaccaggcagccatcctgatggggctggataagggctggcccatctccaagatggacatcggcgtccccctcctggccctggggtgctacagtcaagtgaatccactcaccctgacggccgcggtgctgatgctcgtcgcgcactacgctataatcggcccggggctgcaggcgaaggccacacgggaggcgcagaaacgcaccgcagccggcatcatgaagaacccgactgtggacgggatcgtggccatagacctggaccccgtcgtgtacgacgccaagttcgagaagcagttgggccagatcatgctgctgatcctctgtacgagccagatactgcttatgagaaccacgtgggcgctctgcgaaagcatcacgctcgccacggggcccttaaccaccctctgggaggggtccccgggtaagttctggaacaccactatagccgtgagcatggccaacatcttccgcgggtcctatctggctggcgccggcttagccttcagcctcatgaaatccctcggtggcggacggcgagggaccggggcacagggcgagaccctgggcgagaagtggaagcggcagctcaaccagctgtccaagagtgagtttaacacctataagcgttccgggatcatggaggtcgacagaagcgaggccaaggagggcctgaagcgcggtgaaacgacgaagcacgcggtttcgcggggcaccgcaaagttacgatggtttgtggaacggaatttagtcaagcccgaggggaaggtgatcgacctgggctgcggccgcggcggctggagctactactgtgccgggctgaagaaggtgaccgaagtcaaggggtacacgaagggcgggcccggccacgaggagcccatccctatggccacctacgggtggaacctcgtgaagcttcactccggtaaggatgtgttcttcatcccacccgagaagtgcgacactctgttatgcgacatcggggaatcttcgcccaatccgaccattgaggaggggcggacgctgcgtgtcctgaagatggtggagccgtggttgcgggggaaccagttctgcatcaagattctgaacccctacatgccctcggtggtcgagaccctggagcagatgcaacgcaagcacggcggtatgctcgttcggaatccgttatcccgcaacagcacccacgagatgtactgggtttcctgcgggaccggtaacatagtcagcgctgtaaacatgacctcccgaatgctgcttaacaggttcacgatggcgcaccgcaagcccacctacgagcgggatgtggaccttggggccggcacccgccacgtcgccgtggagcccgaggtggctaacctggacatcatcggccagcggatcgagaatatcaagcatgagcacaaaagcacttggcactacgacgaggacaacccctacaagacctgggcctaccacgggtcatacgaggtcaagccgtctggctccgcgagcagcatggtaaacggagttgtaaagctcctgacaaagccttgggatgtaatccccatggtcacccagatcgccatgacggacactaccccgttcggccaacagcgcgtgtttaaagagaaggtggacaccagaaccccgaaggccaagcgcgggacggcccaaatcatggaggtcaccgccaaatggctgtggggcttcctctcccggaacaagaagccccgcatctgcaccagggaggagttcaccaggaaggtgcgaagcaacgcggcaatcggcgcagtgttcgtcgacgagaaccagtggaactctgccaaggaggcggtggaagacgaacgcttctgggacctggtgcatcgggagcgtgagctgcataagcaagggaagtgcgccacatgcgtctacaacatgatgggcaagagagagaagaaactgggggagttcggcaaggcgaaggggagccgcgccatctggtacatgtggctgggcgcgcggttcttagagttcgaggcgctcggcttcatgaacgaggatcactggttttcccgcgaaaacagcctatccggagtggagggcgaggggctccataagctcggatatatcctccgtgacatcagcaagattcccggaggcaacatgtacgccgacgacaccgccggctgggacaccaggatcaccgaggacgacctgcagaacgaggcccgcatcacagacattatggagccggaacatgccctcctggcgaagtccatctttaaactgacataccagaacaaggtggtccgcgtgcagcgccctgccaagaacgggaccgtgatggacgtcatcagccggcgcgaccagcgtggatccggccaggtgggcacctacggtctcaacacgttcaccaacatggaggcccaactgatacggcagatggagagcgaggggatcttctctccaagcgagctagagacccccaacctggccgagcgggtgttggattggctggagaagtatggcgtcgagcgtctcaagaggatggccatctccggggacgactgtgtggtgaagccgatcgatgaccgcttcgcgactgcccttacagccctgaacgacatggggaaggtccgtaaggacatcccgcagtgggagcctagcaaggggtggaacgactggcagcaggtccccttctgctcccaccacttccaccagctcatcatgaaagatggccgcgagatagtggtcccgtgccggaaccaggacgagctggtgggccgcgcccgggtaagccagggggccggctggaacctgagggagaccgcgtgcttaggcaagagctacgcccagatgtggcagctgatgtatttccaccggcgcgacctgcggctcgcggccaatgcgatctgctccgccgtccccgtggattggatacccacctcacgcacgacttggtccatccacgcccaccaccaatggatgaccaccgaggacatgctgagcgtatggaaccgcgtctggatcgaagagaacccctggatggaagacaagacccatatctccagctgggaggatgtgccgtatctgggcaagcgggaagatcagtggtgcggatcactcatcggcttaacggcccgcgctacctgggcaaccaacatacaggtggccatcaaccaggtccggcgcctcattggcaacgagaactacctcgactacatgactagcatgaaacggttcaagaacgagtcggaccccgagggtgccctgtggtga

SEQ ID NO: 24123 - RNA, 9879 nt, synthetic construct
  misc_feature 1..9879: note = derived and/or modified CDS sequence (opt11) from DENV-1__FJ024434__SS-prME
  source 1..9879: mol_type = other RNA
agcgtgacgatgctgctcatgctcatgcccaccgcactggctttccacttgaccacccgaggcggggagcctcacatgattgtatctaagcaggagcgaggtaagagcttgttattcaaaacctcggccggggtcaacatgtgtaccctcatcgcaatggacctaggcgagctgtgcgaggacacaatgacttacaagtgcccgagaatcaccgaagccgagcccgatgatgtagattgctggtgcaacgctaccgatacatgggtgacgtacggaacatgtagccagaccggcgagcaccggcgcgacaagcggtccgtagccctcgcgccccacgttggtctaggtctggagactcgcaccgagacctggatgagcagtgaaggcgcatggaagcagatacagagagtcgagacctgggccttacgccatcccggcttcacggtcatcgccctgttcctggcccacgccatcggcaccagcattacccagaaggggatcatcttcatcctcctgatgttggtgaccccctccatggccatgcggtgtgtcgggattggcagccgtgacttcgtggagggtctctccggcgctacgtgggtagacgtcgtactggagcatgggagctgcgtgaccaccatggccaaggataagcctaccttggacatcgaattactgaaaacggaggtcaccaatcccgccgtgctgcggaagctctgtatcgaggctaagatttccaataccaccacagactcgcgctgcccaacccagggcgaggccaccttagtggaagagcaggacgccaacttcgtctgcagacgcaccttcgttgatcggggttgggggaacggctgcgggctgttcggtaaggggtccctcatcacgtgcgccaagttcaagtgtgtgaccaagctggagggcaagatagtccagtatgagaacttaaagtacagcgtcatcgtaacggtccataccggcgaccagcaccaagtcggaaacgagtcaacggagcacggcaccaccgctaccattacgcctcaggcccccacgaccgaaatacagctcaccgactacggggccctgaccctggactgcagcccccgcacgggcctcgacttcaacgagatggtccttctcaccatgaaagagaagtcctggctggtgcacaaacaatggttcctggatctgcctttaccctggacaagtggagccagcacctcgcaagaaacatggaaccgtcaagatctgctggtgaccttcaagaccgcccacgcgaaaaagcaggaggtcgtcgtgctcggcagccaggagggcgccatgcacacagcgctgacgggggccactgagattcagacctccggcaccacgaccatcttcgctgggcaccttaagtgccgcctcaagatggacaagctgaccctaaaaggcatgagctacgtcatgtgcacgggctccttcaagctcgagaaagaggtagcggagacgcagcacggtacagtactagtccagatcaagtacgagggcaccgatgccccctgcaagatacctttcagcactcaggatgagaagggtgtgacgcagaacggccggctgatcaccgcgaaccctatagtgacagacaaggaaaagcccgtcaacatcgaggccgaaccgccattcggggaatcctacatcgtgataggtgcgggcgagaaggccctaaagctctcgtggttcaagaaggggtccagcatcggtaagatgttcgaggcaactgctcgcggggcccggaggatggcgatacttggcgacacggcgtgggactttgggtctatcggcggagtctttacctcggtcgggaagctggtgcaccagatcttcggcaccgcctatggggtcctcttctctggcgttagctggaccatgaagatcgggatcggcgtgctgcttacatggctcggcctgaactctcgcagcacctccttgagcatgacatgcatcgccgtagggctcgttacgttatacctgggcgtgatggtgcaggccgactccgggtgcgtcataaactggaagggtcgggagctgaagtgcgggagcggtatcttcgtaacgaacgaggtgcacacctggaccgagcagtacaagttccaggcggacagcccaaagcgcttgagtgccgccatcggcaaggcctgggaggagggggtctgcggcatccggagcgccacccgcctggagaacataatgtggaagcagatctccaacgaattaaaccacatcctcctggagaacgacatgaagttgacagtggtggtcggggacgtggcgggcatactggggcagggcaagaagatgatacggccccagccaatggagtacaagtatagctggaagtcctggggcaaagcaaagatcataggggccgacgcccaaaacacgaccttcatcatcgacgggcccaacactcccgaatgccctgacgaccagcgagcgtggaacatctgggaagtggaagactacggttttggcatatttactacgaacatctggctgaagctacgggacagttacacccaggtctgcgatcaccgcctgatgtccgccgcgattaaggacagcaaggccgttcacgccgatatgggctactggatcgagtcagagaagaacgagacttggaagctggcgcgcgccagctttatcgaagtgaagacctgcatttggccgaagtcccacacgttatggagcaatggagtcttggagagtgagatgatcatccccaagatctacggcgggccaatcagccagcacaactaccgccccggctacttcacgcagaccgccgggccctggcaccttgggaagctcgagctggacttcgacttatgcgagggaaccacggtcgtggttgacgagcactgcgggaaccggggtccgtccctccgcaccaccaccgtgacgggcaagatcatccatgagtggtgttgccggagctgcacactgccgccccttcggttcaggggcgaggacggctgctggtacggcatggagatccgccccgtgaaggagaaggaggagaacttagtcaagtccatggtgtccgccggcagcggggaagttgactccttcagcttaggactgctctgcatctccataatgattgaggaggtcatgcggagccgctggtcccgaaaaatgctgatgactgggacgctagctgtattcttcttactgatcatgggccagctgacatggaacgacctgatcaggctttgcatcatggtgggggcgaacgccagcgatcgcatgggcatgggcaccacctatctagccctcatggccaccttcaaaatgcggcctatgttcgcggtcggactacttttccgccggttaacgtcaagagaggtgctgctgctcaccatcggcctgagcctggtggcctccgtcgagctcccgaacagcctagaggagctgggagacggcctcgcaatgggaatcatgatccttaagctactcaccgacttccagtcccaccagctctgggccaccctgctcagcttaacgttcatcaagaccacctttagcctgcactacgcctggaaaaccatggcgatggtgctcagcatcgtctccctgtttcccctgtgcctctcaacgacctcccagaagaccacctggctgccagtcctgcttgggagcctgggctgcaagccgctcacgatgtttctcattgccgagaacaaaatctggggtcggaagtcctggcccctaaacgagggcatcatggccgtggggatcgtctcaatccttctctcttcattgctgaagaacgatgtgcccctcgccggccccctgatcgccggcgggatgctgatcgcctgctacgtgatctctggatccagcgccgatctatccctggaaaaggctgccgaggtctcttgggaggaagaagcagagcactccggcgcgagccacaacatcctggtggaggtgcaggatgacggcaccatgaagatcaaggacgaggagagggacgacaccctgaccatccttctgaaagccaccctcctggccgtcagtggtgtgtacccgctctcaatccccgcaactctcttcgtgtggtacttttggcaaaagaagaaacaacggtcaggcgtcctgtgggacacccccagccctccggaggtggagcgcgccgtgctcgacgacggtatctaccggatcatgcagcgcgggctgctcggccggtcccaggtcggcgtgggcgtgtttcaggaaaacgtcttccacactatgtggcacgttacccgcggtgcggtgcttatgtaccagggcaagcggctagaacccagttgggcttccgtcaagaaggacctcatcagttacggtgggggctggagactgcgggggagctggaacacgggcgaggaggtgcaagttattgccgtcgagcccgggaaaaacccgaaaaacgtacagaccgctcccggcaccttcaagactcccgagggcgaggtgggtgccatcgccttggacttcaagcccggcacgagcgggtcccccatagtcaaccgcgagggaaaaatcgtgggcttgtacggcaatggcgtcgtcaccaccagcggaacctatgtcagcgccatcgcccaggccaaagcgtcccaagagggtccgctgcccgagatcgaggatgaggtattccggaagcgcaatctgacgatcatggacctccatcccggtagcggcaaaacccggcgctacttgccggccatcgtccgggaggccatcaagcgcaagctaagaaccctcatcctggcacccacccgggtggttgcatccgaaatggctgaggccctgaagggaatgcccatccgctaccagacgaccgccgttaaaagcgaacacaccggaaaggaaatcgtggatctcatgtgccacgccacctttacgatgcgtctactgtcccccgtgcgcgtcccgaactacaacatgataatcatggacgaggctcacttcaccgaccccagttccatcgcggcgcggggatatataagcaccagagtggggatgggagaggcagccgccatcttcatgaccgcgacgccgcccggttccgtagaggcatttccgcagagcaacgccgttatccaggacgaggaacgggacatcccagagcgctcctggaacagcgggtacgagtggataaccgacttcccgggcaaaaccgtgtggttcgtgccttccatcaagtctgggaacgacatcgccaactgcctccgcaagaacggcaagcgtgttatacaactgagccggaagaccttcgacacggagtaccagaagaccaagaacaacgattgggactacgtggtgaccacggacatttcggagatgggggcgaacttccgcgctgatcgcgtcatcgacccgcgccggtgcctgaagcccgtgatccttaaggacggccccgagcgtgtaatcctcgcaggtcccatgccggtcacggtcgcatcggccgcacaacggcgcggccggatcggccgcaaccacaataaggagggggaccagtacatctatatgggacaacccctgaacaacgacgaggaccacgctcattggaccgaagccaagatgttgctggacaacatcaacaccccggagggaatcatcccagctctgttcgagccggagcgcgaaaagtccgcagcggtcgacggagagtacaggctaagaggggaggcacggaagaccttcgtggagctgatgcgccggggggatctgcccgtgtggctttcgtacaaggtcgccagcgagggcttccaatactcggaccgccggtggtgcttcgacggggagcgcaacaaccaggtgctggaggagaacatggacgtagagatttggacgaaggagggcgagcgtaaaaaactccgcccacggtggctcgacgcacgcacatactccgaccccctggccctgcgggagtacaaggaatttgcggccgggcgccggtcagtctccggcgacctcatcctggagataggcaagctgccgcagcacctcacccaacgggcccagaacgccttggacaacctggtgatgctccacaacagcgagcagggtgggcgagcgtaccgccacgccatggaggaactgccggacacaatcgagactctgatgctcctggccctaatcgccgtgctgaccggtggcgtcaccctgtttttcctctcggggcggggcctcggcaagaccagcataggactgttatgtgtgatggcctccagcgtgctcctgtggatggcgtccgtggagcctcactggatcgctgcctccatcatcttggagttcttcctcatggtgctgctgatccccgagccggaccgccaacgtacgccccaggacaaccagttggcctacgtagtcatcggtctgctgtttatgatcctcacggtggccgcgaacgaaatggggctcctggaaaccaccaagaaggacctcggcataggtcacgtggctgtcgaaaatcatcatcacgcggccatgctggacgtggacctccaccccgcttctgcctggaccctctacgccgtggccaccaccatcataaccccgatgatgaggcatacgatcgagaacacgaccgccaacattagccttaccgcgatcgcgaaccaggccgcgattcttatggggctcgataagggatggcccatctccaaaatggacatcggagtccccctgctggccctcggctgctacagccaagtgaacccccttaccctgacagcagccgtgctcatgcttgtcgcacactacgccatcatcggcccgggtctccaggcaaaggcgacccgcgaggcccagaagcggaccgcagccgggatcatgaagaaccctaccgtggacggcatcgtggcaattgacctcgaccctgtcgtttatgacgcgaagttcgaaaagcaactcggccagatcatgctactcatactgtgcacttcccagattctgctcatgagaaccacctgggctctgtgcgagagcatcaccctggcagcggggccgctcaccaccctgtgggagggctccccgggcaagttctggaacactaccatcgccgtgagcatggctaacatcttccggggctcctacctcgccggtgcggggttagcattcagcctgatgaagtccctcggcggaggccgccgggggactggcgcgcagggcgagaccttgggggagaagtggaagcgccagctgaaccaactgtccaagagcgagtttaatacctacaagcgatccgggatcatggaggtcgacaggagcgaggccaaggagggcttgaagcggggcgaaaccacgaaacacgccgtgtcacgcgggaccgccaaactgcggtggttcgtggagcgcaatctggtcaagccggaaggcaaggtgatcgatctgggctgcgggcgtggggggtggtcgtactactgcgccggactcaagaaagtgaccgaagtcaaagggtacaccaagggcggccccgggcacgaggagcccatcccgatggcgacgtacggctggaacctggtgaagctgcacagcgggaaggacgtgttcttcatcccgcctgagaagtgcgataccttattatgtgacataggtgagagttcccccaacccgaccatcgaggaggggcgcaccctccgtgtcctcaagatggtggaaccctggctgcgcggcaaccagttttgcatcaagattttgaatccttatatgcccagcgtggtcgaggccctcgagcagatgcagcggaaacacggcgggatgctggttcgtaacccgttgtctcgaaacagcacgcatgagatgtactgggtgtcatgcggcaccggcaatatcgtcagcgccgtaaatatgaccagtcgcatgctcctcaaccgctttaccatggcccatcgaaagcctacctacgaacgcgacgtggacctgggcaccggcacccggcacgtcgcagtcgaaccagaggtggccaacctggacatcatcgggcagaggatcgaaaatatcaagcacgagcacaagtccacctggcactacgacgaggacaacccgtataagacctgggcgtaccatggttcctacgaagtcaagccgagcgggagtgcaagcagtatggtgaacggcgttgttaaactgttgacgaagccctgggacgttatccccatggtcacccagatcgcaatgacggacaccacgcccttcgggcagcagcgggttttcaaggagaaggtggacaccaggacccccaaagctaaacggggaaccgcgcagatcatggaagtcacggcccgttggttatggggcttcctgtcccggaacaagaagccacgcatctgcaccagggaggagtttacacgtaaggtgcggagcaacgcggccataggcgcggtgtttgtcgacgagaaccagtggaactcggcgaaggaggcagtggaggacgagcgcttctgggacctggtgcaccgggagcgcgaactccacaaacagggcaagtgcgcgacatgcgtttacaacatgatggggaagcgggagaagaagctcggggagttcgggaaggctaaggggagccgcgcaatttggtacatgtggctgggcgcccgtttcctcgaattcgaagccttggggttcatgaacgaggaccattggttttcccgcgagaacagtctgagtggcgtggagggggagggcctccacaagctagggtacatcctgcgggacatcagcaagatccccggcggcaacatgtacgccgacgacacggccgggtgggacacccgcatcaccgaggacgacttgcagaacgaggcgaagatcaccgacatcatggagcccgaacacgccctgctggccaaggccatattcaagctcacatatcagaataaggtggtccgcgtgcagcgacccgcgaagaacgggaccgtgatggacgtcatctcgcgccgggaccaacgcgggtccggccaggtgggcacatacgggctgaacaccttcacgaatatggaggcccagttaattcggcagatggagtccgagggcatcttcagccccagtgagcttgagacccccaacctggcagagcgcgccctggactggctcgagaagtacggggtggagcgactcaagcgtatggccatcagtggcgatgactgcgtggtcaagccgatcgacgaccggttcgcgaccgcgctgaccgccctaaacgacatggggaaggtgcgcaaggacattcctcagtgggaaccctcgaagggctggaacgactggcagcaagtcccgttttgtagccaccacttccaccagctgataatgaaggacggccgggagattgtggtgccttgccgtaaccaagatgagctggtggggcgggccagggtgtcccagggcgccggctggagcctccgggagacagcgtgcttgggtaagagctacgcccagatgtggcaactgatgtacttccaccgacgggatttacgcctggccgccaatgccatatgctctgcagttcccgtcgactgggtcccaaccagccgtaccacgtggtccattcacgcccaccatcaatggatgacgacggaggacatgctgtcagtgtggaaccgcgtctggatcgaagagaacccatggatggaggataaaacgcacatctccagttgggaggacgtcccgtacctcgggaagcgcgaggatcagtggtgcgggagtttaatcggcctcaccgctagggccacgtgggccaccaatattcaggtggcgatcaaccaggtccgccgactcatagggaacgaaaactaccttgactacatgatcagcatgaagcgctttaagaacgagtccgacccggagggcgccctgtggtag

SEQ ID NO: 24124 - RNA, 9879 nt, synthetic construct
  misc_feature 1..9879: note = derived and/or modified CDS sequence (opt11) from DENV-1__FJ024435__SS-prME
  source 1..9879: mol_type = other RNA
agcgtgaccatgctgctgatgctgatgcccactgccctggcattccacctcaccacccgtggaggtgagccccacatgatcgtgtctaagcaagagcggggcaaaagcctgctgttcaagaccagcgcgggggtgaacatgtgcacgctcattgcgatggacctgggggagctgtgcgaggataccatgacctacaaatgtcccagaatcaccgaaacagagcccgacgacgtggattgctggtgcaatgcaaccgacacctgggtgacctatggaacctgcagccaaaccggcgagcaccggcgggacaagcggtcggttgccctcgcgccccacgtgggcctgggtctcgagacacggaccgaaacgtggatgtcatccgagggcgcctggaagcagatacagcgcgtcgagacgtgggccttgcgacatcccgggttcacagtgaccgcactgttcctggcccatgcgattggcacctccatcacacagaagggtatcatcttcattctcctgatgctggttacaccaagtatggccatgagatgcgtcggcatcggtagccgggactttgtggaggggctctccggcgcaacctgggtggacgtcgtactggagcacgggagctgcgtgaccaccatggccaaggacaagcccactctcgatatagagctcctgaagaccgaggtgaccaaccccgccgtgctgcggaaactctgcatagaggctaagatctccaacactaccaccgacagccgatgcccgacacagggcgaggcaacgctggtggaagaacaggacgcaaacttcgtctgccggaggacctttgtggatcggggctggggtaacggctgcgggctgttcggcaaggggtccctcatcacgtgcgccaaattcaagtgcgtgactaaactggagggcaagattgtccagtacgaaaatctgaagtactctgtgatcgtgacggtccataccggcgaccagcaccaggtggggaacgaatccaccgagcatggaacaaccgccacgatcaccccccaggcgcccaccacggagatccagctcacggactatggggccctaaccctggactgcagcccccggactgggctcgactttaacgagatggtcttgttgaccatgaaggaaaagtcctggctagtgcataagcagtggttcctggacctgccactaccgtggacgagcggggcgagcacgtcccaggagacttggaaccggcaggacctgctggtaaccttcaagacggcccatgccaagaagcaggaggtcgtggtgctcggcagccaggaaggcgcgatgcacaccgccctgaccggggccaccgagatacagacatccggaaccaccaccattttcgccggtcacctgaaatgccgcctaaaaatggacaagctgacactgaaaggcatgtcttacgtgatgtgcaccggttccttcaagttagagaaggaactggcggaaacccagcatggcactgttctggtacagatcaagtatgagggcacggacgcgccctgcaagatcccgttctccacccaagacgaaaaaggtgtgacccagaacggccggctgatcaccgccaatccaatcgttacggacaaggagaaacccgtgaatatcgaggccgagccgcccttcggtgagtcatacatcgtcatcggggccggagagaaggcgctcaaacttagttggttcaagaaggggagcagcatcggcaaaatgttcgaggccaccgcccgcggggcccgccgcatggccatccttggcgacaccgcgtgggacttcgggtccatcggcggcgtgttcaccagcgtggggaagctcgtccaccaaatcttcggcacggcatacggggtgttgttctccggcgttagctggaccatgaaaatcggcatcggcgtcctgctaacctggctgggcctaaactcccgcagcacctccctcagcatgacgtgtatcgccgtggggttagtgacactgtacctcggcgtcatggtgcaggctgactccgggtgcgtaatcaattggaagggtcgggagctgaagtgcgggtcaggcatcttcgtcaccaacgaggtgcacacatggaccgaacagtacaagtttcaggcggacagcccgaaacgcctgtccgctgccatcggaaaggcctgggaggagggggtctgcggtatccggagcgccacgcggctcgagaatatcatgtggaagcagatcagcaatgagttgaaccacattctgctagagaacgacatgaagttcaccgtcgtggtgggggatgtcgccggtatcctggcgcaggggaagaagatgatccggccccaacccatggaacacaaatacagctggaagagttggggcaaggcgaaaataatcggcgccgacgtgcagaacacaacctttatcatcgacgggcccaataccccggagtgtcccgacgatcagcgcgcctggaacatctgggaggtggaggactatggcttcgggatcttcaccaccaacatctggttgaagctccgggactcttatacccaagtctgcgatcaccgtctgatgtccgcggccatcaaggacagcaaagcagtgcacgccgacatggggtactggatcgagtccgagaagaatgagacctggaagctggcacgggcgagcttcatcgaggtcaagacgtgtatctggcccaagtcccacactctctggtcaaacggcgtcctggagtccgagatgatcatccccaaaatatacggcgggccgatcagccagcacaactaccgccccgggtacttcacccagacggccggcccctggcacctggggaagctcgagctggactttgacttatgcgaaggcacaaccgtcgttgtcgacgagcattgcggcaaccgagggccgtccctccgcactacgactgtgaccggcaagatcatatacgagtggtgctgccggagctgcacgctgcctcccttgcgcttccggggggaggatggttgttggtacggcatggagatccgccccgtgaaggagaaggaggagaacctcgtaaagtccatggtcagcgccggcagtggcgaagtggacagtttcagcctggggctgttgtgcatctccatcatgatcgaggaggtcatgcggagccgctggtccaggaaaatgttaatgacgggcaccttagccgtattcttcctcctaatagtggggcagctcacctggaatgaccttatcaggttatgcatcatggtcggcgctaacgcctcggaccgcatggggatgggcacgacgtacctggccctaatggccaccttcaagatgcggcctatgttcgcggtaggcctgctcttccggagactcacatcccgcgaggtgctgctgttaaccatcgggctgtcgctggtcgcttcggtggagctccccaacagcctggaggagctgggcgatgggctcgcgatggggatcatgatcctgaagttactcacggacttccagtcccaccagctgtgggccacactgcttagcctgaccttcatcaagaccacgttctccctgcactacgcttggaagaccatggccatggtcctaagcgtggtttccctgttccccctgtgcctcagcaccacctcccagaagacgacttggcttcccgtcctgctcgggagcctgggttgcaagccgttaaccatgttcttgatcgcagagaacaaaatctggggcagaagatcctggccactgaacgaggggatcatggccgtgggcatcgtgagcatcctgctcagctccctgctgaagaacgatgtgccccttgcagggcccctgatcgccggcgggatgctgattgcttgctacgtaatcagcgggtcctccgcggatctctccctggaaaaagccgccgaagtgagctgggaggaggaggccgagcacagtggcgccagccacaatatcctggtcgaggtgcaagatgatgggaccatgaagataaaagacgaggagcgggacgacacgctcactatcctgctgaaagcaaccctcttggctgtgtccggggtctaccctctgtctatcccggccacattgttcgtctggtatttctggcagaagaagaagcagcgcagcggcgtcctgtgggacaccccctcgccgccagaggttgagcgggcagtcttagacgacggtatttacagaatcatgcagcgtggcttgctcgggcgctcccaggtgggcgtcggagtgtttcaggaaaacgttttccacacgatgtggcatgtcacccgtggcgccgtgctgatgtatcaggggaagcgcctcgagcccagctgggcatccgtgaagaaagacctcatcagctatggcggtgggtggcgcctacagggctcctggaacaccggggaagaagtccaggtgatcgccgtggaacccggcaagaaccccaagaacgtgcagactgcccccgggacgtttaaaacccccgaaggcgaggtgggcgcaatcgctctcgatttcaaacccgggaccagcggctcccccattgtgaaccgcgaggggaagatcgtgggcctttacggcaacggggtggtcaccacgagcggtacctacgtcagcgcgatcgcccaggccaaagcgtcccaggagggcccgctgcccgaaatagaagacgaggtgttccggaagcgcaacctgaccatcatggacctccatcccggaagcgggaaaacccgtcgctacctgccggcgatcgtgcgtgaggccatcaagcgcaagctgcgcacactcatcctggcccccacccgggtcgtggcctccgagatggctgaggcgctgaaaggtatgcccatacggtatcagaccacggctgtgaagagcgagcacacgggaaaagagatcgtcgacctcatgtgccacgccaccttcaccatgagacttctgtcccctgtgcgtgtgccgaactacaacatgatcatcatggacgaggctcactttaccgacccttcctccatcgcagctcgtgggtacattagcacacgcgtaggcatgggcgaggccgcggccatcttcatgaccgccaccccgccaggctccgtggaggcgttcccacagagcaatgcggtgatccaggacgaggaacgggacattcccgaaagatcttggaattcaggatacgagtggatcactgacttccccggcaaaacagtttggtttgtacccagcatcaagagcggcaatgacatcgcaaactgcttgcggaaaaacgggaagagagtgatacagctgtcccgcaagacctttgataccgaatatcagaagactaaaaataacgactgggactatgtcgtgacgaccgacatcagcgagatgggagcaaacttccgcgcggaccgggtgattgacccgcgccggtgcctgaagcccgtcatcctcaaggatgggcccgagcgcgtgatcctggccggccccatgccggtcacggtggcctccgccgcgcagcgtcgcgggcggatcggccgcaaccacaacaaagagggtgaccagtacatttacatgggtcagcccctgaacaatgacgaagatcacgcgcactggacggaggccaagatgttactggacaacataaacacgccagagggcatcatccccgcactgtttgagccggagcgcgagaagagtgccgccatcgacggcgagtaccggttacgcggcgaggcacggaaaaccttcgtcgagctgatgcgcagaggggacctgcccgtctggctctcctacaaggtggcctcggagggatttcagtacagcgaccggcggtggtgtttcgatggcgaacgcaacaaccaggttctggaagagaacatggacgtcgagatatggaccaaggagggggaacggaagaagctgcgcccccggtggctcgacgcacgcacctactccgaccccctggccctgcgggagttcaaggagttcgccgccggacgcaggtcggtttccggggacctcatcctggaaatcgggaagctcccgcagcacttaacgcagagagcccagaacgccctggacaacttagtcatgttgcataacagcgagcagggcgggcgtgcataccgccacgcgatggaggagctgccggacactatcgagacgctgatgctcttggccctgatagccgtcctcaccggcggggtgactctgttttttctgtccggaagaggtttgggcaagacgagcatcggcctactgtgtgtgatggcctcttccgttttactgtggatggcctccgtggagccccactggatcgcggcaagcatcatcctggagttcttcctcatggttctgctgattcccgagccggaccgccagcgtactcctcaggataaccagctcgcttacgtggtaattgggctgctgttcatgatcttgaccgttgcggccaatgaaatgggcctgctcgagaccacaaagaaagatctcgggattggccacgtcgcggtcgaaaaccaccatcacgctgccatgctggatgtggacctacaccccgcctccgcctggaccctttacgcggtcgccacaaccataattacgccaatgatgcgccacaccatcgagaacaccaccgccaacatctccctgacggccatcgccaatcaggcggccatcctcatggggctggataaaggctggcccatatccaagatggacatcggcgtacccttgctggccctcggttgctactctcaagtgaatcccctgaccttaaccgccgcggtcctcatgctggtggctcactacgccatcatcggcccggggctgcaggccaaggccacccgggaggcccagaagcggacggccgctggcatcatgaagaatcccacagtggacgggattgtcgccattgacctagaccccgtggtgtatgacgccaagttcgagaagcagctgggccaaatcatgttactcatcctgtgcacctcacagatcctgctcatgcgcaccacgtgggcgctttgcgagtctatcactctggccactggccccctcaccacgctctgggagggctcgccgggcaagttctggaacaccaccatcgctgtcagcatggccaacattttccgggggtcctacttggccggcgcgggtctcgccttcagcctgatgaagtccctcggcggcgggcgccggggtaccggggcccagggggagacgctcggcgagaaatggaagcgccagctgaaccagttatccaagtcagaatttaacacctacaagcgctccgggatcatggaggtggaccgttctgaagccaaggagggcctcaagcgcggggaaaccaccaaacatgcagtgtcccgcggcacggccaaactgcggtggttcgtagaacgcaacctagtaaagcccgaggggaaggtgatcgacctgggttgcggccgcgggggctggagctactactgcgccggtctgaagaaggtcaccgaagtgaagggctacaccaagggcggccctggccacgaggagcccatccccatggcaacctacgggtggaacctggtgaagctgcactccggcaaggatgtattcttcatcccgcccgagaagtgcgatacgctcctgtgtgacatcggcgagagctcccctaacccaaccatcgaggaggggcgcacccttcgggtgcttaagatggtggagccctggctgcgtggcaaccagttctgcatcaaaatcctgaacccctacatgccctctgtcgtggagacactcgagcaaatgcagcggaagcatggcggcatgctcgtgcgcaacccgctctcacggaacagcacccacgagatgtactgggtctcctgcgggacgggcaacatcgtatccgccgtgaacatgacctcccgtatgttgctgaacaggttcaccatggctcaccggaaaccgacctacgaacgcgacgtagacctgggagccggtacgcggcacgtggccgtcgagcccgaagttgccaatctcgacatcattggccaacgcattgagaacataaaacatgagcataagtccacctggcactatgacgaggataacccctacaaaacctgggcctaccacgggtcatacgaagtgaagccgagcggttccgcatccagcatggtcaacggggtggtgaagttactgaccaagccctgggatgtcatccccatggtgacgcagatcgccatgaccgacacaacccccttcggccagcagcgggtatttaaggagaaggtcgacacccggacccccaaagccaagcgagggaccgcccaaatcatggaagtgaccgccaagtggttatggggctttctttcgcgcaacaagaagcctaggatatgtacgcgcgaagagttcacgcggaaggtgcgcagcaacgcggccatcggtgccgttttcgttgatgaaaaccagtggaactccgctaaggaggctgtcgaagatgaacggttctgggacctagtccaccgggagcgggagctacacaaacaagggaagtgcgcgacctgcgtgtacaacatgatgggcaagagggagaagaagctaggggagttcggcaaggctaagggtagccgggccatttggtacatgtggctgggcgcgcgcttcctcgagttcgaggccctgggcttcatgaacgaggaccactggttctcccgggagaactccttatccggggtggagggagaggggctccataagttgggatacatcctgcgcgacatctcgaagatccccgggggcaacatgtatgccgacgataccgccggctgggacacgagaatcaccgaggacgacctccagaacgaagctcgcatcaccgatatcatggagccggagcacgcccttctggcgaagtccatcttcaagctcacttaccagaataaggtcgttcgcgtgcaacggcccgccaaaaacgggacggtcatggacgtcatcagcaggcgagaccagcgcggttccggacaagttgggacctacggcctgaacaccttcactaacatggaggctcagctgatccggcaaatggagagcgaagggatcttctcccccagcgagctcgagactcccaacctggccgaacgcgtcctggactggctcgaaaagtacggcgtcgagcggctgaagcgtatggccatctccggggatgactgcgtagtcaagccgatcgatgaccgattcgcgaccgcactgaccgccctcaacgacatgggcaaggtgcggaaggacatcccccagtgggagccctctaaggggtggaacgactggcagcaggtccccttctgctcccaccatttccaccagctgatcatgaaggatggcagagagatcgtcgtgccgtgtagaaaccaggatgagttggttggccgggcccgcgtcagccagggcgccgggtggtctctcagagagaccgcgtgccttgggaagtcttacgcccagatgtggcagctgatgtactttcatcgccgagacctccgcctggccgccaacgcgatctgtagcgcagtgcccgtggactggataccgacgtcccgcactacttggagcatccacgctcaccaccagtggatgaccacggaggacatgctgtccgtctggaatcgagtctggatcgaagagaacccctggatggaggacaaaacccacatcagcagttggggcgacgtaccgtacttggggaagcgcgaggaccaatggtgcggcagtctgatcggccttaccgcccgtgccacctgggcgactaatatacaggtcgctattaaccaggtgcgccgattgatcgggaacgagaactaccttgactacatgacgtccatgaagcgcttcaagaacgagagcgaccccgaaggcgcgttgtggtga

SEQ ID NO: 24125 - RNA, 9879 nt, synthetic construct
  misc_feature 1..9879: note = derived and/or modified CDS sequence (opt11) from DENV-1__FJ024436__SS-prME
  source 1..9879: mol_type = other RNA
tcagtgacgatgttactcatgctgatgcccaccgccctggccttccaccttacaaccagggggggggagccccatatgatcgtgtccaagcaggagcggggcaaaagcctattgttcaagaccagcgctggggtcaatatgtgcaccttaatcgccatggacctgggggagctgtgcgaggacaccatgacgtacaaatgcccccgcattaccgaagccgagccggacgacgtagactgctggtgtaacgccaccgatacgtgggtgacctacgggacctgcagccagactggcgagcacaggcgcgacaaacggtccgtggccctcgcgccccacgtaggcttaggtttagagacgcgcaccgaaacatggatgtcctccgagggcgcctggaagcaaatccagcgcgttgagacctgggcgctgcgccacccggggttcactgtaatagccctgttcctggcgcatgccatcggcactagtatcacacaaaaggggattatcttcatcctgctgatgctggtaaccccgtcaatggcgatgcggtgcgtcggcatcggcagccgcgatttcgtagaggggttgtccggcgccacatgggtggatgtcgtgctggagcatgggagctgcgtgaccaccatggccaaagacaagccaaccctcgatatcgagctcctcaagaccgaagtgaccaacccagctgtactgcgaaaactctgcattgaagcgaagatatctaacacgaccacggacagccgctgcccaacccagggggaggcaacactggtggaggagcaagacgccaatttcgtctgccgccgcacctttgttgacaggggatgggggaacggatgcgggctgttcggtaaggggtccctgatcacgtgcgccaaatttaagtgcgtgactaagctggaaggaaaaatcgttcaatacgagaacctgaagtacagcgttatcgttaccgtccacactggcgatcagcaccaggttgggaacgagtccacggaatacggcaccacagcgactatcacgccgcaggcccccagcacggagatccagctaactgactacggcgctctgacactggactgcagcccacgtactggccttgacttcaacgagatggtactgctgacaatgaaggagaagtcctggctcgtgcataaacagtggttcctagatcttcctcttccctggacctcaggggcatccaccagccaggagacgtggaaccgtcaggacctgctggtaacgttcaagaccgcccacgccaagaaacaggaggtcgtggtactcggctcacaggagggggccatgcacaccgccttgaccggtgccacggagatccaaactagcggcaccaccacgatcttcgccggacacctgaagtgtagactcaaaatggacaagctgaccttgaaaggcatgtcgtacgtcatgtgcaccgggagcttcaagctcgaaaaggaagtggcggagacccaacacggcaccgtgcttgtccaaattaagtacgagggcactgacgcaccctgcaagatcccctttagcacgcaggacgaaaagggggttacccagaacggccgtctgatcactgccaacccgatcgtgaccgacaaggagaagcccgtcaatatcgaggccgaaccgccattcggggagagctacatcgtaatcggcgcgggcgagaaggccctgaagctctcctggttcaagaaggggtcgagcatcggcaagatgttcgaagcgaccgcccgcggtgcgcggcgcatggcgatactgggggacacggcttgggatttcggtagtatcggcggtgtatttacctccgtcgggaagctcgtgcaccaaatcttcgggacggcctacggggtgctcttcagcggcgtctcctggaccatgaagattgggatcggcgtgctgctgacctggctcggcctgaactcccggtccacgtctctgtcaatgacctgcatcgccgtggggctcgtcaccctgtacttaggcgtgatggtgcaggccgactccgggtgcgtcattaactggaagggccgggagctcaagtgcgggagcggcatcttcgtgaccaacgaggtgcacacctggaccgagcagtacaagtttcaggcagattccccgaagaggcttagcgccgccatcggcaaggcctgggacgagggggtgtgtggtatacggtccgccacgcgcctagagaacatcatgtggaaacaaatctctaatgagttaaaccacatcctgctggagaatgacatgaagttcaccgtggtggtcggggacgtcgcaggtatcctcgcccaaggtaagaagatgattagaccccaaccgatggagtacaagtactcctggaagtcctggggcaaggccaagatcatcggcgccgacgtgcagaacacgacgtttatcatagatgggcccaatacccccgagtgccccgatgaccagcgcgcgtggaacatctgggaggtggaggactacggcttcgggatctttaccacaaacatttggctgaagctgcgggattcgtacacacaggtgtgcgaccatcggctaatgagcgcagccattaaagattccaaggccgtacatgccgacatgggttactggatcgagagcgagaagaacgagacctggaagctggcgcgagcatccttcatcgaggtcaaaacctgcatatggcccaagagtcataccctatggtctaatggcgtactcgagtcggaaatgatcatccccaagatttacggcggcccgatctcgcagcacaattaccggcccgggtatttcacgcagaccgccggcccgtggcatctggggaagctggagctagacttcaacttgtgcgaaggcacaaccgtggtcgtagacgaacactgtggcaaccggggtccgtcgttacgcacgaccactgtcaccgggaaaatcatccacgaatggtgctgtcgatcctgcactctgccaccactccgcttcaagggcgaagacggctgctggtacgggatggagatccgccctgtcaaggagaaggaggagaacctagtcaagagcatggtaagtgccggatcgggcgaggtcgactcattctccctcgggctgctttgtatcagcatcatgatagaggaggtgatgcggagtcggtggagcagaaagatgctaatgaccggcactctggccgtgtttttcctgctcatcatggggcagctgacctggaacgatctgatccgactctgtattatggtcggcgcgaatgcgtccgatcgcatggggatgggcaccacctacctggccctgatggccaccttcaagatgcgcccgatgttagcggtgggcctgctgttccggcggctcaccagccgggaggtgctactgctcacgattgggctgtccctggtggcctctgtcgagctccccaatagcctagaagagctgggggacggtcttgccatgggcatcatgatcttgaagcttctcaccgacttccagagccatcaactgtgggccacattgctctccctgacttttattaaaacgacctactccttacactacgcctggaagaccatggcaatggtattgtctatcgtgtcgcttttccccctgtgcctctccacaacgagccagaagactacctggctgccggtgttgctcggctccctcgggtgcaagccgctgacgatgttcttaatcgcagagaacaagatctggggacgcaagagctggcccctgaacgaggggattatggccgttggtatcgtgagcatcctgctttccagtttactgaagaacgacgtgcccctcgcggggcccctgatcgcagggggaatgctgattgcgtgctacgtcatctcaggaagttccgccgacctctcactggagaaggccgccgaagtgtcctgggaagaggaggccgaacattcgggcgcatcccacaacatcctcgtggaggtccaagacgatgggacgatgaaaattaaggatgaagagcgggacgacacgctcactatcctgttaaaggccaccttactggccgtgagcggagtctacccgttatcgatccctgccaccctctttgtctggtatttctggcagaaaaagaagcagagatcaggtgttctgtgggatacgccttcaccgcccgaggtggagcgggccgtcctggacgacggcatctacaggataatgcagcgtggcctactcggccgcagccaggtgggcgtgggggtatttcaggagaacgtgtttcacacaatgtggcacgtgacccgcggggccgtcctgatgtaccagggcaagcgcctggagccctcgtgggccagcgtgaagaaggatttaatctcctacggcggcgggtggagactgcagggcagctggaataccggggaggaggtgcaagtgatcgctgtggaacctggcaaaaaccccaagaacgtgcagacggcgcccggcacctttaagacctcagagggcgaagtcggcgccatcgcgttagacttcaagcccggcaccagcggcagccccattgtgaaccgcgaggggaagatcgtgggtctctacggaaatggggtcgtgacaacctcgggcacctacgtctcagccattgcccaggcgaaagcatcgcaggaggggcccctgccggaaatcgagaacgaggtctttcgcaagcgcaacctcaccatcatggacttgcaccccggctccgggaagacaaggcgctacctgcccgccattgtgcgggaggctatcaagcgcaaactgcggactctaatactggcaccgacccgtgtggtagcgtccgagatggcggaggctctaaagggcatgccaatccgctatcaaaccacggccgtcaagtcggagcacacagggaaggagatcgtggacctcatgtgccatgcgaccttcaccatgaggctcctgtctcccgtccgcgtgcccaactataacatgattatcatggatgaggcccatttcaccgacccgagctccatcgcggcacggggttacatttcgacccgcgtgggcatgggggaggccgccgccatcttcatgactgcgacgccgcccggatccgtcgaggcctttccccagagcaacgccgtgatccaggacgaggagcgtgatatcccggagcgcagctggaatagcgggtacgagtggatcaccgactttcctggaaagaccgtgtggttcgtcccatccatcaagtcgggcaacgacatcgcaaactgcctcaggaagaatgggaagagagttattcagctctccaggaaaaccttcgacaccgagtaccagaagacgaaaaacaacgattgggactatgtggtcaccacagacatatctgagatgggcgccaacttccgcgccgaccgcgtgatcgaccccagacgatgcctgaaaccggtgatcctcaaggacgggcccgagcgagtcatcctggccggccccatgcccgtgaccgtcgcctccgcggcgcagagacgaggccggatcggtagaaaccataacaaagagggtgaccagtacatctacatgggccagcccttaaacaacgacgaggaccacgcccactggactgaggctaagatgttgctggataacatcaacaccccagagggcattatccccgctctgtttgagcccgagcgggaaaaatccgcagctatagacggagagtaccgtctgagaggcgaggcccggaagaccttcgtggagttgatgcgccgcggggatttgccggtgtggctaagctacaaggtcgcctcggagggttttcaatacagcgaccgccggtggtgcttcgatggcgagcgcaacaaccaagtgctggaggagaacatggacgtggagatctggactaaggaaggagagcgaaagaaactgcgcccccggtggctagacgcccgaacgtactcagacccgctggcgttacgggagttcaaggaattcgcggctggccggaagagcgtctccggggacctcatcctggaaatcggaaagctgccccagcacctcacccagcgggcccagaacgccctggacaaccttgtgatgctccacaactcagaacagggcgggagggcgtaccggcacgccatggaagagcttccggacaccatcgagaccctaatgctcctggccctgatcgccgtattgacgggcggtgtcaccctgttcttcctatccggccgcggtctcggcaagacaagcataggccttctgtgtgttatggcctcctctgtgctcctatggatggcgtccgtcgagccccactggatcgccgcctccatcatcctggagttcttcctcatggtgcttctcatcccggagcccgaccggcagcgcaccccgcaggataatcagctcgcctatgtcgtcatcggtttgttgttcatgatactcaccgtggccgccaacgagatgggcctgctggagactactaagaaggatcttgggataggccacgttgccgtcgaaaaccaccatcatgctgcaatgctagacgtggaccttcaccccgcctccgcctggaccctctatgccgtggccaccacgatcatcacccctatgatgcggcacacgattgagaacactactgcgaacatcagcctaactgcgattgcgaatcaggccgccatcctgatgggtttggacaagggctggccgatttccaagatggatatcggcgtccccctcctggctctcgggtgttacagccaggtgaatccgttaacattgaccgctgcagtgttaatgcttgtcgcgcactacgccataattggccctgggctccaggccaaggcgacccgcgaggcccagaagcggactgccgccggcatcatgaagaatccgactgtcgacgggatagtcgctatcgacctcgatccagtcgtgtacgatgcaaagttcgaaaaacagctgggccaaatcatgctgctcatcttgtgcacgagccaaatcctgctcatgcgcactacatgggccctctgcgagagcattactctggccaccggccccctcacgacactgtgggagggcagtcccggcaagttctggaacaccaccatcgccgttagcatggcaaacattttccggggaagctacttggcgggcgccggtttagccttctccctgatgaagtcacttgggggagggcgccgtggcacgggggcccaaggcgaaaccttgggcgagaaatggaagcgacagctgaaccaattaagtaagtctgaattcaacacctacaagcgaagtgggattatggaggtagatagaagcgaagctaaggagggcctcaagcggggggaaaccacgaagcacgccgtgtcacggggcacggccaagttgcgttggttcgtcgagcggaatctggtcaagccggaggggaaggtgatcgatttgggctgcggacgaggaggctggtcctactactgcgccgggctcaaaaaggtgaccgaggtaaagggctacaccaagggcgggccgggccacgaggagcccatccccatggctacgtacgggtggaacttagtgaaactccacagtggcaaggacgtgttcttcatcccgcccgaaaagtgcgacactcttctgtgcgacattggggagagctccccaaaccccacaatcgaagagggccggacccttcgcgtcctcaagatggttgaaccctggcttcgtgggaaccagttctgcatcaaaatactgaatccctacatgcccagcgtagtcgagacgctcgagcaaatgcagcgcaagcacggcgggatgcttgtgcggaacccactgtcacgaaacagcactcacgagatgtactgggtgtcctgtgggaccggcaacatcgtcagtgcggtgaatatgacctccagaatgctcctgaacagattcaccatggcccaccggaagccgacgtacgaacgcgacgtcgacctcggggccggcacccgccacgtcgccgttgagcccgaagtcgcgaaccttgacatcatcggtcagcggattgagaacatcaaacacgagcacaagtctacctggcactatgacgaagacaacccatacaaaacctgggcgtaccacgggtcatacgaggtaaagccttcagggagcgcctcgagcatggtgaacggcgtcgttaagttactgacgaagccgtgggacgttatcccaatggtcacacaaatcgccatgaccgacaccactcccttcggccagcagcgtgtgttcaaggagaaggtggacacccggacccctaaagcaaagagggggactgcccagatcatggaagtcactgctaagtggctctggggattcctttcccgaaacaagaagccgcgcatctgcacaagggaggaatttaccagaaaagtcagaagcaacgctgcaatcggcgccgtgttcgtcgacgaaaaccagtggaattccgcgaaggaggccgttgaggacgagagattctgggacctggtgcaccgggagcgcgagctccataagcaggggaaatgcgcgacctgtgtctacaatatgatggggaagcgtgagaagaagctgggggagtttggcaaggctaaaggcagccgcgctatctggtacatgtggctgggagcgcggttcttagagttcgaagccttgggcttcatgaacgaggaccactggttttcacgcgagaacagcctgtccggggtggagggcgaggggttgcataagctcggctacatcctgcgggatatcagcaagatccccgggggcaacatgtacgcggacgacacggcgggctgggatacccgcataacagaggacgacttgcagaacgaggcaaagatcacggacatcatggagccagagcacgcgttgctagccaagtccatcttcaagttgacgtatcagaacaaggtcgtccgggttcagcgccctgcgaagaacgggacagtgatggatgtcatcagccggagagaccagcgaggctcgggccaagttgggacttacggccttaatacctttacgaatatggaagcccagctgattcgtcagatggagagcgaaggcatattttcccctagtgaactcgagacccccaacctggcaggtagagtgctggactggctcgaaaaacacggcgtcgaaagactaaagcgcatggcaatatccggggacgactgtgtagtgaagcccatcgacgatcgattcgccaccgccctgaccgctctcaacgacatgggaaaggttcgcaaggacattccccagtgggagccctcaaagggctggaacgactggcagcaggtcccgttttgcagccaccatttccaccaactgatcatgaaagacggccgggagatcgtagtcccctgccgcaatcaggacgaactggtgggtcgggcccgcgtttctcaaggcgcggggtggtctctccgcgaaacagcatgcttaggcaagtcgtacgcacaaatgtggcaattaatgtacttccacagaagggatcttagactggccgcgaacgccatctgtagtgccgtccccgtagattgggtgcccacgtccaggaccacttggagcattcacgcccaccatcagtggatgaccaccgaagacatgctgtctgtctggaaccgcgtgtggatcgaagaaaatccctggatggaggataagacgcacattagctcctggggggacgtgccatacctcggaaagcgagaggaccagtggtgcggcagcctgatcgggctgaccgcccgagcgacgtgggccacaaacatccaggtcgccatcaaccaagttcggcgcctaataggcaatgagaactacctggactacatgacttccatgaagcgcttcaagaatgaaagcgaccccgaaggggcactgtggtga

SEQ ID NO: 24126 - RNA, 9879 nt, synthetic construct
  misc_feature 1..9879: note = derived and/or modified CDS sequence (opt11) from DENV-1__FJ024472__SS-prME
  source 1..9879: mol_type = other RNA
tcggtgaccatgttgcttatgttaatgcccacagcccttgccttccacctcaccacccggggcggggaacctcacatgatcgtgtcgaaacaggagcggggcaagagtctgttgttcaagacatccgccggggttaacatgtgcactctcatcgccatggacttgggcgaactctgcgaggacaccatgacctacaagtgcccccggatcaccgaaacagagccggacgacgtagattgctggtgcaacgccacggacacctgggtgacctacgggacgtgcagccagaccggcgaacaccggcgagacaagcgctcagtggctcttgcgccccacgttggcctgggcctcgagacccgcaccgaaacgtggatgagctcagaaggcgcctggaagcaaatccagcgagtggagacgtgggcccttcggcaccccgggttcaccgttatcgccctattcctagcccacgcgatcgggacaagcatcacccagaagggtatcattttcattctcctaatgctggtgacgccgtccatggccatgcggtgtgttgggatcggctcgcgcgacttcgtggaggggctctccggcgccacctgggtcgatgtggtgctggagcacgggagctgcgttaccaccatggccaaggacaaacccacgttggatatcgagctcctgaagaccgaggtcaccaacccagccgtgctgcggaagttgtgcatcgaagcaaagatctccaacaccacgaccgactcacgctgcccgacccagggcgaggccaccctggttgaggaacaagatgccaacttcgtttgccggcgcacattcgttgatcggggctgggggaacggttgtgggttgttcggcaaggggtccctgataacctgcgccaaatttaagtgtgtgaccaagctggagggcaagattgtccagtacgagaacctgaagtacagcgtgatcgtgactgtccacacgggtgaccagcaccaggtcgggaacgagtcgactgagcacgggactactgccaccatcacgccccaggcgcccacgaccgagatccaattgacagactacggagccctaacgttggactgcagcccccgcaccgggctcgattttaacgaaatggtcttgttaactatgaaggagaagtcctggctggtgcacaagcaatggttcctggaccttcccctcccctggaccagcggtgcatcaacttcccaggaaacgtggaacagacaggatctgttagtgaccttcaagaccgcgcatgcgaagaaacaggaagtagtggtgctaggcagccaggagggcgctatgcacacagccttaacaggagctaccgagatccagacatccgggaccactaccatcttcgccgggcatctgaagtgtagactcaagatggacaaactgaccctaaagggcatgtcttacgtcatgtgcactggttcattcaaactcgagaaagagcttgcggaaacccaacacggcaccgttctggtgcagatcaagtacgagggcaccgacgcgccctgtaagatccctttttcgacacaggatgagaagggggtcacgcaaaacggcagactgataaccgccaatccgatcgtgaccgacaaagagaagcccgtgaacatcgaggcagagccaccctttggggagtcctacatagtcatcggcgccggcgagaaagcgctcaagctaagctggttcaaaaagggcagtagcatcggtaagatgtttgaggcaacggcccgcggggccagaaggatggccatattaggcgacaccgcgtgggacttcgggtccataggtggggtgttcacctctgtgggaaagctcgtccatcagatcttcggcaccgcctacggagtactgttctccggagtaagctggacgatgaagatcggaatcggcgtactgctcacgtggctaggactgaactcccgttcgacctccctcagcatgacctgcatcgccgtgggactcgttacgctgtacctcggtgtcatggttcaggcggacagtgggtgcgtgattaattggaaaggcagggaactgaagtgtggtagcggaatcttcgtgacgaacgaagtgcacacttggacggaacagtataagttccaagccgacagcccaaagcggctatccgcggccgtcggcaaagcctgggaggaaggcgtctgtggcatccggagcgccactcgactcgaaaacatcatgtggaagcaaatttccaacgagctgaaccacatcctgctggagaacgacatgaagttcacggtggtagtaggcgatgtggccggcatactggcgcaggggaaaaagatgatccgaccccagcccatggagtataaatactcatggaagtcctggggcaaggctaagataatcggcgccgacgtgcagaacaccacctttatcatcgacgggcccaacacgccggagtgccccgacgaccaacgcgcctggaacatctgggaggttgaggactacggcttcgggatctttactaccaacatctggcttaagttacgggactcttacacccaagtgtgcgaccatcgcttaatgtccgcggctatcaaagacagcaaggcagtccacgccgacatgggctactggattgagtccgagaagaatgaaacctggaagctggctcgggcgagctttatagaagtcaagacttgcatttggcccaagtctcacaccctctggagcaacggcgtgctggagtccgagatgataattcctaaaatctacgggggaccgattagccagcacaactaccgccctgggtactttacccaaactgccggcccctggcacctggggaagctcgaactggacttcgacctgtgtgaggggacaaccgtggtggtggacgagcactgcggcaaccgcgggccgtccctccgcactacaacggttaccgggaagataatccacgagtggtgctgtcggagctgcaccctgccgccgctgcgcttccgcggggaggatggctgctggtacggaatggagatccgacctgtcaaggagaaggaggagaacctcgtcaagtccatggtgagcgccggctcgggggaggtcgactccttcagcctagggctgctctgtatctcaatcatgatcgaggaggtgatgagaagccgctggtcccggaagatgcttatgaccggcacgctggccgtgatcttcctcctcatcatgggccagctgacctggaacgacctcatcaggctgtgcatcatggtcggcgccaacgcatccgatcgcatggggatgggcactacctacctagccctcatggctacgtttaagatgcggcctatgttcgctgtgggcctgctgttccgccgcctcacctcccgcgaagtgctgctgttgaccatagggctgagcctggtcgcctccgtggaattacccaactcgctagaagaacttggagatgggctggcaatgggcatcatgatcctgaagctgctcactgacttccagtcccaccaactgtgggccacgcttcttagcctgaccttcatcaagaccactttctccttacattacgcctggaagacgatggccatggtactcagcattgtttcactattccccctgtgcctcagcaccacctcccagaagaccacgtggctgcccgtgttactcggcagccttgggtgcaagccgctaacgatgttcctcatcgcggagaacaagatctggggccggcgctcctggcccctgaacgaaggcattatggcggtcgggatcgtgagcattctgttaagctccttactgaagaatgacgtgccgctcgccgggcccctgatcgccgggggcatgctgatcgcgtgttacgtcatctcagggtcctcggcagatctctccctggagaaggccgccgaagtgagctgggaggaggaggcagagcactctggcgccagccataacatcctcgttgaggtccaagacgacggaaccatgaagatcaaggacgaagaacgggacgataccctcacaatcctcctgaaggctacgttgctggccgtgtccggcgtgtatcctttaagcattcctgccacccttttcgtttggtacttctggcagaagaagaagcagcgctccggggtgctgtgggacacccctagcccgcccgaagtggagcgggccgtcctggacgacggcatctaccgaatcatgcaacggggcctgctcgggcgctcacaagtaggcgtgggggtctttcaggagaacgtgttccacaccatgtggcacgtgacgaggggcgccgtcctgatgtatcaggggaagcggctggagccctcctgggcgtcggtgaagaaggacctcatcagctacggaggcggttggagattacaggggtcctggaacaccggagaggaggttcaggtcatcgccgtggagcccggcaagaaccccaagaacgtgcagacggcccccgggaccttcaagacgcccgagggggaggtcggcgcgatcgccctggatttcaagcccgggaccagcggctcaccaattgtgaaccgcgaggggaagatcgtcggtctgtatggcaacggcgttgtaactaccagcggcacgtatgtgagtgcgatcgctcaggcaaaggccagccaagaaggaccgctgcccgagatcgaggatgaggtgtttcgcaagcgaaacctgaccatcatggatctacaccccggaagcggcaagacccgacggtacctgccggccatcgtccgggaggccatcaaacgtaaactacgcacgctcatactggcccccacgcgggtggtggcttcagagatggctgaggcactgaaaggtatgcccatacgctaccaaaccacggccgtcaaaagcgagcacaccggcaaggagatcgtggatctcatgtgtcacgcgaccttcaccatgcggctgctgtcccccgtccgggtcccgaattacaacatgatcatcatggacgaggctcacttcaccgacccaagctccatcgccgcacgggggtacatcagcacgagagttgggatgggtgaggctgcagccatcttcatgacggccaccccgcccggctccgtagaggcgttcccacagagcaacgccgtgatccaggacgaggagcgagacatccccgagcgttcctggaatagcgggtacgagtggatcaccgatttccccggcaagacggtgtggtttgtccccagcatcaagtccggtaacgacatcgcaaactgccttcggaagaatgggaagcgcgtgatacagctgtccagaaagacgttcgacactgagtaccaaaagaccaagaataacgactgggactacgtagtcaccaccgacatcagcgagatgggcgccaatttccgcgcggacagggtaattgaccctcgccggtgcttgaagcctgtgatcctcaaggacggacccgagcgtgtcattttagccggccctatgccggtgaccgtggcctccgcggcccaacggcgcgggcggatcggccgcaatcacaataaggagggtgaccaatatatctacatggggcagcccctgaacaacgacgaggaccacgctcactggaccgaggccaaaatgttgctcgacaacatcaacacccccgaaggcatcatcccagccctgtttgagcccgagcgcgagaaatcagccgccattgatggcgagtaccggcttcgcggcgaggcgcggaagacattcgtggagcttatgcgcagaggggacctgcccgtgtggctctcctataaggtcgccagcgagggcttccaatacagcgatcggcggtggtgcttcgacggcgagcgtaacaaccaggtgctggaggagaacatggacgtggaaatctggactaaggagggtgagcggaagaagctgaggccgcggtggctcgacgcccgcacgtactccgaccccctggccctgcgggagttcaaagagttcgccgcgggcaggcggagcgtatccggcgacctcatccttgagatcgggaagttgccccagcacctcactcagcgcgcccagaacgccctagacaacctggtaatgctccacaacagcgaacaaggcgggcgggcctaccgccacgcaatggaggagctgcccgacaccatcgagactctgatgctcctggccctaatcgccgtcctaaccggtggagtgaccctgttctttctatcgggtcgggggttaggcaaaacctcgatcggtctgctttgcgtgatggcgagtagtgtgctcctttggatggcttcagtcgagccgcactggatcgccgccagcatcatccttgagttcttcctcatggttctgctgatccccgagccggacagacagcgaacaccgcaggacaatcaactcgcatacgtggtcatcggcctgctgttcatgatcctcaccgttgccgctaacgagatgggcctgctggagaccacaaagaaagatctcgggatcggccacgttgcagtcgagaaccaccatcacgccgcaatgctggacgtggacttgcatcccgcatccgcctggacgctctacgcggtggccaccaccatcattacccctatgatgcgccacacaatcgaaaacactactgccaacataagccttaccgcgatcgccaaccaggcggccatcctgatggggctcgacaaaggctggccgatctccaagatggacatcggcgttcccctgcttgcgttggggtgctacagccaggtgaatcctctaactctgaccgccgcagtcttaatgctggtagctcactacgcgatcatcggcccggggctgcaggccaaggcaacgcgcgaagcccagaaacggaccgccgccggaatcatgaagaatcccactgtagacgggatcgtggccatagacttggatcccgttgtatatgacgctaagttcgaaaagcaactgggccagattatgctgctcatcctgtgtaccagccaaatcttgctgatgcgcacgacatgggcactgtgcgaaagtatcacgctagccaccggcccgctcaccaccctgtgggagggttccccgggcaagttttggaacacgaccatcgccgtatcgatggcaaacatcttccggggctcctacctggccggagcaggcctcgccttcagcctgatgaaatctctcgggggcggacgacggggaaccggggcgcagggcgaaacgctcggcgagaagtggaaaagacagctgaaccaactgtccaagtctgagttcaatacttacaaacggtccgggatcatggaggttgatcgcagcgaggccaaggagggtctcaagcgtggagaaaccaccaagcatgcggtgagccgcggcacggccaagctgcgttggttcgtggagcggaatttggtaaagcccgaggggaaggtcatcgacttaggctgcgggcgcgggggctggagctattactgcgccggactcaagaaggtgacggaggtcaagggttacactaagggcggacccggacacgaggagcccattcctatggccacctatggctggaacctggtaaaactgcattccggcaaagacgtcttcttcattccacccgagaagtgcgataccttgctgtgcgacataggggagagctcccccaatccaacgatcgaggagggccgcacgctgcgggtcctcaagatggtggagccctggcttagagggaaccaattctgcatcaagatcctgaacccctacatgcctagcgtggtcgaaaccctcgaacagatgcagcggaagcacggcggcatgctggtccgcaacccgctgtcccggaacagcacacacgaaatgtactgggtgagttgcgggaccggcaatattgtaagcgccgtgaacatgacgtcccgcatgctcctaaaccgtttcaccatggcccacaggaaacccacgtacgagcgcgatgtggacctgggagcaggcacccggcacgtcgccgtggagcccgaggtggcaaatctcgatatcatcggacaacgcatcgagaatatcaaacacgagcacaagagcacgtggcactatgatgaggataacccttacaagacatgggcttatcacggatcctacgaggtgaagccatcaggctccgccagcagcatggtgaacggtgtcgtaaagctgctaaccaagccctgggatgtgatccccatggtcacccagattgccatgaccgataccaccccctttggccagcagagggtgtttaaagagaaggtggacacccgcacccctaaagcaaagcggggtaccgcccagattatggaggtcaccgccaagtggctctggggcttcctcagccgcaacaagaagccgagaatctgcacgcgcgaagagtttacgcggaaggttcgaagtaatgccgcaattggcgccgtattcgtcgacgagaaccaatggaactctgcgaaagaggccgtggaggacgagcggttttgggacctggtgcatcgggagcgagagctacacaagcaagggaaatgtgcgacctgtgtttataacatgatgggcaagagggagaagaagctgggtgagttcggaaaagcgaaggggagcagggctatctggtatatgtggctcggtgcccgcttccttgagttcgaagcgcttggtttcatgaacgaggaccactggttcagtcgggagaatagcctgtccggggtggagggcgagggcctccataagctgggctacattctgcgcgacatctctaagattcccgggggcaacatgtacgccgacgatacggcgggctgggatacccggataacggaggacgacctccaaaacgaagcccggatcaccgatatcatggaacccgagcatgcgctgctggcgaagtccatcttcaagctgacctaccaaaacaaggtggttcgtgtgcagcggccggccaagaacgggaccgtaatggacgtaatcagccgacgggaccagcgcggctccggtcaggtgggcacgtacggcctgaatactttcaccaatatggaggcccaactgatccggcagatggaatccgagggcatcttttcgcccagtgagctcgagacccccaacctggcggagcgcgtgctggactggctcgagaagtatggcgtcgagaggctgaagcgcatggccatctccggggacgattgcgtggtgaagcctatcgacgatcggtttgcgaccgccttgaccgccctcaatgacatgggcaaagttcgcaaagatatccctcaatgggagcccagcaaggggtggaatgactggcaacaggtccccttttgctcccatcacttccaccagctgatcatgaaggatgggcgtgagatagtggtcccttgccgaaaccaggatgaactcgtgggcagggcccgcgtgtctcaaggggccggttggagcctccgagaaaccgcgtgcttgggaaagtcttacgctcagatgtggcagctgatgtacttccaccgccgggaccttcgcttggccgccaacgccatctgcagcgcagtccccgtggattggatccccacctccaggacaacctggtcaatacatgcccaccaccagtggatgaccaccgaggacatgttgtcagtgtggaaccgtgtctggatcgaggagaacccctggatggaagacaaaacgcacatcagctcctggggagacgtcccgtatttagggaagcgggaggaccagtggtgcgggagcttgatcggactgacagcgcgggccacctgggcgaccaacatccaagtagcaataaaccaggttcgcaggctcatcggaaacgagaattatctggactacatgacaagcatgaagcgtttcaaaaacgaaagcgaccccgagggagccttatggtga

SEQ ID NO: 24127 - RNA, 9879 nt, synthetic construct
  misc_feature 1..9879: note = derived and/or modified CDS sequence (opt11) from DENV-1__FJ024439__SS-prME
  source 1..9879: mol_type = other RNA
agcgtgaccatgctgttaatgctgatgcccaccgctttggcgtttcacttaacaacccggggcggggagccccacatgatcgtgtccaagcaggaaagagggaagtcactactgttcaagacttctgcaggcgtgaacatgtgcaccctaatagccatggacctgggcgagctctgcgaagacaccatgacctacaagtgtccccggatcaccgagaccgagccagacgacgtggactgttggtgcaacgctacagatacctgggtcacctatggtacctgctcccaaacgggtgagcatcggcgcgacaagcggtccgttgccctcgcgccacacgtgggcctagggctggagacacgcaccgaaacatggatgtcgtccgagggggcctggaagcagattcagcgggtcgagacgtgggccctcagacatcccggcttcactgtgatcgcgctattcctggcccacgcgattggcacgagcatcacccaaaaggggattatcttcattctcctgatgctcgttacaccctccatggctatgcggtgcgttggcatcggcagtcgcgactttgtagaggggttgtccggcgccacctgggtggacgtcgttctggagcatgggagctgcgtgactaccatggccaaggacaagcccacgctggacattgaactccttaagaccgaagtcaccaaccctgccgttcttcgtaagctctgcatagaagcgaagatcagtaacacaacgactgattcacgctgcccgacccagggcgaggcaacgctggtggaggagcaggatgccaacttcgtctgccggcgcacgtttgtggaccgggggtggggcaacggttgcggcctgtttggcaaggggtccctaatcacgtgcgccaagttcaagtgtgtcacaaaactggagggaaagatagtccaatacgaaaaccttaagtactctgtgatcgttactgtccacacgggtgaccagcaccaggtaggtaatgagtcaaccgagcacggcaccaccgcgaccatcaccccgcaggcccctaccactgagatccaactcaccgactacggggccctgacgcttgactgtagcccacgtaccggactcgatttcaacgagatggttctgctgaccatgaaagagaagtcctggctcgtacacaagcagtggttcctcgatctgcctctcccatggaccagcggggccagcacgtcgcaagagacctggaatcggcaggatctgctagtgacttttaagaccgcccacgctaaaaagcaagaggttgtggtactcggcagtcaggagggcgcgatgcacacggcactgacgggggccacagagatacagacctcgggcacgacgaccatctttgccgggcatctgaagtgtcgcctgaaaatggacaagttaacgttaaagggcatgtcatacgtcatgtgcacgggctcgttcaagctagagaaggaggtggcggaaactcagcacggtaccgtgctagtacaaattaaatatgaggggaccgacgcgccctgcaagatcccctttagcacacaagatgagaagggagttacgcagaacggccggctgatcaccgccaacccaatcgtgacggacaaggagaaaccagtcaacatcgaggccgaaccgcccttcggagaatcctacataataataggtgccggcgagaaggcgctaaagttgtcatggttcaagaagggttcctctatcggaaagatgtttgaggccacggcccgtggggcccggcgcatggccatccttggcgataccgcgtgggacttcgggtccatcggaggagtgttcacaagcgtggggaagctggtccaccagatcttcggcacagcttacggggtcctgttctccggtgtgtcctggacgatgaagatagggatcggagttctattaacctggctcggcctgaactcgcgcagcaccagtttcagcatgacctgcatcgccgtgggactggtcactttatacctaggagtcatggtgcaggccgactccggatgcgtgataaattggaagggacgggagttaaagtgcgggagcggcatcttcgtaaccaacgaagtgcacacctggaccgagcagtacaagttccaggccgattcacctaagcggctctccgccgccatcggcaaggcttgggaggaaggggtgtgcggcatccggagcgcaacccgcttagagaacatcatgtggaagcagatctcaaacgagctgaaccacatcctcttggaaaacgacatgaagttcaccgtggttgtgggggacgtcgccggcatcctggcgcaggggaagaagatgatcaggccgcaacccatggagtacaagtactcgtggaaatcctgggggaaagcaaagatcatcggagcagacgtccagaacaccaccttcatcatcgacgggcccaataccccggaatgccccgacgaccaacgggcctggaacatctgggaggtggaggactacggcttcggtatttttacgaccaacatctggctcaagttgcgtgacagctacacgcaggtctgcgatcaccgcctgatgtccgcggccatcaaggacagtaaggccgtccatgccgacatgggatactggattgagtctgagaagaacgagacctggaaactcgcccgggcgagcttcatcgaggtgaaaacgtgcatctggccgaagtcccacaccctgtggagcaacggcgtcctggaatcagagatgatcatacccaagatctatgggggcccgatctcacagcataattaccgcccggggtacttcacacaaacggccggcccctggcatctcgggaagctggagctggatttcgacctgtgcgagggcacaactgtggtggtcgatgagcactgcggcaaccgggggccgtccctgagaaccaccactgtgaccggaaagatcatacacgagtggtgctgccgaagctgcaccctgccgcctctgcgtttccgcggggaagacgggtgttggtatggaatggagatccggcccgtgaaggaaaaggaggagaacctggtaaagtccatggtgagcgccggctcaggcgaggtggactctttcagcttagggctcctgtgcatctccatcatgatcgaggaagtaatgcggtcacgctggtcccggaaaatgctgatgacgggcacactcgccgtgtttttcctgttgatcatgggacagctaacctggaacgatctgatccgcctgtgcatcatggtcggcgccaacgcgagcgaccgcatgggaatgggcaccacttacctcgccttgatggcgacgttcaagatgcgtccgatgttcgccgtcgggctcttattcagacggctaacttcccgtgaagtgctgcttctgacgataggactatctctcgtagccagtgtcgagctgccgaatagcttagaagagttaggcgacgggctggcgatgggcatcatgattctgaagctcctgaccgactttcagagtcaccagctgtgggctacgctcctgagcctgaccttcatcaagaccaccttctccctccactacgcatggaaaaccatggcaatggtgctgagcatcgtcagtctgtttcctctctgcctgagcaccacctcacagaagaccacatggcttcccgtgctgctgggctcactggggtgcaagccgctcaccatgttcttaatcgcggaaaacaagatctggggtagaaggtcgtggcccctgaacgaggggatcatggccgtcggcatagtctcgatcctcctgagtagcctgctgaagaacgacgtgcccctggccggcccgttaattgccggcggtatgctgatcgcctgctacgtcatcagcggatccagcgcggacttatcccttgaaaaagccgctgaggtgagctgggaagaagaggccgagcactccggcgccagccataacatcctcgtcgaggtacaggacgatgggaccatgaagatcaaggacgaggagcgggacgatactctgaccatcctgctaaaggcgacgttgctggccgtctccggcgtttacccgttatctatccctgcaaccctgttcgtgtggtatttttggcagaagaagaaacagagatccggggttctgtgggacacccccagcccacccgaagtggggcgggctgtgctcgatgacggtatctatcgcataatgcagagagggctgctcggcaggagtcaggtcggtgtgggcgtgttccaggagaacgtatttcacaccatgtggcatgtgacgcgcggcgccgtgctgatgtaccaggggaagcgcttggaacccagctgggcttccgtcaaaaaggacctgataagctatggcggagggtggcggctacaaggctcctggaataccggagaggaggtccaagtaatcgccgtcgaaccggggaagaatcccaagaacgtgcagaccgcccctggtaccttcaagacgcccgagggggaggtgggggccatcgccctcgacttcaaacccggcacctctggaagtcccattgtcaaccgtgaaggcaaaatcgtgggattgtatgggaacggcgtggtaactacaagtgggacgtacgtttcagcgattgctcaagcgaaggcctcccaggagggcccgctgcccgagatcgaggatgaggtgttcaggaagcgcaacctcaccatcatggatctgcaccccggaagcggcaaaacccggcggtacctgcccgcgatcgtccgggaagctatcaagcgcaaactccggacactgattctagccccaacaagagtggtggcctccgagatggcagaggcgctcaagggcatgcccatccggtaccagacaacagcggtcaagagcgagcacaccggaaaagagatcgtggacctaatgtgtcatgccacattcaccatgcggctcctctccccggtgcgcgtaccgaactacaacatgatcatcatggacgaggcccactttaccgaccccagctccatcgcagcgcgaggatacatcagcaccagagtgggaatgggagaggctgcagccatcttcatgacggccacaccacctggatccgtggaagcattcccgcagagcaacgccgtcatccaggacgaggaacgcgacatccccgagcgctcgtggaacagcggctatgagtggatcacggacttccccggcaagaccgtctggttcgtgcccagcatcaagagcgggaacgacatagctaactgtctccgcaaaaacggcaagagggttatccagttaagccggaagactttcgacaccgagtaccagaagaccaagaacaacgactgggactacgtggtgaccacggacatctcggagatgggggcaaacttccgcgcggatcgggtcatcgacccacgcagatgtctgaagcctgtgatcctgaaagacggccccgaacgggtgatcctcgccgggcctatgccggtaacagtggcttccgcagcccaaagacggggccggatcggacgtaatcataacaaagagggagaccaatatatctacatgggccagcccctcaacaacgacgaagaccatgcccattggaccgaggccaagatgctgctggacaacatcaacacccccgaagggatcatcccagccctcttcgaaccggaacgggagaagtccgccgcgatcgacggcgaatatcggctgcgcggcgaagcgcgtaagacgttcgtagaactgatgcgccggggcgatctccccgtgtggctgtcctacaaggtggctagtgagggctttcaatacagcgaccgccggtggtgcttcgacggggaacgcaacaaccaggtactggaggaaaatatggatgtggaaatatggaccaaagagggcgagagaaagaagctccgcccacgatggctggacgccaggacctactccgaccccttagccttgcgggagttcaaggagtttgccgcgggtcgccggagtgtctccggcgacctgatcctggagatcggcaagctcccgcagcacttaacccagcgcgcccagaacgcccttgacaatctcgtcatgctgcataacagtgaacagggcgggcgcgcttacaggcaagcgatggaggagctaccggacaccatcgaaaccctcatgctcttggctctcatcgccgttctgacagggggcgtcactctgttctttctctcgggccggggtctcgggaaaaccagcatcgggcttctctgcgtgatggcttcctccgtgcttttgtggatggccagcgtagagccgcactggatcgccgcaagtatcatccttgagttctttctgatggtcctgctaatacccgaacctgacagacagcgtacaccccaagacaaccagctggcttatgtggtaattggcctcctgttcatgatactgaccgttgccgctaacgagatggggcttctcgagaccaccaagaaagatctaggcatcgggcatgtagcggtcgaaaaccatcaccacgccgcgatgctggatgtcgacctccaccccgcctccgcatggaccctgtacgcggtggctaccaccataatcactccgatgatgcgccacacgatcgagaacaccacggccaacatcagcctgacagcgatagcgaaccaggcggcgatcctcatgggtctggacaaggggtggccgatctccaaaatggacatcggggtaccacttctcgccttaggttgctacagccaggtgaaccccctgacactcaccgctgcggttcttatgctggtcgcacactacgccatcatcgggccgggactccaggccaaggcgaccagggaggcgcagaaacggaccgctgccgggatcatgaagaaccccacggtcgacggcatcgtggccatagacctcgacccggtggtttatgacgccaaattcgagaagcagctgggccagatcatgctccttatcctctgcacctctcagattctcctgatgcgcacaacctgggccttatgcgagagcataacgctcgccaccgggccattaaccacgctttgggagggttcaccggggaaattttggaacactaccatagccgtgtcgatggccaacatattccgcggttcctacctcgccggcgctgggttggccttctcactgatgaagtccctcgggggcggacgccgaggtacaggcgcccagggcgagaccctcggggagaagtggaagcggcaattgaaccagttgtccaagtcggagttcaacacgtacaagcggagtggtatcatggaagtggacaggagtgaggccaaagaaggactaaagcggggcgagacaacgaaacacgcggtcagccgcggaaccgcgaaacttcggtggttcgtcgagcgcaacctcgtgaagccagagggcaaggtcatcgacttgggatgtgggagaggagggtggagctactactgcgccggcctgaagaaggtcaccgaagtgaaggggtatactaagggtggcccaggccatgaggagccgatcccgatggctacctacggctggaaccttgtcaaacttcactccgggaaggacgtgttcttcatacccccggagaaatgcgacactctgttatgtgacatcggcgaaagctcacccaaccctacgatcgaagaggggcgaacactcagggtgttgaaaatggtggagccttggctgcgcggcaatcaattctgcattaagatcctaaatccctacatgccctccgttgtggaaaccttagagcaaatgcagcgcaagcacggcggaatgctggtcagaaacccgctctcccgcaatagcacccacgagatgtactgggtatcctgtggcacagggaacatcgtgagcgccgtcaacatgacctctcgcatgctgctgaaccggtttacaatggctcatcggaagcccacctacgaacgcgacgtcgacctgggggccgggactcggcatgtggccgtcgagcccgaagtggcaaacctcgacatcattgggcagcggatcgaaaacatcaagcacgagcataaatctacgtggcactatgatgaagacaacccctacaaaacttgggcctaccacggctcgtacgaggtgaaaccgagcggcagtgcgagcagcatggtaaacggtgtagtcaaacttctaacgaagccctgggatgtaatacccatggtgacccagatcgccatgacggacaccaccccatttggacagcagcgggtcttcaaggagaaggtggacacccgcacgccaaaagctaagcggggcaccgcccagatcatggaggtaaccgcgaaatggctttggggcttcctgagccgaaataagaagcctcgaatctgcacccgcgaagagttcacgcggaaggtccgtagcaacgcagccattggggccgtgttcgtggatgagaaccagtggaacagcgccaaggaggcggtcgaggacgagcggttttgggatctcgtgcaccgggaaagagagctgcacaagcaagggaagtgcgcgacctgcgtgtacaatatgatggggaaacgcgagaagaaacttggagagttcgggaaagcgaaaggcagccgggccatatggtacatgtggctcggggcccgcttcctggagtttgaggccctcgggttcatgaacgaggaccactggttcagtcgggagaacagcctctccggcgtggagggggagggtctgcacaaactgggatacatcctccgcgacatctccaatatccccggaggcaacatgtacgctgatgacacagccgggtgggatacccgcatcacagaagacgacctgcagaacgaggccaggataaccgatatcatggagcctgaacacgcccttctagccaaaagtatcttcaaacttacttaccagaataaggtggtgcgcgtccagcggcctgccaagaacgggaccgtgatggacgtcatcagccgccgcgaccaacgcgggagcggacaggtgggtacatacgggctaaataccttcactaacatggaggctcaactcatccggcaaatggaaagtgagggcatattctcccccagcgagctggagacccccaacctggcagaacgcgtgctcgactggttagagaaatacggggtggagcggttaaaacgcatggcaatcagcggcgacgactgcgtcgtgaaaccgatcgacgatcggttcgcgacggccctcaccgcgctgaatgacatgggcaaggtgcgcaaggatatcccgcagtgggagccctctaagggctggaacgactggcagcaggtccccttctgctcgcaccacttccaccagctgatcatgaaggatggtcgggagatcgtcgtgccgtgccggaaccaggacgagctcgtagggcgggctagggtcagccagggcgcaggctggagtctccgggagaccgcatgtctagggaagtcctatgctcagatgtggcagctcatgtacttccaccgccgtgacctgagactggccgccaacgcaatctgttcggccgtgcccgtcgattggatccccacctccagaaccacctggagcatccatgcccaccaccagtggatgaccacagaggacatgctctccgtgtggaaccgcgtgtggattgaagagaacccttggatggaggacaagacgcacatctcatcttggggtgacgtcccgtatctgggaaagcgcgaagaccaatggtgcggctcactgatcgggttgacagcccgggcaacctgggcgaccaacatccaagttgccatcaaccaggtgcgccggcttatcggcaacgaaaactatctagattacatgacttccatgaaacgcttcaagaacgaaagtgaccccgagggtgccctatggtga

SEQ ID NO: 24128 - RNA, 9879 nt, synthetic construct
  misc_feature 1..9879: note = derived and/or modified CDS sequence (opt11) from DENV-1__FJ024441__SS-prME
  source 1..9879: mol_type = other RNA
tcggtgaccatgctgctaatgttgatgcccacggccctggccttccacctgaccacccggggaggggagccccatatgatcgtgagcaaacaggaaaggggcaagtccctcctgttcaagacctcagccggggtgaatatgtgtactctaatcgcgatggatctgggcgaactatgcgaagacactatgacctataagtgtccacgcatcacggagacggagccagacgacgtggactgttggtgcaacgccaccgacacctgggtgacctatgggacctgcagccagaccggtgagcatcgtcgcgacaagcgatccgtggccctcgcgccccacgtgggcctgggattagagacacgcaccgagacttggatgagcagtgagggcgcgtggcggcagatccagcgcgtcgaaacgtgggccctccgtcacccggggttcacagtgatcgctctgttcctggcccacgcgatcgggaccagcataacccagaaggggatcatcttcatcctactgatgctggtgaccccctctatggccatgcgctgtgtcggtattggcagccgggatttcgtggaaggactttccggcgccacatgggtggacgtggtcctagagcacgggagctgcgtgaccactatggcgaaggataagcccacgctggatatcgagctactgaagaccgaggtcacaaatcccgcggtgctgcgcaaactctgtatcgaggctaaaatctccaatactacgactgactcacggtgtccgacccagggcgaggccaccctggtggaggagcaggacgccaacttcgtgtgtaggcggactttcgtggaccgcggctggggaaacggttgcggcctgttcggcaagggttccctcataacatgcgccaaatttaagtgcgtcacaaagctggagggaaagatcgtccagtatgaaaacttgaagtacagcgtgatcgtgaccgttcacacgggggaccagcaccaagtagggaacgaatccaccgagcacggcaccactgcaaccatcaccccgcaggcgcctactacagaaatccagctcacagactacggtgccctgacgctggactgctcgccccgtacaggtctcgatttcaacgagatggttttgctgaccatgaaggaaaagagttggctcgtgcacaagcagtggttccttgacctgcccctcccgtggacctcgggggccagcacgtcgcaggaaacctggaacaggcaggacctgctggttacctttaagaccgcccacgcgaagaaacaggaggtcgtcgtgctcggcagccaggagggagcgatgcacacggctctgactggggccacggagatacaaaccagtggcacgaccaccatcttcgccgggcacctaaagtgtcggttgaagatggacaagttgaccctaaagggtatgtcatacgtgatgtgcacagggtccttcaagttagaaaaggaggtggctgagacccagcacggcacggtgctggtccagatcaaatatgagggcaccgacgcgccctgcaagatccccttcagcacccaggacgagaagggagtcacacagaacggacgtttgatcactgccaatcctattgtgacagacaaggagaagcccgtcaacatcgaggccgagccgccgtttggcgagtcctacatcaccataggcgccggcgagaaggcgctgaaactttcgtggttcaagaaaggatcctcaattggcaagatgttcgaggctaccgcacgcggggctcgccgtatggccattctgggcgacaccgcgtgggacttcggctccataggcggcgtcttcaccagcgttgggaagctggtccaccagatcttcgggacggcctacggcgtgctgttctctggcgtcagctggaccatgaagatcgggattggagtgctgctgacctggctcggcctaaactcacgctcaacctccctgagcatgacgtgcatcgccgtggggcttgtgaccctgtatttaggcgttatggtacaagccgactccggctgcgtgatcaactggaagggccgcgagctcaagtgcgggagcggcatatttgttacgaacgaggtgcacacatggacagagcagtataagtttcaggccgacagcccgaagagactgtccgcggctatcggcaaggcttgggaggagggggtgtgcggcatccgcagcgcaacgcggctggaaaacattatgtggaaacagattagcaatgagttaaaccacatcctgctggagaacgacatgaagttcaccgttgtggttggtgacgtcgcgggcattcttgcgcaaggcaagaaaatgatccgcccgcagcccatggagtacaaatacagctggaagtcctgggggaaggccaagatcatcggcgccgacgtacagaacaccacattcatcatcgacggccctaacaccccggagtgtcctgacgaccaacgggcctggaacatctgggaggtggaggactacggctttgggatatttaccaccaacatctggctaaaactgcgcgacagctacactcaggtctgtgaccacagactaatgtccgccgccattaaggacagcaaggccgtgcacgcagacatggggtactggatcgagtccgagaagaacgaaacgtggaagctggcgcgcgcgtctttcatcgaggtgaagacctgcgtctggcccaaatcccacaccctctggtccaacggcgtgctcgagagcgagatgattatccccaaaatctacggaggaccgatcagccagcacaactacaggcccggttacttcacccagacggccgggccttggcacctggggaagttggagttggacttcgacttgtgcgagggcaccaccgtggtcgtggacgaacattgtggcaacagagggccgtcattacggaccaccactgtgaccggtaagattatccacgagtggtgttgccgctcctgcactctgccgcccctccggttccgcggtgaggacggctgttggtacggtatggaaattcgtcccgtcaaggagaaggaagagaacttggttaaatccatggtcagtgcaggtagcggcgaggtcgattcattcagcctaggactactgtgtatctctattatgatcgaggaggtgatgcgctctcggtggtcccgcaagatgctaatgacgggcaccctggctgtgttcttcctgctcatcatgggtcagctgacctggaacgacttaatccgcctctgcatcatggtaggcgccaacgctagcgaccggatgggtatgggcacgacatacctagcactgatggccacgttcaaaatgcgcccaatgttcgcagtgggcctcctgttccgcaggctgacctccagagaggtgctcctgctgaccatcggactcagcctggtcgcgtcagtcgagctgcccaacagcttagaagaactaggcgacgggctcgcgatgggaatcatgatcctcaaactgctgacagactttcagtcccaccaactgtgggccaccttactttcgctcactttcattaagaccaccttctctctgcactacgcgtggaagaccatggccatggtcctgagcatcgtgtccctcttcccactgtgcctatcaaccacctcccagaagaccacatggctccccgtgctgctgggtagcctcgggtgcaagcctctaaccatgtttctcatagctgagaacaagatttggggcaggcggagttggcccctcaacgagggtatcatggcagtaggcatagtgagcatcctcctgagctccctcctgaagaatgacgttcccctggccggaccgttaattgcaggcgggatgctgatcgcctgttacgtcataagtgggtccagcgccgacctgtcacttgaaaaggccgctgaggtctcttgggaagaggaggccgagcactccggggcaagccacaacatcctagtcgaggtccaggacgacgggactatgaagatcaaggacgaggaacgcgacgacaccttgacgatcttgcttaaagccacgctgctggctgtgtccggagtgtacccgctgtctatccccgcgacgctgttcgtctggtacttctggcaaaagaagaaacagcggtccggggtgctctgggacacccccagcccgcccgaggtggagcgcgccgtcctagacgacggcatttaccggatcatgcagcgcgggctgttagggcggagccaggtgggcgtaggtgtcttccaagagaacgtgttccacacgatgtggcacgtgacacggggcgccgtactcatgtatcaggggaaacgattggagcccagctgggcatccgtgaagaaagatctgatcagctatggcggcgggtggcggctccagggctcctggaacaccggcgaggaagtgcaggtcatcgcagtggagcccggcaagaacccaaagaacgtgcagaccgccccggggacgtttaaaacacccgagggagaggtaggagccatagccctggatttcaagcccgggaccagcggctcccccatagtgaaccgggaggggaagatcgtcggtctgtacggcaacggggttgtgacgacaagcggcacgtacgttagcgcgatcgcccaggccaaggcctcccaagaggggcctttgccagaaattgaggacgaagtcttccgcaaaagaaacctgaccatcatggatctgcaccccggcagcggcaagacccgccggtatcttccggcgatcgtgcgcgaggccatcaagcgcaagctgcggacgttgatccttgcccccacccgggtcgtcgcctccgagatggcagaggccctgaaaggcatgcccatccggtaccagaccaccgccgtgaagagtgagcatactggcaaagagatcgtggacttgatgtgccacgcaaccttcaccatgcgcctactgtcccctgtccgggtgcccaattacaacatgatcataatggacgaagcccacttcacagaccctagctccatcgccgcccgcgggtacatcagcacccgggtgggaatgggggaggctgccgccatctttatgaccgccacgccacccgggtcagtcgaggcgttccctcagagcaacgccgttatccaggacgaggaacgcgacatccccgagcgctcctggaacagcgggtacgagtggatcactgactttcctgggaagacggtctggttcgtaccctccataaagagcggcaacgacatcgccaactgtctgcggaaaaacgggaagcgagtgatccagctctctcgtaagacctttgacaccgagtaccaaaagacaaagaacaacgactgggactacgtggtcacgactgacatcagcgagatgggcgctaactttcgggcggaccgcgtgatagacccccggcggtgcttgaagccagtcatcctgaaggacgggcctgagcgggtcatcctcgccgggcccatgccggtgactgtcgcctccgccgcccagcgccgggggcgcataggtcgcaaccacaataaggagggcgatcagtatatttacatggggcagcctcttaataatgatgaggaccacgcgcactggaccgaggcaaaaatgctgctcgacaacatcaatacgcccgaaggaatcataccagccttattcgagccggaaagggagaaatccgccgccatagacggcgagtaccgcctgagaggcgaggcgagaaaaacattcgtggagctcatgcgtcgcggggacctgcccgtttggctgtcatataaggtcgcaagcgaaggattccagtattcggatcggcgctggtgcttcgacggcgagaggaacaaccaagtgctcgaagagaatatggatgtggagatctggaccaaggaaggcgagcgcaagaagctgcggccccgctggttagacgcccggacatactccgaccccctcgctttaagagagtttaaagagttcgccgcgggccggcgctctgtgtcaggagatctgatcctcgagatcgggaagctgccgcagcacctgacgcagcgggcccaaaacgccctcgacaacctggtcatgttgcacaacagcgagcagggtgggcgcgcctaccggcacgcgatggaggagctccccgatacaatcgagaccttgatgttgctggcgctgatcgctgtgctgaccggcggggttaccttattctttctgtccggtcgggggctgggcaagacgagcatcggactcctgtgcgtgatggcctccagcgtgctcctttggatggcctccgtagagccccactggatcgcggccagtataatcctggaatttttcctgatggttttgctgatccccgagccggaccggcagcgcactcctcaagataaccagttggcctacgtggtcataggattactgttcatgatcctgaccgtggccgcgaacgagatgggcctactggagaccacgaaaaaggacttagggatcggccacgtggcggtcgagaaccaccaccacgccgccatgctcgacgtggacctgcatcccgcttcggcctggaccttgtacgcggtagcgacaacgatcattacgccaatgatgcgccatacaatagagaacactaccgccaacatctcgcttaccgccatcgccaaccaggcagccatactgatggggctcgataagggctggccaatcagcaagatggacatcggcgtcccgctcctcgccctgggatgctacagccaggtgaaccccctcaccctgaccgccgccgtcctgatgctcgtcgcccattacgccatcataggccccgggctgcaggccaaggcaacgcgcgaggcgcaaaagcgcacggctgcaggcattatgaagaatcccaccgtggacgggatcgtggccatcgaccttgacccggtcgtgtacgacgccaagttcgagaaacagctagggcagatcatgttgctgatcctgtgcacctcccagatcttgcttatgcggactacctgggccctctgtgagagcatcaccctggccaccggccctctgacgacgctgtgggaggggtccccagggaagttttggaacaccacaatcgccgtaagtatggcaaacatcttccgcgggtcctacctggccggagcgggccttgccttcagcctcatgaagtccctcggtggcgggaggcgcggaaccggggctcagggtgaaacgttaggcgagaagtggaaacggcagctcaaccagctgagcaagagcgagttcaacacctataaacgctcgggcatcatggaggtcgaccggtcggaagccaaggagggtctgaagcgtggggagaccaccaagcacgcggtttcacggggaacggcgaagctccgatggttcgtggagcggaacctggtcaagccggaggggaaggtgattgacctgggctgcggccgtggcggatggtcatactactgtgccggactgaagaaggtaaccgaggtcaaagggtacactaagggagggcccggccacgaggagccaatcccgatggccacctacgggtggaatttagtgaaactgcactcaggcaaggatgtatttttcatcccgcccgagaagtgcgacaccctgctttgcgacataggggagagctcccccaacccgaccatcgaggagggcaggaccctgcgcgtcctgaaaatggtggagccctggctccggggcaaccagttctgcatcaagatcctgaacccctatatgcccagcgtggtggagaccctggagcaaatgcagagaaagcacggcggtatgctcgtcaggaacccgctgtcccgaaactcaacccatgaaatgtattgggtgtcctgcggtacgggaaatatcgtcagtgcagttaacatgacctcccgaatgttactcaaccggttcaccatggcacacagaaagcccacctacgagcgtgacgtcgacctgggggccgggacgcgacacgtcgccgtggagcctgaggtggccaacttggacatcattggtcaacggatcgagaacattaagcatgagcacaagagcacttggcactacgacgaggacaacccatacaagacctgggcctaccacgggtcctacgaggtcaagccctcgggttcggcgagcagcatggtgaacggggtcgttaagttactgacaaagccctgggatgtaatccccatggtcacccagatcgccatgaccgataccacacccttcggccaacagcgtgttttcaaggaaaaggtggacactaggaccccgaaagccaagagggggactgctcagatcatggaggtcaccgccaagtggctgtggggcttcctctcacgcaacaaaaagcccaggatatgcacgcgagaggagtttacccgcaaggtgcggagcaacgcggccatcggcgccgtgttcgtcgacgaaaaccagtggaactctgcaaaggaggcggtggaggatgagcgcttctgggaccttgtgcaccgggaacgcgagctgcataaacagggtaaatgcgcaacctgcgtttacaacatgatgggtaaacgggagaagaagctcggggagttcggtaaagctaaggggtcaagggccatctggtacatgtggttaggcgcccggttcctggagtttgaggcgctcggctttatgaacgaggatcactggttctcccgcgagaacagcctgtccggtgtggaaggcgaggggctgcacaagctcggatacatcctgcgcgacatcagcaagatccctggagggaacatgtacgccgacgacacagccggctgggacacacgcataacggaggatgacctgcaaaatgaggcacgcataaccgacatcatggaaccggaacacgccctactggccaagtccatatttaagctgacctaccagaacaaggttgttcgggtgcagcgtccagccaagaacgggactgtgatggacgtcatcagccgacgcgaccagcggggatcgggccaggtgggtacgtatggtctaaacaccttcaccaatatggaagcccagctgatcaggcaaatggagagcgaaggaatcttcagtcccagcgagctggagacgccaaatctcgccgagcgcgtgttggactggctcgagaagtacggcgtcgaacggctcaagcggatggccatcagtggcgacgactgcgtggtgaagccgatagacgaccgctttgcgaccgccctgaccgccctgaacgatatgggcaaggtgcggaaggatatcccccagtgggaacccagcaaggggtggaacgactggcagcaagtccccttctgctcgcaccacttccaccaactcatcatgaaggacggccgcgagatcgtggtaccgtgtcggaaccaggacgagttagtgggcagggcccgggtgagccagggagcgggctggagcctgcgcgagactgcgtgcctcgggaaatcctacgcccagatgtggcagctgatgtatttccataggcgggacctgcggttagccgccaacgcgatttgcagcgcagtccccgtggattggatacccacgagtcgaaccacgtggagcatccacgcccaccatcagtggatgacgacggaggacatgctatccgtgtggaatcgcgtctggattgaggagaatccttggatggaagacaaaacccacatcagctcctggggtgacgtcccatatctggggaagcgggaagaccagtggtgcggcagccttatcggactgacagctcgggcaacctgggccaccaacatccaggtggccatcaaccaggtacggcgcctgatcgggaacgagaactatctggactacatgacctcgatgaagcggttcaagaacgagagcgaccccgagggagccctgtggtag

SEQ ID NO: 24129 - RNA, 9879 nt, synthetic construct
  misc_feature 1..9879: note = derived and/or modified CDS sequence (opt11) from DENV-1__FJ024442__SS-prME
  source 1..9879: mol_type = other RNA
tctgttacaatgctgctcatgctgatgcccaccgccctggccttccacctcaccaccaggggcggggagccccacatgatcgtgagcaagcaggagcgtggcaagagcctgttgttcaagacttctgccggcgtgaatatgtgtaccctcatcgccatggacctgggcgagctgtgcgaggatacgatgacctacaagtgccccagaatcaccgagaccgagcccgacgacgtggactgctggtgtaacgccactgatacctgggtgacctacggtacctgcagccagacgggagaacaccggcgcgacaagcggtccgtcgccctcgcgccccacgtgggcctagggcttgagactcgcactgagacctggatgagctcagagggcgcttggaagcagatccagcgtgtcgagacttgggctctgcggcaccctgggttcacggtgatcgctttattcctggcacacgcgatcggcacgagtatcacccagaaagggataatcttcatcctcctgatgctggttacgccgtccatggccatgcggtgcgtcggcataggcagccgcgacttcgtggaaggtctctccggcgcgacctgggtggacgtcgtgctggagcacgggagctgcgtgacgaccatggccaaggacaagccgacgctggacatcgagctcctgaagactgaagtaacgaaccccgccgtgctgcggaagctctgcattgaggcgaagatcagcaacacaacgaccgacagccgctgcccgacccagggcgaggccaccctcgtggaggagcaagatgccaacttcgtttgccggcgcacgttcgtggaccgtggttgggggaacggctgcggtttgttcggcaaggggtccctcataacgtgcgccaaattcaagtgtgtgaccaagttggagggcaaaatcgtccagtacgagaacctgaagtacagcgtgatcgtgaccgtccatacaggcgaccaacaccaggtggggaatgagtcgacggagcacgggaccaccgccaccatcacgccacaggcgcctaccacggaaatccagctcaccgactacggggcactgacgctggactgctcaccccgcaccggactcgacttcaatgagatggtcctgctgaccatgaaggaaaagtcctggctcgtgcacaagcagtggttcttggatctgccccttccctggacatccggggctagcacgtcccaggagacctggaaccggcaggacctgctggtcaccttcaagaccgcccatgcaaagaagcaggaggtcgtggtgctcggctcgcaggagggcgcgatgcatactgccctgaccggcgccaccgagatccagacgtcgggcactaccacgatcttcgccgggcacctgaagtgccgcctcaagatggacaagctgaccctgaagggcatgagctacgtcatgtgcacggggtcgttcaagctagaaaaggaagtagccgaaacccagcacggcaccgttttagtccagatcaagtacgagggcaccgacgcgccctgcaagatccccttcagcacgcaagacgagaagggggtgacccaaaatggccggctgatcacggcaaacccgatcgtgactgataaggagaagcccgtgaacatcgaggccgaaccgcccttcggggagtcctacatcattatcggtgccggcgagaaggcgctgaagctcagctggttcaagaaggggtcttcaatcggcaagatgttcgaagccacggcccgcggggccagaaggatggccatactgggcgacactgcatgggacttcgggtccatcggcggcgtgttcacaagcgttggaaagctcgtccaccagatcttcggcaccgcgtacggtgtgctgttctctggcgtgagctggacgatgaagatcgggataggcgtcctgctgacttggctcggcttgaactcccgcagcacctccctgtctatgacctgcatcgcagtgggtctcgtgacgctgtacttaggcgtcatggtgcaggccgactccgggtgcgtgatcaactggaagggccgggaactcaagtgcgggagcggtatcttcgtcaccaacgaggtacacacctggaccgagcagtacaaattccaggccgacagccccaagagactgtccgcagccatcggaaaggcctgggaagagggtgtttgcggcatccgatcagccacccggctcgaaaatatcatgtggaagcagatctccaacgagctgaaccacatcctgctggagaatgacatgaaattcacggttgtggtgggggacgtggccggcatcctcgcgcaggggaagaagatgatccggccccagcccatggagtacaagtacagttggaagtcctggggcaaggccaaaatcatcggcgccgatgtgcaaaacaccacctttatcatagacgggcccaacaccccggagtgccccgacgatcagcgcgcctggaacatctgggaggtggaggactacggcttcgggatcttcactacaaacatctggttgaagctgcgggatagctatacgcaggtctgcgaccaccgcctcatgtctgcggcgatcaaggacagcaaagcggtgcacgccgacatgggctattggatcgagtccgagaagaacgagacctggaagctagcccgggcgagctttattgaagtgaagacgtgcatctggcccaagtcccacaccctttggtctaacggtgtcttggaatccgagatgatcatcccgaagatttatgggggaccgatcagccagcacaactatcgcccggggtacttcacccagaccgccggcccgtggcacctggggaagctggagctcgatttcaatctgtgcgagggcacgaccgtagtggtcgacgagcactgcggcaaccgggggccgtcactgcgcacgaccacggtcaccggcaagattatccacgagtggtgctgccggagctgtaccctgccgccgttgcgcttccgcggggaggatggctgctggtatgggatggagatccgccccgtgaaggagaaggaggagaacttagtgaagtccatggtgtcggccggaagcggcgaggtggactccttctccctcgggttactgtgcatctccatcatgatcgaggaagtcatgcggagccgctggtcccggaagatgctcatgacaggcacgctggccgtattctttctgctcatcatggggcagctaacctggaacgacctgatccgcctttgcatcatggtaggcgccaacgcgagcgaccgcatggggatgggcaccacctacctggcgctgatggccacgttcaagatgcggccgatgttcgcggtcggactcctgttccgccggctgacttcccgcgaggtgctcctgctgaccattgggctcagcctggtggcctccgtcgagctgcccaacagcctcgaggagctgggcgacgggttagcgatggggatcatgatcctcaagctgctgaccgactttcagtcccaccaactctgggccacgctgctgtctctgactttcattaaaaccaccttctccttacactacgcctggaagacgatggcgatggtgctgagcatcgtctccctcttcccgttatgccttagcaccacctcccagaagaccacgtggctccccgtgctgctgggcagcctcgggtgcaagccgctgaccatgttcctgatcgcggaaaacaagatctggggccggcgctcctggcccctaaatgaggggatcatggccgtgggcatcgtcagcatccttctgagctccctcttgaagaacgacgtgcccctggccgggcccctcatcgccggcggcatgctgatcgcctgctacgtaataagcggctcctccgcagacctgtccctcgaaaaggccgccgaggtgtcttgggaggaagaggccgagcactccggcgcgtcccacaatatcctggtggaggtgcaagacgacgggaccatgaagatcaaggacgaagagcgagatgacaccctgaccatcctcctaaaggcgacgctgttggcagtctccggcgtctacccgctgagcatccccgccaccctctttgtatggtacttctggcagaagaagaagcagcgctcgggggtcctctgggacacgcccagcccgcccgaggtggagcgggccgtgctcgacgacggcatctaccgcatcatgcagaggggcctgctgggccgctcccaggtcggcgtgggtgtgttccaggagaacgtcttccacaccatgtggcacgtgacgcgaggcgccgtactcatgtaccaggggaagcgcctggagccgagctgggcgtcagtcaagaaggacctgatcagctacggcggcggttggcggctccagggctcttggaacaccggggaggaggtacaggtgatcgccgtcgagcccgggaagaaccccaagaatgtgcagaccgcccccgggactttcaagacgcccgagggcgaggtgggcgccatcgccctggacttcaagcccgggaccagcggctcccccatcgttaaccgcgagggtagaatcgtgggtctgtacggaaacggggtggttacaaccagcggcacgtacgtgagcgcgatcgcccaggccaaggcttcccaagaggggccgctccccgaaatcgaggacgaggtgttccgcaagcggaacctgaccatcatggacctacaccccggatcggggaagacccgccggtacctccctgcgatcgtcagggaggccatcaagcgcaaattgcggaccctcattctcgcccccacacgcgtggtggcctcagagatggccgaggctctcaagggcatgcccatccggtatcagaccaccgccgtcaaaagcgagcacaccggcaaggagatcgtggacctgatgtgtcacgccactttcaccatgcgcttactgtcccccgtgcgggtcccgaactacaacatgatcatcatggacgaagctcacttcaccgacccgagctccatcgccgcgagggggtacatttctactcgggtgggcatgggggaggcggccgccatcttcatgacggccacgccgcccgggtccgttgaggcgttcccgcagtccaacgcggtgatccaggacgaggagcgtgatatccccgaacggtcctggaatctggggtacgagtggatcaccgatttccccggcaaaaccgtgtggttcgtgccctcgatcaagtccggcaacgacatcgccaactgcctacgcaagaacgggaagcgggttattcagctgagccggaagactttcgataccgagtaccagaagacgaagaacaatgactgggactacgtggtaaccaccgacatctccgagatgggggccaactttcgggcagaccgcgtcatcgatccccggcggtgcctaaagccggtgatcctcaaggacgggccagagcgggtgatcctggccggcccaatgccggtcacggtagcaagcgccgcccagcgccgaggcagaatcggccgcaaccataacaaggagggcgaccaatacatctacatggggcagccccttaacaacgacgaagaccatgcgcactggacagaagcaaagatgctactggacaacatcaataccccagagggcatcatccccgctctgttcgagccggagcgggagaagagcgccgccatcgacggggagtaccgcctccgcggcgaggctaggaagacgtttgtcgagctgatgcggcgcggggacctgccagtgtggttgtcttacaaagtggcctccgagggcttccagtacagcgaccggcgctggtgctttgacggcgaacggaacaaccaggtcctggaagagaacatggacgtggagatatggaccaaggagggagagcgcaagaagcttaggccccgctggctcgacgcgcggacctacagcgacccactggccctgcgcgagttcaaagagttcgccgcgggccgacgctccgtgagcggggacctcatcctcgagataggcaagctgccacagcacctcacccagagagcccagaacgccctcgacaatctggtcatgctccacaactcagagcaaggcgggcgggcctatagacacgcaatggaagagctgcctgacactatcgagaccctaatgctcctggccctcatcgctgtgctcaccggtggggtgaccctgtttttcctaagcggccgtgggctcggcaagacctccatcggcttactgtgcgtcatggccagctcggtgctcctgtggatggcaagcgtagagccccactggatcgccgcctccatcatcctggagttctttctcatggtcctactaatcccagagccagatcggcaacgaacgccccaggacaaccaactcgcgtacgtggtgatcgggctgctgttcatgatccttactgtcgccgccaacgagatgggcctgctggaaaccaccaagaaggacctagggatcggtcacgtggcggtggagaatcaccaccacgccgccatgctggacgtcgacctgcaccccgccagtgcttggacgctgtacgcggtggccactacaatcataaccccgatgatgcggcacacgattgagaacaccaccgccaacatcagtcttaccgccatcgccaaccaggcggccatcttgatggggctcgataagggctggcccatcagcaagatggacattggcgtgcccttgctggccctgggttgctactctcaggttaacccccttactctgaccgccgcggtgctcatgctggtcgcccactacgcaataatcggcccgggactgcaggccaaggccacccgggaagcgcagaagcgcaccgccgccggcatcatgaagaaccccacggtagacggtatcgtggccattgatttagaccccgtggtctacgacgcgaaatttgagaagcagctggggcagatcatgttgctcatactgtgcacgagccagatcctgttgatgaggaccacctgggcgctgtgcgagagtatcacgctggccaccggccccttaaccaccctgtgggaggggagcccgggcaagttctggaacacgaccatcgccgtatccatggccaacatcttccgcggctcttacctggccggcgcgggcctagccttctccttgatgaaaagcctcgggggcgggcgacgcgggacaggggcgcaaggcgagaccttgggcgaaaaatggaagcggcagctaaatcaattaagcaagtccgagttcaacacttacaagcgcagcgggataatggaggtggaccgctccgaggccaaggagggcttgaagcgcggggaaaccaccaagcacgcggtcagccggggcacggccaagctgaggtggttcgtcgaacggaacctggtgaagcctgaagggaaggtgatcgacctaggatgcggccgcgggggctggtcctactactgcgccgggctaaaaaaggtgacggaggtgaagggctacaccaagggcgggcccggccacgaagagcccatcccgatggccacctatgggtggaatctggtcaagctgcactcaggcaaggacgtgtttttcataccccccgaaaagtgcgacaccctcctgtgcgacatcggggagagcagccccaacccgacgatcgaggaagggcggaccctccgcgtgctcaaaatggtcgagccctggctgcgggggaaccagttttgtatcaagatcctgaacccatatatgccttccgtggtggaaaccctcgagcaaatgcagcgcaagcacggcggcatgctggtccggaacccgttatcccgcaactccacccacgagatgtactgggttagctgtgggacaggcaacatcgtgtctgccgttaacatgacgagcaggatgttactgaaccggttcaccatggcgcaccgcaagcccacctacgagcgggacgtggaccttggtgctggcacacgccacgtggcagtcgagcccgaggtagcgaatctcgatatcatcgggcagaggatcgagaatatcaagcacgaacacaagagcacgtggcactacgacgaagacaacccatacaagacctgggcgtaccacgggagctacgaggttaagccgtccggctctgcgtccagcatggtcaacggggtggtcaagctgctgaccaagccctgggacgtcatccccatggtgacccagatcgccatgacggacaccactcccttcggccagcaacgcgtctttaaggagaaggtggacacccggacgccgaaggccaagcgcggcaccgcccagatcatggaagtgaccgccaagtggctctggggcttcctgagccggaacaagaagccccgcatctgtacccgggaggaatttacgcgcaaggtccggtccaacgctgcgataggcgccgtctttgttgacgaaaaccagtggaatagcgcgaaggaggcggtcgaggacgagcgcttctgggacctcgtgcaccgggaacgcgagctccacaagcaagggaagtgtgcaacttgcgtgtacaacatgatggggaagcgggaaaagaagctgggtgagttcggaaaagccaaggggtcccgcgccatctggtacatgtggctgggtgcccggttcctagagttcgaagcgctgggcttcatgaacgaggaccattggttcagccgcgagaactccctgagcggggtggagggcgagggtctccacaagctgggctacatcttacgggatatctccaagatccccggaggcaatatgtacgctgacgacaccgcgggctgggatacccgcatcaccgaggacgatctccagaatgaggcccgcatcaccgacatcatggagccagagcacgccctgctcgccaagagcatcttcaagctcacctatcagaacaaggtggtgcgggtccagcgccccgccaagaacggaaccgtgatggatgtgatctcgcgacgcgatcagcggggcagcgggcaggtcggtacgtacggcctgaacacattcaccaacatggaggcccagctgatccgccagatggagtccgaaggtattttctcaccctccgagctcgagacccccaacctggcagagcgggtgctggactggctcgagaagtacggcgtggagcgcttgaagcggatggccatcagcggggacgactgcgttgtgaagccgatcgacgaccgctttgctacggccctgaccgccctgaacgacatgggcaaggtgcggaaggacatcccacagtgggagccttccaagggttggaatgactggcagcaggtccccttctgcagccatcactttcatcagctgataatgaaggacggccgcgagatagtggtgccgtgccggaaccaggacgagctggtcggccgcgctcgggtttcccaaggggccggctggagcctccgagagaccgcgtgcttggggaagagctacgcccagatgtggcagctgatgtacttccatcggcgcgacttacggctggccgcaaacgcgatctgctccgccgtgcccgtggactggatccccaccagccgaacgacctggtccatccacgcccaccaccagtggatgaccaccgaagacatgcttagcgtgtggaacagggtgtggatcgaagagaacccctggatggaggacaagacccacatctccagctggggggacgtcccctacctcgggaagcgggaggaccagtggtgcggctccctgattggcctgaccgcccgcgccacttgggcgacgaacatccaggtagccatcaaccaggtgcggcgcctcattgggaacgagaactacctggactacatgaccagcatgaagcggttcaagaacgagggcgacccggagggcgccctctggtga

SEQ ID NO: 24130 - RNA, 9879 nt, synthetic construct
  misc_feature 1..9879: note = derived and/or modified CDS sequence (opt11) from DENV-1__FJ373296__SS-prME
  source 1..9879: mol_type = other RNA
tcggtgaccatgctgctcatgctcatgcctattgccctcgccttccatctcacaacacgcggcggggaaccccacatgatcgtgagcaagcaggaacggggcaagagcctgctgtttaagaccagcgcgggggtgaacatgtgcactctcatcgccatggacctgggcgaactctgcgaggacaccatgacgtacaagtgcccccgcatcacggaagccgagcccgatgatgtcgactgctggtgcaacgcgaccgacacttgggtgacgtacggtacctgcagccagaccggcgagcatcgacgcgataagcggtccgtggccctcgcgccccacgtcggccttgggctggagacacggacggagacttggatgagttccgagggcgcctggaagcaaatccaacgcgtggagacctgggccttgcgccaccccgggttcacagtgattgcgctattcctggcgcatgcgatcggcacgagcatcacccagaagggcataatctttatccttttgatgctggtgaccccttccatggccatgcggtgcgtgggcatcggctccagggacttcgttgaggggctctcgggtgccacctgggtcgacgtcgtgctggagcacgggagctgcgtgacgaccatggccaaggacaagcccaccctggacatcgagcttctgaaaaccgaggtcactaaccccgcggtgctgcggaagctctgcatcgaggccaagatctccaataccaccaccgacagccgctgcccgacgcagggcgaggccaccctcgtggaggagcaggacgccaacttcgtttgccggaggaccttcgtggaccgcggttgggggaacggctgcggactgttcggcaaggggtccctcattacatgcgccaagttcaagtgcgtgacgaagctggagggcaagatcgttcagtatgagaacctgaaatacagcgtgatagtcaccgtccacaccggcgaccagcaccaggtggggaatgagtccaccgaacacggcacgactgcgaccatcacgcctcaggcgcccacaacggagatccagctcaccgactacggggccttgaccctagactgcagccctcgcaccgggctcgacttcaatgagatggtcctgttgacgatgaaagaaaagagttggctagtgcataaacagtggttcctcgaccttccattgccctggacgtcgggggcctccacctcacaggagacctggaaccggcaggacctgttggtaactttcaagaccgcccacgcgaagaagcaggaggtcgtggtgttgggcagccaggagggcgccatgcacacagccttaacaggggctacggagatccagacgtcgggcaccaccacaatcttcgctgggcacctgaagtgccgcctcaaaatggacaagttgaccctgaaaggcatgagctacgtcatgtgtacggggagtttcaagttagagaaggaggtggcggagacccagcacggcacggtgctggtccagatcaagtatgaaggcaccgacgccccctgcaagatccccttcagcactcaggacgagaagggggccacccagaacggccggttgatcacggccaacccgatcgtcaccgacaaggaaaaaccggtgaacatcgaggcggaaccgcccttcggggaatcctatatcgtcatcggcgccggtgagaaggccctgaaactctcctggttcaagaaagggtcctcaattggcaagatgttcgaagctaccgcccgtggggcccggcggatggccatcctgggcgacaccgcctgggacttcgggtccatcggcggcgtgttcacgagcgtggggaagctggtccaccaaatcttcggcaccgcctacggggtcctcttctccggcgtgagctggaccatgaagatcgggatcggagtgctgttaacctggctcggcttaaactcccgcagcacctcactgtctatgacctgcatcgccgtggggctcgtgacattgtacctgggcgtgatggtgcaggcggactcgggatgcgtgatcaattggaaaggacgggaactcaaatgtggaagcgggatcttcgtcacaaacgaagttcacacgtggaccgagcagtacaaatttcaggccgacagcccgaagcgcctatccgccgcgatcggcaaggcttgggaggagggggtttgcgggattcggagcgcgacccgactcgagaacatcatgtggaagcaaatctccaacgagctaaaccacatactgctggagaacgacatgaaactcacagtcgtggtgggggatgtcgccggcatcctagggcagggcaagaagatgatccggccgcagcccatggagtacaagtactcctggaagtcatggggaaaggccaagatcatcggggccgacgctcagaacaccacttttatcattgacggccccaacaccccggagtgccccgacgaccaacgagcatggaacatctgggaggtggaggactatgggttcggcattttcaccacaaatatttggctgaaactccgggacagctacacccaggtgtgcgaccaccgcctgatgtccgccgctatcaaggattccaaggccgtccatgcggacatggggtactggatcgagtcggagaagaacgagacctggaaacttgcgcgagccagcttcatcgaggtgaagacgtgcatctggccaaagtcccacaccctctggagcaatggggtgttggagtctgaaatgatcatccccaagatctacggcggcccgataagccagcacaactaccgcccaggctactttacccagactgccgggccctggcatttgggcaagctggaactggacttcgatctgtgtgagggaaccaccgtcgttgtagatgaacactgcgggaaccggggtccgtccctccgcacgaccaccgtcaccgggaagatcatccacgaatggtgctgccggtcgtgcacgctgccgccccttcgcttccggggcgaggacgggtgttggtacggcatggagatccgcccggtgaaggagaaggaggagaaccttgttaagtccatggtgagcgccggatcaggggaggtggactccttcagtctgggtctgttgtgtatctccatcatgatcgaagaagtgatgcggagccgctggtcgcgaaagatgctgatgaccgggacccttgcagtattcttcctcctaatcatgggccagctgacctggaacgatctcatcaggctctgcatcatggtgggggccaacgcaagcgaccggatgggcatgggcacgacttacctggccctcatggccactttcaagatgcgaccgatgttcgcggtgggtttgttattccggcggcttacaagtcgcgaggttctcctgctcacgattggcctgtctctggtcgcctccgtggagctccccaattcacttgaagagttaggggatggactcgccatgggcatcatgatcctgaagttgctcaccgattttcagtcccaccagctgtgggccaccctgttgtctctgacattcatcaaaacgacgttctccctgcactatgcgtggaagaccatggctatggtcctcagcatcgtatccctgtttcccttgtgcctcagcaccacgtcgcagaagaccacctggctgcccgtcctcctcgggagcctgggctgtaagccactaaccatgttcttgatcgctgagaacaaaatatgggggcgcaagtcatggcccctgaacgagggcattatggccgttggaatcgtgtctatcctgctcagctccctgctgaagaacgacgtccccctcgccggcccactgatcgcaggagggatgcttatcgcctgctacgtgatcagcggttcctcagcagacctcagtctggagaaggcggccgaggtatcctgggaggaggaggcggagcactcaggggccagccacaacatactcgtcgaggtgcaggatgacggtactatgaagatcaaagacgaggaacgcgatgacaccctcactatccttctaaaggccacgctcctggccgtatccggggtgtacccgctgtctatccccgccactctcttcgtatggtacttttggcagaaaaagaagcagcgctcaggagtgctgtgggacacccccagcccgcccgaggtcgagcgcgccgtgctagacgacggaatataccggatcatgcagcgcgggctgctcgggcggtcccaggtgggggtcggcgtgttccaggagaacgttttccacaccatgtggcacgtcaccagaggggccgtgcttatgtatcagggtaagcggctggagcccagttgggcctccgttaagaaggacctcatcagctatggtggtggctggcgcctgcgggggtcctggaacaccggcgaagaagtccaggtgatcgccgtggaacccgggaagaaccccaaaaacgtacagaccgcgcccggcacgttcaagacccccgagggcgaggttggggcgatcgccttagacttcaaacccggcacaagcggctccccaatcgtcaatcgcgagggcaaaatcgtcggtctctacgggaacggagtggttacgacaagcgggacctacgtcagcgcaatcgcccaagcgaaggccagtcaggaaggacctctgcccgagatcgaggatgaggtgttccgcaaacgcaatctgaccatcatggacctccatcccggatcaggaaagacgcgtcgatatctgccagcaatcgttcgagaagccatcaagcgcaaacttaggacactcatcctggcccccacccgggtcgtggcgagtgagatggccgaggcgctgaagggcatgcccatccgctaccagacaacggccgtcaaatcggagcataccgggaaggagatcgtcgacctcatgtgccacgccaccttcactatgcggttgctgtcccccgtacgagtgccgaactacaatatgatcatcatggacgaggcccacttcacggacccgagctccattgccgcccgggggtatatcagcacgcgcgtcgggatgggcgaggcggccgcgatctttatgaccgccacgccgcccggttccgtagaggccttcccacaaagcaacgccgtcatccaggacgaagaacgggatatcccggagcgctcctggaactcgggctacgagtggatcactgatttccccggaaagaccgtctggtttgttccctccatcaagagcggcaacgatatcgcgaactgcctccggaagaacggcaagcgcgtgatccaactgtcccggaagacctttgacacggagtaccaaaagacgaagaacaacgactgggactatgtcgtgacgaccgacataagcgagatgggggccaacttcagggccgaccgggtgatcgacccgagaaggtgcctgaaacctgtcatcctaaaggatggccctgagcgtgtcatcctagccggcccgatgccggtcacagtcgccagcgcggctcagcggcgcggccggatcggccgcaatcacaacaaggagggggaccagtacatctacatgggccaacccctgaacaatgacgaagaccacgcgcactggacagaggcgaagatgctcctggacaacatcaacacccccgaaggaatcatacccgccttgtttgagccggagcgcgagaagtctgcagcagtggacggcgagtatagactaaggggagaggctcggaagacgttcgtagagctgatgcgcagaggggaccttcccgtgtggttgtcctacaaggtggcctctgagggcttccagtactcagaccgccggtggtgcttcgacggggaacgcaataatcaggtcctggaagagaacatggatgtcgagatatggacaaaggagggcgagcggaagaaactgcgcccccgttggctcgacgcgcgcacttactccgacccactggcactgcgggagttcaaggagtttgccgcagggcgtcgctcagtgtctggtgacctcattttggagatcgggaagctgccgcagcacctcacacagcgcgcccagaacgcactagacaacctggtcatgcttcacaacagcgagcagggcgggcgggcttaccgccacgccatggaggagcttccggacaccatcgaaaccctgatgctcttagccttaattgccgtgctcactggaggggtgactctgtttttcctgtccggacggggcctcggcaagacctcgatcgggttactgtgcgtcatggcgtccagcgtgttgctgtggatggcctccgtggagccccactggatcgctgcaagcatcatactcgagtttttcttgatggtcctgctgatccccgagccggaccgccagcggacgccacaggataatcagttggcctacgtggtgataggcctgctgtttatgatcctcacggtcgcggccaacgagatgggcttactggagacgaccaagaaggacctcggcatcgggcacgttgccgtggagaaccatcatcacgccgctatgctggacgtggacctgcaccccgcgagtgcctggaccctgtacgccgtggcgaccacaataataaccccgatgatgcgccataccatagaaaacaccacagccaacatcagcctaacggcgatcgccaatcaggccgccatcctgatgggcttagacaagggctggcccatctccaaaatggacatcggggtgcccctgctggcgctcggctgctatagccaggtgaaccccctcactctgaccgccgcagtactcatgctggtggcccattatgccatcatcgggcctggcctgcaggcgaaggccacgcgcgaggcccagaagcggactgccgccgggattatgaagaatcccacggtcgacgggatcgtggcgattgacctcgaccccgtggtctacgacgccaagttcgagaagcagctgggtcaaatcatgctgctcatcctgtgcaccagccagatcctcctcatgcgtacgacctgggccctgtgcgagagtatcacgctggccaccgggcccctcacgaccttatgggagggctccccggggaagttctggaacacgaccatcgccgtgtcaatggcgaacatattcagagggtcctacctggctggagcggggcttgccttctctctgatgaaatccctgggcgggggtcgacgggggaccggcgcgcagggcgaaaccctcggcgagaagtggaagcgacaattaaaccaattgtccaagagcgagttcaacacctacaagcgaagtggtatcatggaggtcgaccgcagcgaggccaaggagggcctcaaaagaggggaaaccacgaagcacgccgtctcccgtgggaccgccaagctgcgttggttcgttgagcgcaacttggtgaagcccgagggcaaggtcatcgaccttggctgcggacggggcgggtggtcttactattgcgctggcctcaagaaggtaaccgaggtgaaggggtataccaagggcggacccggacacgaggagcccatcccgatggcgacgtacggctggaacctagtgaagctgcactccgggaaagacgtgtttttcatcccgcccgagaaatgcgacactctgctgtgcgacattggcgagtcttccccaaatccgacaattgaggaggggcggaccctgagagtgctcaaaatggttgagccgtggctgcgcggcaaccaattctgcatcaagatcctgaatccctatatgccaagcgtggtggagacacttgaacagatgcagcggaaacatggcgggatgttggtgcgcaacccgctgtcccggaatagcacccacgagatgtactgggtgtcctgcggcacggggaacatcgtctcagccgtcaacatgacctcccgcatgctcctgaaccgctttactatggcccaccggaagcccacctacgagcgcgacgtagacctgggcaccggcacccggcacgtggccgtcgagcccgaggtggccaatctcgacatcatcggtcagcgcatcgagaatatcaagcacgagcataagagcacctggcactacgacgaagacaacccctacaaaacgtgggcataccatggctcctacgaggtgaagcctagcgggagcgcgagcagcatggtcaacggcgtagtcaagctgctgaccaagccgtgggatgtgatccccatggttacccagattgccatgaccgacacgacgcccttcgggcagcagcgagtatttaaggagaaggtagacacccgcaccccaaaggccaagcgggggacggcccagatcatggaagtgaccgcgcgctggctctggggcttcctgtcccgaaataagaagccccgcatctgtacccgggaggagtttaccaggaaggtccggagcaacgccgccatcggggccgtgttcgtggacgagaatcagtggaactccgcaaaagaggccgtcgaggacgagcgcttctgggacttagtgcaccgggagcgcgagctccacaaacagggtaaatgcgccacgtgcgtgtacaacatgatggggaagagggagaagaaacttggcgagttcgggaaagccaagggtagccgcgccatctggtacatgtggctgggcgcgcgatttctggagttcgaggccctgggatttatgaacgaagaccactggttctcccgagaaaactcattgtccggggtcgagggggagggcctccacaagctggggtacatcttaagggacatcagcaagatccccggaggcaatatgtacgccgacgacaccgccgggtgggacacccgcatcaccgaggacgacctacagaacgaggccaagataacggacatcatggagccggagcacgcgttgcttgcgaaggccatcttcaagctcacctatcagaacaaggtggtgcgcgtccagcggccggcaaagaacggcaccgtgatggacgtgatatcccgccgggaccagcgcggaagcggccaggtcggcacttacggattaaacacgttcaccaacatggaggcccagctcatacggcagatggaatccgaaggtattttctcgccctccgagctcgagacgcccaacctggcggagcgcgccctggactggctagagaagtacggggtggaacggctaaagcgcatggccattagcggcgatgactgcgtggtaaagccaatcgacgatcggttcgctaccgccctgacggcgctcaacgacatggggaaggtcaggaaagacatcccacaatgggagcccagcaagggctggaacgactggcaacaggttcctttttgctctcaccacttccaccagctgattatgaaggacgggcgggagatcgttgtgccgtgcaggaaccaggatgagctagtggggcgggcccgcgtctcccagggtgcggggtggtctctgcgggagaccgcctgtctgggcaagagctacgcgcagatgtggcagttaatgtacttccatcgccgggaccttcgcctggccgccaacgcaatctgtagtgccgttcccgtggactgggtaccaacgagcaggacaacctggtcgatccacgcgcaccaccagtggatgaccaccgaggacatgctgagcgtgtggaaccgcgtgtggattgaggagaatccctggatggaggacaagacacacatctccagctgggaggacgtcccgtacctcggaaagcgcgaggaccagtggtgcggctccctgatcggcctgacggccagggcgacgtgggcaacgaacattcaggtggccattaatcaggtgcgccggctcatcgggaacgaaaattacctcgattacatgacctcaatgaagcgcttcaagaacgagtccgaccccgagggcgctctgtggtga

SEQ ID NO: 24131 - RNA, 9879 nt, synthetic construct
  misc_feature 1..9879: note = derived and/or modified CDS sequence (opt11) from DENV-1__FJ182018__SS-prME
  source 1..9879: mol_type = other RNA
agcgtgaccatgctgctcatgttaatgcccactgccctggccttccacctcaccacccggggcggggaaccccacatgatagtgagcaagcaggagcggggaaagtccctgctgtttaagaccagcgccggggtgaacatgtgcactcttatcgccatggacctgggcgaactgtgtgaggacaccatgacttacaagtgcccgaggatcaccgaaaccgaacccgacgacgtggactgctggtgcaacgccacggacacgtgggtgacctacgggacctgcagccagacgggcgagcaccggcgggacaagcggtccgtggccctcgcgccccacgtgggcctggggctggagacccggaccgaaacttggatgagctccgaaggggcctggaagcagatccagcgcgtcgagacatgggccctccggcaccccggtttcaccgtaatcgcgctattcctggcacacgcaataggcaccagcatcacccagaaggggatcatcttcatcctcctgatgctagtgacgccctcaatggccatgcggtgcgttggcatcggctcccgcgacttcgtcgaaggtctctccggcgccacctgggtcgacgtcgtcctggagcatgggagctgcgtgacaacgatggccaaggataagcccactcttgacatcgagctcctgaagaccgaggtgaccaacccagccgtgttacgaaaactctgcatagaggcgaagatctccaacaccacgaccgacagtcgctgcccgacccagggggaggcgaccctggtagaggaacaagatgccaatttcgtttgccggcgcacgttcgtggaccggggctgggggaacggctgcgggctgtttggcaagggctccctcatcacgtgcgccaaattcaagtgcgtgaccaagctggaaggcaagatagtccagtacgagaacctgaagtactcggtgatagtgaccgtccacacaggggaccagcaccaggtggggaacgagtccaccgagcatggtacaaccgccaccatcacgccccaagcgcccactaccgagatccaactcaccgactacggggctctgacgctggattgctccccccgcactggactcgacttcaacgaaatggtcctcctgaccatgaaagagaagtcctggctcgtacacaaacagtggttcctggatctgcccctaccctggaccagcggggcctctacgagccaggaaacctggaatcggcaggatctgctggtgaccttcaagactgcccatgccaagaagcaggaggtcgtggtgctcggcagccaggagggtgcgatgcacacggccctgaccggggctaccgagatccagacctccggcacgaccaccatcttcgccgggcatctaaagtgccgcctcaaaatggataagctgaccctgaagggcatgtcatacgtcatgtgcacgggttccttcaagttggaaaaggaggtggccgagacgcagcacggcaccgtgctggtccagatcaagtacgagggaaccgacgctccgtgcaaaatccccttcagcacgcaggacgagaagggggtgacccagaacggcagactgatcaccgctaaccccatcgtgaccgacaaggaaaagcccgtaaacatcgaggccgaaccgcccttcggggagagttacataattataggcgccggcgagaaggcgctgaagctctcatggttcaagaaagggtccagcatcggcaagatgttcgaagccacggcaaggggggcgcggcgcatggccatcctgggtgataccgcgtgggacttcggctccatcggcggcgtgttcaccagcgtggggaaactggtccaccagatcttcggcaccgcctacggggtgctcttctccggcgtgtcgtggacgatgaagatcgggatcggcgtcctgctgacctggctcgggctgaactcccgcagcacctccctgtcaatgacctgtatagccgtaggtttggtgaccctgtacctgggcgtaatggtgcaggccgactccggctgcgttatcaactggaaggggcgcgagctcaagtgcggaagcggcatcttcgtcaccaacgaggtgcacacgtggactgagcagtataagttccaggccgacagcccgaagagactgtccgctgctatcgggaaagcttgggaggagggggtgtgcggcatccgaagtgcaacccgcctggagaacatcatgtggaagcagatctccaacgagctcaatcacatcctgttggaaaacgacatgaagtttacggtcgtcgtgggggatgtggccggcattctcgcgcaggggaagaagatgatccgtccccagcccatggagtacaagtacagctggaagtcatggggcaaggccaagatcatcggcgccgacgtgcagaacactaccttcatcatcgacggacccaacaccccggaatgcccagacgaccagcgcgcctggaacatctgggaggtggaggactacggctttgggatattcacaaccaacatttggctgaagctgcgggactcacacacccaggtctgcgaccaccgcttgatgtcggccgccatcaaggacagcaaggccgtgcacgccgacatgggctactggatcgagtccgagaagaacgagacctggaagctcgctcgggcgtctttcatcgaggttaagacgtgcatctggcccaagtcccacacgctgtggagcaacggcgtcctcgaatccgagatgatcatccctaagatttacggggggccgatcagtcagcacaactatcgccccgggtacttcacccagaccgccggcccctggcacttagggaagctggagctcgatttcgacctgtgcgagggcacgaccgtggtggtagacgagcactgcggcaaccggggaccgagtctgcgcaccaccaccgtgaccggcaagatcatccatgaatggtgctgccggagctgtacgctgccgcccctccgcttccgcggggaagatggctgctggtacgggatggagatccgccccgttaaggagaaggaggagaacctggtcaagtccatggtgagcgccggcagtggcgaggtggactccttctctctcgggctgctgtgcatctccatcatgatcgaggaggtgatgcggagccgctggtcccggaagatgctcatgaccggcacgctggccgtgttcttcctcctcattatggggcagctaacttggaacgacctgattcgcctctgcatcatggtgggcgccaacgcgagcgaccgcatgggaatgggtactacctatctggccctaatggctacgtttaaaatgcgtccgatgttcgccgtaggcctcttattccgtaggctgacctctcgtgaggtgctcctgctgacaatcgggttgagcctggtggcctccgtcgagctgcccaacagtctcgaggagctgggcgacgggctggctatgggaataatgatcctcaagctgttaacagactttcaatcccaccagctctgggccacgctgctgtcattaaccttcatcaagaccaccttcagtctgcattacgcgtggaagacgatggccatggtgctgagcatcgtctccctgttccccctgtgcctgagcaccacctcacagaagaccacgtggctccctgtgctgctaggcagcctcggatgcaaaccattaaccatgttcctgattgccgagaacaagatctggggccgcaggagctggcccctcaatgagggcatcatggctgtgggaatcgtcagcatcttgctgagctccctattgaaaaacgacgtgcccttggccggcccactcatcgccggcggcatgctgatcgcctgttatgtgatctcggggtccagtgcggacctgtctttagagaaggccgccgaagtcagctgggaggaagaggccgaacactccggggcaagccacaacatcctggtggaggtgcaggacgatgggacaatgaagatcaaggatgaggagcgcgatgacaccctgaccattctcctgaaggcgacgctgttggccgtctccggcgtgtacccgttatctatcccagccaccctgttcgtgtggtacttctggcagaagaagaagcagcggtccggtgtcctctgggacacccccagcccgcccgaggtcgaacgggccgtgctggacgatggcatctatcgcatcatgcagcggggcctgttggggcgctcgcaggtcggggtgggtgtgttccaggagaacgtttttcacacgatgtggcacgtgacgcggggcgccgtgttaatgtatcaggggaagcgactggagccgagctgggcatccgtcaagaaggatctgatcagctatggcggcgggtggcggctccagggctcctggaacaccggggaggaggttcaggttatcgccgtcgagcccggcaagaaccccaagaacgttcagaccgcccccgggaccttcaagacgcctgagggcgaggtgggcgccatagccctggacttcaagcccgggaccagcggctcgcccatcgtaaaccgtgaggggaagatcgttggcctgtacggaaacggggtggtcaccaccagcggaacgtacgtgagtgcgatcgcacaagccaaggcctcccaagaagggcccctccccgagatcgaagacgaggtgttcaggaagcgcaaccttacgatcatggaccttcaccccggaagcgggaaaacgaggcggtatctcccggcaatcgtccgggaggccatcaagcgcaagctacgcaccctgatcctcgcccccacgagggtggtggcctccgagatggccgaggcgctgaagggcatgcccatccgctaccagaccaccgccgtcaagagcgaacacaccggcaaagagatcgtggatctcatgtgccatgccacgttcaccatgcggctgctgtcccccgtgcgggtcccgaactataacatgatcatcatggatgaggcccacttcaccgatccaagctccatcgccgcaagggggtacatcagcacccgcgttggtatgggggaggccgccgccatattcatgacggccacgccgcccggttcggttgaagcgttccctcagagcaacgccatcatccaggatgaagagcgggacatccccgagcgctcctggaatagcgggtacgagtggattactgactttccaggcaagaccgtctggttcgtgccctctatcaagagcggcaacgatatcgccaactgcctgcggaagaacgggaagcgcgttattcaactctcgcgtaagacgttcgacaccgagtaccagaagaccaagaacaacgactgggactacgtcgtgaccacggacatctctgagatgggtgcaaacttccgcgcggatcgggtgatcgacccgcgcagatgcctgaagcccgttatcctcaaggacgggcccgaacgcgttatcctcgccggcccgatgccggttaccgtcgcctccgccgcccagcggcgcgggcggatcggccgcaatcacaataaggagggcgaccagtacatctacatggggcagcccctgaacaatgacgaggaccacgcacactggaccgaagccaagatgctgctcgacaacatcaacacccccgagggcatcattcccgcgctgttcgaaccggagcgtgagaagagtgcagccatcgatggggagtaccggctgcgcggcgaagcgcgtaagacgttcgtggagctgatgcgccgcggggacctgcccgtctggctatcctacaaggtcgcgtcggaggggtttcagtacagcgatcgccggtggtgctttgacggcgaacgcaacaatcaagtcctcgaggagaacatggacgtagagatctggacaaaggagggggagcggaagaagctgcgcccccggtggctggacgcacgcacctactccgaccccctcgccctgcgggagttcaaggaattcgccgcgggtcgccggagtgtctcaggggacctaatcctcgagatcggaaagctaccgcaacacctgacccagcgcgcacagaacgccctagacaaccttgtgatgctgcataatagcgagcagggggggcgggcctaccgccacgctatggaggagctccccgacacaatcgagacgctgatgttgttagcactgatcgccgtcctgaccggcggggtgactctcttcttcctgtctgggcgggggctgggcaagaccagcatcggactcctgtgcgtgatggcctccagcgtcctcctctggatggccagcgtagagccccactggatcgcggccagcattatcctggagtttttcctgatggtgctcctgattcctgagccggaccgccaacggactccccaggacaaccagctggcttacgtggtcatcgggttactgtttatgatcctgacagttgccgccaatgagatgggcctgcttgagaccaccaagaaggacctggggatcggccatgtcgcggttgagaaccaccaccacgccgccatgctagacgtggatctgcaccccgcctccgcctggacgctgtacgcggtcgccactaccatcataaccccgatgatgcgccatacgatcgagaacaccacagcaaacataagcctcaccgccatagccaaccaggctgccattttaatgggtctggacaagggctggcccatctccaagatggacattggcgtgccactcctggccctggggtgctacagccaggtgaaccccctcacgctgaccgccgcggtactgatgttggtggcccactacgccatcatcggcccggggctgcaagcaaaggccacccgcgaagcccagaaacggaccgccgccggcattatgaagaaccccacggtggacgggatcgtcgctatcgacctggacccggtggtgtacgacgccaagttcgaaaagcagctcggacagatcatgttacttatcctctgcacctcccagatcctgctgatgcgaaccacctgggcgctgtgcgaaagcataacgctggccaccggcccactgaccaccctctgggagggatccccgggcaagttctggaacacaaccatcgcagtcagcatggccaacatcttccgggggtcatacctggcaggcgcgggcctggccttctctctcatgaaaagcctcgggggcggacgccgtgggaccggggcccagggtgagaccctgggggaaaagtggaagcgccagctcaaccagctgtccaagagcgaatttaacacgtacaagcggtccgggatcatggaggtcgaccgcagcgaggccaaggagggcctgaagcgaggcgaaaccaccaagcacgcggtgtcccgcggcaccgccaaactccggtggttcgtggagcgcaacctggtgaagcccgaagggaaggtcatcgacctgggctgcggccgcgggggctggagctactactgtgccgggctgaagaaggtcacggaggtgaagggctacaccaagggcggccccggccacgaggagcccatcccgatggccacttacggttggaacctcgtaaagctgcactccggcaaggacgtgttctttatcccgcctgagaagtgcgacaccttgctctgtgacatcggggaaagctcacccaacccgacgatcgaggagggccgaacccttagggtactgaagatggtggagccctggctccgcggcaatcagttctgcatcaaaatcctgaacccttacatgccctcggtcgtggagaccctggagcagatgcagcgcaagcatggtggcatgctcgtgcgcaacccgctttccagaaacagcacccacgagatgtactgggtctcctgtgggaccggcaacatcgtgagcgcggtgaacatgacgtcccgaatgctgctcaaccgattcaccatggctcaccggaagccgacctatgagcgggacgtcgatctgggtgccggcaccaggcacgtagccgttgagcccgaggtcgccaacctggacatcatcggccagcgcattgagaacataaaacatgagcacaagagcacgtggcactatgacgaggacaacccctacaagacctgggcctaccacgggtcctacgaggtgaagccgagcggttccgctagctcgatggtcaacggggtcgtgaagctcttgaccaagccctgggacgtcatccccatggtgacccagatcgccatgacggacaccacgcccttcggccagcagagagtgttcaaggagaaggtcgacacccgcacgccgaaagccaagcgggggaccgcccagatcatggaggtaacagccaagtggctgtggggcttcctctcccgcaataagaagccacggatctgcacccgcgaggagttcacgcggaaggtacgcagcaatgcagcaatcggcgccgtcttcgtggacgagaaccagtggaactccgccaaggaggcggtggaggacgagcggttttgggaccttgtgcaccgcgagcgggagctgcacaagcaggggaaatgcgcgacctgtgtttacaatatgatgggtaagcgcgaaaaaaagctcggggagttcggcaaggcgaagggaagccgggccatctggtacatgtggctgggcgcccgcttcctcgagttcgaggctcttggcttcatgaacgaggaccactggttctcccgggagaactccctgtcaggggtggagggcgaggggttgcacaagcttggctacatcctgcgcgacatcagcaagatcccaggggggaacatgtacgccgacgacaccgccggctgggacactaggatcacggaggacgatctgcagaacgaggcccgcatcaccgacatcatggagccggagcacgccctcctggcgaagtccatattcaaactgacctaccagaacaaggtagtgcgcgtgcagcggcccgccaaaaacgggaccgtcatggacgtgatctcacgcagagaccagcgcggctccggccaggttgggacatacggcctcaacacttttaccaacatggaggcccagcttatccggcagatggagagcgaggggatcttctcacccagcgagctggaaaccccaaacttagccgagcgcgtcctggactggctagagaaatacggcgtcgagcggctcaagcgcatggccatctccggggacgactgcgtggtcaagccgatcgacgaccggttcgctacggccctgacagcgttaaacgacatgggcaaagtgaggaaggacataccgcagtgggagccaagcaaggggtggaacgactggcagcaggtccccttctgttcccaccatttccaccagctcatcatgaaggacggtcgggagatcgtcgtgccgtgtcgaaaccaagacgagctggtgggccgggcccgcgtgagccaaggggccggctggagcttgcgggagaccgcgtgccttgggaagtcctacgcccagatgtggcagctgatgtacttccatcgccgggacctgcgcctcgccgcaaacgcgatctgcagcgccgtgcccgtggattggataccaacctcccggacgacctggagcatccacgcgcaccaccagtggatgaccaccgaggatatgctgtccgtctggaatcgcgtgtggatcgaggaaaacccttggatggaggacaagacgcacatcagctcttggggcgacgttccgtatttagggaagcgcgaggaccagtggtgcggcagcctcatcggcttgactgcgcgggccacctgggcgaccaacatccaggtcgccatcaaccaggtgcgccggctgatcgggaacgagaactacctcgactacatgacctccatgaagagattcaagaacgaaggtgacccggagggcgcactgtggtga

SEQ ID NO: 24132 - RNA, 9879 nt, synthetic construct
  misc_feature 1..9879: note = derived and/or modified CDS sequence (opt11) from DENV-1__FJ410287__SS-prME
  source 1..9879: mol_type = other RNA
agcgtgacgatgctgctgatgttgatgcccaccgccctggccttccacctcaccacccggggcggggagccccacatgatcgtgagcaagcaagagcgtggcaagtccctgctgttcaagaccagcgccggggttaacatgtgcactctcatcgccatggacttgggcgagctgtgtgaggacactatgacctacaaatgccctcggatcaccgagaccgaacctgacgacgtggattgctggtgcaacgcaacggacacctgggtcacctatgggacatgcagccagacgggtgagcaccggcgagacaagcggagcgtggccctcgcgccacacgtgggcctgggcctggagacacggaccgaaacctggatgagctcagagggcgcatggaagcagatccagagggtcgagacatgggccctccgccacccggggttcaccgtcatcgcgctgttcctggcccacgcgataggcaccagcatcacgcagaaggggatcatcttcattctcctgatgttggtaacgccctccatggccatgcggtgtgtcggcatcggcagccgcgacttcgtggaggggctgtccggcgcgacttgggtggacgtcgtgctggagcacgggtcatgcgtgaccaccatggctaaggacaagcccacgctggacatcgagctcctgaagaccgaggtgaccaaccccgccgtgctgcggaagctctgcatcgaagcgaagatctccaacaccacgaccgactcacgctgccccacgcagggcgaagccaccctggtagaagagcaggatgccaacttcgtctgccggcgcaccttcgtggatcggggatggggcaacggctgcggcctgttcggcaaggggtccttgatcacgtgtgccaagttcaagtgcgttaccaaattagagggaaagatcgtccagtacgaaaacctgaaatactcggtgatcgtgacagttcacacgggtgatcagcaccaggttgggaacgagtccaccgagcacggcactaccgctaccattacctcccaggcgcccacgaccgaaatccaactcaccgactacggtgcccttacgctggattgctcaccccggaccggcttagacttcaacgagatggtcctgctgaccatgaaagagaagtcctggttggtacacaagcagtggtttcttgatctgccccttccgtggaccagcggagcgagcacgtctcaggagacgtggaatcggcaagacctgttggtaaccttcaagaccgcccacgccaaaaagcaggaagtggtggtgctcggctcacaggagggagcgatgcacacggccttgactggggccaccgagatccagaccagcggcacgaccaccatcttcgcagggcacttgaagtgccgcttaaagatggacaaactgacccttaagggcatgtcctacgtcatgtgcacggggagcttcaagctcgagaaagaagttgccgaaacccagcacggcaccgtcctggtccaaatcaagtatgagggcaccgacgcgccatgcaaaatccccttcctgactcaggatgagaagggtgtgacgcagaacggtcggctcattaccgcaaaccccatagtgacagacaaggaaaagccagtcaacattgaagccgaaccgcccttcggggagtcctacatcatcatcggcgccggcgagaaggcgcttaaactgagctggttcaagaaggggtccagcatcgggaaaatgttcgaggcaacggcccgcggagccaggcgcatggccatcctgggcgacactgcgtgggatttcgggtccatcggtggcgtgtttaccagcgtggggaaactcgtccatcagatctttggaaccgcctatggcgtgctgttctccggcgtgagctggacgatgaagatcgggataggcgtccttctcacttggctgggcctgaactcccgcagcacatccctcagcatgacctgcatcgccgtagggctcgtgaccctgtacctcggcgttatggtgcaggcagactccgggtgcgtgatcaactggaaaggccgggagctgaagtgcgggagcggcatcttcgtcaccaacgaggtgcacacctggacagagcaatacaagtttcaggcggacagccccaagcgcctgtccgcggccatcggcaaagcctgggaagagggggtgtgcggcattcgtagcgccacccgcctcgagaacatcatgtggaagcagatatccaacgagctgaaccatatcctgctcgagaatgacatgaagttcacagttgtggtgggagacgtcgccggaatcttggcgcaggggaagaagatgattcggccgcagcccatggagtataagtacagctggaagtcctggggtaaggccaagatcatcggggctgatgtgcagaacaccaccttcatcatcgacgggcccaacacgcccgagtgcccggacgaccagcgcgcttggaacatctgggaagtggaggactacggcttcgggatcttcacgacaaacatttggctgaaactccgggacagctacacccaagtctgtgaccaccgcctgatgtccgcggcaatcaaggacagcaaggccgtgcacgccgacatgggctactggatcgagtccgagaagaacgagacctggaagctggcgcgggccagcttcatcgaagttaagacctgcatctggcccaagtcccacaccctctggagcaacggcgtcttggagtccgagatgatcatacccaaaatttacgggggccccatctcccagcacaactaccgcccagggtacttcacccagaccgccggcccctggcatttagggaagctcgagctcgacttcgatctgtgcgagggcactaccgtggtagtcgacgagcactgcggcaaccgggggccctccctcaggaccaccaccgtgaccgggaagatcatccatgaatggtgctgccggagctgcaccctgccccccctgaggttccgcggggaggacggctgctggtatgggatggagatacgccccgtgaaggagaaagaggagaacctcgtcaagtccatggttagtgcaggcagcggcgaggtggattccttctcgctggggcttctctgcatctccatcatcatcgaggaagtcatgcgaagccgctggtcccggaaaatgctgatgaccggcacccttgcagttttcttcctcctgatcatggggcaactgacttggaacgacctcatccgcctgtgcatcatggtgggcgccaacgccagcgacagaatggggatgggcaccacctacctggccctcatggccacgttcaagatgcgacccatgtttgccgtagggctgctattcagaaggttgacctcacgcgaggtgctgctgctcaccattgggctgtcactggtggcgtccgtcgaattgccgaacagcctggaggagctgggcgacgggctcgcgatgggaatcatgatcttaaagttactcaccgactttcagtcccaccaattgtgggcgacgctgctctcgcttaccttcatcaaaacgactttcagtctgcactacgcctggaagacgatggctatggtgcttagcatcgtctccctgttcccactgtgcctcagcaccacctcccagaagaccacgtggctccccgtgctgctcggcagtctgggctgcaagcccctaacgatgttcctcatagcggagaacaagatctggggccggcgctcctggccgctgaatgaggggatcatggccgtgggtattgtcagtatcctgctcagctccctgctgaagaatgacgttcccctcgcagggcccctaatcgcaggcggcatgctgatcgcctgctacgtgatcagcggttcctctgcggacctctcactggagaaagccgccgaggtcagctgggaagaggaggcagagcactccggcgccagccacaacatccttgtggaagtgcaggacgatgggaccatgaagatcaaagacgaggaacgggacgacaccctcacaatcctgctgaaggcgacgctattggcggtttccggcgtgtaccccttgagcatcccggccaccctcttcgtgtggtatttctggcagaagaagaagcaacgctccggggtcctgtgggacaccccctcgccaccggaggtggagcgggccgtgctggacgacggcatctacaggatcatgcaacggggcctgctcgggcgctcccaggtcggagtgggagtgttccaggagaatgtcttccataccatgtggcacgtgacgcggggagcagtgttaatgtaccaggggaagcgcctggagccgagctgggcatctgtcaagaaggacctgatcagctacggcggcgggtggcggctgcaaggctcctggaacactggggaggaagtccaggtgatcgccgtcgagcccggaaagaaccccaagaacgtgcagacggccccggggaccttcaagacgccagagggcgaggtgggggccatcgccctggacttcaaacccggtaccagtggcagccccattgtcaaccgcgaggggaagatcgtgggcttatacggcaatggggtggtcaccacatcaggcacgtacgtgtcggcaatagcccaggccaaggcgtcccaggaaggtcccctgccggagatcgaggacgaggtgttcagaaagcggaacctgaccatcatggacctccaccccggcagcggtaagacccggcgctacttacccgccatcgtccgggaggccattaaacgcaagctgagaacccttatcctggccccgacccgagtggtggcctccgagatggctgaggcgttgaagggcatgcccatccgctatcagaccacagcagtcaaaagcgagcacacgggcaaggagatcgtggacctcatgtgccatgccacgtttaccatgcggctgctctccccagtacgcgttcccaactataacatgatcatcatggacgaggcccacttcaccgacccgagctcaatagccgcgcggggttacatcagcacccgcgttggcatgggggaggccgccgccatcttcatgacggccacgccgcctggctccgtggaggcgttcccccagagcaacgctgtcatccaggatgaggaacgggacatcccagagcgctcctggaacagcgggtatgagtggattaccgacttccctggcaagaccgtgtggttcgtgccctcgatcaagagcggcaacgacatcgccaactgcctccggaagaacggtaagcgcgttattcagctctccagaaagactttcgacacggagtaccagaaaactaagaacaacgactgggactacgtggtgacaacggacatatctgagatgggcgccaacttcagggcggaccgggtcattgacccccgccgctgcctgaagccggttatcctcaaggacgggcccgagcgcgtgatcctggcaggccccatgcccgtcactgtggcctcagccgcccagcggcgcggacggatcggccgcaaccacaacaaagagggcgaccagtacatctacatggggcagccgcttaacaacgacgaggaccacgcgcactggaccgaggccaaaatgctcctggacaatatcaacacccccgagggcatcattcccgctctgttcgagcccgaacgcgagaagtcggccgccatcgatggggagtaccgtctccgcggggaggcccggaagacgttcgtcgaactgatgcgccgcggagacctaccggtgtggctctcctacaaggtggccagcgaggggttccagtatagcgacaggcggtggtgctttgacggggagcgcaacaaccaggtcctagaggagaacatggacgtggagatctggaccaaggagggcgagcggaagaagctgcgcccccggtggctcgacgcccgcacctactccgaccctctggccctgcgggagtttaaggaattcgcagctggccgccggagcgtttccggggacttaatactggagatcggtaagctgccccagcacctcacccagcgcgcccagaacgccttagacaatctggtcatgctccataacagcgaacagggcgggagagcctaccgccacgctatggaagagctgcctgacacaatcgagactctgatgctcctggccctgatagccgtgctcaccggcggggtcacactatttttcctatccggccgggggctcggcaagacctccatcgggctgctgtgcgtcatggccagcagcgtgctcctttggatggcctccgtggagccccattggatcgcggcgagcataatcctggagttcttcctcatggtcctgctgatccccgagcccgaccgtcagcggacgccacaggacaaccaacttgcctacgttgtgatcgggctgttgttcatgatactcactgtagctgccaatgagatgggcctgctggagaccaccaagaaggacctcgggatcgggcacgtggcggtagagaaccatcaccacgctgccatgctggacgttgacctgcaccccgcctccgcttggactctctacgccgtggccaccaccatcataacccccatgatgcgccacacgatcgagaacacaactgccaacattagcctgaccgccatcgccaatcaggcggccatcctgatgggactggacaagggctggccgatctccaagatggacatcggagtgccgctgctggccctcggttgttacagtcaggtcaatcccctgacgctgaccgctgcggtgctgatgctcgtggcccactacgccatcatcggcccggggctacaggctaaggcaacgcgcgaggcgcagaagaggacagctgcgggcatcatgaagaacccgaccgtagacgggattgtggccatcgatctagacccagtggtatatgacgccaagttcgagaagcagctggggcagatcatgctgctcatcctatgcacctcccaaatcttactcatgcgcaccacctgggcgctgtgcgagtcaattacgctcgccacgggcccccttaccaccctgtgggaggggtcgcctggcaagttctggaatacgaccatcgccgtaagcatggccaacatcttccgggggtcctacctggcaggcgcgggtctcgcgttcagcctcatgaagtccctcgggggggggcgccgggggacaggggcccagggagagaccctcggcgagaagtggaagcgccaactgaaccagctgtctaagtctgagttcaacacgtacaagcggtccgggatcatggaggtggaccgcagcgaggccaaggagggcctcaagaggggggagaccaccaaacacgccgtctcccgcggcaccgccaagctgcggtggttcgtggaacgcaacttagtgaagcctgaggggaaggtcatcgacctgggctgcggcagggggggctggtcatactattgcgcagggctcaagaaggtcacggaggtgaaaggctatacgaagggcggacccggccatgaggagcccatccccatggccacctatgggtggaacctggttaagctgcactccggcaaggacgtttttttcatcccgcccgagaagtgcgacaccctcctctgcgatatcggcgaaagctcccccaacccgacgatagaggagggccgcaccctgcgcgtgctcaagatggttgagccatggctccgcgggaatcagttctgtatcaagattctgaacccgtatatgccctctgtggtggagaccctcgagcagatgcagcggaagcacggcggcatgctagtgcgcaaccccctgagcaggaactccacgcacgagatgtactgggtgagttgtgggacgggcaacattgtgagcgccgtcaacatgacgtccaggatgctcctgaaccgcttcaccatggcgcaccgaaagccgacatatgaaagagacgtggacttaggggccggcaccagacacgtggccgtagaacccgaggtggccaacctagacataattggccagcgcatcgagaacatcaagcacgagcacaaaagcacgtggcactacgacgaggacaacccctacaagacctgggcctaccatggctcctacgaggtgaagcccagcggctccgcgtcctctatggtcaacggcgttgttaagttattaaccaaaccctgggacgtaatccccatggtgacccagatcgccatgacggacaccacccccttcggccagcagagagtcttcaaggagaaggtggacacgcgcacacccaaggccaagcgggggaccgcccagataatggaggtgaccgccaagtggctctggggcttcctgtccagaaacaagaaaccgcggatctgcacccgcgaggagttcacgcggaaggtccgctctaacgcagccatcggcgccgtgttcgtggatgagaaccagtggaactccgctaaggaggcggtcgaggacgagcgtttctgggatctggtgcaccgcgagcgggaactccacaaacaggggaagtgcgcgacgtgcgtgtacaacatgatgggcaaacgcgagaagaagctcggggagttcggcaaggccaaggggagccgggcgatctggtacatgtggcttggcgcacgcttcttggagttcgaggcactgggcttcatgaacgaggaccactggttctcccgggagaatagcctgtccggggtagagggcgaggggcttcataagctgggctacatcctgcgtgacatctccaagatccccggcggcaacatgtacgccgacgacactgcggggtgggacacccggatcacagaggatgatctccaaaatgaggcgcgcatcacagacatcatggaacccgagcacgcactgttggcgaagtccatcttcaagctcacctatcagaacaaagtggtgcgcgttcagcggccggccaagaatgggaccgtgatggacgtgattagccgccgggaccagcgcggctctgggcaagtcggcacgtacggccttaacaccttcaccaatatggaggcccagttgatccggcaaatggagagcgaggggatcttcagccccagcgagctcgagacccccaacctggccgagcgcgtactggactggctcgaaaagtacggggtggaacggctgaagagaatggccatcagtggggacgactgcgtcgtgaagcccatcgacgacagattcgcgaccgccctgacagccctcaacgacatgggcaaggtgcgcaaggacatccctcagtgggagccctccaaagggtggaacgactggcagcaggtccccttctgctcccatcatttccaccagctgattatgaaggacggcagggagatagtcgtaccctgccgaaaccaggacgagctggtcggccgtgcacgcgtgtcacagggggccgggtggagcctccgagagaccgcgtgtttagggaagtcctacgcacaaatgtggcagctgatgtactttcaccgcagggacctccgcctggccgccaacgcgatttgcagtgccgtgcccgtcgactggatccccacctcccggacgacctggagcatccatgctcatcaccagtggatgaccaccgaggatatgctgtccgtctggaaccgcgtgtggattgaggagaacccttggatggaggacaagacgcacattagcagttggggagacgtcccctacctggggaagcgtgaagatcaatggtgcggcagtctgatcggcctcactgcccgggctacttgggcgaccaacatccaggtggccataaaccaggtgcgccggttaatcgggaacgagaactacctggactatatgacgtccatgaagcgcttcaaaaacgagggcgacccggaaggcgccctgtggtga

SEQ ID NO: 24133 - RNA, 9879 nt, synthetic construct
  misc_feature 1..9879: note = derived and/or modified CDS sequence (opt11) from DENV-1__FJ432719__SS-prME
  source 1..9879: mol_type = other RNA
tcggtgacaatgctactaatgctcatgcccaccgccttagctttccacctaacaactagagggggcgaaccccatatgatcgtttccaaacaagaacgaggcaagagcttactgttcaaaacctccgcgggcgtaaacatgtgcacacttatagcgatggatctcggtgaactatgtgaggataccatgacgtataaatgccctaggataactgaaactgaaccggatgacgtagactgctggtgcaatgccacggacacctgggtaacatacgggacctgcagccaaacgggtgaacatcggcgggacaaaagatccgtcgccctagcaccgcacgtgggcctaggcctagagacacgcaccgagacatggatgtcttctgagggggcatggaaacaaatccagcgagtcgaaacctgggccctccggcacccgggcttcaccgtgatcgccctattcctagcccacgcaatagggacctcaataactcaaaaaggaatcatctttatactcctgatgctggtgactccgagcatggccatgcgatgcgtagggatcggatcgagagacttcgtagagggactaagcggggcgacatgggtcgacgttgtccttgaacacgggtcttgtgtaacaacaatggccaaggataagcctacgttggatatagagcttttaaagacggaggtaacaaacccagcagtcctgcgaaagctctgcatagaagctaagatatcgaatactaccaccgatagcagatgcccaacacaaggagaagctacattagtagaggagcaagacgctaacttcgtctgccgacgaacgtttgtagaccgtggatggggaaacggatgcggactgttcgggaaggggtcacttataacatgtgcaaagttcaaatgcgtcacaaagctagaaggcaagatcgtacagtacgaaaacctaaaatattcggtgatcgtaacggtacatacaggggatcagcaccaagtcggcaacgaaagcacggaacatgggacgaccgcaaccatcacgccccaggcaccgaccgcagagatacaactcacagattacggagccctaacgctagactgcagcccaagaacaggactagacttcaacgaaatggtgctcctcaccatgaaggagaaaagctggctagtacacaagcaatggttcttagatctaccactaccgtggacaagcggagcaagtacctctcaagagacatggaaccgccaagatttactcgtcaccttcaaaacggcacacgcgaaaaagcaagaagtcgtagtgctagggtcgcaagaaggcgccatgcacacggccctaaccggagccacggagatccaaacatccggcacaactaccatatttgcaggtcaccttaagtgtagactgaaaatggacaagttaacgcttaagggaatgagttacgtgatgtgcactgggtccttcaaactagagaaggaactcgcagagacccagcacggcacggtactcgtacaaatcaagtatgagggaacggatgcgccatgcaaaattccgttctcgacccaggacgaaaagggagtgacacaaaacggcagactgataacggcgaacccgattgtgacggacaaagagaaaccagtaaacatcgaagcagaaccacccttcggggaaagttacattgtaataggcgccggggaaaaagctctcaagctctcttggtttaagaaagggagctccataggtaagatgttcgaagcaaccgcccgaggggcccgccgtatggccatattaggtgacactgcatgggacttcggtagtataggaggggtattcacgagcgtaggaaaactcgtccaccaaatattcggcacagcctacggagtactgttctctggggtgagctggaccatgaaaatcggcataggcgtgctactgacctggcttggcctaaactccagatccacatccctctcgatgacgtgcatagcagtcggattagtgacattgtacctcggagtcatggtccaagccgactcaggctgcgtcatcaattggaagggacgagagctaaaatgcggttcgggaatcttcgtgacaaatgaggtccacacatggacagaacaatataaattccaagcggactcccctaagcgcttaagcgcggcaattggaaaggcctgggaagaaggcgtatgcgggatccgttcagccacacgacttgagaacataatgtggaagcagatatccaacgagctcaaccatatactactggaaaacgacatgaaattcacagtcgtagttggcgatgtcgccggcatattagcccagggcaaaaagatgatccgcccacaaccaatggaatacaagtactcttggaaaagttggggcaaggccaaaataatcggagccgacgtgcagaacacgacttttattatagacgggccgaacactcctgaatgccccgacgaccaacgtgcctggaacatctgggaagttgaggactacgggtttggaatcttcacaacgaatatatggctgaagctccgtgacagttacacccaggtatgcgaccatcgactcatgtccgcggccataaaagactcgaaagccgtccacgctgacatgggatattggattgagtccgaaaagaatgaaacttggaaactagcacgagcatccttcatagaggtaaagacatgcatctggccgaaatcccatacgctatggagcaatggggtgctcgagtccgagatgataatcccaaagatctacggtgggccgataagtcaacacaactaccggccaggatactttacacaaacggccggcccttggcacctcggcaaactggaattggacttcgacctgtgtgaagggacaaccgtagtggtagacgaacactgtggtaaccgaggtcccagcctgagaaccacgacggtcacagggaaaataatccacgaatggtgttgtaggagctgcacactgccacccttgcggttcagaggtgaggacgggtgttggtacggaatggaaatacggcccgtcaaagagaaagaagagaatctagtgaaatctatggtgtcggcagggtcgggagaagtagactcgttcagcctgggcctcttgtgcatctccataatgatcgaagaagtaatgagatcgaggtggtcgcgcaaaatgttaatgacgggcacgctcgcagtattcttcctcttaatcatgggccaattgacatggaacgacctaatacgactgtgtatcatggttggggcaaacgcaagcgaccgcatgggcatggggaccacctacctggcgctgatggccacgttcaaaatgaggccgatgttcgcggtaggactactctttaggcgcctcacctcccgcgaggtcctgctccttacaatcggactatcgcttgtagcctccgtcgaacttccgaatagcctcgaagaactgggcgacgggctggcaatgggcataatgatactaaaactgctcacggacttccaaagtcaccaattgtgggccaccctccttagccttacatttataaagacaactttcagcctccactacgcttggaaaacaatggcgatggtactaagcatcgtctcgctattccccctatgcctgtcgacaacaagtcaaaagacgacctggctacccgtgctactcggttcactagggtgtaaaccactcaccatgtttctgatcgcagagaacaaaatatggggacggcgatcatggcccttaaacgaggggatcatggcggtaggaatagtctccatactactgagctccctcctcaaaaacgatgtgccgcttgcgggacccctcatagcaggaggcatgcttatagcttgctacgtcatatcgggcagcagcgccgacctctccctcgaaaaagcggcggaggtgtcctgggaagaggaggccgagcatagcggagcgtcacacaacatcctcgtggaagtccaggatgacggcactatgaaaatcaaggacgaggaacgcgatgacaccctaaccatcctcctaaaagccacactgctagccgtgtcgggagtatatccgctatccatcccggcgacgttgttcgtttggtacttctggcagaagaagaaacagaggtcgggggtcctatgggacacccccagtccgccggaggtcgaaagggccgtactggatgacggaatataccggatcatgcaacgagggctcctcggacgctcgcaagtaggcgtgggagtcttccaagagaacgtgtttcatactatgtggcatgtgaccaggggcgccgttttaatgtaccaaggaaaacgcctggagccgagctgggcgtcagtcaagaaagacctgatatcctatggaggaggatggcgcttgcaaggctcatggaacacaggagaagaggtgcaagttatagcggtagaacctgggaaaaacccgaagaacgtgcaaaccgcccccggtaccttcaaaacgccagagggagaagtaggagcaatagctctggactttaagcctggaacatcaggcagtccgatcgtaaaccgtgagggtaaaatcgtaggattatatggtaacggagtcgtaacgacctcgggaacatatgtgagtgcgatagcccaggccaaggcgtcacaagaaggaccactaccggaaatcgaggacgaggtcttcagaaaacgaaacctaaccatcatggatcttcacccaggctcaggcaagactagaagatacctccccgcaatagtccgagaagcaatcaaaaggaaactccgcacgctaatccttgcccctactcgggtagtagcttcagaaatggcagaagcactcaaaggcatgccgatcaggtatcaaaccacagctgtcaagagcgagcacacaggcaaggagatcgtcgacctgatgtgccacgctacctttactatgcgactcctctcaccagtccgtgtcccaaattataacatgataatcatggacgaagcgcactttaccgacccctcgagcatagctgcccgagggtacatatctaccagagtaggtatgggtgaagccgcagctatttttatgaccgcaacaccccctgggagcgtggaagcgtttccgcaaagcaatgcggtaatccaagacgaggagcgcgacatacctgaacgatcctggaacagtgggtacgagtggataacggacttccccggcaagacagtctggttcgtgccatctatcaaaagcgggaacgacatagcaaactgcctgcggaaaaacggcaagcgggtgatccagttaagccgaaaaacgttcgacactgaataccaaaagacaaagaataacgactgggactacgtggtcaccacagacatatcagaaatgggggccaacttccgtgcagacagagtaatcgatccgcgccgctgtctaaaaccggtcatcctcaaagacgggcccgaaagggtaatactcgcaggacccatgcccgtaaccgtggctagcgccgcccagcgaagagggcgaatcggcagaaatcacaataaagaaggggaccaatacatatacatgggacaaccgctaaacaacgacgaggaccacgcacattggacagaagcaaagatgctcctcgacaacataaacacccccgagggcataatacccgctttattcgaacccgaacgcgaaaaatcagcggccatagacggcgaataccggctacgaggagaggcccgcaagaccttcgtagaattgatgaggaggggtgacttgcccgtctggctttcctataaggtcgcttccgagggcttccagtatagcgatagacgatggtgctttgacggcgaacgtaacaaccaagtactggaagagaacatggacgtggaaatatggacgaaagagggagaaaggaagaaactacgaccgcgttggctagatgccaggacatacagcgaccctctcgcactaagggagttcaaggaatttgccgcaggccgaaggagcgtaagcggtgacctaatactagaaatcggaaaacttccgcaacacctcacgcaacgcgcacagaatgcccttgacaacctagtcatgctccacaacagtgaacaaggaggccgagcctaccgccacgcaatggaagaactgcctgacaccatagagaccctcatgttacttgctctgatcgcagtcctaaccggcggggtaacattgttctttctctccggcagagggctgggcaaaaccagcataggcttactctgcgtcatggcgtcatcagtcctcctttggatggctagcgtagaaccccactggatcgcagcaagcatcatacttgagttcttccttatggtgctactgatacccgaacccgacagacaacgaacgccccaagacaaccagctggcgtatgtggtaattgggctactattcatgatactaaccgtagccgcgaacgaaatgggtctactagaaacaaccaagaaagacttggggatagggcatgtagccgtcgaaaatcaccaccacgcggcaatgctggacgtagacctccatccagcctcagcgtggacactctacgccgtggctacaaccataatcacccccatgatgcgccacacgatagagaataccacggctaacatatcacttaccgcgattgcgaaccaagccgcaatcttgatgggattggataaaggttggccgatctccaagatggacatcggagtgccgttgttagcactggggtgttactcacaggtaaatcccctcacactgactgctgctgtattaatgctagtagcccactacgcaataattggtccaggcctccaggccaaagccacccgcgaggctcaaaagcgcactgcagcaggtataatgaaaaaccctacagtagacggcatagtggcgatcgacctcgacccagtagtgtacgacgcgaaatttgaaaagcaattgggccaaataatgcttctaatcttatgtacttcccagatcctcctaatgagaacgacatgggcgctgtgcgagagcataaccctagcaactggaccgctgacaacactctgggaaggctcaccaggaaaattctggaacaccacgattgcggtatccatggcaaacatctttcggggctcctacctagcaggagccggactagccttcagcttaatgaaaagcctcggaggagggcggcgaggaacgggagcccaaggcgagaccttgggcgagaaatggaaacggcaactgaaccagctgagtaagagtgagttcaacacatacaagcgatcaggcatcatggaggtagaccgaagcgaagccaaggaaggcctgaaaagaggagaaaccacaaaacacgcagtttccaggggcaccgcaaaattaagatggttcgtggaacgtaacctggttaaaccggaaggcaaagtcatagacctgggatgtgggcgagggggatggagctactactgcgcaggccttaagaaagtgactgaagtcaaagggtacaccaagggtggccccggccatgaagaacccataccgatggcaacatacggatggaacctggtaaagctccatagtggcaaagatgtctttttcattcctcccgagaaatgcgacacactcctatgcgatataggagaatcatcccccaacccgactatagaagaaggcagaacgctcagggtcctgaaaatggtggaaccatggcttcgaggaaaccagttctgcataaagatcctgaacccctacatgcctagcgtagtggaaacgctcgaacagatgcagcgaaagcacggtggaatgctggtgaggaacccgctaagccgaaacagtacacacgagatgtactgggtatcatgtggcacaggcaacatcgtcagcgcagtcaacatgacgtcgcgaatgctgcttaaccgcttcacgatggcgcatcgaaaaccaacctacgagcgtgacgtagacctcggagcaggcacacgccacgtcgcggtcgagcctgaagtggccaacctcgacataatcggccaaagaatcgaaaacataaaacatgaacacaaaagtacgtggcactacgatgaggacaacccatacaagacttgggcctatcatggatcctatgaggtaaaaccctcgggtagcgccagcagcatggtcaacggggtcgtcaaactcctcacaaagccctgggatgtgatacccatggtaacacagatagccatgaccgatactacccccttcggacaacagagggtcttcaaggaaaaggtggatacacgaacacccaaggccaaaagaggaaccgcccagatcatggaagtcacggccaaatggctatgggggttcctctctcgcaacaagaaacccaggatctgtacaagagaagagttcacccgaaaagtacgcagtaacgccgccataggagcagttttcgtagatgagaaccaatggaactcagccaaagaggcggtcgaggacgaaaggttttgggacctagttcatcgcgaacgagaactacataaacagggcaagtgcgccacctgtgtctataacatgatgggtaaacgtgagaaaaagctaggtgagttcggcaaagcaaaaggttccagagccatatggtacatgtggctcggggcaagatttttggagttcgaagcactaggttttatgaacgaagaccattggttttcccgggaaaatagcctatcgggggttgaaggagagggactacacaagctaggatatatactgagagacatatccaaaataccgggcggtaatatgtatgccgacgacacggccggatgggacacacgcatcacggaagatgacctacagaacgaggcccgaataaccgacatcatggaacccgaacacgccttgttagcaaagagcatattcaaactaacataccaaaacaaggttgtcagagtccaaagaccggccaagaacggcaccgtcatggacgtcatatctcgccgagaccaacgcggttcaggccaagtaggaacgtacgggctcaacacatttactaacatggaagcccaactaatccggcagatggaaagtgaagggatattcagtccctcagagttagaaacaccaaacctggcagaacgcgtactcgattggcttgaaaagtacggtgtagagcgactaaaaaggatggccatatcgggtgacgactgcgtagttaagccaatcgatgacagattcgcaacggccttgacagcgcttaatgatatgggaaaagttagaaaagacattccacagtgggaaccttccaaagggtggaatgactggcaacaagttccattctgctcacatcacttccaccagctgattatgaaagacggaagggaaatagttgtgccctgtcgcaatcaagacgagttagtcgggcgggccagagtctctcagggggcaggctggagcctacgagaaacagcgtgtctaggtaagtcgtacgctcaaatgtggcaactaatgtacttccacagacgcgaccttcgactcgccgcaaacgccatatgttccgccgtacccgttgattggataccaacgtcccggacaacctggtcaatacatgcccaccaccagtggatgacgaccgaagatatgttatcggtatggaaccgcgtttggattgaggagaacccgtggatggaagacaaaacacatatcagcagctggggagacgtgccatatctcggaaaacgggaggaccagtggtgtgggagcttgatcggactaacggcccgggccacgtgggccacaaacattcaggtcgcaatcaaccaggtacgcaggctaataggtaacgaaaattatttggactacatgaccagcatgaaaaggttcaaaaacgagagcgaccctgagggagctctatggtaa

SEQ ID NO: 24134 - RNA, 9879 nt, synthetic construct
  misc_feature 1..9879: note = derived and/or modified CDS sequence (opt11) from DENV-1__FJ182020__SS-prME
  source 1..9879: mol_type = other RNA
tcggtgaccatgctgctcatgctgatgcctacagccctggcatttcacctcacaacccggggcggggaaccccacatgatcgtgtcgaagcaggaacggggcaagagcctgttgttcaagaccagtgccggggtgaacatgtgcactctcatcgccatggaccttggggagttctgcgaggacacgatgacttataaatgcccccgaatcactgaggccgagcctgatgatgtggattgctggtgcaacgccaccgacacgtgggttacctacgggacatgctcccagacgggggagcatcgtcgggacaagagatcagtggccctggcgccccacgtcggcctcgggctggaaacccgcaccgagacgtggatgagcagcgagggtgcatggaagcagatccagcgggtggaaacgtgggcgctgcgccaccccggatttacggtgatcgccctcttcctggctcacgccattggcacctcaatcacacagaaagggataatcttcatcctgctcatgttagtgacgccctccatggccatgcggtgcgtcggcatcggttctcgcgactttgtggaggggctgtccggagccacgtgggtggacgtggtgctcgagcacgggtcctgtgtgaccaccatggccaaggacaagcccaccctggacatcgagttgctgaagacggaggtaaccaaccccgcggtcttaaggaaactttgcatcgaggcgaaaatctccaacactaccaccgacagccgctgcccaacccagggcgaggccaccctcgtcgaggagcaggatgcgaacttcgtttgccggcgcaccttcgtggatcggggctgggggaacggatgcgggctgttcggcaaggggagtcttatcacgtgcgccaagttcaagtgtgtgaccaagctcgagggcaaaattgtccagtacgagaacctcaagtacagcgtcatcgtcaccgtccacaccggtgaccaacatcaggtgggcaacgaatccacggagcacgggaccaccgcgaccatcacgccccaggccccaagtacggagatccagctgaccgactatggcgccctcaccttagactgcagcccccggaccggcctggacttcaacgaaatggtgctcctgacgatgaaggagaagtcctggctggtgcataagcagtggttcctcgacctaccgttaccctggaccagcggtgcttcaacctcacaggagacctggaaccggaaagaccttctggtaacatttaagaccgcccacgcgaagaaacaggaggtagtggtgctgggttcccaggaaggagccatgcacacagctctaacaggggcaacggagatccagaccagcggcactactacgatttttgccgggcacctgaaatgccggctgaaaatggacaagctcaccctgaagggcatgtcctacgttatgtgcaccgggagcttcaaactggaaaaggaggtggcggagactcagcacggaacagttttagtccagattaaatacgaaggaaccgacgccccctgcaagatccccttctccacccaggatgaaaagggcgttacccagaacggacgtttgatcactgccaacccgatcgtgacagacaaggagaagccggtcaatatagaggccgagccgcccttcggggagagctacatagtgatcggcgcaggcgagaaggcattgaaactttcgtggttcaagaagggttctagcatcggcaagatgttcgaagccaccgcccgaggcgcgcggcgcatggcgatactcggcgacaccgcctgggacttcgggagcatcggaggcgtattcacgagtgtcgggaagctggttcaccaaatcttcgggaccgcctacggggtactgttcagcggcgtctcgtggacgatgaagatcgggatcggcgtgttgctaacctggctggggctcaactcgagatctacctcgttgtccatgacttgcatagccgtggggctggtcacactctacttaggcgtgatggtgcaggccgacagcggttgtgtcatcaattggaaggggagggaattgaagtgtgggtcaggcatcttcgtgaccaatgaggtgcacacgtggacagaacagtataagttccaggctgactcccctaagcgcctttcggcggcaatcggcaaggcctgggaagagggcgtctgcggcatacggtccgcgacacgtcttgagaacatcatgtggaaacagataagcaatgaacttaaccatatcctgctggaaaatgacatgaagtttaccgttgtggtcggtgatgtggcgggcatcctcgcccagggaaagaagatgatccggccccaaccaatggagtacaagtattcctggaagtcctggggcaaggcaaagattataggcgcggacgtacagaataccacgttcatcatcgacgggccaaacacaccggagtgtccggacgatcagcgcgcgtggaacatatgggaggtcgaagactatggattcggcatcttcaccacaaacatctggctcaagctgcgggactcgtacacacaggtgtgcgaccaccgcctgatgagcgcggccatcaaggactctaaggccgtccacgcggacatgggctactggatcgagagcgagaagaatgagacctggaagctcgcgcgggcctcctttatcgaggtaaagacctgcatctggcccaagagccacaccctgtggtcaaacggggtgctagagagcgagatgatcatcccgaagatctatgggggcccaatctcgcagcacaactaccgcccagggtatttcacgcagacggcgggtccctggcacctcgggaagctggagctggattttgacctctgcgagggaacgaccgtggtcgtggacgagcactgcggcaaccggggaccgagccttcgcacgaccaccgtaaccggcaagatcatccacgagtggtgctgccggtcctgcacgctgccacccctccgcttcaagggggaggacggatgctggtacggcatggagatacgcccagtcaaggagaaagaggagaacctagtcaagtcgatggtgagtgccggctccggcgaggtcgactcgttctccctggggttgctgtgcataagcataatgatagaggaggtcatgaggtcccggtggagccggaaaatgctgatgaccggcactctcgccgtattcttcctcctcataatggggcaacttacctggaacgatctgattcgactgtgcatcatggttggcgccaatgctagcgaccgcatgggtatggggacgacataccttgccctgatggccaccttcaagatgcgcccgatgttcgccgtgggactcctgttccggcggctgacctcgagagaagtcttgctcctgacgattgggttgagcctggtcgcaagcgtggagctgcccaactccctggaagaactcggcgacggactggccatgggcatcatgattctgaagctgctaacggatttccagagccaccagttatgggctaccctcctgtccctgaccttcattaagacaaccttcagcctccattatgcctggaagaccatggcgatggtactctccatcgtgagcctcttcccgctctgcctgagcaccactagccagaagactacctggctgcccgtattactgggctccttggggtgcaagcctttaaccatgtttctgatcgcggaaaacaagatctgggggcgcaagagctggccgctaaacgaggggatcatggccgtcggcatcgtgagcatcctcctgtccagcctgctaaagaacgatgtcccactcgctgggcccctgattgcgggcggcatgttaatcgcgtgttatgtgatatccgggagctcggccgatctatcgctggagaaggccgccgaggtgtcctgggaggaagaggccgaacactccggcgcgtcgcataacatactcgtggaggtccaggacgacggtacgatgaagataaaggacgaagaacgggacgacacgctgacaatcctactgaaagcgacactgctggccgttagcggcgtgtatccactctcgatcccggccaccctgttcgtctggtacttctggcagaagaagaagcagcgtagcggcgtgctgtgggatacgccctcgcccccggaggtggaacgcgccgtcctcgatgacggcatctaccgcatcatgcagcggggcttactggggcgcagccaggtcggggtgggagtcttccaggaaaatgtgttccacaccatgtggcacgtgacccggggcgcagtcctgatgtatcaggggaagcgtctcgagccctcctgggccagtgtgaagaaggacctgatctcctacggcggagggtggcggctccagggcagctggaacacaggggaagaggtgcaggtcatagccgtggagcctggcaagaaccccaagaacgtgcagactgcccccgggacgttcaagacttccgaaggggaggtgggcgccatagcgctggacttcaagcccgggacctctgggagcccaatcgtgaaccgcgagggcaagatcgtgggcctgtacggcaacggcgtcgtgacgacttcggggacctatgtgagcgccatagcccaagcaaaggcgtcccaagaggggccactgcctgagatagaagatgaggtctttcggaagcgcaacctcaccatcatggacctacaccccgggagcgggaagacgaggcgctacctccccgcgatagtccgggaggccatcaagaggaaactccggactctgatcttggcgccgacccgcgtggtcgcctccgagatggcggaggcgctcaaagggatgcccatccgctaccagaccacggccgtgaagagtgagcacaccggaaaggagatcgtcgatctgatgtgtcatgccacgtttaccatgcggctcctgtcccccgtcagggtacccaactacaacatgatcatcatggacgaggcccacttcacagaccctagctcaatcgcagcacggggttatatcagcacccgggtgggcatgggggaggccgccgctatttttatgaccgcgacacccccaggctccgtggaggccttcccccagagcaatgcagttattcaagacgaggaacgggatatccccgaaaggtcctggaactcggggtacgagtggatcacagacttccccggaaagaccgtatggttcgtcccctccatcaagtcggggaatgatattgcaaactgcctgaggaaaaacggaaaacgcgtaatccagctcagccggaagaccttcgacaccgaataccagaaaacgaagaataacgactgggactacgtcgtcacaacggacatttcggagatgggcgcgaacttccgcgctgaccgggtgatagaccccaggcggtgcctcaaaccggtgattctgaaagacggtcccgagagagttattctagctggccccatgcctgtgaccgttgccagtgccgcccagcggcgaggtcggatcggcaggaaccacaacaaggagggcgatcagtatatctacatggggcaaccgctaaataacgacgaggaccacgcgcactggacggaggcgaagatgctgttagacaacataaacacccccgagggtatcattcccgcactattcgagcccgagcgggagaaatccgccgcgatcgacggggagtaccgcctgcgcggcgaggcacgcaagaccttcgtggaactgatgcgccgcggggatttaccggtgtggctgtcatacaaggtagccagtgagggcttccaatatagcgaccgccggtggtgcttcgacggagagcggaacaatcaggtgctggaagagaacatggacgtggagatctggaccaaggagggggaacggaagaagttgaggccccggtggctggacgccaggacgtactccgaccccctggccctcagagagttcaaggagttcgcggccggccggaggagcgtctccggggacctgatactagagatcgggaagctaccccagcacctgacacaacgcgcgcaaaacgccctggacaacctcgtgatgctgcacaacagcgaacaaggcggacgcgcgtaccgccacgccatggaagaactgccggatacaatcgagaccttgatgttactagctctaattgcggtacttactggcggtgtcactctgttcttcctatccggccggggacttggcaagaccagcataggactgctctgcgttatggcctcctctgtgctactgtggatggcgtccgtcgagccgcactggatagcggctagcatcatcctcgagttcttcctgatggtgctgctcatcccggagcccgatcgacaacggaccccgcaggacaaccagctggcatatgtggtcatcgggctcctgttcatgatcctgaccgtggccgcgaacgaaatgggcctgctcgagacgaccaagaaagacctggggataggccacgtggccgtggagaaccatcatcacgccgccatgctggacgtggacctccatccagcttccgcatggaccctgtacgccgtggccactacgataatcacgcccatgatgcgccacaccatcgaaaacacgacggccaacatatcactgactgctatcgcgaaccaggcggcgatcctaatgggtctcgacaagggctggccgatctccaagatggacatcggagtccccttgctggccctggggtgctatagccaggtgaaccctctgacccttaccgcggccgtgctgatgctggtcgcccactacgccattataggccccggccttcaggctaaagcgacgcgggaagcacagaagcggactgccgcaggcatcatgaagaatcccaccgtcgatggaatcgtagcgatagacctggaccccgtcgtgtatgacgcgaagttcgagaagcagctaggccagatcatgctcctcatcttatgtacaagtcagatcctactgatgcgtacgacgtgggcactgtgtgagagcatcaccctcgccaccggccccctgacgaccttgtgggaagggtcccccggtaagttctggaataccaccatcgccgtgagcatggcaaacatcttcagagggagctacctcgcgggcgcgggccttgccttctccctgatgaaaagcctaggagggggaagacgagggactggggctcagggcgagaccctgggcgagaagtggaagcgccaactgaaccaactctccaagtcagagttcaacacctacaagcggtccggcatcatggaggtcgatcgttccgaggcaaaggagggcctgaagcgcggggagaccaccaagcacgccgtcagtcgcggcaccgcgaagctgcggtggttcgtggagcgcaacctcgtcaagccggagggcaaggttatagacctggggtgtggccgcggcgggtggtcctactactgtgctgggctaaagaaggtgactgaggtgaaaggctacaccaagggcggcccgggccacgaggaaccgattcccatggccacatacgggtggaacctggtgaaattacactccggcaaagacgtgttcttcattccgcccgagaagtgtgacacgctgctttgtgacataggggagtcttcccccaaccctaccatcgaggaaggaaggaccctgagggtcctgaagatggtggagccgtggttacgtggcaaccaattctgtatcaaaatcctaaacccttacatgcccagcgtggtcgagaccctggagcagatgcagcggaagcacgggggcatgctggtgcgaaaccccctctcccggaacagcacccatgaaatgtactgggtgtcatgcggaaccggcaatatcgtaagtgcggtgaatatgacctcccgaatgctgctaaaccggttcacgatggcccacagaaagccgacgtatgagcgcgacgtggacctcggggccggtacccggcacgtcgcggttgagcctgaggtagccaacctggacatcataggtcagcgcatagagaacatcaaacacgagcacaagagcacttggcactacgacgaggacaatccctacaagacctgggcataccacgggagttacgaggtcaaacccagcggcagcgcatccagtatggtgaacggggtcgtgaaactgcttacgaagccgtgggacgtcatccccatggtgacccagatcgccatgaccgacaccacaccctttggccagcagcgggtgttcaaagagaaggtagatacccgtacgcccaaggccaagcgggggacagcccaaatcatggaggtgaccgcgaagtggctgtggggcttcctttcgcggaacaagaagccgcggatctgcacccgcgaggagtttacccgcaaggtgcgcagcaacgccgctatcggtgccgtgttcgtcgacgagaaccagtggaactccgcgaaggaggccgtcgaggacgagcggttctgggaccttgttcaccgcgagcgggagttgcacaagcaggggaagtgcgcgacgtgcgtctacaatatgatgggcaagcgcgagaagaagctgggggagttcggaaaagcgaagggctcccgggccatctggtacatgtggctgggcgcgcgcttccttgagttcgaggccctgggcttcatgaatgaggaccactggttctcgagggagaatagcctaagtggggtggagggcgaagggctgcacaagctgggctacatcctacgcgacatcagcaagatccccgggggcaatatgtatgccgacgacacggccggctgggatacacggataaccgaggacgatctgcagaacgaggccaagataactgacatcatggagccagagcacgccctgctggcgaaatccatcttcaagctgacttaccagaacaaggtggtccgcgtgcagcggccagccaagaacggtaccgtcatggacgtcatcagccgccgcgatcagcgaggcagcggccaggtgggcacctatggcttgaacacctttactaatatggaggcccaactcatccgccaaatggagagcgaggggatcttcagtccttctgagctggaaacccccaacttagccggccgtgttctcgactggctggagaagcatggggtcgagcgtctgaagcggatggcgatctcaggcgacgactgcgtggtgaaacccatcgatgaccgctttgccaccgcccttacggctttaaacgacatgggcaaagtccggaaagatatcccccagtgggaacccagcaagggctggaacgattggcagcaggtccctttctgctcccaccacttccaccagttgattatgaaggatggtcgagaaatagtggtaccctgtcgcaaccaggacgagctggtggggcgcgcacgggtgagccaaggcgcgggctggagcctgcgcgagacggcctgtctggggaaatcctacgcccagatgtggcagttaatgtacttccaccggcgcgacctccggttggccgcgaacgcaatctgtagcgccgtgccggtagactgggttcctacctcccgcacaacctggagcattcacgcacatcaccagtggatgacgaccgaagacatgctctccgtgtggaacagggtgtggatcgaggagaacccgtggatggaagacaagacccacatcagctcctggggagacgtgccctacctgggcaagcgcgaagatcagtggtgcggcagcctgatcgggctcaccgctcgggcgacgtgggccaccaacatccaggtcgcgataaaccaagtgcgtcggctgatcggtaacgaaaactacctagactacatgacgtccatgaagcggtttaaaaacgagagcgatccggagggggccctctggtga

SEQ ID NO: 24135 - RNA, 9879 nt, synthetic construct
  misc_feature 1..9879: note = derived and/or modified CDS sequence (opt11) from DENV-1__FJ182022__SS-prME
  source 1..9879: mol_type = other RNA
tcggtgactatgttgttgatgttgatgcccaccgccctagcctttcacctaacgacccggggcggggaaccccatatgatcgtaagcaagcaggagcggggcaagagcttattatttaagacctctgcaggggtgaacatgtgcaccctcatcgctatggatctgggcgagctgtgcgaggacacgatgacctacaagtgcccacgcatcaccgagaccgagcccgacgatgtggactgctggtgcaacgccacggatacctgggtgacctacggcacctgcagtcagacgggtgaacaccggagagacaagcggagtgtggccctcgcgccccacgttggcctgggtttggagacccgcaccgagacctggatgagctccgagggcgcatggaagcagatccagcgggtcgagacatgggcgctccgacatcccgggtttacagtgatcgccctcttcctggcccacgccatcggcaccagcatcacccagaaagggattatcttcatcttactgatgctggtcactccctctatggccatgcggtgcgtcggtatcggtagccgcgacttcgtggaggggctctccggggcaacctgggtggacgtagtgctggaacacgggtcgtgcgtaaccaccatggccaaggacaagcccacgctggacatcgagctcctgaagacggaggtcaccaacccagctgtgctacggaagctctgtattgaggcgaagatatccaatacgacgaccgactctagatgccccacccagggcgaggccacccttgtggaggagcaggatgctaacttcgtctgccggcgaacgtttgtcgaccggggttgggggaatggctgcgggctgttcggcaaggggtcgctaatcacgtgtgcaaagttcaagtgcgtgaccaagctggagggcaaaattgtccagtacgagaacctgaagtacagcgtaattgtgaccgttcatacgggcgaccagcaccaggtagggaacgagtccaccgagcatgggaccacagctaccatcacgcctcaggcgcccaccacagagatccagctcacagactacggggccctgacgctagattgcagccctcgcactgggttagatttcaacgaaatggtgttactgaccatgaaagagaagtcctggctggtccacaaacagtggtttctcgacctgcctctgccctggacctccggagccagcacgtcccaggagacctggaaccggcaggatctgctcgtcacctttaagaccgcccacgccaagaaacaggaggtagtggtgttaggcagccaggagggtgcgatgcacactgccctgaccggggcgaccgagattcagacgtccggcacgaccaccatcttcgccggccacctgaagtgccgcctaaaaatggacaagctgacccttaggggcatgagctacgttatgtgtactgggagctttaagctcgagaaggaggtggccgagacccaacacggcacagtactggtccagatcaagtacgagggcaccgacgcaccctgcaagatccccttttctacgcaggacgagaagggggtgacccagaacggccgcctgatcaccgccaacccgattgtcaccgacaaagagaagcccgtcaatatcgaggctgagccgcccttcggagagtcctatatcgtgatcggcgccggcgaaaaggcgctgaagctcagctggtttaagaagggctccagcataggtaaaatgttcgaggccacggcccgcggcgccagacgtatggcgatcctgggcgacaccgcatgggactttggatccattggcggggtgttcaccagcgtcgggaagctggtgcaccagatcttcggcacagcctatggggtgctgttctccggcgtctcttggacgatgaagattggaatcggtgtgttactgacttggctgggactgaattcccggtccacatcactcagcatgacctgcatcgccgtggggctcgtaacgctgtatctgggcgttatggtccaagccgactccgggtgcgtcatcaactggaagggccgggagctcaaatgtggaagcggtatcttcgtgaccaacgaggtgcacacctggaccgagcagtataagttccaggccgacagcccgaagcggctgtcggcggctatcggtaaggcctgggaggagggggtctgcggcatccgtagcgcgacccgactcgagaacatcatgtggaagcagatctccaacgagctcaatcacatactgctggagaacgacatgaagttcacggtagtggtcggggacgtggccggcatcctcgcgcaagggaagaagatgatccgcccccagcccatggagcacaagtacagctggaagtcctggggcaaggcaaagataatcggtgccgacgtgcagaacaccacgttcatcattgacgggccaaatacgccggagtgccccgatgaccagcgcgcctggaatatttgggaagtcgaggactacggcttcgggatattcaccaccaacatctggctgaaactgcgcgacagttacactcaagtgtgcgatcaccgcctcatgtcagcggccatcaaggacagcaaggctgtgcatgcagacatgggctactggattgaatccgagaagaacgaaacctggaagctggcccgcgcgtcttttatcgaggtcaagacatgcatctggcccaagtcccacaccctgtggagtaatggcgtgctggaatcggagatgatcatcccaaagatctacgggggtccgatcagccagcacaattaccggcccgggtacttcactcagacggccggcccctggcacctgggcaagctggagttagacttcgacctgtgcgagggcacgacggtggtggtggacgagcactgcggtaatcgcggtccgtccctgcggaccacaacggtgaccggcaagatcatccacgagtggtgctgccgctcatgtaccctgccgcccctccggttccgcggggaggatggctgttggtacgggatggagatccggcccgttaaggagaaggaggagaacctggttaagtccatggtaagcgccggctcgggagaggtcgactccttcagcctcggtttgttatgcatctccattatgatcgaagaggtgatgcggtcgcggtggagtcgtaagatgctcatgaccggcacgctagccgtgttttttctgctcatcatggggcagttaacctggaacgacttaattcgcctctgtataatggtaggtgcgaacgcgagcgatagaatggggatggggaccacctatctggctctcatggccacgttcaagatgcgcccgatgttcgccgtgggactcctgtttcgacgcctgacctcccgggaggtgcttctgctgacgatcgggctgagcctggtcgcctccgtggagctgcccaacagccttgaagaactgggggacgggctggcgatgggtatcatgatcctcaaactgctgaccgacttccagagtcatcagctctgggccacgcttctgagcctcaccttcataaagaccacgttctcccttcactacgcctggaagacgatggccatggtcctgagtatcgtttccctgttccccctgtgcctgtccacgacctcccagaagaccacgtggctccccgttctgctgggcagcttgggatgcaagccgctgactatgttcttaattgcggagaacaaaatctggggtcggcggtcctggcctctcaacgaggggatcatggcagtaggcatcgtgtcgatcctgttgagctccctcctgaagaatgacgtgcccctggccgggccactaatcgctggcggcatgctgatcgcctgctacgtcatcagcgggtccagcgctgacctatccctcgagaaggctgccgaggtgagctgggaggaggaggccgagcacagcggagccagccacaatattctggtggaggtccaggacgacggtaccatgaaaatcaaggacgaggagcgcgacgacaccctaaccatcctactgaaggcgacgctgctcgccgtgtctggcgtgtacccactgagcatccccgccaccctgttcgtatggtacttctggcagaagaagaagcagcggtccggggtgctctgggacaccccttcgccgcccgaggtggagcgagcagtcctggatgacggcatctatcgaatcatgcagcgcggcttactggggcggtcccaggttggcgtgggggtgttccaagagaatgtgttccacaccatgtggcacgtgacgcgcggcgccgtcctcatgtaccaggggaaacgtctggagccctcttgggcgtccgtgaagaaggatctgataagctacggaggcgggtggagactccagggctcttggaacactggggaggaggtgcaagtaatcgccgtggaacccggcaagaacccaaagaacgtgcagaccgctccagggacattcaaaacacccgagggtgaggtcggcgccatcgccttagactttaaacccgggacctcgggctcccccatcgtgaaccgggaggggaagatcgtaggcctgtacggaaacggggtcgtgaccaccagcggcacgtacgtgagcgcgatcgcacaggccaaggcctcgcaagaggggccgctccccgagatcgaagatgaggtctttcgcaaacgcaacctgaccatcatggacctgcaccccggcagcgggaagaccaggcggtacctcccggctatagtccgcgaagcgattaagcgcaaactgaggaccctgatcctcgcccccacgcgcgtggtcgcttcagagatggccgaagcgctgaagggcatgcccatccggtaccagacgacagccgtgaagagcgagcacaccggcaaagagatcgtggatcttatgtgccatgctactttcacaatgcgcctcctgtccccagtaagagtgcctaattacaacatgatcatcatggatgaggcgcacttcaccgacccgagttcaattgcagcaagaggatacatcagcacacgggtgggcatgggtgaggccgctgccatcttcatgacggccacgcccccaggttccgtcgaggcgttcccgcagagcaacgccgtgatccaggacgaggagcgcgacattccggaacggtcttggaacagcggctacgagtggattaccgacttcccaggtaagaccgtttggttcgtacccagtatcaagagcgggaatgacattgctaactgcctgcgcaagaacgggaagcgcgtgatacaactctcgcgaaagactttcgacaccgagtaccagaagaccaagaataacgactgggactatgtcgtcaccacggacataagcgagatgggcgccaacttccgggctgaccgcgtgatagatccgcggcgctgcctgaagcccgtgatcctgaaagacggacccgaacgggtcatcctcgccggcccaatgccagtgaccgtggcctccgcagctcaacggcgggggcgcatcggccggaatcacaacaaggagggcgaccagtacatttatatggggcagcccctaaataacgacgaggaccacgctcactggaccgaggccaagatgctgctcgacaacattaacacccccgagggcatcatcccggctctgtttgagccggagcgcgagaagtccgccgccatcgacggggagtaccgcctccgtggggaagcaagaaagacgtttgtggaactaatgcggcgcggggatttgcccgtgtggctgtcctataaagtcgccagcgagggcttccagtacagcgaccggcgctggtgcttcgacggcgagcggaacaaccaagtgttggaggagaatatggacgtggagatctggaccaaggagggagagcgcaagaagctgcggccccgctggctggacgcccggacctactccgacccgctcgccttgagggagttcaaggaattcgccgcgggccggaggagcgtctccggggacctgatcctcgagataggcaagcttccgcagcacctgacccagcgggcccagaacgccctagacaaccttgtgatgctgcacaacagcgagcagggcgggcgcgcttatcggcacgcgatggaagagctccccgacacgatcgaaactctgatgctgctcgccctcatcgccgttctgactggcggggtcaccctcttcttcctatccggccgagggctgggcaagaccagcatcggcctcttatgcgttatggcctcaagcgtgctgctctggatggcctccgtcgagccccactggatcgcggccagcataatcctggaatttttcctgatggtgctgctgatccctgagccagaccggcagcgcacgccccaggacaaccagttggcctacgtggtcatcgggctcctgttcatgatattaaccgtggccgccaacgagatgggcttactagagacgaccaagaaggacctggggatcggccacgtagcggtcgagaaccaccaccacgccgccatgctggatgtggacctgcacccagccagcgcgtggacgctgtacgcggtggcaaccaccatcatcacccctatgatgcgccacacgatcgagaacaccaccgccaacatctctctcaccgccatcgccaaccaagcggccatcctgatgggactggacaaggggtggcccatctccaaaatggacattggcgtgcccctcctggccctggggtgctatagccaggtgaaccccctcacgctgaccgccgcggtgctgatgctcgtcgcacactacgcaatcattggtccgggactgcaggccaaagccactcgggaagcgcagaaacgcactgccgccggcatcatgaagaaccctaccgtggacggaatcgtggccatcgacctggatcccgtcgtttacgacgccaagttcgagaagcagctcggacagatcatgttactgatcctctgcacatcccagatcctgctgatgcggacgacatgggcgctctgtgagtccatcacgctggccactggcccgctgaccacattgtgggaggggtctccgggcaagttttggaacaccaccatagcagtgtccatggcaaacatcttccgggggtcctacctggcgggcgctggcctggccttcagcctcatgaagtcccttgggggcgggcggcgcgggaccggggcccagggcgagactctgggcgagaagtggaagcggcagcttaatcaactgtcaaagagcgaattcaacacgtataaacgctccggaatcatggaggtggatcgcagcgaggcgaaggaaggtctgaagcgcggtgagaccacgaaacatgcggtgtcccgggggaccgccaagttgcggtggttcgtcgagcggaacctggtcaagcccgaaggaaaggtgatcgacctgggctgcggccgcggtggctggagctactactgcgccgggctgaagaaggtgacggaggtcaagggctataccaagggcggccccgggcatgaggagcccatcccaatggctacctacggttggaatctcgtgaagctgcactccggcaaggacgtgttcttcatcccaccggagaagtgcgataccctgctctgtgacatcggggagagctcccctaacccgaccatcgaggaggggcggaccctgcgagtattaaagatggtggagccctggctccgggggaaccagttctgcattaagatcctgaacccctatatgcccagcgtggtggagaccctggagcagatgcaacgcaaacacggaggtatgctagtgcggaaccctttgagccgcaacagcacacacgagatgtactgggtgtcatgtgggaccggcaacatcgtgagcgccgtgaatatgacatcccgcatgctactgaacaggtttaccatggcacaccgtaaacccacatatgagcgggacgtggacctgggggccggcacccgccacgtggccgtagagcccgaggtagccaaccttgacatcataggccagcgaatcgagaacatcaagcatgagcacaagagcacttggcactatgatgaggacaacccctacaaaacctgggcctaccacgggagctacgaggtcaagccttctggctccgcgagtagcatggtgaacggagttgtgaaactcctgaccaagccatgggacgtgatccccatggtaacccagatcgccatgacggacaccacacccttcggccagcagcgagtctttaaggagaaggtcgacactcggacgcctaaggccaagcgggggacagcccagatcatggaagtcaccgccaagtggctgtggggtttcttaagtaggaacaagaagcctcgcatctgtacccgggaagagttcacacgaaaggtccggtctaatgcggcaataggagcagtattcgttgacgaaaaccagtggaacagtgccaaggaagcagtggaggacgagaggttctgggacctggtgcaccgggagcgcgagctgcacaagcaggggaagtgcgctacttgcgtttacaacatgatgggcaagcgggagaagaagctcggggagttcggcaaggccaaggggagccgcgcaatctggtatatgtggctgggtgcccggtttctggagttcgaggcgctcggcttcatgaacgaggaccactggttctcgcgcgaaaattctttgtccggagtggagggcgaggggctgcacaagctcggctatatcctgcgggacataagcaagatccccgggggcaacatgtacgccgatgacaccgcgggctgggacacccgaataacggaagacgacctacaaaacgaggcccgcatcaccgacataatggagccggagcatgccctcctagcgaaatcaatcttcaagctgacctatcagaacaaggtggtcagggtgcaacgtccagcgaaaaacgggactgtgatggacgtcatcagcaggcgagatcagcggggctcaggccaggtgggcacgtacggcctcaacaccttcaccaacatggaggcccagctgatcagacagatggagtctgaagggatcttcagcccctctgaattggagacccccaacctcgccgagcgggtgctggattggctggagaaatacggagtcgagcgcctcaagcggatggcaatcagtggagacgactgtgtggtgaagccgatcgatgacaggttcgcgacggccctgactgccctgaacgacatgggaaaggtacggaaggatatcccccagtgggagcccagcaagggttggaacgactggcaacaggtccccttctgttcccaccacttccaccagctcatcatgaaggacggccgcgagatagtggtcccgtgtaggaaccaggacgaactagtgggtcgcgcccgggtcagccagggggccggctggagcctgcgcgagaccgcgtgtctcggcaagagttacgcccaaatgtggcaactgatgtacttccacagacgcgatttaagattagccgccaacgcgatctgcagcgccgtccctgtggactggatccccacctcccgtacgacttggagcattcacgcccaccatcagtggatgaccaccgaggacatgctatccgtatggaacagggtctggatcgaggagaacccctggatggaagacaagactcacatcagctcctggggcgacgtgccgtacctagggaagcgggaagaccagtggtgcggcagcctcatcggcctgacagcccgcgccacctgggcgacaaatatccaggtggctattaaccaggtccggcgcttaatagggaatgagaactacctcgactacatgaccagcatgaaacggttcaagaacgaaagcgacccggagggcgccctttggtga

SEQ ID NO: 24136 - RNA, 9879 nt, synthetic construct
  misc_feature 1..9879: note = derived and/or modified CDS sequence (opt11) from DENV-1__FJ024447__SS-prME
  source 1..9879: mol_type = other RNA
agcgtgaccatgctgctgatgttgatgcccaccgccctggccttccacctcaccacgcggggcggggagccacacatgatcgtgagcaagcaggagcggggcaaaagcctgctgttcaagacctcggccggggtgaacatgtgcacgctcatcgccatggaccttggcgagttatgcgaggataccatgacgtacaaatgtccccgcataacagagacagagcctgacgacgtggactgctggtgcaatgcgacggacacctgggtcacctacgggacctgcagtcagacgggcgagcaccgaagggacaagcggtccgtcgccctcgcgccgcatgtgggcctggggcttgagacccgtaccgaaacctggatgagctccgagggcgcctggaagcagatccaacgtgtcgaaacgtgggctctgcgccacccaggattcaccgtgatagccctgttcctagcccacgcgatcggcacctcgatcacccagaagggcatcatcttcatcctcctgatgctggtgacgccctccatggccatgcggtgcgtcggaatcggcagtcgcgactttgtggaggggctctcgggtgccacatgggtggacgtcgtgctggagcacggtagttgcgttaccacgatggccaaggacaaaccaacgctggatatcgagctcttgaagaccgaggtcacaaaccccgcggtgctgagaaagctctgcatcgaggcgaagatatcgaacaccacgaccgactctcgctgtccgacacaaggcgaggctaccctggtggaggagcaggacgccaacttcgtctgccgacgcacgtttgtagaccgaggatgggggaacgggtgcgggctgtttggcaagggttccctcattacgtgcgccaagtttaagtgcgttaccaagcttgagggcaagatagtccagtatgagaacctgaagtacagcgttatagtgacagtccatacgggtgaccagcaccaagtcggcaacgagtccactgagcacggcaccacagccaccatcacgccgcaagcgcccaccaccgagatccaactaaccgactacggggccctgacgctggactgttccccccgtactggcctcgactttaacgagatggtcctcctgaccatgaaggaaaagtcctggctcgttcacaagcagtggttcctggatctgcccctcccctggacaagcggggccagcacatctcaggagacctggaaccggcaggacctgctggtgaccttcaagaccgctcacgcgaagaagcaggaggtcgtggtgctcggcagccaggagggagcgatgcacacggccctgaccggggccaccgagatccagacttctggcacaaccaccatcttcgccgggcacttaaagtgccgcctcaagatggacaagctgaccctaaagggaatgtcttacgtcatgtgcacggggtccttcaagctcgaaaaggaggtggcggagacccagcacggcactgtgctggtccagatcaagtacgagggcacggacgcgccctgcaagatccctttcagcacgcaggacgagaagggagttactcagaacggccgactgatcaccgccaatcctattgttacagacaaggagaagcccgtcaacatcgaggccgagccgcccttcggggagagttacatcgtaatcggtgccggcgagaaagcgctgaagctaagctggtttaagaaggggtccagcataggcaagatgttcgaggccacggcccgcggggcccggcgcatggccatcctgggcgataccgcgtgggacttcgggtccatcggcggcgtgttcaccagcgttgggaaggtggttcaccagatcttcggcaccgcctacggggtcctcttcagtggcgtgagctggacgatgaagatcgggatcggcgtgctcctcacttggctgggactgaactcccgctctacatccctgagcatgacctgcatcgctgtcgggctggtgacgctctacctgggcgtgatggtccaggcggactccgggtgtgtgattaattggaaggggcgggagctgaagtgcgggagcggcatttttgttaccaacgaggtccacacgtggaccgagcagtacaagttccaggccgactcgcctaagaggctctcagcggcgattggcaaggcctgggaggagggtgtgtgtggcatccggtcagctacccgcctagagaacatcatgtggaagcaaatctccaacgagcttaaccacatcctcctcgaaaatgacatgaagttcacggtcgtcgtaggggacgtagccggcatcctggcgcaggggaagaagatgatccggccccagcccatggaatacaagtactcctggaagagctggggcaaggccaagatcatcggagcggacgtccaaaacacaaccttcattatcgacggccccaacaccccggaatgccccgacgatcagcgtgcctggaacatctgggaggtggaggactacggattcgggatcttcactaccaacatctggttaaagctgagagactcttacacccaggtgtgtgaccaccgcctgatgtccgcggccatcaaggacagcaaagcggtccacgccgacatgggctattggatcgagagcgagaagaacgaaacatggaagctcgctcgggcgtctttcatcgaggtgaaaacttgcatctggcccaagtcccatactctgtggagcaacggcgtgctggagtccgaaatgatcatccccaaaatatatgggggcccgatcagccagcacaactaccgccctggctacttcactcagaccgcaggcccatggcacctcgggaagttagagctggatttcgacctctgcgagggcacgaccgtagtggtggacgagcactgcggcaatcgagggccgtccctgcgcacgaccacggtgaccggcaagatcatccacgaatggtgctgtcggagctgcaccctgccgcccctgcgcttcagaggggaggacggctgctggtacgggatggagatcaggccagtgaaggagaaggaggagaacttagtgaagtccatggtcagcgccggcagtggcgaggtggactcgttctcactggggctcctttgcatatccatcatgatcgaggaggtgatgcgatcccgctggtccagaaaaatgttaatgaccggcactctcgcagtcttcttcctgcttatcatggggcaactcacctggaacgacctgatccgcctgtgcataatggtgggcgccaacgcgagcgatcgcatggggatgggcaccacctacttggccctaatggctacgttcaagatgcggccgatgttcgccgtcggtcttctgtttcgccggctgacctcacgcgaggtcctgcttctgacaatcgggctgagcctcgtagcctccgtcgagctgcccaacagcctggaagagctcggcgacgggttggcgatgggaatcatgatcctgaaactcctaactgacttccagtcccatcagctctgggccacgctcctgagcctgaccttcatcaagaccaccttctccctccactatgcctggaagacgatggcaatggtgctgagtatcgtgtccctgttccccctctgtctgagcaccacctcccagaagaccacgtggttaccggtcctcttaggcagcttggggtgcaagccgctcaccatgttcttgatcgcggagaacaagatctggggccggaggtcctggcccctgaacgagggcatcatggccgtcggaatcgtgagcatcctcctgagcagcctgctcaagaatgatgtgcccctggccggtccgctgattgccggcggcatgctcatcgcctgctacgtgataagtgggtccagcgctgacctgtccctagagaaggccgccgaggtgtcgtgggaggaagaggccgaacattccggtgcctcccacaacatcctcgttgaggtgcaggacgatgggaccatgaaaattaaggacgaagagcgggacgacaccctgaccatcctgctcaaggcaacgctgctggcggtgtccggcgtgtacccgctcagcatccccgccaccctgttcgtgtggtacttctggcagaagaagaagcagcgctcaggggtgttgtgggacaccccttccccgcccgaggtcgggcgggcggtgctcgatgacggcatctaccgcattatgcagagagggttactgggccgctcccaggtaggggtcggcgttttccaggaaaatgtgttccataccatgtggcacgtcacgagaggggccgtgctgatgtaccaggggaagagactcgagcccagctgggcttccgtgaagaaggatttgatcagctacggcgggggctggcggctacaaggctcctggaacaccggggaggaggttcaggtgatcgcagtggagcccgggaagaaccccaagaatgtccaaacggcacccggaacgttcaagacgcctgagggcgaggttggagccatcgccctcgacttcaagcccggcacctccgggtcccccatcgtgaaccgcgagggcaagattgtcggcctgtacgggaatggcgtggttaccacgagcggtacttacgtcagcgcgatcgcgcaggccaaagcctctcaggagggaccgctacctgagatcgaggacgaggtgtttcggaagcgcaaccttaccatcatggacctgcaccccgggagcggcaagacccggcgatacctgccggccattgtacgggaggcaatcaaaaggaaacttcgcaccttaattctggccccaacgcgggtcgtggcctccgagatggcggaggcgctcaaaggcatgccgatccgctaccagaccaccgccgtgaagtcggagcacaccgggaaggagatcgtcgatctgatgtgccacgcgacgtttaccatgcggctgctctcccccgtgcgtgttccgaactataacatgatcatcatggacgaggcccacttcactgaccccagctccattgctgcgcgaggctacatttctacgcgcgtcggcatgggtgaggccgcagcaatcttcatgacggccacgccgcccgggtccgtagaggccttcccgcagagcaatgccgtgatccaggatgaagagcgagacatcccagagagatcgtggaactctgggtacgagtggatcacagacttccccgggaagacggtctggttcgtaccctccatcaagagcgggaacgacattgccaactgtctgaggaagaacggcaagcgcgtgatccaactgtccaggaagacgttcgatacagagtaccagaagaccaagaataacgattgggactacgttgtgacaacggacatcagcgagatgggcgccaacttccgcgcggatcgggtaattgatccgcgccggtgcctcaaaccggtcattttaaaggacggccccgagcgcgtgatcctggccgggcccatgccggtaacggttgcttcagctgcgcagcggcgcggccggatcggccgcaaccacaacaaggagggggaccagtacatctacatgggccagccccttaacaatgacgaggaccacgcgcactggacggaagcgaagatgctgttggacaacattaacactccagagggtatcatccccgccctcttcgaaccagagagggagaagtcagccgccatcgacggagagtaccggctgcgcggggaggcacggaagacgttcgtggagcttatgcgccggggcgacttgccagtctggctgtcctataaggtggccagcgaaggcttccagtacagcgacagacggtggtgctttgacggggagcgcaacaaccaggtgctggaggagaacatggacgtcgagatctggaccaaggagggcgaacggaagaagctccgcccacggtggctggacgcccgcacctactccgacccactcgccctcagggaattcaaggagttcgccgcaggccgccggagcgtgagcggagacctgatcttggagatcggcaagctcccacaacatctgacccagcgcgcgcagaacgccctggacaatctcgtgatgttacacaacagcgaacaaggcgggcgggcataccgccacgcgatggaagaacttccagacacgatcgagaccctcatgcttctggccttaatcgcggtcctgaccgggggcgtgaccctgttctttctctccgggcggggcctgggcaagaccagcatcgggctgctttgcgtgatggccagtagcgtcctactctggatggcatccgtggagccccactggatcgcggcgtctatcatcctcgagttcttcctgatggtcttactaattccggagccggaccgccagaggacgccccaagacaaccaactggcctatgtcgtgatcggtctactgttcatgatcttaacggtggccgccaacgagatggggctcctcgagaccaccaagaaggacctggggatcgggcacgtcgcggtggagaaccaccaccacgccgctatgctggacgtggacctccaccccgcctccgcatggacattgtacgcggttgcaaccacaatcataaccccgatgatgcggcacacgatcgagaacaccaccgccaacatcagcctgaccgccatagctaatcaggcggccatcctcatggggctggacaagggctggcctatctccaagatggacatcggggtgcccctgctcgcgttgggctgctacagccaggtaaaccccttgacactcactgccgcggtattaatgctggttgcccattatgccattatcgggccgggcctacaggccaaagccacgcgcgaggcgcagaaacggacggccgccgggatcatgaaaaacccgaccgtggacggcatcgtcgccatcgacctggaccccgtggtgtatgacgccaagtttgaaaagcagctaggccagatcatgctcctgatcctctgcacatctcaaatactcctgatgcgtaccacgtgggcgttatgtgaaagcataacgctcgccacagggcccctgaccacactttgggaggggtccccggggaaattctggaatacgaccattgcggtcagcatggccaacatctttaggggctcctatctcgccggcgcagggcttgcatttagcctgatgaaaagcctcggcgggggacgcagggggaccggcgcccagggcgagacactgggtgaaaagtggaagcgtcaactcaatcaactctccaagagcgagttcaacacatacaagcggtccggtattatggaggtggacagaagcgaggccaaggaagggctgaagaggggcgagactaccaagcatgctgtgagccgcgggaccgccaagctgcgttggttcgttgaacgcaacctcgtgaaacccgagggcaaagtgattgacttgggctgcggacggggcgggtggagctactactgcgcaggcctgaagaaagtcacagaggtgaaggggtataccaagggcggccccggacacgaagagcccattccaatggccacctacggctggaacctggtgaagctccattccgggaaggatgtcttcttcatcccgcccgagaagtgcgacacgctgctgtgcgacatcggtgaatcttcccccaatccgacgattgaggaggggaggaccctccgggtgcttaaaatggtggagccctggctgcgtggcaaccaattctgtatcaagatcctcaacccttacatgcccagcgtggtggagaccctggagcagatgcagagaaagcatggcgggatgctggtgcgcaaccccctctcgcggaactcaacccacgagatgtactgggtttcatgtgggactgggaacatagtgagcgccgtaaacatgacgtctcgcatgctgctgaaccgcttcactatggcgcatcggaagcccacgtatgagcgcgacgtcgacctcggggccggcacccggcacgtggccgtggagcccgaagtcgcgaacttagacatcatcgggcagcgcatcgagaacataaagcacgaacacaagagcacgtggcactacgacgaggataacccctacaagacctgggcctaccatggctcctacgaggtgaaaccgagcgggtccgcgagcagcatggtcaacggcgtggtgaagttgctcaccaagccttgggacgtcatccctatggtcacccagatcgccatgacggacaccacccctttcgggcagcagcgggtgttcaaggagaaggtggatactcgcacgccaaaggctaagcgaggcaccgcccagatcatggaggtgactgccaaatggctgtggggcttcttgtcccgcaacaagaaaccaagaatctgcacccgcgaggaatttactcggaaggtgcgaagcaacgctgccatcggcgccgtcttcgtggacgagaaccagtggaactccgcaaaagaggctgttgaagacgagcgtttctgggacttggtccacagagaacgggagctgcacaagcagggcaagtgcgcgacctgcgtgtacaacatgatggggaagcgcgaaaagaagttgggcgaattcggcaaagccaagggcagccgggctatttggtatatgtggctcggtgcccgcttcctcgagttcgaggctctggggttcatgaacgaggaccactggttctcccgggagaactcactcagcggcgtggaaggggagggcttacacaagctgggatacatcctccgcgacatcagcaacatccccggcggcaacatgtatgcggacgacacagctgggtgggacacccggatcacggaggacgacctgcagaacgaggcccgcatcactgacataatggagcctgaacacgcacttctcgcgaagtccatattcaagctgacatatcagaacaaggttgtgcgcgttcagcggcccgcgaaaaacggaaccgtcatggacgtgatatctcgccgggaccagagagggagcggtcaggtaggcacgtacgggctgaacaccttcaccaacatggaagcccagcttatccggcaaatggaaagcgagggcattttctccccctcggaacttgaaaccccaaacctggccgagcgcgtactcgactggctggagaaatacggggttgagcggcttaagcgcatggcaatttccggcgacgactgcgtggtgaagccaattgacgaccggttcgcgacggccctcaccgccctgaacgacatggggaaggtgcgtaaagacatcccccaatgggagcccagcaaggggtggaacgactggcagcaagttccattctgctcccaccatttccaccaactgatcatgaaggacggtcgggagatcgtagtgccgtgccgcaaccaggacgaattggtgggacgggcccgcgtgagccagggcgccgggtggagcctcagagagacagcctgcctcggcaagtcctacgctcagatgtggcagctcatgtacttccatcgccgggacctgcgccttgccgccaatgcgatctgtagcgcggtgcccgttgattggatcccaacctcccggacgacctggagcatccacgcccaccaccaatggatgaccacggaggacatgctttccgtttggaaccgcgtgtggattgaggagaacccctggatggaagacaagacccacatcagctcctggggagacgttccgtacctgggtaaacgcgaggaccagtggtgcggcagcctgatcgggctcaccgcccgggccacctgggcgaccaacatacaggtagcgataaaccaggtgcgcagattgatcgggaatgagaactaccttgactacatgacctccatgaagcgcttcaagaatgagtcggaccccgagggcgccctctggtga

SEQ ID NO: 24137 - RNA, 9879 nt, synthetic construct
  misc_feature 1..9879: note = derived and/or modified CDS sequence (opt11) from DENV-1__FJ182025__SS-prME
  source 1..9879: mol_type = other RNA
agcgtgaccatgctgctcatgctgatgcctaccgccctggcgtttcatttgaccacacggggcggtgagccccacatgatcgtgagtaagcaggagcgggggaagtccctgctgtttaaaacgagcgccggtgtgaacatgtgtaccttaatcgccatggacttaggggaactgtgcgaggataccatgacctacaaatgccctaggatcaccgagaccgagccggacgacgtggattgttggtgtaacgccacggacacctgggttacgtatggcacgtgcagccagacgggcgagcaccgccgtgacaagcggtcagtggccctcgcgccccacgtgggcctcggcctcgaaacccgcacagaaacctggatgagctcagagggcgcatggaagcaaatccaacgggtggaaacgtgggctttgcgccaccccgggttcaccgtgatcgccctgttcctggcccacgccatcggcaccagcatcacacaaaaggggatcatcttcatcctcctgatgctggtcactccctcaatggccatgcggtgcgtcggtataggctcgcgggacttcgtcgaaggactctccggcgctacctgggtcgacgtcgttctggagcacgggtcatgcgtgaccaccatggccaaggataagccaacgctggacatcgagctcctgaagactgaggttaccaaccccgctgttctgcggaagctctgcatcgaggctaaaattagtaataccacgaccgacagcagatgtccgacccagggcgaggccacactggtggaggagcaggacgccaacttcgtttgccggcgcacgttcgtggaccggggctggggcaacggctgcggcttgttcggcaaggggtccctcattacgtgcgctaagttcaagtgcgtgaccaaactagaaggaaagatcgtccaatacgagaacctgaagtacagcgtgattgtgaccgttcacaccggcgaccagcatcaggtgggtaacgagtccaccgaacatggcaccaccgccaccatcacgcctcaagcgcccaccaccgaaatccagctcactgactacggggccctcacgttggactgctctccccgtaccggtcttgatttcaacgagatggtcctgctgaccatgaaggagaagtcctggctcgtgcacaagcagtggttcctagacctgccactaccctggacctctggcgcctcgacgagtcaggagacgtggaaccggcaggacctgctggtaaccttcaagaccgcccacgcgaagaagcaagaggtcgtggttttaggcagccaagagggcgcgatgcacactgccctgaccggggccacggagatccagaccagcgggaccacaaccatatttgccgggcacctgaaatgccgcctcaagatggacaaactgaccctgaaggggatgagctacgtcatgtgcacgggaagcttcaagcttgagaaagaagtggccgagacccagcacggtaccgtgcttgtccagatcaagtacgagggcaccgatgcgccctgtaagatccccttctctacacaggacgaaaagggagtgacccagaacggccgactgatcaccgcgaacccgatcgtgaccgacaaggagaaacccgtgaacattgaggcagaaccgcccttcggagagtcttatatagtgatcggcgccggtgagaaagcgctgaagttaagctggttcaagaaaggatccagcatcggcaaaatgttcgaggccacggcacgcggggcgagacgcatggctattttaggcgacacagcgtgggacttcggatcgatcggcggcgtattcactagcgtcgggaaactggtgcaccagatcttcggaaccgcgtacggggtcctgttctctggcgtcagctggacgatgaagatcgggatcggcgtcctgctgacctggcttggtttaaactcccgcagcacctccctcagcatgacctgtattgccgtcgggctcgtcacactgtacctgggcgtgatggtgcaggctgattccgggtgcgtgattaactggaagggtcgggagctcaagtgcggaagcggtatcttcgttacgaatgaggttcatacctggaccgaacagtacaagttccaggcggacagccccaaacggttgtcagcggcgatcggaaaggcctgggaggagggggtatgcggcatccggagcgccaccagactggagaacatcatgtggaagcaaatttccaatgagttgaaccatatcctccttgagaacgacatgaagttcactgtggtggtcggggacgtggccggcatcctcgcgcaggggaagaagatgatccgaccccaacccatggagtacaaatatagctggaagtcctggggcaaggctaagatcatcggcgccgacgtacagaacacaacctttatcatcgacgggcccaacaccccggagtgtcccgacgaccagcgggcgtggaacatctgggaggtcgaggactacggcttcgggatcttcacgaccaacatatggcttaagttgcgggacagctacacccaggtgtgcgaccaccgccttatgtccgcggccatcaaggacagcaaggccgtacacgccgacatgggttattggatcgagtcggagaagaacgaaacctggaagctggcacgggcgtcattcattgaggtaaagacgtgtatctggcccaagtcccacaccctgtggagtaatggtgtactcgagtccgagatgatcatcccaaagatctacggggggccgatctcccagcataattaccgccccggctacttcacccagactgccggcccttggcacctgggcaagctggagctcgactttgacctctgcgagggaacgaccgtggttgttgacgagcactgcggcaaccgggggccgtccctgcgcaccaccactgtaacggggaaaatcattcacgagtggtgctgtcggtcgtgcaccctgccgcccctccgcttccgcggggaggacggatgttggtatgggatggaaatcagacccgtgaaggagaaggaggagaacctggtgaagtccatggtgtcagccggcagcggcgaagtagactccttctccttagggctgctgtgcatatccatcatgatagaggaagtgatgcgcagccgttggtccagaaagatgctcatgaccggtacgctggctgtgttcttcctgctcatcatggggcagctgacctggaatgatttaatcagactctgtattatggtcggcgccaatgcgagcgaccgcatgggtatgggcaccacctaccttgccttaatggccactttcaagatgcggccgatgtttgccgtagggcttctgtttcgccggctgacatcccgtgaggtgttacttctgaccatcgggctgagcctggtcgcttccgtggagttacccaacagcctcgaggagcttggagacgggctggcgatgggcatcatgatattaaagctgttgacggatttccaatcccaccagctgtgggccactttactgtcgctcaccttcattaagaccactttctccctacactacgcctggaagacgatggccatggtcctgagcatagtgtccctcttccccctgtgtctgagcactacctcccagaagaccacgtggttacctgtgcttctcggcagcctcgggtgcaagccgctgaccatgttcctcatcgcggagaacaagatatgggggaggcggtcgtggcccctcaatgaggggattatggccgtcggaatcgtgagcatactactaagcagcctcctgaagaacgacgtgccgctggccggacccttgatagccggcggcatgctgatcgcatgttacgtaatcagcgggtccagtgcggacctgtccctcgagaaggccgccgaagtcagctgggaggaggaggccgagcactccggcgccagccataacatcctggtggaggtccaggacgacggcaccatgaaaatcaaggacgaagagcgcgatgacaccctgacgatccttctgaaggcgacgctcctcgccgtgtccggcgtatacccgttgtcgataccagcaacgctgtttgtctggtacttctggcagaagaagaagcagcgctccggggtgctctgggacacaccaagcccgcccgaggtgggtagagcagtcctggacgatggcatctaccgcatcatgcagcgcgggctgctgggcaggagtcaggtgggtgttggcgttttccaggagaacgtattccacacaatgtggcacgttacgcgcggggccgtcctcatgtatcagggcaagcgccttgagccgtcttgggcttccgtgaagaaggatctgatatcatacggcgggggctggcggcttcagggatcttggaacaccggggaggaggtccaagttatcgccgtggagccaggcaagaaccccaagaacgttcagacggcaccaggaaccttcaagactcccgagggcgaggtcggggctatcgccctcgacttcaaaccgggcacctctgggtctcccatcgtgaacagggagggcaaaatcgtgggtctgtacgggaacggcgtcgtaaccacttcagggacttacgtgagcgcgatagcccaggccaaggcgtcccaggagggcccgctacccgaaatcgaggacgaggtgttccggaagcgcaacctgaccatcatggacctgcacccggggtctggcaagacccggcgatatctcccggcaatcgtgcgtgaggcaataaagcgcaaactgcgcaccttaatcctcgcccctacgcgggtggtcgcatccgagatggctgaagcgctgaaaggcatgcccatacgctaccagaccacagccgtcaagagcgagcataccgggaaggagatcgtcgacttgatgtgtcatgccacgttcaccatgcggctgctgtcccccgtccgtgtccctaactacaacatgatcattatggatgaggcccacttcactgaccccagcagcatcgccgcgcggggatatatcagcacacgcgtggggatgggcgaggccgccgccatctttatgaccgcgacaccgcccggatccgtcgaggcgttcccgcagtctaacgccgtgatccaagacgaggagagagatatccccgagcgctcgtggaacagcggctacgagtggatcactgactttccaggtaagaccgtgtggttcgtcccttccatcaagtccggcaacgacatcgcaaattgccttaggaagaacggaaagcgcgtgatccagctctcccggaagacgtttgacactgagtaccagaaaaccaagaacaacgactgggactacgtcgtgaccacggacatctcggagatgggagccaactttcgcgcggaccgggtgatcgacccccgccggtgcctgaagccagtgatcctcaaggacggtcccgagcgcgtcatcctagccgggcccatgccggtgactgtcgcctccgcagcgcagcggcgcggccggataggtcgcaaccacaacaaggagggcgaccagtacatttatatgggccagccccttaataacgacgaggaccacgcgcactggaccgaggcgaagatgctcctcgacaacattaacaccccagaaggaatcatccccgctctcttcgagccagagcgcgagaagtccgccgccattgatggcgaataccgcctccgcggagaggcgcggaaaacgttcgtagagctcatgcggcggggagacctccccgtttggttatcctacaaggtcgcctcagagggtttccagtacagcgacagacggtggtgctttgacggggaacgcaacaaccaggttctcgaggaaaacatggatgtggaaatctggacgaaggagggcgaacgcaagaagctgcgcccccggtggctggacgcccgcacctactccgaccccctcgccctgcgggagttcaaggagttcgcggccggccgccggtccgtctctggcgacctgatcctcgagatcgggaagctccctcagcatctgacccagcgcgcccagaatgccctcgataatctggtgatgctgcacaatagcgagcagggtgggcgagcttaccgccacgccatggaggaattgcccgacacgattgagaccctgatgctcctcgccctgatcgctgtgttaactgggggtgtcaccctcttctttctatcggggcgaggactgggcaagacaagcatcggactcctttgcgttatcgcctcctctgtgctgctttggatggcaagtgttgaaccccactggatcgcagcaagcattatcctcgaattcttcctgatggtgctcctgatccccgagccggaccgccaacggacaccccaggataaccaactggcctacgtggtcatcggtctgctttttatgatcctaacagtggctgccaatgagatgggtctcctagagaccacaaagaaggacctgggcatcgggcacgtggcagtcgagaaccaccatcacgcggcaatgctcgacgtggatctgcaccccgcctctgcatggaccctgtacgcggtggccaccaccatcatcaccccgatgatgcggcacactatagagaacaccactgccaacatcagcctcaccgccatcgctaaccaggccgcgattctaatgggtctggacaagggctggcccatcagtaaaatggacatcggggtcccccttctagctctgggctgctactcccaagtgaaccccctcacgctgacggcagcggtgctaatgctcgtcgcccattatgctattatcgggccgggactccaggccaaggccactcgtgaggcgcaaaagcggaccgccgctgggataatgaaaaaccctacggtcgacggcatcgtagctatcgacctcgatcccgtggtctatgacgccaaattcgagaaacaactcggccagatcatgctgcttatcctttgcacctcccaaatactgctgatgcgcaccacctgggcgctctgcgagagcattacgttggccaccggacccctgaccacgctctgggaaggctccccggggaagttctggaacaccaccatcgccgtaagcatggccaacatctttaggggatcctacttagctggcgccgggcttgccttttccctcatgaagtctctgggcgggggcaggcgggggaccggggcccagggcgagaccctgggggagaagtggaaacgccagttaaaccaactgtcgaagtcagagttcaacacttacaagcgatcaggaatcatggaggtcgacaggtctgaggccaaggaggggctgaaacggggcgagaccaccaagcacgcggtgtcccgcgggaccgcgaagctccggtggttcgtggagcgcaacctggtgaagcctgagggcaaggtgatcgacctgggatgcggacggggcgggtggagctactattgcgccggcttgaagaaggtgacagaggtcaaggggtacaccaagggcggccccgggcacgaagagcccattccgatggccacctacggttggaacctggtgaagcttcactccgggaaggacgtattcttcattccgcccgaaaagtgcgacaccctgctctgcgacatcggcgagagttcccccaacccgacgatcgaggaggggcgaactttgcgggtcctgaagatggtggagccctggctgcgcggcaaccagttctgcatcaagatcctcaacccctatatgcccagcgtagtagagaccctggagcagatgcagcggaagcacggaggcatgctcgttcgcaacccgctcagtcgcaattccacccatgagatgtactgggtgtcctgtggcacgggtaacatcgttagcgccgtgaacatgacgtcccgaatgctgcttaaccgcttcaccatggcgcaccggaagccaacctatgagcgggacgtagacctcggcgccggcacccgtcatgtcgccgtggagcccgaggttgccaatctggatatcattgggcagcgtatcgagaacatcaagcacgagcacaagagcacatggcactacgacgaggacaacccgtacaagacgtgggcctaccatggatcctatgaggtcaaaccgagcgggtctgccagcagcatggtgaatggtgtcgtgaagctcctgactaagccctgggacgtgatcccgatggtcactcagatcgcgatgacagacaccacccccttcgggcagcagcgggtgttcaaggagaaggtggacacccgcacgccgaaggccaagcggggcactgcccaaataatggaggtcaccgccaagtggctgtggggcttcctctcgcgcaacaagaaaccccggatctgcacccgcgaggagttcacgcggaaggtacgtagcaacgccgccataggggccgtattcgtcgacgaaaatcagtggaactccgccaaggaggcggtcgaggacgagcggttttgggacctagtgcacagggaacgcgaacttcacaagcagggaaaatgcgcgacctgcgtatacaacatgatggggaagcgtgaaaaaaaactcggcgagttcgggaaggcgaaaggctctcgtgccatttggtacatgtggttaggcgccaggtttctggagttcgaggcgctcgggttcatgaacgaggaccactggttctcccgggagaacagcctatccggcgtagagggggagggcctccacaagctcgggtacattctgcgcgacatcagcaacatccccggcggcaatatgtacgccgacgacacggctgggtgggacacccggatcacggaggacgacctgcagaacgaggcccgcattaccgacatcatggagcctgagcacgccctgctggcgaagtccatcttcaagcttacctaccagaacaaagtagtcagagtacagcggcctactaagaatggaacggtgatggatgttatcagccgccgcgatcaacgcgggtccggccaggtaggcacctacgggctcaacaccttcaccaacatggaggcccagctgatccggcagatggagagcgagggcatcttttcccccagcgagttggagacacccaacttggccgagcgcgtgctggattggctggagaagtacggtgtcgagcggctgaagcgcatggccatttccggcgacgactgcgtggtcaagccggtcgacgaccggtttgccaccgcgctcaccgccctcaacgacatggggaaggttcgcaaggacatcccccagtgggagcccagcaagggctggaacgactggcaacaggtccccttctgttcccatcatttccaccagctaatcatgaaggacggacgggagatcgtagtgccttgtcgcaaccaggatgagttagtagggcgagcccgcgttagccagggggcaggttggagtctgcgggaaactgcctgcctcggtaaatcctatgcgcaaatgtggcaactgatgtacttccaccgccgagacctgcgcctcgccgccaacgccatttgttcggccgtgccagtggactggatccccacgagccggaccacctggagcatacacgcccaccatcagtggatgaccactgaggacatgctgtccgtctggaaccgcgtgtggatcgaggagaacccctggatggaggataaaacccacatcagctcatggggcgacgtgccgtatttgggtaaacgcgaggaccagtggtgcggcagccttatcgggctgaccgcccgagccacctgggccacgaacatccaggtcgcaatcaaccaagtgcgcagattaattgggaacgagaactacctcgactacatgacgtcaatgaagcgcttcaagaacgagagcgaccccgagggggccctgtggtga

SEQ ID NO: 24138 - RNA, 9879 nt, synthetic construct
  misc_feature 1..9879: note = derived and/or modified CDS sequence (opt11) from DENV-1__FJ373297__SS-prME
  source 1..9879: mol_type = other RNA
tccgtgaccatgctactcatgctgatgccgacggccttggccttccacttgaccacccgcggtggagaaccccacatgatagtttccaagcaggagcggggtaagagcctgctgttcaagacctccgccggggttaacatgtgcacgctcatcgccatggaccttggcgagctgtgcgaggacactatgacctacaagtgcccccggatcacagaggtggagcccgatgacgtggactgttggtgtaacaccaccgatacctgggtgacctacggtacctgcagtcagacaggcgagcacagaagggacaagcggtccgtggcccttgcgccgcacgtcggtctggggctggagacgagagccgagacctggatgagctccgagggcgcgtggaagcaaatacagaaggtggagacctgggcactgaggcacccagggttcacggtgatcgccctgttcctggcccacgcgatcggcaccagcattacccagaagggtataatcttcatcctcctgatgctggtcaccccctccatggccatgagatgcgtcggtataggcagccgggatttcgtcgaagggctctccggggccacatgggtcgacgtggtactggagcacgggagctgcgtcaccaccatggcaaaggataagccgactctggacatcgaattgctgaagacggaggtgaccaaccccgccgtgctgcgaaaactttgcatcgaagcgaagatctccaacaccaccacggacagccggtgcccgactcagggcgaggccaccctggtcgaggagcaggacgccaacttcgtgtgcaggcggaccttcgtggaccgtggctgggggaacggctgcgggctgtttggcaaagggtccctcatcacgtgcgccaaattcaaatgcgtcacaaagctagagggcaagatcgtgcagtacgaaaacctgaagtactcggtgatcgttaccgtgcacaccggcgaccagcaccaggtcggcaacgagtccacggaacacggcaccaccgccaccatcacgcctcaggctcccacaagcgagatccaacttaccgactatggggccttaaccctggattgcagcccccggactggtttagacttcaacgagatggtgctgttgacaatgaaagagaagagctggctcgtgcacaagcagtggtttctggacctgccgctcccctggaccagcggggcctccaccagccaggagacctggaacaggcaggatctgttggtgaccttcaagacggcccatgcaaagaaacaagaggtagtggtgctcggctcccaagagggcgcgatgcataccgccctgaccggggccactgagatccagaccagcggcacaaccacgatctttgccgggcaccttaagtgccggctcaagatggacaagctaaccctgaaggggatgagctacgtgatgtgcaccggtctcttcaagctggagaaggaggtggcggaaacccagcatggtacggtcctggtgcagattaagtacgagggcaccgatgcgccctgtaaaatccccttcagcacccaggacgaaaaaggggtgacccagaacggccgcctaataacggccaaccccatcgtcacggataaggagaagccggttaacattgaggccgaaccccccttcggggagagctatatcgtgatcggcgccggcgaaaaggcgctaaaactgagctggttcaagaagggttccagcattggcaaaatgtttgaagcaaccgcccggggcgcccgccggatggctatactgggcgacaccgcgtgggacttcggttccatcggcggcgtctttacgagcgtggggaagctcgtgcaccagatctttggcaccgcctacggggtcttattttccggagtgtcttggacaatgaaaatcgggataggggtgctgcttacctggctgggccttaacagtcgctctacatccctctcaatgacctgcattgccgtcgggctggtgacgctgtacctaggggtaatggtccaagccgactccgggtgcgtgatcaactggaagggccgcgagctgaaatgcgggtcgggcatcttcgtgactaacgaggtccacacgtggaccgagcagtacaagttccaggccgacagcccgaagcggctgtccgcggccataggcaaggcgtgggaggagggcgtttgtggcatacgctccgcgacacggctggagaacatcatgtggcgccagatatcaaacgagttgaaccacattctgctcgaaaacgacatgaagttcacagtggtcgtcggggacgtggtcggcatactggctcaggggaagaaaatgatccgaccccaacctatggagcataagtacagctggaagtcctggggcaaggcgaagattatcggggcagacgtccagaacaccacgttcatcatcgacgggcccaataccccggagtgccctgacgaccagcgcgcttggaatatctgggaggtggaggactacggcttcgggatcttcaccaccaatatctggctaaagctcagagactcttacacgcaggtctgtgaccaccgcctgatgtccgccgcgatcaaggacagcaaggccgtgcatgccgacatgggctattggattgagtccgagaagaacgagacctggaagctggcacgggccagctttatcgaggtaaagacctgcatctggcctaagtcccacacactctggagcaacggcgtcctagagtccgagatgattatcccgaagatctacgggggcccgatcagccaacacaactaccgtcccgggtacttcacgcagaccgctggaccctggcacctggggaagttggagctggatttcgacctgtgtgaggggaccacggtggttgtagacgagcactgcggcaaccggggtccgtcactccgcacaaccaccgtgactggaaagatcatccacgagtggtgctgccggagctgcacgcttccgccgctaagattcaaaggggaagatggctgttggtacgggatggagatcagacctgtgaaagagaaggaggagaacctcgtgaagtctatggtgagcgccggcagcggcgaagtagattccttcagcctggggctgttgtgcatctccattatgatcgaggaggtaatgcggagccggtggtcccgcaaaatgctgatgacgggcaccctcgctgtcttctttcttctgatcatggggcagttaacctggaacgacctcataaggtcctgcatcatggtgggagccaacgcctccgaccgaatgggtatgggcacgacttacctggctctgatggccaccttcaagatgcgcccgatgtttgccgtcggcctcctgttccggcgcctcaccagccgggaggtcctcctgctgacgatcgggctctctttagttgccagcgtggagttacccaattccctcgaggaactcggtgatgggctggccatgggcatcatgatcctcaagctgctgaccgacttccagagctaccagctctgggctaccttactgtccttgaccttcattaaaaccacattcagcttacactacgcatggaaaaccatggccatggtgctgagtatcgtctcactccttcctctgtgtctctccaccacctcacagaaaaccacctggcttcccgtgctgctcgggagtctgggatgtaagccgctgaccatgttccttatcgcggagaataaaatctggggcagaaagagctggcccctaaacgaaggaatcatggcggtgggcatcgtctccatactactctcctcgttactgaagaatgacgtgcccctcgcagggcccctgattgccggcggcatgctgatcgcctgctatgtgataagcggcagctccgccgacctgagcctggagaaagcggcggaggtctcctgggaggaggaggctgagcactctggagcttcccacaacatcctagtcgaggtgcaagacgatgggaccatgaaaatcaaggacgaggagcgggacgacacactcaccatcctgctgaaggccaccctcctggcggtcagtggcgtgtacccgctgtccatcccagccaccctctttgtttggtacttttggcagaagaagaagcagcgctcaggggtcctgtgggacacgcccagtcctccagaggtggagcgggccgtgctggacgacggaatataccgtataatgcagcggggcctgctcgggcgctctcaggtcggcgtgggggtgttccaggagaacgtctttcacacgatgtggcacgtgactcggggcgctgtgctgatgtaccaggggaaacgcctggagccctcctgggccagcgtcaagaaggacctcatctcttacggcggcgggtggcggctgcagggcagctggaacactggagaggaagtgcaggtgatcgcggtcgagcccggcaagaaccccaaaaacgtgcagacggcaccaggcaccttcaagaccccggagggcgaggtgggcgccatcgccctggacttcaagcctgggacatccggcagccccatcgtcaacagggagggcaaaatcgtcgggctgtacggcaacggggtggtcaccactagcggcacctacgtgtcggccatcgctcaggcaaaggcctcacaagaaggaccgctgcccgaaatcgaggatgaggtgttccgtaagcgcaacctgaccatcatggatctccaccccggcagcggtaagacgcggcgctacctaccggccatcgttcgggaggctattaaacgcaagctgcggaccctcatcctggcccccacccgcgtggtggccagcgagatggcagaggccctgaaaggcatgcccatccgctaccaaaccacggcggtcaagtccgagcacaccggccgggagatcgtcgacctcatgtgccacgcgaccttcacgatgcgcctgctgagcccggtgcgggtcccgaactacaacatgatcattatggacgaggcccatttcacggatccctctagcatcgccgcccgcgggtatatctccacgcgggtagggatgggtgaagcagccgccatcttcatgaccgctactccgcccggcagcgtggaagccttcccacagtccaacgcggtgattcaggacgaggagcgcgacatccccgagcgctcttggaactccgggtatgagtggattaccgacttccccgggaagaccgtgtggtttgtacccagcatcaagagtgggaacgacatcgccaactgtctccgcaagaacgggaagcgggtaattcagctgagccgcaagacttttgacaccgagtaccagaagacgaaaaataatgactgggactatgtcgtgaccaccgacatatctgagatgggagctaactttcgggccgatcgcgtcatagacccgcggcggtgcttgaagcccgttatactcaaggatgggcccgagcgcgtcatcctggcggggcccatgccggtgaccgtggccagcgccgcccaacgcagagggcgcatcggtcggaaccacaacaaggagggcgatcagtacatctacatgggtcagccactgaacaacgatgaggaccacgcccactggacggaggccaagatgctcttggacaatatcaacacccccgagggcatcattcccgccctgtttgagccggagcgcgagaagagcgccgctatcgacggcgagtaccgcctccggggcgaggcgcgaaagacctttgtagagctgatgcggcgcggggacctgcccgtatggctcagctacaaggtggcgtcggagggcttccaatactccgacaggcgttggtgctttgacggggagcggaacaatcaagtcttggaggagaacatggacgtggaaatctggaccaaggagggcgagcgcaagaagctgcggccgcgctggctcgacgccaggacttacagcgaccctctggccctgagagaatttaaggaatttgcagccggccggcgcagcgtgagcggggacctgattctggagatcggcaagctaccccagcatctcacccagcgagcgcagaacgcactagataacctggtcatgttgcacaattccgaacagggcgggcgggcgtaccggcacgccatggaggagttacccgacactatcgaaaccctcatgttgctggccctgatcgctgtgctcaccggaggggtgacccttttcttcctaagcggtcgtgggctcggcaagacctccatcggtctgctttgtgtcatggccagctccgccctactgtggatggcctcggtggagccccactggatcgcagcctccatcatcctggagttctttctaatggtgctactgatacccgagccagacaggcagcgtactccccaggacaaccagctcgcatatgttgtgatcgggctactgttcatgatcctcaccgtagcagccaacgagatgggactgctggagacgacaaaaaaggaccttgggatcgggcacgtcgcggttgagaaccaccaccacgctaccatgctcgacgttgacctgcaccccgcgagcgcctggacgctctacgccgtcgcgacgaccatcatcaccccgatgatgcgccacactatagagaacaccaccgcaaacatctccctcaccgcaatcgccaaccaagccgcaattctgatgggtctcgacaagggctggccgatcagcaagatggacatcggcgtgcccctgctggccctcgggtgctactcgcaggtaaaccccctgaccctgaccgcggctgtactcatgctggtagcgcactacgccatcatcggcccggggctgcaggccaaggcaacccgcgaggcccagaagcgcaccgcggctggcatcatgaagaacccgaccgtcgacgggatcgtcgccatcgaccttgaccccgtagtgtacgatgccaagttcgaaaagcagctgggccaaatcatgctgcttatcctgtgcacgagccagatcctgctcatgcggaccacctgggccctgtgtgaatccatcaccctggcgacgggccctctcaccaccttatgggaggggtcaccgggcaagttctggaataccaccatcgccgtctccatggccaatatattccgcgggagttacctggccggggccggcctcgctttcagcctgatgaagtccctcgggggcgggcggagagggaccggggcccagggtgagaccctgggcgagaaatggaagaggcagctcaaccagctgagcaagtccgagttcaacacttacaaaagaagcgggatcatggaggtggatcggtccgaggcaaaggaggggctccgccgcggggaaaccaccaaacacgccgtgtccagaggcactgcgaagctgcgatggtttgtcgagcgcaatttagtgaagcccgaggggaaggtcattgacctgggctgcggcaggggcggttggtcctactactgcgctgggctcaagaaggtcaccgaggtgaaggggtatacgaagggcggcccgggccacgaagaacccatcccgatggccacgtacgggtggaaccttgtgaagctgcactccggcaaagacgtgttcttcatcccgcccgagaagtgcgacaccctcctgtgcgacatcggggaatcctcccccaacccgaccattgaggagggccgcacgctgcgggtactaaagatggtggagccctggttacgcgggaaccagttctgcatcaagatactaaacccatacatgccgagtgtcgtggagaccctcgagcagatgcagcggaaacacggaggcatgctggtgcgcaacccgctcagccgtaacagcacccacgagatgtattgggtcagctgcgggaccggtaatatcgtgtccgccgtgaacatgacgagccgcatgctcctgaaccgcttcacgatggcacacagaaagccgacttacgaacgcgacgtggacttaggagccggaacacggcacgtggccgtggaacccgaggtcgcaaaccttgatataatcggtcagcgcatcgagaacataaagcatgagcataagtcgacctggcactacgacgaggataacccctacaaaacttgggcctaccacgggagctatgaggtaaaaccgtccggcagcgccagcagcatggtcaacggggtggtgaagttactgactaagccctgggatgtgataccaatggtgacccagatcgcgatgaccgatacgactcccttcggccagcaacgggtgttcaaggagaaggtcgacacccgcaccccgaaggcgaagcgcggaacggcccaaatcatggaggtgaccgcccgctggttgtggggctttctgtcccggaacaagaaacctaggatctgcacccgggaggagttcacccgcaaggtgcggtccaatgccgcgatcggcgctgtgttcgttgatgagaaccagtggaatagcgccaaggaggcggtggaggacgagaggttctgggatctggtccacagagagcgagagctccacaagcagggcaagtgtgcgacctgtgtatacaacatgatgggcaaacgtgagaagaagctgggagagttcgggaaggccaagggctcccgggccatctggtatatgtggctaggcgctcggttcctcgagttcgaggccctgggcttcatgaacgaagatcactggttcagcagagaaaattccctcagcggggttgagggcgaggggcttcacaagctgggctacattctgcgggacatctccaaaatcccaggtggcaacatgtacgcggacgataccgccggctgggacaccaggatcaccgaggacgacttgcagaacgaggccaagatcacggatatcatggagccggaacacgccctgttagcgacatcgatcttcaagctaacctaccagaacaaggtcgtacgagtgcagcggcccgcgcgcaatggtaccgtcatggacgtgatctccaggcgcgatcaacggggtagcggccaagtgggcacatacggcctgaacaccttcaccaacatggaagcccagctcatccgccaaatggagtccgaggggattttcagtccttctgagctcgagacccccaacctggccgaacgggtcctggactggctcgagaaacacggcgtggaacgcctgaagcggatggccatcagcggggacgattgtgtggtcaagcccatcgatgaccgtttcgccacggcgctgtccgccctcaacgacatgggcaaggtgcggaaggacatccctcaatgggagcccagcaaagggtggaacgactggcagcaagtgcccttctgctctcatcattttcaccagctgatcatgaaagacggccgcgagatcgttgtgccgtgccgtaaccaggacgagctggtgggccgcgcccgggtctctcagggcgcgggatggagcctccgggagacggcctgtctggggaagtcctacgctcaaatgtggcagctgatgtacttccatagacgagacctccggttggcagccaacgctatctgtagtgcggtgcccgtggattgggtcccgaccaaccgcaccacatggtccatccacgcccaccaccagtggatgacgaccgaagacatgctgtcggtgtggaatcgagtgtggatagaggaaaatccttggatggaagacaagacacacatctccagctggggtgacgtcccttatctcgggaaacgggaggaccagtggtgtggctcgttgatcggcctgaccgcccgcgccacctgggccacaaatatccaggtggcaatcaaccaggtgcggcggttgatcgggaacgagaactacctggactacatgaccagcatgaagcggttcaagaacgactccgaccctgagggagctctgtggtga

SEQ ID NO: 24139 - RNA, 9879 nt, synthetic construct
  misc_feature 1..9879: note = derived and/or modified CDS sequence (opt11) from DENV-1__FJ024448__SS-prME
  source 1..9879: mol_type = other RNA
agtgtgacaatgctgctcatgctgatgcccaccgccctggccttccacttaacgacccgaggcggggaaccgcacatgatcgtgagcaaacaggagcggggcaagtctttgctgttcaagacgagcgcgggggtgaacatgtgcaccctcatcgctatggacctgggcgagctatgcgaggacaccatcacatacaagtgtccccgcattaccgagaccgagcctgatgacgtggattgctggtgcaatgccacggacacctgggtcacatatgggacctgtagccagacgggcgagcaccggcgcgataagcggtccgtggccctcgcgccccacgttggtctggggctggagacgcgcacggagacttggatgagctccgagggcgcctggaagcagatccagcgggtcgagacgtgggcgctcagacaccccgggttcaccgtgatcgctctatttctggcacacgcgataggcactagcatcacccaaaaggggatcatcttcattctcctgatgctggtgacgccctccatggccatgagatgtgtcggcatcggtagccgagacttcgtggaagggctatccggcgctacctgggtggacgtggtgctggagcacgggtcctgcgtgactaccatggccaaggacaagcccacgctggacatcgagctgctgaaaaccgaagtcaccaaccccgccgtactgcggaagctctgtatcgaggcaaaaatatccaacaccacgactgacagccggtgcccgacccagggagaggccactctggtggaggagcaggacgccaacttcgtctgtcggcgaacgttcgtggaccgaggctggggaaacggctgcgggctgttcggcaaagggtccctcatcacgtgcgccaagttcaagtgcgtgaccaagctggaggggaagatcgtccagtacgagaaccttaaatacagcgtgatcgtgaccgtccacacgggcgaccagcaccaagttgggaacgagtccaccgagcacgggacaaccgccaccattacgccccaggcgcccaccacggagatccagctaaccgactacggtgccctgactctggactgcagcccccgcaccggcctcgacttcaacgagatggtactgttaacaatgaaggagaaatcctggctcgtgcacaagcagtggtttctggacctacccttaccctggacctccggggcctcgacgtcgcaggaaacgtggaaccggcaggacctgctggtgaccttcaagaccgcacacgctaagaagcaggaggtcgtggtgctcggcagccaggagggcgcgatgcatacggcgctgactggcgccaccgaaatccaaacctccggcacgactaccatcttcgccgggcatctaaaatgccgcctcaaaatggacaagctgaccctgcggggaatgagctacgtcatgtgcacggggtccttcaagctcgagaaagaggtggccgaaacccagcacggaaccgtacttgtccagatcaagtacgaggggaccgacgccccctgcaagatccccttctcaacccaggacgagaagggagtgacccagaacggtcgcctaatcaccgccaacccgatcgtgacagacaaggagaagcccgtcaacatagaggctgagccgccgtttggagagtcctacatcgtgataggcgccggcgagaaggcgttgaagctctcctggtttaagaaggggtccagcatcgggaaaatgttcgaggccacagcccgcggggccaggcgcatggccatcctgggcgataccgcgtgggactttgggtccatcggcggcgtgttcaccagcgtcggtaagctggtgcatcagatctttggcaccgcctacggggtgttattctccggcgtctcttggacgatgaagatcgggatcggcgtgctgctcacctggctcgggctgaactctcggagcacctccctgagcatgacctgcatcgccgtggggctcgtcacgctgtacctgggcgttatggtgcaggccgattccggatgcgtcataaactggaagggccgagagctgaagtgcgggagtggcatcttcgtgaccaacgaggtgcacacgtggaccgagcagtacaagtttcaggccgattcccccaagcggctgtccgcggccatcgggaaagcctgggaggagggggtctgcggcatcagaagcgcgactcggctggagaacatcatgtggaagcagatatccaatgagctcaaccacatcctgctggagaacgacatgaagttcactgtggtggtaggggacgtggcgggcatcttagcgcagggtaagaagatgatccgcccccaacccatggaacacaagtacagctggaagagttggggcaaggccaagatcatcggcgccgacgtgcagaacacgaccttcatcatcgacgggcccaataccccggagtgccccgacgaccagagggcgtggaacatctgggaggtcgaggactacggctttgggattttcacgactaatatctggctgaaattacgcgacagctacacccaagtgtgcgaccaccggcttatgtccgcggccatcaaggactcgaaggccgtgcacgccgacatgggctactggatcgagtccgaaaagaacgagacttggaagctggcccgcgcgagcttcatcgaagtcaagacgtgcatctggcccaaatcccacaccctgtggtcgaacggcgtgctcgaatccgagatgatcatccccaagatctacgggggcccgatcagccagcataactaccggcccgggtacttcacccagactgcaggcccctggcacctggggaagcttgaattggacttcgacctgtgcgaggggacgaccgtggtcgttgacgagcactgcggtaacagagggccgtccctgcggaccaccacggtgactggcaagattattcacgagtggtgctgtcgcagttgcactctgcctcccctccggttccgcggggaggacggatgctggtacgggatggagatccggcccgtcaaagagaaggaggagaacctggttaagtcaatggtgagcgccggtagcggcgaggtcgactccttcagcttagggctgctgtgcatctccattatgatcgaggaggtgatgcgcagtcggtggtcccgcaagatgcttatgaccggcaccctcgccgtgttcttcctactcatcatggggcagcttacctggaacgacctgatacggctatgcattatggtcggagccaatgcgtctgaccggatggggatggggaccacctacctggccctgatggcaaccttcaagatgcgcccgatgttcgccgtgggcctactgttcaggcgcctcacttcccgggaggtcttactgctgactatcgggctttcgctcgtcgcaagcgtggagctgcccaatagcttggaagagttgggcgacgggctggcaatgggcatcatgatcctcaagctgctgaccgacttccaatcccatcagctctgggcaacgctgctgagcctcactttcatcaagactaccttctctctgcactacgcctggaaaacgatggccatggtcctgagcatcgtgtccctcttccccctgtgcctaagcaccacctcccagaagaccacgtggctccccgtcctgctgggctcgctcgggtgcaagccgcttaccatgttccttatcgcggagaacaagatctggggccggcggtcctggcccctcaacgaagggatcatggccgtcgggatagtgagcatccttctgagctccctcctgaagaacgacgtacccctggccggccccctcatcgccggcggcatgcttattgcctgctacgtcatttcaggctccagcgcggacctgagtctcgagaaggcagccgaggtgagctgggaggaggaggccgagcattccggcgctagccacaacatcctagtggaggtccaggacgacgggaccatgaagatcaaggatgaggaacgcgacgacaccctgaccatcctcctgaaggcgacgctgctcgccgcctctggcgtgtacccgctgagcatccccgcaaccctgttcgtttggtatttctggcagaagaagaagcagcggtccggggtcctctgggacaccccgagcccgccggaggtcgagcgcgccgtgctcgacgacggcatctacaggatcatgcaacgcggccttctggggcggtcccaggtcggcgtgggtgtgttccaggagaacgtattccacaccatgtggcacgtgacgcgcggtgctgtgctcatgtaccaggggaagagactggagcctagttgggcgtccgtcaagaaggacctgatcagctatggtggagggtggcgccttcagggttcatggaacaccggggaagaagtgcaggtgatcgccgtagagcccggcaaaaaccccaaaaacgtgcagaccgccccaggaacctttaagactccagagggcgaggtgggtgccatcgcgttggacttcaaacccgggaccagtggctcgcccatcgtaaaccgtgaggggaagatcgtgggcctgtacgggaacggagtggtcactacatcggggacgtacgtgagcgccatcgcccaggccaaggcgtcccaggaagggccgttgcccgagatcgaggacgaggtgttccgcaagcggaacctaactatcatggacctacaccccggcagcggaaagacccgccggtacctcccggcgatcgtgcgcgaggccatcaagcgcaagctgcggaccctcatcctcgcccccacccgcgtggtggcctccgagatggcggaggctctgaagggcatgcccatccggtatcagactacagccgtaaaaagtgagcacaccgggaaggagatcgtggacctgatgtgccacgccacgtttaccatgcgcctcctgtccccggtgcgggtcccgaactacaacatgatcattatggacgaggcccacttcaccgatcccagctccatcgcggcccgcgggtacattagcactcgggtgggcatgggagaggccgccgccatcttcatgacggctacgccgcccggctccgtcgaggccttcccgcagagcaacgccgtaattcaggacgaggaacgcgacatccctgagcggtcttggaacagcgggtacgagtggatcaccgacttccccggcaagaccgtgtggttcgtaccctccatcaaaagcgggaacgacatagccaactgcctgcgcaaaaacgggaagcgggtcatccaattatcccgaaaaacgtttgacaccgagtaccagaagaccaagaataacgactgggactacgtggtgacgacggacatcagcgagatgggcgcgaattttagagccgatcgcgtcatcgacccgcggcgctgcctgaaaccggtgatactgaaggacgggcccgagcgggtgatcctcgccggccccatgccggtaacggtggccagtgccgcgcaacgccgggggcggatcggccgtaatcataataaagagggcgaccaatacatctacatgggacagcccctgaacaacgacgaggaccacgcccactggaccgaggccaagatgttactcgacaacatcaacacccccgagggtatcatccccgccctgttcgagccggagcgggagaaatccgccgctatcgacggggagtaccgcctgcgcggcgaagcccgaaagacgttcgtcgaactcatgcggcgtggggatctgcccgtgtggctgtcttacaaggtggccagtgagggtttccagtacagcgatagacgctggtgcttcgacggggagcggaataaccaggtcctcgaggagaatatggacgtggagatttggaccaaggagggggagcgcaagaaactgcggccccgctggctggacgccagaacctattccgaccccctcgccctgcgcgagttcaaggagttcgccgcgggccggcgcagcgtgtccggggaccttatcctcgagatcggcaaactcccacaacacctgacccagcgggcccaaaacgccttagataacctggtcatgctgcataacagcgagcagggagggcgcgcgtaccggcatgcaatggaggagctacctgacacgatcgagaccttaatgctgctcgccctgattgccgtgctaaccggcggagtgaccctcttcttcctttcgggccgcgggcttgggaagacgagcattggcctcctatgcgtcatggcttccagtgtgctgctctggatggcatccgtggagccgcactggatcgctgcatccatcattctagagttcttcctgatggtcctcttaatccccgagccggatcggcagcgcacgccccaggacaaccagctggcctatgtggtgatcgggctcctgttcatgatcctgaccgtggccgctaatgagatgggccttctggagaccacaaagaaggacctggggattggccacgtggccgtggaaaaccatcaccacgccgccatgctcgatgtcgacctgcaccccgctagcgcgtggacgctgtatgccgtggctaccaccatcatcacacccatgatgcgacacacgatcgagaataccaccgccaacatcagccttaccgccatcgcaaaccaggccgccatcctaatggggctggacaagggctggcccatctccaagatggacatcggtgtgcccctcttagcgctggggtgctacagccaggtcaaccccctcacgctgaccgctgctgtgctgatgctcgtggcccactacgccatcatcggcccggggctgcaagccaaggcgacccgggaggcccagaaacgcaccgccgcgggcatcatgaaaaatcccacggtcgacggtatcgtcgccatcgacctggaccctgtggtctatgacgcgaagttcgagaagcaactcggccagatcatgctgctgatcctctgcacctcccagatcctgctgatgcgcaccacctgggcgctctgcgagagcatcacgctggccaccggccccctgaccaccttatgggaagggtccccgggcaagttctggaacacgaccatcgctgtgagcatggccaacatcttccgcggctcctacctggcgggcgccggcctggccttcagcctcatgaagtccctcgggggcgggcgtcgcgggaccggagcccagggcgagaccctgggagagaaatggaagcggcagctcaaccagctatccaagtccgagtttaacacttacaagagatccggtatcatggaggttgaccggagcgaggcgaaggagggcctgaagaggggggagaccaccaagcacgctgtctcccggggcaccgccaagctccgctggtttgttgagcggaacctggtgaagcccgaggggaaggtcatcgacctgggctgcggccgcgggggctggagctactactgcgcggggctgaagaaggtgacagaggtgaaaggctacaccaagggcggccccggccacgaggagcccatcccgatggccacctacggctggaacctcgttaaactgcattccggcaaggacgtgttcttcatacctccagagaagtgcgacaccctgctctgcgacatcggggagagctcccctaacccgacgatagaggagggtcggactctgcgcgtgcttaagatggtagagccctggttgcgggggaaccaattctgcatcaagatcctgaatccctatatgcccagcgtggtggagaccctggagcagatgcagaggaaacacggcggaatgctggtccggaaccctctatcccgcaacagcacccacgagatgtactgggtatcctgcgggaccgggaacatcgtgagtgctgtcaacatgacgtcccgcatgttgctcaaccgattcaccatggcccaccgcaagcccacctatgaacgggacgtggacctgggggcgggcacccggcacgtggccgtcgaacccgaagtggcaaacctggacatcatcggccagcgcatcgagaacatcaagcacgagcataagtcgacgtggcactacgatgaggataacccttataagacatgggcgtaccacgggtcctacgaggtgaagccgagtgggtccgccagcagcatggtaaacggggtcgtcaaactcctcaccaagccctgggacgtcatccccatggttacccagatcgctatgacggacaccacacccttcggccagcagcgcgtctttaaggagaaggtggacacccggacgccgaaagccaagcgcgggaccgcccagatcatggaggtcaccgcgaaatggctgtggggcttcctctcccggaacaagaagccccgcatctgcacgcgggaggagttcacgcgcaaggtccggagcaacgccgccatcggagcagtgttcgttgatgagaaccagtggaattccgcgaaggaggcagttgaggacgaacgcttctgggacttggtgcaccgggagcgcgagctccacaagcaagggaagtgcgcgacctgcgtatacaacatgatgggcaaacgggagaagaagttgggcgaattcgggaaggccaaggggtctcgcgccatctggtacatgtggctgggcgcgcgattcctggagttcgaggctttgggcttcatgaatgaggaccattggttttccagagagaactcactgtccggggtcgagggcgaggggctgcacaagctcggctacatcctgcgggacatctcgaagatcccagggggcaacatgtatgccgacgacaccgcaggatgggacacccgcatcacggaggatgacctgcagaacgaggcccgcatcacggacatcatggaaccggagcacgcgctcctggccaagagtatcttcaagctgacctaccagaacaaggtcgttcgggtccagcgccccgccaagaacgggaccgtgatggacgtgatatctagacgcgaccagcggggcagtggccaggtaggaacgtatggcctcaataccttcaccaacatggaggcccagctgatcagacaaatggagagcgaggggatcttctcccccagcgagcttgaaactcccaacctcgccgagcgggtgctagactggctggagaagtacggcgtggagcgtctcaagcggatggcgatcagtggcgacgactgcgtcgtaaagccgatagacgaccgcttcgccacggccctgaccgccctcaacgacatggggaaggttcgtaaggacatcccccagtgggagccaagcaagggctggaacgactggcagcaagtccccttctgctcccaccacttccaccaactcatcatgaaggacggccgggagatcgtggtgccgtgtcggaaccaggacgagctggtcggccgcgcccgtgtgtcacagggggcggggtggagcttacgcgagactgcctgtctggggaagtcctacgcacagatgtggcagcttatgtacttccaccggcgcgacctgcgcctcgccgcgaacgcaatctgcagcgctgtgcccgtcgactggatccccacgtcccggacgacgtggagcatccacgcgcatcaccagtggatgaccaccgaggatatgctgtctgtctggaaccgcgtgtggatagaagagaacccctggatggaggacaagacgcacatcagctcctggggcgacgtcccatacctggggaagcgggaggaccaatggtgcggcagcctcatcggcctgaccgcgcgcgccacctgggccaccaacatccaggtggccatcaaccaagtccggcgccttatcggaaacgagaactacctcgactacatgacatccatgaagcggtttaagaacgagtcagatcccgagggcgctctgtggtaa

SEQ ID NO: 24140 - RNA, 9879 nt, synthetic construct
  misc_feature 1..9879: note = derived and/or modified CDS sequence (opt11) from DENV-1__FJ182026__SS-prME
  source 1..9879: mol_type = other RNA
tcagtgacaatgctgctgatgctgatgccgaccgccctggcgttccatctcacaacccgaggcggggagccccacatgattgtgagcaagcaggagcggggcaagagcctactgttcaagacaagcgcaggggtgaacatgtgcaccctcatcgcgatggacctcggcgagctgtgcgaggataccatgacgtacaagtgcccacggatcacagagaccgagccagacgatgtggactgctggtgtaacgccacagacacgtgggtcacctacgggacgtgtagtcagacgggcgagcaccgaagggacaagcggtctgtggccttggcgccccatgtgggcctggggctggagaccagaaccgaaacctggatgtcgtcagagggcgcttggaagcagatccagcgggtcgagacgtgggccctacggcaccccgggttcaccgtaatcgccttattcctagcccatgcgataggaacctctatcacccagaagggcatcatctttatcctactaatgctggtgacgccctccatggccatgcgatgcgtcggtatcggctctagggacttcgtagaggggctctctggagccacctgggtggatgtcgtgctggagcacggaagctgcgtcaccaccatggccaaagataaaccgacgttagacatcgagctcctgaagacagaggtcaccaaccccgccgtactgagaaagctctgcattgaggcgaagatctccaataccacgaccgacagccgctgcccaacccagggcgaggccaccctcgtcgaggagcaggatgccaacttcgtgtgtcggcgcacgtttgtggaccgtggctgggggaacggctgcgggctgttcggtaagggtagcctcatcacgtgtgccaagtttaagtgtgtgactaagctggagggcaagatcgtccagtacgaaaacctaaaatacagcgtgatcgtgaccgtacacacgggcgaccagcaccaggtggggaacgagagcacagagcacggtacgacggccaccataacgccccaggcgcccaccacagagattcagctcaccgactacggggccctgacgttggactgctcacccagaaccggccttgacttcaatgagatggtccttctgaccatgaaggagaaatcttggcttgtgcacaaacagtggttcctagacctgcccctcccatggaccagcggggccagcacttcgcaggagacatggaaccggcaagacctgcttgtcaccttcaagacggcccatgcgaagaagcaggaggtggtggtactaggcagtcaggagggcgctatgcacacagccctgacgggggccaccgagatccagacctccgggacgaccaccatcttcgccgggcacttgaagtgccggctcaaaatggacaagttgaccctgaagggtatgtcttacgtcatgtgcactgggtccttcaagcttgaaaaggagctggccgaaacccaacacggcacagtgctggtgcagatcaagtacgagggtacagacgcgccttgcaagatccccttcagcacgcagaacgagaaaggggtcacccaaaacggaaggttaatcaccgccaacccgatcgtaaccgacaaggagaaacccgtcaacatagaagccgagccgcccttcggggagtcctacatcgtcatcggggccggcgagaaggcgctcaagctgagctggttcaagaaggggtctagtatcgggaagatgttcgaggccacggcccgcggcgcccggcgcatggccatcctgggcgacaccgcatgggacttcgggtcgatcggcggcgtattcaccagtgtggggaaactcgtacatcagatcttcggcacagcttacggcgtgctgttctcgggcgtaagttggacgatgaagatcgggatcggtgtcctgctaacctggctgggtctgaattcccgcagcacctccctcagcatgacctgcatcgccgtggggctggtgacgctgtacttaggggtaatggttcaggccgattccgggtgtgtcatcaactggaagggccgggagctgaagtgcggtagcggcatctttgtcacgaatgaggtgcacacctggaccgaacagtacaagttccaggccgactcaccgaagcgcttgtccgcggccatcgggaaggcgtgggaggagggggtgtgcggcatacggagcgccaccagactcgaaaacatcatgtggaagcaaatctccaacgagctgaaccacattctgcttgagaacgacatgaagttcacggtcgtggtgggggacgtggccggaatcctggcgcaggggaagaagatgatccggccccagcccatggagtacaagtatagttggaagtcctggggcaaagctaagataatcggagccgatgtccagaacacgacctttatcatagacgggcccaacaccccagagtgtcccgacgatcagcgcgcgtggaatatctgggaggtggaggactacggcttcggaatcttcacaaccaacatttggctgaagctccgggacagctacacccaggtctgtgaccacagattgatgtccgcggccatcaaggacagcaaggccgtccacgccgacatgggctactggatcgagtcggaaaagaacgaaacatggaaactggcccgggcgtcgttcatcgaggtgaagacgtgcatctggccgaagtcgcacaccctatggtctaacggggtcctggagtccgagatgatcatacccaagatctacggaggcccgatcagccagcacaactaccgccccggatatttcacacagaccgccggcccctggcacctagggaagctcgagttagacttcgacctgtgcgaaggcacgaccgtggtggtcgacgagcactgcggcaaccgtgggcctagtctccgcacgactacggtgactggcaaaatcatccacgagtggtgctgtcggagttgcaccctacctcctctgcgcttccgcggggaggatgggtgctggtacgggatggagatccgccccgtgaaggagaaagaggagaacctcgtaaaatccatggtgtcggccggcagcggcgaggtggactcattttcattagggttattgtgcatctcaatcatgatcgaggaggtcatgcggagtcgctggtcacggaagatgctgatgaccggaacgctggccgtctttttcctcctgatcatggggcagcttacgtggaacgacttaatccggctatgcatcatggtgggagccaacgcgagcgaccgaatgggtatgggtaccacctatctggcgttaatggccacgttcaagatgcggccgatgtttgccgtgggcctgctcttcaggcgcctcacctcccgtgaggtgctgttattaacgatagggttgagcttggtcgcctccgtcgagctccccaacagcttggaggagttaggagatgggttggcgatgggtatcatgatactgaagcttctaaccgacttccagtcccatcagctgtgggccacgctgctcagcttaacctttataaagacgaccttctccttacactacgcctggaagacgatggcgatggtcctcagcatcgtctccctgttccccctgtgcttaagcaccacctcccaaaagaccacgtggctgcccgtgctgttaggaagcctggggtgtaagccgcttactatgttcctcatcgccgagaacaagatctggggcagacgctcctggcccctgaacgaagggatcatggccgtgggcatcgtcagcatcctgctctcatccctgttaaagaacgacgtgcccctcgccgggcctcttatcgccggagggatgctgatcgcgtgctacgtgatttctgggtccagcgcggacctctccctggagaaggccgccgaggtcagctgggaagaggaggccgagcacagcggcgccagccataacatcctggtggaagtgcaggatgacggaaccatgaagatcaaggacgaggagcgggacgacaccctcacgatcctgcttaaggcgacactcctggccgtgtccggagtttacccgctgagcattcccgccaccctattcgtgtggtacttctggcagaaaaaaaagcagcgctccggggtgctttgggacacccccagcccgcccgaggtcgaacgggcagtgcttgacgacggcatctaccgcattatgcagagaggactgctcgggcgcagtcaagtcggcgtgggggttttccaggagaatgtcttccacaccatgtggcacgtcacccggggcgccgtgctgatgtaccagggtaagcgcctggaaccgagttgggcgtccgtcaagaaggatctcattagctatggcggagggtggcgtctgcagggctcctggaacgccggggaagaggtacaggtgatcgccgtcgagcccggcaaaaaccccaagaacgtgcagaccgcccctgggacctttaagacccccgaaggggaggtgggcgccattgcgctggacttcaaacccgggacgtccggctcccccattgtcaatcgggaagggaagatcgtgggcctctacggcaatggggttgtcaccacgagcggaacctacgtgagcgcaattgcccaggccaaggcgtcccaggaggggccgctgcctgaaatcgaggatgaggttttccggaaacgcaacctgaccatcatggacttgcatccaggaagcgggaagacgcggcgctatctgccggctatcgtcagagaggccatcaagcgcaagcttcgcaccctcatcctggcccccacccgggtggtggcttccgaaatggcggaggccctgaaaggcatgccgatccgctaccagacgaccgccgtcaagagcgagcacaccggcaaggaaatcgttgacctgatgtgccacgccactttcacgatgcggctgctgtcgcccgtgcgcgtccccaactacaacatgatcataatggacgaggcccacttcaccgaccccagctccatcgcggcccggggttacataagcacccgcgtggggatgggggaggccgccgccatcttcatgacagcgaccccgcccggttccgtggaggcgttcccgcagagtaacgccgtaatccaggacgaggagagggacatacccgaacgctcctggaactcagggtacgagtggattaccgacttccccggaaagactgtgtggttcgtgccctccataaagagcggcaacgacatcgctaactgcctccgcaagaacgggaagcgtgtcatccagctgtcgcgtaaaaccttcgatacggagtaccagaagaccaaaaacaatgactgggactacgttgtgactactgacatcagtgagatgggcgcgaatttcagagccgaccgggtaatcgacccgcgccggtgcctgaaacccgtgatactgaaggacgggcccgagcgtgtaatattggccggccccatgccggttaccgtggcctccgccgcgcagcgccgcgggaggatcggccgcaaccacaacaaggaaggcgaccagtacatttacatgggtcagcccctcaacaacgacgaggaccacgcccactggactgaggccaagatgctcctggacaacattaacacccctgagggcatcatccccgccctgttcgagccggagcgggaaaagtccgccgcgatcgacggggagtaccgactccgcggcgaggcccgaaaaacctttgtggaactgatgcgcaggggtgacctgcccgtgtggctctcatacaaggtggcaagcgagggcttccagtactctgaccgccgatggtgcttcgatggagagcgcaacaaccaggtcctggaggagaatatggacgttgagatctggactaaggaaggggagaggaagaagttaagaccccggtggttggacgctcgcacctactccgaccccctggcgctccgggagttcaaggagttcgctgccggccgccggagcgtgtcaggggacctcatcctggaaatcggcaagctgccgcagcacctgacccaacgcgcccagaatgccctggacaacttagtcatgctccacaacagcgaacagggcgggagggcgtaccgccacgccatggaggagctgcccgacaccatcgaaacgttgatgctcctggccctaatcgccgtgctaaccggcggcgtaacacttttcttcctgtccggccgaggactcggcaagactagcatcggcctgctttgcgtcatggcctcctccgtgctcctgtggatggcgtccgtggagccccactggatcgccgcttctatcatactggaattctttttgatggtccttttaatccccgagccggaccgtcagcggacgccacaggataaccagctcgcctacgtagttatcgggctgctgttcatgattctcacggtcgcggcgaacgagatgggtctactggagaccaccaagaaggacctcggaataggccacgtggccgtggagaaccatcaccacgcggcgatgctggacgtcgacctccatccggcctccgcgtggacactctatgccgtggccacgaccatcatcacaccgatgatgcgccacacaattgagaatacgaccgccaacatcagcctgaccgccatcgcgaaccaagccgccatactgatgggacttgacaagggctggcccatttccaagatggacatcggcgtacccctgctggctctcgggtgctacagccaggtcaatcccctgaccctgacggctgccgttctcatgctcgtggcccattacgccatcatcggcccggggctgcaggccaaggcgacccgggaagctcagaagcggacggccgccggcataatgaagaaccccaccgtcgacgggatcgtggcgatcgacctagacccggtcgtctatgacgcaaaattcgagaaacagctggggcagatcatgctgcttatcctgtgcacgtcccagatcctgctcatgcgcacgacctgggcgctgtgcgaaagcatcaccctggccacgggccccctcaccaccctttgggaagggtccccgggcaagttctggaacaccactatagccgtaagcatggcgaatatattccgggggtcgtacctggcgggggctggcttagcattcagccttatgaagtccttagggggcggccgccgtggaacaggagcacagggcgaaaccctcggcgagaagtggaagcgccagcttaaccaactgtccaagagcgagttcaacacctacaagcggtctgggatcatggaagtggaccgcagcgaagcgaaggagggcctcaagcgcggggagacgacaaaacacgccgtctcccgaggcaccgccaagctgcgctggttcgtggagcggaacctggtgaagcccgagggcaaggtcatcgacctgggctgcggccgcgggggctggagctattattgcgccggcctcaaaaaagtgaccgaggtgaaaggctacacgaagggagggcccggccatgaggaacccattccgatggcgacctacgggtggaacctagtcaagctacactccgggaaggacgtgttctttatcccgccggagaaatgcgacacgctcctgtgcgacatcggcgaaagctcccccaacccgaccatcgaggagggccgcacgctgcgggtgcttaagatggtagagccctggcttagagggaaccagttctgcatcaagatcctcaacccatacatgccaagcgtggtggagaccctcgagcagatgcaacggaagcacggcggtatgttagtccgcaatccgttatccagaaacagcacgcacgagatgtactgggtctcctgcgggaccggtaacatcgtgagcgcggtcaacatgacgtcccgcatgcttctcaaccgcttcacgatggcccaccggaagcccacctatgaaagggacgtagacctgggggccggcacccgacacgtggccgtagagcccgaggtcgccaatctcgacataattggccaaagaatagagaacatcaaacacgaacacaaaagtacctggcactatgacgaggacaacccctacaagacgtgggcgtaccatggctcctacgaagtgaaacccagcggctccgccagcagcatggtgaacggggtggtcaagcttctgacaaaaccctgggacgtgatacccatggtaacccagatagccatgaccgacacaacccccttcggtcagcaacgggtcttcaaagagaaggtggacacccggaccccgaaggccaagcgagggacggcgcagatcatggaagtgaccgcgaagtggctttggggcttcctgtcccgcaataagaaacctcggatctgcacccgcgaggaatttacccggaaggtgcggagcaacgccgcaataggcgccgtgttcgtcgacgagaatcagtggaactcggcgaaagaggccgtcgaggacgagcgattctgggacctggtccaccgcgagcgggagctccacaaacaggggaagtgcgccacgtgtgtgtataatatgatgggcaaacgcgaaaagaagctgggggagttcggaaaggcaaaaggaagtcgggctatctggtatatgtggcttggggcccgtttcctcgaattcgaggcacttggatttatgaacgaggaccactggttcagtagggagaactctctgtccggggtagagggcgaggggctccacaagctgggttacatcctacgcgacatctcgaaaattccgggtggaaatatgtacgccgacgataccgccggttgggacacccggatcaccgaggacgatctccagaacgaagcccgtataacggacatcatggagccggagcacgcgctgctggccaagtccatcttcaagctgacctaccagaacaaggtggtgagggtccagcggcccgccaagaacgggaccgtgatggacgtcatcagccgccgggatcagcgaggctccgggcaggtcggcacctacggcctgaacacgttcactaacatggaagcccagctgatcaggcagatggagagcgaaggcatcttctcccctagtgaactcgagacccccaacctggctgagcgcgtgctggactggctcgagaaatacggcgtggagcggctgaagcgcatggcgatctccggggatgactgcgtcgtgaagcccatcgacgatcggttcgccaccgccctgacggccctcaacgacatggggaaggttcgcaaggacatcccccagtgggagccaagcaaagggtggaacgactggcaacaggtccccttttgctcacaccacttccaccagctgatcatgaaggacggcagagagatcgtggtaccttgccggaatcaggacgagctggttgggcgggctcgcgtgagccagggggctggatggtccctccgggagaccgcgtgtctgggtaaatcctacgcgcagatgtggcagctgatgtactttcaccgtcgcgacctccgcttagcagctaatgcgatctgcagcgccgtgccggtcgactggataccgacctccagaacaacctggtccatccacgcgcaccaccaatggatgaccaccgaagacatgttgtccgtctggaatcgcgtgtggatcgaggagaacccctggatggaagacaagacccacatcagctcctggggcgacgtaccgtatctcgggaagcgcgaagaccaatggtgcgggagcctgatcggcctgacggcccgggcgacgtgggctaccaatatccaggtggccataaaccaagtccgccggttgatcgggaacgagaactacttagactacatgacctcgatgaagcgcttcaagaacgagagcgatcccgaaggcgccctttggtaa

SEQ ID NO: 24141 - RNA, 9879 nt, synthetic construct
  misc_feature 1..9879: note = derived and/or modified CDS sequence (opt11) from DENV-1__FJ182027__SS-prME
  source 1..9879: mol_type = other RNA
agcgtaaccatgctgctaatgctgatgcccacggccctggccttccacctcaccaccaggggcggggaaccgcacatgatcgtgtcaaagcaagagcggggcaagagtctgttgttcaaaacgagtgccggggtcaacatgtgcaccctcattgcgatggacctgggcgagctgtgcgaggacaccatcacctacaagtgcccccgcattaccgagaccgagcccgacgacgtggattgctggtgcaacgccacagacacctgggtaacctatgggacttgcagccagacgggcgagcataggcgggataagcggtccgtagccctcgcgccccacgtgggcctggggctggagacccgaaccgagacctggatgagctccgagggcgcctggaagcagatacaaagagtcgagacgtgggccctacgccaccccgggttcaccgtgatcgccctatttctggcacacgccataggcaccagcatcacccagaagggcatcatattcatactcctgatgctggtgacaccctccatggctatgcggtgtgtcggcatcggctcacgcgatttcgtggaagggctctccggcgccacctgggtggacgtcgtgctggagcacgggagctgcgtgaccaccatggccaaggacaagcccacgctggacatagagctcctgaagactgaggtcaccaacccggcagtgctgcggaagctctgcatcgaagccaagatatccaacacaacgaccgactcacgctgtccgacccagggcgaggccaccctggtggaggaacaggacgccaactttgtctgccgcagaacgttcgtagaccggggttgggggaacggctgtggcttattcggcaagggctcactcatcacgtgcgcaaagttcaagtgcgtaacaaagctggagggcaagatcgtccagtatgagaacctcaagtacagcgtaatcgtgaccgtccacaccggcgaccaacaccaggtggggaacgagtctaccgagcacggtactaccgccaccatcacgccgcaggcgcccaccacggagatccagctcacagactacggggccctgacgctggactgcagcccccgcaccggcctcgacttcaacgagatggtcctgctgaccatgaaggaaaagtcctggctcgtgcacaagcagtggttcctggatctgcctctaccctggaccagcggtgccagcacatcccaggagacgtggaaccggcaggacttactggtgaccttcaagaccgcccatgccaagaagcaggaggtcgtagttctcggcagccaggagggcgcgatgcacacagccctgacgggggccaccgagatccaaacctccggcaccacaaccatcttcgccgggcacttaaagtgccgcctcaagatggacaagctgaccctgaggggcatgagctacgtcatgtgcaccgggtccttcaagctcgagaaggaggtggccgagacccagcacggcaccgtgctggtccagatcaagtacgagggtacagacgcgccctgcaagatccccttcagcacgcaggatgagaagggggtcacccaaaacggccgccttatcacagccaatccgatcgttactgacaaagagaagccggtcaacatcgaggccgagcctccttttggtgagtcatatatcgttatcggcgccggggagaaagcgctgaagctcagctggttcaagaaggggtccagcatcggcaagatgttcgaggccactgcgcgcggggcccgccgcatggccatcctaggcgacaccgcgtgggacttcgggtccatcggcggcgtgttcaccagcgtcgggaagctggttcaccaaatcttcggcaccgcctacggcgtgctattttccggcgttagctggacgatgaagatcgggatcggcgtactgttaacctggctcggtctgaactcccgcagcacctccctgagtatgacctgcatcgcagtgggcctcgtcactctgtacctgggcgtaatggtgcaagctgactccgggtgcgtgatcaactggaaaggccgcgagcttaagtgcgggagcggcatcttcgtgaccaacgaggtgcacacctggaccgagcaatacaagttccaggccgacagcccgaagcggctgtccgcggctatcggcaaggcatgggaggagggggtctgcggcatacgcagcgccacccggctggagaatatcatgtggaagcagatctccaacgagctcaaccatatcctgctggagaacgacatgaagttcacggtggtggtgggggacgtagccggcatcttagcccaggggaagaaaatgatccgcccccagccgatggagcacaagtacagttggaagtcctggggcaaggccaagattatcggcgctgacgtgcagaacactacctttatcatagacgggccaaacacccctgagtgcccggacgaccagcgggcatggaacatctgggaggtcgaggactacggcttcgggatcttcacgacaaacatctggctgaagctgcgcgacagctacacccaggtgtgcgaccaccggctcatgtccgcagcgatcaaggacagcaaggcggtgcacgccgacatgggctactggatcgagtccgagaagaacgagacctggaagctggcacgcgctagcttcatagaggtcaagacatgcatttggcccaagtcccacaccctgtggagcaatggcgttttagagtccgagatgataatccccaagatctacgggggcccgatcagccagcataactaccggcccgggtatttcacccaaaccgccggcccgtggcacctggggaagctggagctcgacttcgacctgtgcgagggtacgaccgtcgtagtggacgaacactgtggcaaccgtggcccgtccctgcggaccaccacggttaccggcaagataatccatgagtggtgctgtcgcagctgcaccctgccccccctccggttccgcggggaggatggctgctggtatgggatggagatccggcccgtcaaagagaaagaggagaacctggtgaaatccatggtgagcgccggctcgggcgaggtggactcatttagcctcggactgctgtgcatctccatcatgatagaggaggtgatgaggagccggtggtcccgcaagatgctcatgaccggcactctggccgtcttcttcctgctcatcatggggcagctaacctggaacgacctgattcgcttgtgcatcatggtaggtgccaacgcgagcgaccgtatggggatgggcaccacgtacctggcactgatggccaccttcaagatgcgcccgatgttcgccgtgggcctcctgttccggcgcctgacatccagggaggttctcctgctgaccatcgggctctccctggtagcctccgtggagctgcccaactccctcgaggagcttggcgatgggctagcgatgggaatcatgatcctcaagctgctcaccgacttccaatctcaccagctttgggccaccctgttgagcctcacctttataaagaccacattctccctgcactacgcctggaagacgatggccatggtcctgtcgatcgtgtcccttttccctctgtgcctgagcacaacctcccagaagaccacgtggctaccggtgctgttaggctcgctcggctgcaagccgctgaccatgttcctgatcgcggagaacaagatctggggcagacgttcctggcctctcaacgaggggatcatggccgtcggcatcgtgagcatactgctaagctcgctcctgaagaacgatgtgcctctggcaggtccactcatagcaggcggcatgctgatcgcctgttacgtcatatcggggtccagcgcggatctgtccttagagaaagccgctgaagtgtcgtgggaggaggaggccgagcactccggtgccagccataacatattagtggaggtccaggacgacgggacgatgaagatcaaggacgaagagcgcgacgacacactgacaatcctcttgaaggcgacgctgctcgccgtgtccggggtgtacccgcttagcatccccgccaccttgtttgtctggtacttctggcagaagaagaagcagagatccggggttctctgggacaccccctcgccgcccgaggtagagcgcgcagtcctggacgatgggatctatcggatcatgcagcgaggactgctggggcggtcccaggtgggcgtaggggtcttccaggagaacgtgttccacaccatgtggcacgtgacgcgcggcgcagtcctcatgtaccagggtaagcggctggagcccagttgggcgagcgtgaagaaggacctgatcagctacggaggcgggtggcgcctccagggctcgtggaacacaggggaggaggtgcaggtcatcgctgtggagcctggcaagaatcccaaaaacgtgcaaaccgcgcccggaaccttcaagacccccgagggtgaggtcggcgccatcgccctggacttcaagcccgggacctctggttcccccatcgtcaaccgtgaggggaagattgtgggcttatacggcaacggggtcgtgaccaccagcggcacgtacgtgagcgcaatcgcccaggccaaggcttcacaggaagggccactccccgagatcgaggacgaggtcttccgcaagcggaacctgaccatcatggacctgcacccaggcagcgggaagacccgccgctacctcccggccatcgtgcgcgaggccatcaagcgaaagctgcggaccctgatcctcgcccccacccgcgtcgtcgcctcggagatggccgaggcgttgaagggaatgcccatccggtaccagaccaccgccgtcaagagcgagcacaccggcaaggagatcgtggacctgatgtgccacgccacgttcaccatgcgcctcctgagcccggtccgggtcccgaattacaacatgataattatggacgaggcccacttcaccgaccctagctccatcgccgcgcgcgggtacatcagtacaagggtgggcatgggggaggccgccgcaatcttcatgacggccacgccgcccggctctgtcgaagccttcccgcagtcgaacgccgtgatccaggacgaggagcgcgacatccccgaacgttcctggaatagcgggtacgagtggatcaccgatttccccggtaaaacagtgtggttcgttccatccatcaagtccggaaacgacatcgccaattgcctgagaaagaacgggaagcgcgtgatccagttgtcccgcaagacgttcgacaccgagtaccaaaagaccaagaacaacgactgggactacgtggtcaccacggacatcagcgagatgggcgccaacttccgcgcggaccgcgtaatcgatccgcggagatgcctgaagcccgtgatactgaaggacggcccagagcgagttatcctcgccggccccatgccggttacagtcgcctccgccgcgcagcgccgggggcgcatcggccgaaaccacaacaaagagggcgaccagtacatctacatggggcaacctctgaataacgatgaggatcacgcgcactggaccgaggccaaaatgctgctcgacaatatcaacacacccgagggcatcatccccgccctgttcgagccggaacgggagaagtccgccgccatcgacggggagtaccgcctgaggggcgaggcgcgcaagaccttcgtcgagctcatgcggcgcggggacctgccggtatggctgtcctacaaagttgccagcgagggcttccagtatagcgaccggcgctggtgttttgacggcgagcggaacaaccaggtgctcgaggagaacatggacgtggagatatggaccaaggaaggtgagcgcaagaagcttcggcctcgctggctggacgcccggacttatagtgatccattggccctgcgtgagttcaaggaattcgccgctggacggcgcagcgtctccggcgacttaatcctcgaaatcgggaagctgccacagcatctgacccagcgggcccagaatgccctcgacaacctggtgatgctgcacaatagcgagcagggcgggcgcgcctaccgtcatgcgatggaggaactccctgacacgatcgagacgctgatgctgctcgccctgatcgctgtgctgactggcggagtaaccctcttcttcctgtccggccgcgggctgggcaagaccagcatcggcctcctgtgtgtgatggcctcctcggttctgctctggatggcctccgtggagccgcactggatagcggctagcatcatcctggaattctttctgatggtgttactgatccccgagccggaccggcagcgcacgccccaggacaaccaactggcctacgtggtcatcgggctactcttcatgatcctgactgtcgctgccaacgagatgggcctgctggagaccaccaagaaggacctagggatcggccacgtggcggtcgagaaccaccaccacgccgccatgctcgacgtggacctgcaccccgcctccgcctggacgctgtacgcggttgccaccactatcatcaccccgatgatgcgccacacgatcgagaacaccaccgccaacatctcactcaccgccatcgccaaccaggcggcgatcctgatggggctagataaggggtggcccattagtaaaatggatatcggcgtccccctcctggccctggggtgctacagccaagtgaaccccctcacgctgaccgcagcggtgctcatgctcgtcgcacactacgccatcatcggaccggggctgcaggctaaagccacccgggaggcgcagaaacgcaccgccgcaggcatcatgaagaaccccactgtcgacgggattgtggctatagatctcgaccctgtcgtgtacgatgccaagttcgagaaacagctcggccagataatgttgctgatcctctgtacctcccagatattgctgatgcgaacgacctgggctctatgcgagagcatcacgctggctacggggcccctgaccaccctctgggaggggtctccgggaaaattctggaacacgaccatcgccgtgagcatggccaatatcttccgcgggtcctacctggccggcgcgggcctggccttcagcttaatgaagtccctcgggggagggcggcgcgggacgggtgcccagggcgagaccttaggcgagaagtggaagcggcagttgaatcagttgtccaagagcgaattcaacacgtacaagcgctccgggattatggaggtcgacaggagcgaggccaaggagggcctgaagcgcggtgaaaccaccaagcatgcggtgagccgaggcaccgccaagctccgctggttcgtcgaacggaacttagtcaagcccgaggggaaagtgatcgacctgggctgcggccgcggcggctggagctactactgcgccggcctcaagaaggtgacggaggtcaaaggctacaccaagggcggtcccggccacgaggagcccatcccaatggccacctacgggtggaaccttgtgaagctgcactccggtaaggatgtgttcttcattccgcctgagaaatgcgacaccctgttgtgcgacatcggggaaagctcccccaacccaaccatcgaagagggccggaccctgcgcgtactgaagatggtggagccctggctccgggggaatcagttctgcatcaagatcctgaacccgtatatgcccagcgttgtcgagacgttagagcagatgcaacgcaagcacggcggcatgctggtgcggaatcccctgtccagaaacagcacccacgagatgtactgggtgtcttgcgggaccggcaatatcgtttccgccgtgaacatgacgtctagaatgctcctcaaccggttcactatggcgcaccgcaagcccacctacgaacgggacgtggatctcggggcaggcactcgccacgtcgcagtggagccagaggtggccaacctggatattatcggccagcggatcgagaatatcaagcacgagcacaagagcacgtggcactatgacgaggacaacccgtacaagacttgggcctaccacgggtcctacgaggtcaagccgtcgggctccgcaagctcgatggtaaacggcgtcgtgaagctcctgaccaagccctgggacgtgatccctatggtcacccagatcgctatgacggacaccacccccttcggccagcagcgcgtgttcaaggaaaaagtggacaccagaacaccgaaggccaagcgcgggactgcccagattatggaggttaccgccaaatggctgtggggcttcctctcccggaacaagaagccccgcatctgcacccgggaggagttcacacgcaaggtgcggtctaacgcggcgatcggcgcagtgttcgtcgatgagaaccagtggaactcagccaaggaggcggtggaggacgagcgcttctgggacctagtgcatcgggagcgcgagctgcacaagcaggggaagtgtgcgacctgcgtatataacatgatggggaagcgcgagaagaagctcggggagttcggcaaggccaaagggagccgcgccatctggtacatgtggctgggtgcccggttcttagagttcgaggccttgggcttcatgaatgaagaccattggttctccagggagaacagcttatccggggtggagggcgaggggctgcacaagttaggctacatcctgcgtgacatcagcaagattcccgggggcaacatgtacgccgatgacaccgctggctgggacacgagaataacggaggacgacttgcagaacgaggcccgtatcaccgacatcatggagccggagcatgccctcctggcgaagtcaatcttcaaactgacctaccaaaacaaggtggttagggtgcagcgccccgccaagaacgggaccgtgatggacgtcatcagccggcgcgaccaacggggctccgggcaagtaggcacgtatggcctcaataccttcaccaatatggaggcccagcttatccgccagatggagagcgaagggatcttttcccccagcgagctagagaccccaaacctagcggagcgggtgctggactggctggagaagtacggcgtggagcgcctcaagcggatggccatctccggggacgactgcgtagttaaaccgatcgacgacagattcgcgacggccctgaccgccctgaacgacatgggcaaggtccggaaggacatcccacaatgggagcctagcaaagggtggaatgactggcaacaggtccccttctgttcccaccacttccaccaactcatcatgaaggatggccgcgagatcgtggtcccgtgccgaaaccaagacgagctggtgggccgcgcccgggtgagccagggggccgggtggtccctgcgcgagaccgcctgcctgggtaagagttatgcccagatgtggcagctgatgtatttccaccggcgggacctcaggctggccgcgaatgcgatctgcagcgccgtccccgtggattggattcccacctcaaggaccacctggagcatccacgctcaccaccagtggatgaccacagaagacatgctgtccgtgtggaaccgcgtctggatcgaagaaaatccctggatggaggacaagacgcacatctcctcctggggcgatgttccttacctggggaagcgggaagatcagtggtgcggcagcctcatcggcctcaccgcccgcgccacctgggcgaccaacatccaggtggccatcaatcaggtccggcgcctgatcgggaatgagaactacctcgactacatgacatcgatgaagcggttcaagaatgagagcgaccctgagggcgccctgtggtga

SEQ ID NO: 24142 - RNA, 9879 nt, synthetic construct
  misc_feature 1..9879: note = derived and/or modified CDS sequence (opt11) from DENV-1__FJ024449__SS-prME
  source 1..9879: mol_type = other RNA
agcgtgaccatgctgctcatgctgatgcccacagcacttgctttccatctcacaacacgggggggggaacctcatatgatcgtaagcaagcaggagcgtggcaagagcctgctgttcaagacgagcgccggggtgaacatgtgcaccctcatcgccatggatctgggcgagttatgcgaagataccatgacctacaagtgcccccggatcaccgaaaccgagcccgacgacgtggactgctggtgcaatgcaacggacacatgggtcacctatgggacgtgcagccaaaccggcgagcaccggagggataagcggtccgtggcactcgcaccccacgtgggactgggtctagagacgcgcacggagacctggatgagctcagagggggcctggaagcaaatacagcgggtcgagacatgggccctccggcatcccgggttcaccgttatcgccctgttcctggcccacgcgatcggcactagcatcacacagaaagggatcatcttcatccttctgatgctggtgacgccctccatggccatgcggtgcgtcggcatcggctcacgcgatttcgtcgaggggctatccggcgccacctgggtggacgtcgttctggaacacgggagctgcgtgaccaccatggccaaggacaagcccacgctggacatcgagctcttaaagaccgaggtaaccaaccccgccgtcctgcggaagctctgcatcgaggcgaagatctccaacaccacgaccgacagcaggtgcccaacccagggcgaggcgaccctggtggaagaacaggacgcgaactttgtgtgccggcgcacgtttgtggacaggggctgggggaacggttgcggcctgttcggcaaggggtccctcataacttgcgctaagttcaagtgtgtgaccaagttggagggcaaaatagtccagtacgagaacctgaagtacagcgtgatcgtgaccgttcacacgggcgaccagcaccaggtgggtaacgagtccaccgagcacggcaccaccgccactatcacgccccaagcacccaccaccgaaattcaactcactgactatggggctctgactctggactgcagcccccgcaccggcttagacttcaacgagatggtactgttgaccatgaaggagaaaagctggctcgtgcacaagcagtggtttctggacctgccactcccctggacctcaggcgccagcacgtcccaagagacctggaaccggcaggacttgctagttaccttcaagaccgcccatgcgaaaaagcaggaagtcgtggtgttgggcagccaggagggcgccatgcatacggccttaaccggtgcaacggagatccagacgtccggcacgaccaccatcttcgccgggcacctgaagtgccgccttaaaatggacaagctgaccctgaagggcatgagttacgtcatgtgcaccgggtccttcaagctcgagaaggaggtggccgagacccagcacggcacggtgttagtgcaaatcaagtacgagggcaccgacgcgccctgcaagatcccgttcagcacacaggacgagaagggggtgacacagaacggcagattaatcaccgccaacccgatcgtcaccgataaagagaagcccgtcaacatagaggctgagcctcccttcggtgagtcctacataataatcggcgccggcgagaaagcgctgaaattgtcttggtttaagaaggggtccagtatcggcaagatgtttgaagccacggcccgcggggccagacgcatggccatcctgggcgacactgcgtgggacttcggctccatcggcggcgtgttcaccagcgtgggtaagctggtccaccagatattcggaaccgcctacggggtgctgttctccggcgtgagctggacgatgaagattgggatcggtgtcctgttaacttggctcggcctgaactcccgctccacctcactgtcaatgacctgcatcgcggtgggactagtaacgctgtatctgggggtcatggtgcaggccgacagcggctgcgtgatcaattggaagggccgcgagctcaagtgcgggagcggcatctttgtgactaacgaggtgcacacctggaccgagcagtataagtttcaggctgactcacctaagcgtttgtctgcggccatagggaaagcctgggaggaaggtgtgtgcggcatccggagcgctacccgcctggagaatatcatgtggaaacagatctccaacgagctcaaccatatcctcctggagaacgacatgaagttcacggtggtggtgggtgatgtcgctggcatcctagctcagggaaagaagatgatccggccgcagcccatggagtataagtactcttggaagtcctgggggaaggctaagataattggcgcggatgtgcagaacaccacctttatcatagatggccccaacaccccggaatgccccgacgaccagcgcgcctggaacatctgggaggtggaagattacggcttcggaatcttcacgaccaatatctggctgaagctgcgtgattcccacacccaggtctgcgatcaccgcctaatgagtgcggccatcaaggacagcaaggccgtgcacgccgacatgggatactggatcgaatccgagaagaatgagacctggaaactggcccgggctagctttatcgaggtgaagacgtgcatctggcccaagtcccacaccttatggtccaacggggtcctcgaatccgagatgatcatcccgaagatctacggaggccctatctcccagcacaattaccgtcccgggtatttcacccagaccgcgggcccttggcacctcgggaagctggaactggacttcgacctgtgcgagggcactaccgtggtggttgatgaacactgcggcaaccgtgggccaagtctaaggacaaccacggtgactggtaagatcattcacgagtggtgctgccggagctgcaccctgccccccctccgcttcagaggggaggacgggtgctggtatgggatggagatcaggcccgtgaaggagaaggaagagaatcttgtcaagtccatggtgtcggccggatccggcgaggtggattctttcagcctcgggctgctgtgcatctccatcatgatagaggaggtcatgagaagccgatggtcccgcaagatgctgatgacaggcacgctggccgtgttcttcctactgataatggggcagctcacctggaacgatctgatccgcttgtgtatcatggtgggcgccaacgccagcgaccgcatggggatgggcaccacctacctggccctaatggccaccttcaagatgcggccgatgttcgcagtagggctcctgttccgacgtctgacctcacgcgaggtgctcctgctaacgattgggttaagcctggtcgcttccgtcgagctgcccaactccctcgaggagctgggggacgggctcgcaatgggcattatgatcctcaaactgctaaccgactttcaatcccaccagctctgggccacgctgctgtcgctcaccttcatcaagacaaccttttccttacactacgcctggaaaacgatggctatggtgctatctatcgtatccctattcccactgtgcctgagcaccacctcccagaagaccacctggctacccgtactgctgggaagcctcgggtgcaagccgctgaccatgttcctgatagcggagaacaagatctgggggcggcgctcctggcctttaaacgaggggatcatggccgtgggcatcgtgagcatccttctgagctcgttattaaagaacgacgtgccgcttgccgggcccctcatcgccggcggcatgttgatcgcctgctacgtgatcagcgggtccagcgcggacttgtccctagagaaagccgccgaggtcagctgggaggaagaggctgaacactccggtgcctcacacaacattctggtggaggtgcaggacgacggaaccatgaagatcaaggacgaagaacgtgacgataccctcaccatccttctgaaggcgacgctactcgccgtctccggcgtatacccgcttagcataccggccacactgttcgtgtggtacttctggcaaaagaagaagcagcgctccggtgtcctctgggacaccccgagcccgccggaggtggagcgggccgttctcgacgacggaatctaccgcattatgcagagaggcctgctggggcgctcccaagtcggcgtaggggtcttccaggagaacgtcttccacaccatgtggcatgtgacgcggggggccgtgctcatgtaccaggggaagcgcctggagcccagctgggcgtccgtcaagaaggacctgatcagctacggaggcgggtggcggctccagggatcctggaacacgggagaggaggtccaggtcatcgccgttgagccaggcaagaaccccaagaatgtccagaccgccccggggaccttcaaaacgcccgagggcgaggtaggcgccatcgccctggatttcaaaccgggcaccagcggctcccctatcgtcaaccgcgagggcaagatcgtgggcttatacggcaacggggtggttaccacctctggcacgtatgtgagcgcaatcgcccaggccaaagcctcccaagaggggccgctccccgagatcgaggacgaggtgttccggaagcgaaacttaaccatcatggacctgcaccctggaagcggtaaaacgcggaggtatctccccgcgatcgtccgcgaggctatcaagagaaagctgcgcaccctgatcctcgcccccacgcgggtggtggcgtccgagatggcggaggcactgaaaggcatgcccatacgctaccaaactaccgccgtcaagtcagagcacaccggcaaggagattgtggacctgatgtgccacgccacgttcaccatgagactcctgtcccccgtgcgcgtcccgaactacaacatgatcattatggacgaggcccacttcaccgatcctagctccatcgccgcacgtggatacattagcacccgcgtgggcatgggggaggctgcggccattttcatgactgcaaccccacctggctccgttgaggcgtttccgcagagcaacgccgtcatccaggacgaggagagggatatccccgagcggtcgtggaacagcggatacgagtggatcaccgacttccccggcaagactgtgtggtttgttccctccatcaagtccggcaacgacatcgccaactgcttgcggaagaacgggaagcgcgtcattcagctcagccggaaaacgttcgacaccgaataccagaagactaagaacaacgattgggactatgtggttaccacggacatcagcgaaatgggcgccaactttcgggcggaccgggtaatcgacccgcgccggtgcctgaaacccgtgatcctgaaggacggtcccgagcgcgtaatcttggccggccccatgccggtcaccgtagcctccgccgcccagcggcgcgggcggattggccgcaaccataacaaggaaggggaccagtacatctatatggggcagccgttaaacaacgacgaggatcacgcgcactggaccgaggcaaagatgctgctcgacaacatcaacacccccgaaggaatcatccccgccctgttcgagccggagcgggagaagtcggccgccatagacggggaatatcggctccgcggcgaggcccggaagacgttcgtcgagctcatgaggcgcggggacctacccgtgtggttatcctataaggtggccagcgagggtttccagtactcagatcgacggtggtgcttcgacggcgagagaaacaaccaagttcttgaggagaacatggacgtggagatctggactaaggagggcgagcgtaagaagctacgcccccgttggcttgatgcccgcacctactccgatccccttgctttacgagagttcaaggagtttgccgcgggtcgccggagcgtgtccggtgacctgatcctcgaaataggcaagctcccgcagcatctgacccagcgcgcccagaacgccttagacaacctcgtcatgcttcataacagcgagcagggcgggcgagcctaccgccacgcgatggaggagttacccgacacgattgagaccctgatgctgctcgccctgatcgctgtgctgactggcggcgtgaccctgttcttcctgtccggcagggggctcggaaagactagcatcggcctcctgtgcgtcatggccagcagcgtgttgctctggatggcctcagtggaaccccactggatcgccgccagcatcatcctggagttcttcctgatggtgctactgatccctgagccggaccgccagcgaacgccccaggataatcaactggcctacgtagttataggattgctgttcatgatcctcacggtcgcagccaacgagatgggcctcctagagactaccaagaaggacctcgggatcggccacgtagcggtggagaatcatcaccacgccgccatgctcgatgtcgacctgcacccagcctccgcctggacgctttacgcggttgccaccacaatcattacaccgatgatgcgccacaccatcgagaacaccaccgcaaatatcagcctcaccgcaatcgccaaccaggcggccatcctgatggggctggacaaaggatggcccatctccaaaatggacatcggcgtgcccctcctggccctggggtgctacagccaagtcaaccctctcacgctgactgccgcggtgctcatgctcgtagcacactacgccataatcgggcccggattgcaggcgaaggccacgcgcgaggcgcagaagcgcaccgccgctggaatcatgaaaaaccccacagtcgatgggatcgtggccatcgacctggaccccgtggtctacgacgccaagttcgaaaagcaactcggccagatcatgttgctgatactctgcacctcccagattctgctgatgcgcaccacctgggcgctctgcgagtcaatcacgctcgccaccggccccttaaccacactgtgggaggggtccccaggcaaattctggaacacgacaattgccgtcagcatggccaatatcttccgggggtcctacttagccggcgcgggactggccttcagccttatgaaatccctcggtggcgggcgccgggggaccggggctcagggcgagaccttgggggagaagtggaagaggcaattaaaccaactatccaagagcgagttcaacacgtacaagcggagtgggatcatggaggtggaccgttctgaggcgaaagagggcctgaagcgcggggaaaccaccaagcacgcggtctcccgcggtaccgctaagctccggtggtttgtggagcgcaacctcgtgaagcccgaggggaaggttattgacttaggctgcggccgcgggggctggtcatactactgcgccgggttgaagaaggtgacggaggtgaagggctacaccaaaggcggccccggccacgaggagcccatacctatggccacctacggatggaaccttgtcaagttgcattccggcaaggacgtgttcttcatcccgcccgagaagtgcgacaccctgctctgtgacatcggggagagctcccccaacccgacgatcgaggagggccgaaccctgcgggttctgaagatggtagagccctggctccgcggaaaccagttttgcatcaagatcctgaacccctacatgcccagcgtggtggaaacactggagcagatgcagcggaagcatggcggaatgctcgtgaggaacccgctgagcagaaacagcactcatgagatgtactgggtatcctgcgggaccggcaacatcgtgagcgccgtcaatatgacgtcccgtatgctcctcaaccgattcaccatggcgcatcggaagccaacctacgagcgcgacgtggacctaggagcaggcacccggcatgtagccgtcgagcccgaggtcgcgaatctggacataattggtcagcgcatcgaaaacatcaagcacgagcataagtcaacgtggcactacgacgaggataatccatacaagacctgggcgtaccacggctcctacgacgtgaagcctagcggatccgcgagcagcatggtcaacggggtcgttaagctccttaccaagccctgggacgtgatccctatggtgacccagatcgccatgacggatacaacccccttcggccaacagcgggttttcaaggagaaggtggacacccgcacgcccaaggctaagcggggtaccgctcaaatcatggaagtcaccgccaagtggctgtggggcttcctctcccgtaataaaaagccccgcatctgtacccgtgaggagttcacgcggaaggtaaggtctaacgcggccatcggcgcagtgttcgtagatgagaaccagtggaacagcgcgaaggaggcggtcgaagacgagcggttctgggaccttgtgcatagagagcgggagttgcacaagcaggggaagtgtgcgacgtgtgtgtacaacatgatggggaagcgcgagaagaagctcggagaattcggcaaggccaaggggtcgcgggccatctggtacatgtggctgggcgcccgcttcttggaattcgaagcgctcggctttatgaatgaggaccactggttctcccgggagaattctctgtccggcgtcgagggcgaagggctgcataagctcggctacatcctgcgcgacatcagcaagattcctgggggtaacatgtacgccgacgatacggccggctgggatacccggataactgaggacgatctgcagaatgaggctcgcatcaccgacatcatggagccggagcacgccctcctggcgaagtccatctttaagctgacttatcaaaacaaggtggtgcgcgtccagcggcccgccaagaacggcacagtgatggacgttatctcccgccgggaccagcgcggatcagggcaggtcggcacctacggactcaacaccttcaccaacatggaggcccagctcatccggcagatggaatcggagggcatcttctcacccagcgagctggagaccccgaacttggctgaacgcgtgctggactggctaaagaagtacggcgtggagcgtttgaagcgcatggctatctcaggggacgactgcgtcgtgaagcctatcgacgaccgtttcgcgacggctctgactgccctgaacgacatgggtaaggtgcgaaaggacatcccccaatgggagcccagcaagggctggaacgactggcagcaggtccccttctgcagccatcacttccaccagctcattatgaaggacggccgggagatcgtggtcccgtgccgcaaccaggacgagctggtcggccgggcccgcgtgagccagggggcgggatggtccctgcgagagacggcttgcctcgggaaatcctacgcccagatgtggcagctgatgtacttccaccgcagggacttacgcctggccgccaacgctatctgcagcgccgtgccagttgattggatccccacctctagaaccacctggagcatccacgcccaccaccaatggatgacgactgaagatatgctgtcagtctggaaccgcgtgtggatagaggagaatccttggatggaggacaagacacacatcagttcctggggggacgtgccgtacctggggaagcgagaagaccagtggtgcggcagcttgataggcctgaccgcccgtgcgacctgggcgactaacatccaggttgccatcaaccaggtgcgccggctgatcgggaatgagaactacctcgactatatgacctccatgaagcgcttcaagaacgagggcgacccagagggggccctgtggtga

SEQ ID NO: 24143 - RNA, 9879 nt, synthetic construct
  misc_feature 1..9879: note = derived and/or modified CDS sequence (opt11) from DENV-1__FJ390383__SS-prME
  source 1..9879: mol_type = other RNA
agcgtgaccatgctcctgatgctaatgcccaccgccctggcatttcacctcaccaccaggggaggggagccccacatgatcgtgagcaagcaagagcggggcaagagcctgctgttcaagacctccgcaggggtgaacatgtgcacgctcatcgccatggacctgggtgagctgtgcgaggacaccatgacctataagtgcccccggatcactgaaaccgagcctgacgacgtggactgctggtgtaacgccacagacacctgggtgacctacgggacttgcagccagacgggcgagcaccggcgggacaagcggtccgtggctctcgcaccccacgtgggcctcgggctggaaacccgcacagaaacgtggatgtcaagcgaaggtgcgtggaagcagattcaacgtgtcgaaacgtgggccctccggcaccccgggtttactgtgatcgccttgttcctagcccacgcgatcggcaccagcatcacccaaaaggggatcatctttatcctcctaatgctcgtgacgccgtccatggcgatgcggtgtgtaggcatcggcagccgcgactttgtggaggggctctccggggccacctgggtggatgtcgtgctagagcacggcagctgcgtgaccaccatggctaaggataagcccacgctggacatcgagctgctgaagactgaggtcaccaaccccgccgtgctgcggaaactctgcatcgaagcgaagatttcgaatacaactacagacagccgctgccccacccagggagaggccaccctcgtggaggaacaggacgccaacttcgtatgtcgtcgcactttcgtcgaccggggttgggggaacggctgcggtctcttcggcaaggggtccctgatcacgtgcgccaagttcaaatgtgtcaccaagctggaaggtaagatcgtccagtacgagaacctgaaatacagcgtgatcgtgaccgtccatacgggagaccagcaccaggtcgggaatgaatccaccgagcacggcaccactgctaccataacgccccaggcgccaaccaccgagatccaattgaccgactacggcgcgcttacgcttgactgcagcccccgcactggcttagatttcaacgagatggttctgttgaccatgaaggaaaagtcatggctcgttcacaagcagtggttcttagacctgcccctcccctggacgagcggagccagcacgtcacaagagacctggaaccgtcaggatctcctggtaacctttaagactgcccacgccaagaaacaagaggtggtggtgctcggtagccaggagggcgcgatgcacacagccctgaccggggcaacggagatccagacctccggcactaccaccatctttgccgggcacctgaaatgccgtctgaaaatggacaagctgacactaaagggcatgagctacgtcatgtgcacggggtcattcaagctcgagaaggaagtggccgagacccaacacggtaccgttctggtccagatcaagtatgaaggcacggacgcgccctgtaagatacccttcctgacgcaggacgagaaaggggtgacgcagaacggtcgattgattacagccaacccgatagtgaccgacaaggagaagcccgtaaacatcgaggccgaaccgcccttcggagagtcatacatcatcatcggcgccggcgagaaggcgctcaagctgtcctggttcaagaaggggagctcgatcggaaagatgttcgaggccacggcgcgcggggcaaggcgcatggcaatcctcggagacaccgcgtgggacttcgggagcattggcggggttttcaccagtgtagggaagctggtccaccaaatttttgggaccgcatacggggtgctgttctctggcgtgtcctggacaatgaagatcgggatcggcgtcctactcacttggttgggcctcaacagccgctcaaccagcctcagcatgacctgcatagccgtagggctcgtgacgctgtaccttggcgtaatggtgcaagccgacagcggatgcgttatcaactggaagggcagagagctgaagtgcgggtccggcattttcgttactaatgaggttcacacctggactgagcagtacaaatttcaagctgactccccgaagcggctgagcgcggccatcggtaaggcatgggaggaaggggtatgtggcatacgttccgctacacggttggagaacatcatgtggaagcaaatcagcaacgaactgaaccatattctgttagagaacgacatgaagtttactgtcgtggtgggcgatgtggctggcatcttggcgcaggggaagaagatgatcaggccccagcccatggagtataagtattcatggaagtcctggggcaaggcgaagattatcggagctgacgttcagaacaccacgttcattatcgacggccccaacactccggagtgccctgacgaccagagagcatggaacatatgggaagtggaagactacggctttgggatcttcacgaccaatatttggctcaaactccgggactcatacactcaggtctgcgaccaccgcctgatgtcagcggccataaaagacagtaaggccgtacacgccgatatggggtactggatcgagagcgaaaagaatgagacatggaagctcgcccgggcatccttcatcgaggtcaagacatgcatctggcccaaaagccacaccctctggagtaacggggtcctggagagcgagatgatcatacccaagatctacggtggcccgatttcacaacacaactatcgtcctggttacttcacgcaaaccgccggaccgtggcacctgggtaagctcgagctcgactttgacttgtgcgaaggcacgaccgtggtggtcgatgagcactgcggcaaccggggtccttcgctgcgcacgacgacggtgaccggcaagatcatccacgagtggtgctgtaggtcctgcaccctgccgccactgcgcttccgcggggaggacggctgctggtatgggatggagatccggccggtgaaggagaaagaggagaacttagtaaagagcatggtgtccgccggtagtggcgaagtagactctttcagccttgggctcctctgcatcagcatcatcatcgaggaggtcatgcggagtaggtggtcgcgaaagatgctaatgactggcacgctggcagtgttcttcctgctgattatggggcagttgacttggaacgacttgatccgcctgtgcatcatggtgggggccaacgcgtccgatcggatggggatgggtaccacctatctagccctcatggccacgttcaaaatgcgtcctatgttcgccgtaggcctcttattccgccggttgactagccgcgaagtgctcctgctcaccattgggctgtccctcgttgcgagcgttgagctccccaactccctggaagaactgggcgacgggctcgccatggggatcatgatcttaaagttgctcacagactttcagagccatcagctgtgggctacgttactgagtctaaccttcatcaagaccacatttagcctgcactatgcgtggaagactatggcaatggttctgtccatcgttagcctttttcccctgtgtctctccaccacatcgcagaagaccacgtggctgcccgtgcttctcggctctctgggatgcaaaccgctgacaatgttcctcattgcggaaaacaagatttggggccggcgcagctggcccttgaatgaggggataatggcggtgggcattgtatccatcctgctcagcagcctgttaaagaacgacgagcctctcgccggtccactgatcgccggtggcatgctgattgcctgctatgtaatttccgggagctccgcggatctatccctggagaaggccgctgaggtctcgtgggaagaagaggctgagcattcgggggccagccacaacatacttgtggaagtgcaagacgatgggaccatgaagatcaaggatgaggagcgggacgacacactcacaatcctgctgaaggcgacattactggcggtctctggcgtgtacccgctgtcaatcccagccaccctcttcgtgtggtacttctggcagaagaaaaagcagcggagcggcgtgctgtgggacacccccagtccacccgaggtcgagcgggccgtcctggacgatggcatttaccgtataatgcagcggggcctgcttgggcgcagccaagtgggggtcggggtgtttcaggaaaatgtgttccacactatgtggcacgtcacgcgtggggcagtactgatgtaccagggtaaacggctggagcctagttgggcgagtgtgaaaaaggacctcatttcctacggcggcgggtggcggctgcaaggctcctggaacaccggggaggaagtccaggtaatcgccgtggagcccggcaagaaccccaaaaatgtccagaccgcccccgggaccttcaagacgcccgagggcgaggtgggcgccatcgccctcgatttcaagcccgggacctccggtagccccatcgtcaaccgggaggggaagatagttgggctctacggaaacggggttgtgaccacttccgggacatatgtctcggccattgcacaagccaaggccagccaagaggggccgctaccagagatagaagacgaggtgtttcggaaaaggaacctgaccattatggatctccacccaggctccgggaagacccggcgctacctacctgcgatcgtgcgagaggcaataaagcgcaagctgcgcaccctcatcctggccccgacgagggtcgtggccagcgagatggcagaggcgctgaaggggatgcccattcgttaccagaccactgccgtgaagtcagaacatacagggaaggaaattgtggacctcatgtgccacgcaactttcaccatgcgtctcctgtcacccgtgcgcgtaccgaactacaatatgatcattatggacgaggcccactttaccgacccctcaagcatagccgcacgggggtacatctccacacgagtagggatgggcgaagctgcagccatcttcatgacggccacgccgccgggcagcgtggaagcgttcccgcagtccaacgccgtgattcaggacgaggagcgggacatccccgagcgaagctggaactcagggtacgagtggatcactgacttcccgggcaaaaccgtctggtttgtcccctcaatcaagagtggcaacgacattgccaactgcctccgcaaaaacggcaagcgcgtgatccagctgagccggaagacattcgacaccgaataccagaagaccaagaacaatgattgggactatgtagtgaccacggatatcagcgagatgggtgccaacttcagagcggatcgtgtaatcgacccgcgccgttgcctgaagcccgtcatcctgaaggatgggcccgagcgcgtaatactggctggtccaatgccggtgaccgtcgccagtgctgcccagcggcgtgggcgaatcggtcgcaatcacaacaaggagggcgaccagtacatctacatggggcagcctctgaacaacgacgaggatcacgctcactggacggaagccaagatgctgctagacaacatcaacactcctgagggcatcatccccgcgctgttcgagccggagcgagagaagtccgccgccatcgacggtgagtatcgcctccgcggcgaggcgcggaagacgttcgtggagctgatgcgcagaggggacctgcccgtctggctcagctacaaagtggcctccgagggcttccagtacagcgaccgacggtggtgcttcgacggcgagcgcaataaccaagtgcttgaggagaacatggatgtagaaatctggactaaggaaggggagcgaaagaagctgcgccctcggtggttagacgccagaacatacagcgatccactggcgctgcgggagttcaaggagttcgccgctggccgacggtccgtcagcggtgatctcatcctggagatcgggaagctgccacaacacctcactcaacgagcccaaaatgctctggataaccttgtgatgcttcacaactccgagcaaggcgggcgggcataccgccatgcgatggaggagctgcccgacacgattgagaccctgatgctccttgcgctgatagccgtcctcaccggcggtgtgaccctgttctttctgagtggccggggcctaggtaagacatctataggcctgctttgcgtgatggcgagttccgttctcctgtggatggccagcgtggaaccccactggatagccgcctccatcatcctggaatttttcctcatggttctgcttatcccggagccggaccggcagaggacgccgcaggacaaccagctcgcgtacgtcgtgatcggcctgctgttcatgatcctcaccgtggccgccaacgagatggggctgctcgagacgaccaagaaggacctaggcatcggccacgtcgccgtggagaatcatcaccacgcggcaatgctggatgtggacttacacccagccagtgcgtggactctctatgcggtcgccaccactatcataaccccgatgatgcggcacacgatcgagaacacgaccgccaacatctcactgacggccatcgccaaccaggcggctatcctgatggggttggacaaaggctggcccatcagcaagatggacatcggcgtacccctgctggccctcgggtgctactcccaggtgaaccccctgactttaaccgccgcggtcctcatgctggtggctcattacgccatcatcggcccggggcttcaggccaaggctacccgcgaggcgcagaagaggaccgccgcaggcatcatgaaaaacccgactgtggacggcatcgtcgccattgacctcgaccctgtggtgtatgacgccaaattcgagaagcagctcggccagatcatgctgctaatcctatgtacctcacagatcctgctcatgcgcaccacatgggcgctgtgcgagtccattacgctggccaccggcccactcaccaccctgtgggagggcagcccgggtaagttctggaacacgaccatcgccgtcagtatggccaacatattcaggggcagctacctggcgggcgcgggcctagccttctcgctgatgaagtccctcggcggcgggcgccgtgggacaggggctcagggcgaaaccctcggcgagaagtggaaacgccagctgaatcaactgagcaagtccgagttcaacacatacaagcgatctgggatcatggaagtggacaggtcggaagccaaggagggcttgaagcgcggggagaccaccaagcacgctgtgtcgcgcgggacagccaagctgagatggttcgtcgagcgcaacctggtgaagcccgagggtaaggtgatcgacctgggctgcggccgtggcgggtggagttactactgtgccggcctcaagaaggtcacggaggtgaaggggtacaccaagggcggccccggacatgaggaacccatcccaatggccacctatgggtggaacctagtgaagctgcacagtgggaaggatgtcttcttcataccacccgagaagtgcgacaccctcctctgcgacatcggcgagagctcccccaacccgacgatcgaggaaggtcgcacgctgcgcgtgctcaaaatggtggagccctggctgcgcgggaaccaattctgtatcaagatccttaatccctacatgccatccgtcgtggagaccctcgagcagatgcagcggaagcatgggggcatgctggtgcgcaatccactctcgcgtaactccactcacgagatgtattgggtctcttgcgggacaggcaatatcgtgtccgcggtgaacatgacgagccgcatgcttctgaaccgctttacgatggcccaccgaaagcccacctatgagcgcgacgtcgacctgggggccggcacccggcacgtcgccgtggagcccgaggtcgccaacctcgacatcatcggtcagcggatcgagaacattaaacacgaacataagtccacttggcactacgacgaagacaacccttataagacatgggcctatcacgggtcgtacgaggtcaagccgtccggcagcgcgtccagcatggtgaacggagtcgtgaaactcttgacaaagccttgggacgttatacccatggtgactcagatcgccatgacggacactacgccgttcggccagcagcgggtgttcaaggaaaaggtcgatacgcgcacccccaaggcgaagcggggaaccgcccaaatcatggaggtaacggcaaagtggctctggggtttcctgagccgcaacaagaagccacggatctgcactcgggaggagttcacacggaaggtgcgctccaacgcggcaatcggcgccgtctttgtggacgagaatcagtggaacagtgccaaggaggcggtggaggacgagcggttttgggacctggtccaccgcgagcgggagctccacaagcaggggaaatgcgcaacctgcgtgtacaatatgatgggtaagcgcgagaagaaactgggggagttcggcaaggcaaaagggtcccgggccatctggtacatgtggctcggcgccaggttcctggagttcgaggcgttgggattcatgaacgaggaccactggtttagccgggagaactcgttatcaggtgtggagggcgagggcttacacaagctcggctacatcttacgcgacatctccaagattcctgggggtaatatgtacgcggatgacaccgcgggatgggacacccggatcacagaggacgacctgcagaacgaggcaagaatcaccgacatcatggagccggagcacgccctgctggccaagagcatcttcaagctcacgtaccagaataaagtcgtgcgcgtccagcggcccgccaagaacgggaccgtaatggacgtgatttctcgtcgggatcaacgcggcagcggccaggtggggacgtacggcctaaacaccttcactaacatggaggcccaactgatccggcagatggaaagcgaggggattttctctccctcggagttggaaatccccaacttagccgagcgcgttctggactggttggagaagtacggcgtagagcggctgaagcggatggccattagcggggacgactgcgtggtcaagccgatagacgaccgattcgcgaccgccttaactgcgctcaatgacatgggtaaggtgagaaaagacatcccccagtgggaacccagtaaggggtggaacgattggcagcaggtccccttctgtagccaccacttccaccagctgatcatgaaggacggccgggaaatcgtcgtaccctgtaggaaccaggacgagctggtaggccgggctcgcgtgtcccagggggctggctggagcctccgggagaccgcgtgcctgggcaagagctacgcccaaatgtggcagctgatgtactttcataggcgggacctgcgcttggccgccaacgcgatctgctccgccgtacccgtcgattggatccccaccagccggaccacatggagtatccacgcccaccaccagtggatgacaacagaggacatgctgagtgtgtggaacagagtatggatcgaagagaacccctggatggaggacaagacccacatttcctcatggggcgacgtgccgtacctcgggaagagggaggaccagtggtgcgggtccctgatcggcctgactgcccgggctacatgggcaaccaacatccaggttgcaatcaaccaggtgaggcgcctcatcggtaacgagaactatctggactacatgaccagcatgaagagattcaaaaacgagggagatcccgagggggccctttggtga

SEQ ID NO: 24144 - RNA, 9879 nt, synthetic construct
  misc_feature 1..9879: note = derived and/or modified CDS sequence (opt11) from DENV-1__FJ182033__SS-prME
  source 1..9879: mol_type = other RNA
agtgtgaccatgctgctcatgctgatgcccactgccctggcctttcatctcaccacgcgcggaggtgagccgcacatgatcgtgagtaagcaggagcgtggcaagagcctgctgttcaagaccagcgccggtgtgaacatgtgcaccctcatcgcaatggacctgggcgagctttgtgaagacaccatgacctacaagtgcccgcgaatcacggaagtcgagcccgacgacgtcgactgctggtgtaacacaacggacacctgggtgacctacgggacctgcagccaaacgggcgagcaccggcgcgacaagcggtcagtagccttggcgccacacgtgggtctggggctggaaactcgcgccgagacatggatgtcatccgagggagcgtggaagcagatccagaaggtggagacctgggccctcagacaccccgggttcaccgtgatcgcgctgttcctggcccacgcaattggcacgagcatcacccagaagggtatcatattcatcctcctgatgctggtcaccccctccatggcgatgcggtgcgtgggcatcggcagccgggacttcgtggagggtctctccggtgccacttgggtggacgttgtgttggagcacgggagctgcgtcaccaccatggccaaagacaagcccaccctagacatcgagctcctcaagacggaagttaccaaccctgcagtgctgcgaaagctctgcatcgaggcgaaaatttccaacaccacaacggacagccggtgcccaacccagggcgaggccaccctggtcgaggagcaggatgccaacttcgtctgccgccggaccttcgttgaccgtggctgggggaacggatgcgggctgttcggcaaggggtctctcattacgtgtgccaagttcaagtgcgtcaccaaactggagggcaaaatcgtgcagtacgaaaatttaaaatacagtgtcattgtaaccgtgcataccggcgaccagcaccaggtcgggaacgagtccactgagcacggaacgaccgcaaccatcacgccccaggcgcccacgagcgagatccagttgaccgattacggggccctgacgctggattgcagccctagaaccggtctcgactttaacgagatggtgctgttaacgatgaaggagaagtcctggctcgtgcacaagcagtggttcctggacctgccgttaccctggaccagcggggcctccaccagccaggagacttggaaccgccaggacctcctggtcacattcaagaccgcccatgccaagaaacaggaggtggttgtcctcggctcccaagagggtgcgatgcacaccgccctgaccggcgccacggagatccaaaccagcggcaccaccacgatatttgctgggcacttgaagtgcagactcaagatggataagttgaccctgaaggggatgtcctacgtgatgtgcactgggagcttcaagttagagaaggaagttgccgagacccagcatggcacggtcctggtacagattaaatacgagggaaccgacgccccgtgtaagatccccttttccacccaggacgagaagggggtgacacagaacggccgcctaattacagcgaacccgatagtcacggataaggagaagcccgttaatatcgaggccgagccgcccttcggggagagctatatcgtcatcggcgccggagaaaaagcgctgaaattatcctggttcaagaagggaagctccatcggcaagatgttcgaggcgaccgccagaggggcgcggcggatggctatcctgggtgacaccgcgtgggacttcgggagcatcggcggggtcttcacgtcgatcggaaagctggtgcatcagatctttggcacagcatacggagtgttgttcagcggggtctcctggacgatgaagatcgggattggcgtgctactgacgtggctcggccttaacagccgctccacgagcctgtctatgacttgtatcgccgtgggtctggtaaccctgtaccttggggtgatggtgcaagcagacagcgggtgcgtcatcaactggaaaggccgtgagttaaaatgcgggtcaggcatcttcgtgaccaatgaggtacacacgtggaccgagcaatacaagttccaagccgactccccgaagcggctgagcgcggccattggcaaggcatgggaggagggggtatgcggtatccgctccgccacccggctggagaacatcatgtggcgccagatctctaacgagcttaaccacatcctgctagaaaacgacatgaagttcaccgttgtggttggcgacgtcgtgggtatccttgcccaggggaaaaagatgatcaggccacagcccatggagcacaagtactcctggaagtcctggggcaaggcgaagataatcggagccgacgtccagaacactacgtttatcatcgacgggcccaatactccggaatgccccgatgatcagcgcgcctggaacatttgggaagtggaggattatggcttcggtatcttcaccaccaacatctggctgaaactgcgggactcctacacccaagtgtgtgatcaccgactcatgtcagccgctatcaaggattccaaggccgtacacgccgacatgggctactggatcgagagcgaaaagaacgagacctggaagttggctcgcgcctcctttatcgaggtaaagacctgcatctggcccaagtcgcacactctgtggtccaacggcgttttggagagcgagatgatcattcccaagatatacggtggaccgatatcccaacacaactaccgccctggctacttcacgcaaaccgcgggcccctggcatctcgggaaattggaactcgactttgacctgtgcgagggtaccaccgtcgttgtggatgagcactgtggcaaccgtgggccatcgctgcgcacgacaactgtcaccggtaagataatccacgagtggtgctgccggtcctgtacgttaccgcccttacgcttcaagggggaagatggctgctggtacgggatggagatccggccagtgaaggaaaaggaggagaacctagtaaagagcatggtcagcgccggctccggcgaggttgacagcttctccctcggacttctgtgtatttctatcatgatagaggaggtgatgcgatcccggtggtcgcgcaagatgctcatgacggggaccctggccgtgttcttcctgctcatcatggggcaactcacctggaatgacctaatccggtcctgcatcatggtgggcgccaacgcctccgaccggatggggatgggcacgacctacctcgcgctgatggctaccttcaagatgcgcccgatgtttgccgtgggcctcctgtttcggaggttgacctccagagaagtcctactcctgacgatcgggctgagcctcgtggcctccgtcgaactgcccaacagccttgaagagctcggtgacggcctggccatgggtatcatgatactgaagttactgacggatttccagtcctaccagctatgggcgaccctgctaagcctgaccttcatcaagacgaccttctcattacactacgcctggaagaccatggccatggtcctgagcatcgtgagcctgttacccctatgtctaagcacgacgtcccagaagaccacctggctccccgtcctgctcggctcactaggctgcaagccactgaccatgtttcttatcgccgaaaacaagatctggggcagaaagagctggcccttaaacgaggggatcatggcggtgggaatcgtgtcgattctgttgagctccttgctaaagaatgacgtccccctggccgggcccctgatcgccggcggcatgctgatcgcctgctacgtcatatcagggtcaagcgccgacctgtcacttgaaaaggcggccgaggtatcatgggaggaggaggccgaacattctggcgccagccacaacatcctggtcgaggtgcaggacgacggaaccatgaagatcaaggacgaggagcgggacgataccctcacgatcctcctcaaagccaccctgttggcggtgtccggcgtgtacccgctgagcatccccgctaccctgtttgtttggtacttttggcagaagaagaaacagcggtccggggtgctctgggacacgccctccccgcccgaggtcgagcgcgccgtgttagacgacggcatctaccgtatcatgcagcggggactactggggcgctcccaggtgggtgttggggtcttccaggagaacgttttccacaccatgtggcatgtcacacgtggcgccgttttgatgtatcagggaaagcgcctggagccgagctgggcctcagtgaagaaggaccttatctcatacggcggcggttggcggctgcaaggctcctggaacaccggggaggaggtccaggtgattgcggtggagcctggcaagaaccccaagaacgtccagacggcccccgggaccttcaaaacccccgaaggcgaggtcggcgccattgcactggacttcaaacccggcaccagcgggtcacccatagtgaaccgcgaggggaagatcgtaggcctgtacggcaacggagtggtgacgacgtcaggaacctacgtcagcgcgatcgcgcaggcgaaggcatcgcaggaggggccgctccctgagatcgaagacgaggtgttccgaaagcgcaacctgacaatcatggacctgcatccgggtagcgggaagacgcgtcgctacctcccggcgatcgtacgggaggcgataaagcgaaagctgcgaaccctcatcctcgcccccacccgtgtagtggcctccgaaatggccgaagccttaaaaggcatgcccatccgctaccagacaacagctgtcaagtctgaacacaccggccgtgagatcgtcgaccttatgtgtcacgccaccttcaccatgcgtctcctgtctcccgtgcgagtgccgaactacaacatgatcatcatggatgaagcccacttcacggaccccagcagcatcgctgcccgcgggtacatcagcactcgggtagggatgggcgaggcggccgccatcttcatgacagccacgccgcccggttccgtggaggccttcccgcagagcaacgcggtgatccaagatgaggagcgcgacatcccagagcggtcgtggaatagcgggtatgagtggattaccgacttccccgggaaaaccgtgtggttcgtgccctccattaaaagcggcaacgacatcgcgaactgcctgcgcaaaaatgggaaacgagtgattcagctcagccgaaagacctttgacactgagtatcagaagacgaagaacaacgactgggactacgtagtgacgacagacatcagcgagatgggcgccaattttcgggcagatcgcgtgatcgatccccggcgctgcctgaagcccgtgatcttaaaggatggccccgagcgggtgatactcgcgggtcctatgccggtaacggttgcgtccgccgcccagcgccgggggcgcatcgggcggaaccacaacaaggagggcgaccagtacatatatatggggcaaccactgaacaacgatgaggaccacgcccactggaccgaggcaaagatgctgctcgacaacatcaacacccccgaggggatcatcccggccctgttcgaaccggagcgcgagaagtccgccgctattgacggtgagtaccgcctccggggcgaagctcgcaagactttcgtggagctcatgcgacgcggggacctgcctgtttggctgagctacaaggtggctagcgagggcttccagtacagtgacagacgctggtgctttgatggcgagagaaacaaccaggtgctcgaggaaaacatggacgtagagatttggacaaaagagggtgagcgcaaaaaactgcggccccgctggctggacgcccggacgtactccgaccccctcgccctgcgcgagttcaaggaattcgccgcagggaggcgtagcgtctcgggggacctgatcctcgagataggtaagcttccgcagcacctaacccagcgcgcgcaaaatgctctagacaacctggtgatgctgcacaacagcgagcaaggtggacgagcataccggcacgccatggaggagctgccggacaccatcgagacgctgatgctgctcgcgctgatcgcggtgctcacgggcggggtgaccctcttcttcctgtccggtcgtgggttgggaaagactagcattggtctcttatgcgtgatggcttccagcgccctattatggatggcctccgtggagccccattggatcgccgccagcatcatcctggagtttttcctaatggtgctcttgatcccagagccggaccggcagagaaccccccaggacaaccagctggcctatgtcgtcattgggctactgtttatgatcctgaccgtcgccgccaacgagatgggcctcctggagacaaccaaaaaggacctgggcatcggccacgtggccgtcgagaaccatcaccacgccaccatgctcgatgtggatctccaccccgcttccgcctggacgttatacgccgtagctacgacaatcatcactcccatgatgagacatacgatcgagaacacgacggccaacatcagcctcacagccatagccaatcaggcggcaatcctgatgggacttgataagggatggccgatcagcaagatggacataggagtacccctcctggccttagggtgctacagtcaggtgaacccactcaccctgacggccgcagtgctgatgctagtcgctcattacgccattatcgggccgggtctgcaggccaaggccacccgagaagcccagaagaggaccgcggcagggatcatgaagaaccccaccgtggatgggatagtggccatcgacctggaccccgtcgtgtacgacgccaagttcgaaaagcagctcggccagatcatgctgctgattctctgcacgtcgcagatcctcctgatgcgcacaacctgggccttatgtgagtcaatcacactggcgaccgggcccctgacaacactgtgggaggggtcaccggggaagttctggaacaccacgattgccgtgagcatggcgaatatcttccgggggagctacctagctggcgcgggcctggcgttctctctcatgaagtccctcgggggcgggcggcgcggcaccggggcccagggcgagactctgggtgagaagtggaagaggcagctcaatcagctgtccaagtctgaattcaacacctataagcgcagtgggatcatggaggtcgatcggagcgaagccaaggaagggctgcgacgtggggaaacgaccaagcatgccgtgtccaggggcaccgcgaaattaagatggttcgtagagagaaacctggttaagcccgaggggaaagtgatcgaccttggctgtggccgcggcgggtggtcgtattactgtgccgggctaaagaaggttaccgaagtaaagggatacacgaaaggcgggctcggccacgaggaacccatcccgatggcgacctacggctggaatctggtgaaactccactccgggaaggacgtattcttcatcccgcccgagaaatgtgacacgctcctgtgcgacatcggggagagcagccccaaccccacgatcgaggagggccgcacgctgcgggtcctgaaaatggttgagccctggctgcgcgggaaccagttctgtataaagatactgaacccatacatgccctcggtagtcgaaacccttgagcagatgcagcggaagcacggcggtatgctggtgcgcaaccccctgtcccgaaactcaacccacgagatgtattgggtatcctgcgggactggcaacatcgtctctgcagtcaacatgacgtcccgtatgttattaaatcggttcacgatggctcacaggaagcccacctatgagcgcgacgtggacctgggggctggcaccaggcacgtagccgtggagccggaggtggccaatctcgacatcatcggccagcgcatcgagaatatcaaacacgagcacaagagcacctggcactacgacgaagacaatccctacaaaacgtgggcctaccatgggtcctacgaagtaaagccctcgggcagcgccagtagcatggttaacggggtcgtaaaactgctaaccaaaccgtgggacgtgatccccatggttacccagatagcgatgaccgacacgaccccattcgggcaacagcgggtattcaaggagaaagtggacacccgcactcccaaggccaaacgcgggacggcccagataatggaggtcaccgcacggtggctatggggctttctgtcccggaataagaagccgcgcatctgtacccgggaggagttcacgagaaaggttcggagcaacgctgctatcggggcggtcttcgtagatgagaaccaatggaactccgctaaagaggccgtggaggacgaaagattctgggatctggtgcatcgagaacgggagcttcacaagcaggggaagtgcgcaacatgcgtctacaacatgatgggcaaacgggagaagaagttgggcgagttcggcaaggctaaggggagccgcgccatttggtacatgtggcttggcgcaagattcctcgagttcgaagccctgggtttcatgaacgaagaccactggtttagccgcgagaatagcttatccggggtggagggggaagggctccacaagctgggctacatcctccgggacatctcaaagatacccgggggcaacatgtacgccgatgacacggccggctgggatacccgcatcaccgaggacgacctacaaaacgaggccaagatcacggacatcatggagcccgagcatgccctgctcgccacctccatcttcaagctcacctaccaaaacaaggtggtccgagtgcagcggccggcgcggaacgggaccgtaatggacgttatttcccggcgcgaccagcggggatccggtcaggtcggaacgtatggcctgaacaccttcaccaacatggaggcccagcttattcggcagatggagagcgaggggatcttcctgccctccgaactggagacccccaacctggccgaacgggtgctcgactggcttgagaagcacggcgtcgagcggctgaagcggatggcgatcagcggagatgactgcgtggtgaaacccattgacgaccgctttgcgacggcgctcactgccctgaacgatatgggcaaggtacggaaggacatcccccaatgggagccctccaaagggtggaacgactggcagcaggtccccttctgctcgcaccacttccatcagctgatcatgaaggacggacgcgagatcgtagtcccctgccggaaccaggacgaattggttggccgcgccagggtgagccagggagccggatggtccctgcgcgaaaccgcctgccttggtaaaagctacgcgcagatgtggcagctcatgtacttccatcggcgcgacctgcggctggccgcgaacgcgatctgctccgcagtgccggtggattgggttccaacgtcacgcacaacctggtccatccacgcccaccatcagtggatgacgaccgaagacatgctctcggtgtggaaccgcgtgtggatcgaagagaacccctggatggaagacaagacgcatatttccagctggggcgacgtgccctacctgggaaagcgggaggaccagtggtgcgggtcactgatcggcctcacagccagggccacttgggcgaccaacatccaagtagcaataaaccaagtgcggaggctgatagggaacgagaactacctggactacatgacatctatgaagcggttcaagaacgaatcagaccctgaaggcgctctctggtga

SEQ ID NO: 24145 - RNA, 9879 nt, synthetic construct
  misc_feature 1..9879: note = derived and/or modified CDS sequence (opt11) from DENV-1__FJ182034__SS-prME
  source 1..9879: mol_type = other RNA
agcgtgaccatgcttctcatgctgatgcccaccgccctggcttttcacctaacaacccggggcggggagccccacatgatcgtgagcaagcaggagcggggcaagagcctgctgttcaagaccagcgcaggggtgaacatgtgcactttaatcgccatggacttaggcgagctctgcgaggacaccatgacctacaagtgcccccgcatcaccgaagccgaacccgacgatgtggactgctggtgcaacgccacggacacgtgggtgacctatgggacctgcagccaaactggcgagcaccgccgggataagcggtccgtagcgctcgcgcctcatgtgggcttggggctggagacccgcaccgagacctggatgagctccgagggcgcctggaagcagatccagcgtgtggaaacttgggctctccgccatcccgggttcacggtgatcgccctattcctggcgcatgccatcggcacaagcatcacccagaaggggattatcttcatccttctgatgctggtgaccccatccatggctatgcggtgcgtcggcattggcagccgcgacttcgtggaggggctctccggcgccacgtgggtggacgtggtgctggagcatgggagctgcgtgaccaccatggcaaaagacaagcccaccctggacatcgagctcctgaagaccgaggtcacgaatcccgcggtgctacggaagctctgcatcgaggccaagatcagtaacaccaccactgacagccgctgcccgacccagggcgaagccaccctggtggaagagcaagatgccaacttcgtctgccggcgcaccttcgtcgaccggggctgggggaacggctgcgggctgttcggcaaagggtccctcatcacctgcgccaagttcaagtgcgtgactaagctggagggcaagatcgtccagtatgagaatctgaagtacagcgtgatagttaccgtccacaccggcgaccagcaccaggtagggaacgagtccacggagcacggcaccactgcgaccatcacgccccaggcccccagcacggagattcagctcaccgactacggggccctgaccctggactgctcgccccggaccggcctcgactttaacgaaatggtcctgctgacgatgaaggagaagtcctggctcgtacacaaacagtggtttctggacctaccgttaccctggaccagcggcgcctccaccagccaggagacctggaatcggcaggacctgctggtgacgttcaagaccgcccatgcgaagaagcaagaggtcgtcgtgctcggatcccaggagggcgcaatgcacaccgccttaacgggcgccacggaaatccagaccagcggcaccaccacgatattcgccggccatctgaaatgccgcctgaagatggacaagctgaccctgaaaggtatgtcctatgttatgtgtacagggagcttcaagctcgagaaggaggtggcggagacccagcatggtacggtattggtacagatcaagtacgagggcaccgacgccccctgcaagatccccttctccacccaagacgagaagggagtaacccagaacggccggctgatcacggccaaccccatcgtaaccgacaaagaaaagcccgtaaacattgaagccgagccgcccttcggggagtcatacatcgtgattggcgcgggagagaaggctctgaagctttcctggttcaagaaagggagcagcatcggcaagatgttcgaagccaccgcacgcggggcacggcgcatggctatcctgggcgacaccgcctgggacttcgggagcatcggtggcgtgtttacgtcagtcggaaagctggtccaccagatcttcggcaccgcatacggggttctcttcagcggcgtatcctggaccatgaagatcgggataggcgtgctgctgacatggcttggcttaaacagccgctctacgtctctatccatgacctgcatcgccgttgggctcgtaaccctgtacctgggcgtgatggtccaggccgacagcggttgcgtcatcaactggaaggggcgggagctcaagtgtgggagcggtatattcgtgaccaacgaggtgcacacatggaccgagcagtacaagttccaggcggatagtccgaaaagactcagcgcggccatcggcaaggcctgggaggagggggtttgcggaatccggtcagctacccgcctggagaacatcatgtggaagcagattagcaacgaattgaaccacatcctgctggaaaacgacatgaagtttaccgttgtggtcggcgacgtcgcggggatcctcgcacaggggaagaagatgataaggccccagcccatggaatacaagtactcctggaagtcctggggcaaggccaagatcatcggcgccgacgtacaaaacacgacgttcatcatcgacgggccaaacaccccggagtgccccgacgaccagcgcgcgtggaacatctgggaggtcgaggactacggcttcgggatcttcaccaccaatatctggctgaagttgcgggactcctacacacaggtgtgtgatcaccgcctcatgagtgctgccattaaggactccaaggccgtacacgccgacatgggttactggatcgagagcgagaagaacgagacctggaagctggcgcgggcctccttcatcgaggtgaagacctgcatctggcccaaaagccacaccctgtggtccaatggagtgctcgagagcgaaatgataatccccaaaatctacggggggcctatctcccagcacaactaccgccctgggtactttacgcagaccgccggtccctggcacctggggaagctagaactcgacttcaacctatgcgagggcaccaccgtggtcgtggacgagcactgcggcaatcggggcccgagcctacgcacgaccaccgtgaccggcaaaatcatccatgagtggtgctgccggtcctgcacgctgccacccctccgcttcaaaggggaggacggctgttggtatggtatggagatccggcccgtcaaggagaaggaagagaacctggttaaatcaatggtgagcgccggctcgggcgaggtagactcattctccctcggccttctgtgtatctcgatcatgatcgaggaagtgatgagatcccggtggagccgcaagatgctcatgaccggcacactggctgtgtttttcctgttgatcatggggcagctgacctggaatgacctgatccggctctgcatcatggtaggcgctaacgcctccgaccgcatggggatggggatgacgtacctggccctaatggccaccttcaagatgcgcccgatgctcgccgttggcctgctgttccgccgcctcaccagcagggaggtgctgctgctcaccatcggactgtccctggtcgcgagcgtggagctacccaattccctggaggaactgggcgacgggctggccatgggcatcatgatcttgaagctgctcacggacttccaaagccaccagctgtgggccacccttttgtccctgaccttcatcaagacgacttacagcctgcactacgcctggaagaccatggcgatggtgctctccatcgtgtcgctgttccccctctgcctatctaccacaagtcagaagacgacctggctgcccgtgctgctcggctccctggggtgcaagccgctgaccatgttcctcattgcggagaacaagatctgggggagaaagagctggccactgaatgaggggatcatggccgtcggcatcgtgagcattctgctctccagccttctgaagaacgacgtgccactcgccgggcccctgatcgccggcggcatgctaatcgcatgctacgtcatctccgggagctccgccgacttgagcctggagaaggccgcagaggtgagctgggaggaggaggccgagcacagtggcgcgtcccacaacatcctggtggaagtccaggacgatgggacaatgaagataaaggacgaggagcgggacgacacactgaccatcctcctcaaagccaccctcttagccgtgagcggcgtgtacccgctctccatcccagccaccctcttcgtctggtacttttggcagaagaagaagcaacgcagcggggtgctgtgggacacccccagcccgcccgaagtggagcgcgcggtcttagacgacggcatctaccgcatcatgcagcggggcctgctcggacgaagccaggtgggcgtgggcgtctttcaggaaaacgtgttccacacgatgtggcacgtgacccggggcgcggttctgatgtaccaagggaaacgcctggagccctcctgggccagcgtgaagaaagacctcatctcctacggcggcgggtggcgactgcagggcagctggaacacaggtgaagaggtccaggtcatagcggttgaacccgggaagaaccccaagaacgtgcagaccgcccccgggacgttcaaaacctccgagggcgaagtcggtgctatcgcgcttgactttaagcccgggacatcgggctcacccattgtaaaccgcgaggggaagatcgtgggcctctatggcaacggggtagttaccacttccggtacttacgttagcgccatcgcccaggccaaggcgtcccaggaggggccactgccagagatcgagaacgaagttttccggaagcggaacctgaccataatggacctccaccccggctcagggaagaccagacgctacctgcccgctatcgtgcgggaagcgatcaaaagaaagctgcgaaccctcatcctggccccgacccgcgtggtcgcctcagagatggccgaggccctgaaggggatgccgatacgctaccagaccaccgccgtcaagagcgagcacacgggaaaagagatcgtggatttaatgtgccacgccaccttcaccatgcgtctgctgagtccggtccgtgtgccgaattacaacatgatcatcatggacgaggcacacttcacagaccctagctccatcgcggcccggggatatatcagcacacgcgtgggcatgggggaggccgccgccatcttcatgaccgccacaccgccgggctccgtcgaggccttcccccagagcaacgccgtgatccaggacgaggagcgggacatcccggagcgctcctggaactcagggtacgagtggatcacagattttcctggcaaaacggtgtggttcgtcccctccatcaagagcggtaacgatatcgccaactgcctccggaaaaacgggaagcgcgtcatccagctttcccggaagacctttgacaccgagtaccagaagaccaagaacaacgactgggactacgttgtcacgacagacatcagcgagatgggtgcgaacttccgcgccgatcgggtgatcgaccctcgccggtgtctgaagccagtgattctcaaggacggtcccgaacgcgtcatcctggccggccctatgcccgtgaccgtcgccagtgccgctcagcgtcgtggacggatcggccgtaaccacaacaaggagggtgatcagtacatctatatggggcagccgttgaacaacgacgaggatcacgcccactggaccgaggccaagatgctcctcgacaacatcaacacgcccgagggtatcatcccggccctgtttgagcctgagcgggagaagtccgccgcgatcgacggggagtaccgcctccgcggcgaggcccgtaagaccttcgtagagctgatgcgtagaggtgacctgccggtgtggctcagctacaaagtcgcctcggagggcttccagtacagcgaccgccggtggtgcttcgacggtgagcgcaacaaccaggtgctggaggaaaacatggatgtggagatctggaccaaggagggggagcggaagaagctgcgcccccggtggctcgacgcccgcacgtactccgaccccctggccctccgggaattcaaggagttcgccgctggccgtcggagcgtctctggcgacctcatactggagatcggcaagctgccccagcacctcacgcagagggcgcagaacgccctggacaacctggtgatgctccacaacagcgagcaaggcggtcgggcttatcgccacgccatggaggagctgccggacaccatcgagaccttaatgctcctggccctgatagccgtgctgaccgggggtgtcaccctcttcttcctgtccggccgggggctcggaaaaaccagcatcggcctgttgtgcgtaatggcctcgtccgtcctcctgtggatggcgtccgtcgagccccactggatcgccgccagcataatcctggaattcttcctcatggtgctgctgatccccgagcccgaccgccagcggaccccacaagacaaccagctcgcttacgtggtcatcgggctgttattcatgatactgaccgtggccgcgaacgagatgggcctgcttgaaaccacgaagaaggacctcgggataggccacgtagccgtcgagaaccaccaccatgccgccatgctggacgtggacctgcacccagcctccgcgtggaccctctacgccgtagccaccacgatcatcactccaatgatgcggcacaccattgagaacactaccgctaacattagcctgacggccatcgcgaaccaggcagctatcctgatggggctcgacaagggctggcccatctccaagatggacatcggcgtccccctgttagccctcgggtgctacagccaggtgaaccccctgactctgaccgcggccgtgttgatgctcgtcgcccattatgccatcatcggtcccggcctgcaggccaaagcaacccgggaggcccagaaacgcacggccgccggcatcatgaagaacccgaccgtggacgggatcgtggccattgacctggaccccgtcgtgtacgacgccaagtttgagaagcagctgggtcagatcatgctgcttatcctttgcacctcgcagatcctgttaatgcgcaccacgtgggccctgtgcgagagcatcacccttgccaccggccctctaacgacgctatgggaagggagccccggcaagttctggaacacaaccatcgcggtgagcatggcaaacatcttccggggtagctacctggcgggcgccggcttggccttctctctgatgaagtccctggggggcgggcgccggggcaccggtgcccagggggagacgctcggcgagaagtggaagcgccagctgaatcagctgtccaagtcagagttcaacacctataagcgatccggtatcatggaggtggaccgcagcgaggctaaggagggccttaagcgcggggagaccaccaagcacgccgttagccgaggcacggcaaagctgcggtggttcgtggagcgcaacctggtcaaaccggaggggaaggtaatcgatctgggctgcgggcgcggggggtggagctactattgcgccgggctcaagaaggtcaccgaggtcaagggttacaccaaaggtgggcccggccacgaagagcccataccaatggccacttacggatggaacctggtcaagctgcactccggcaaagacgtgttcttcatcccgcccgaaaaatgcgacacgctcctgtgcgacataggggagagctcgcccaaccccacaatcgaggagggccgcaccctgcgagtcctaaagatggtggagccgtggctgcgagggaaccaattttgcatcaagatcctgaacccctacatgcctagcgtcgtcgagaccctcgaacagatgcagcggaagcacggcggcatgctggtgcgcaaccccctgtcccggaactcaacgcacgagatgtactgggtgtcctgtggaaccggcaacattgtcagcgcggtaaacatgacatctcgcatgctcctgaaccggtttaccatggcccatcgcaagccgacctacgagcgggatgtggacctgggggccggcacacggcacgtcgccgtggaacccgaggtggccaacctcgacatcattggtcagcgcatagaaaacattaagcacgagcacaaaagcacctggcactacgacgaggacaatccatacaagacctgggcgtatcacggcagttacgaagtcaagcccagcggatccgcgtccagcatggtgaacggggtagtgaagctgctgaccaagccgtgggatgtgatccccatggtcacgcagatcgcaatgaccgacactactccgttcggccaacaacgggtgtttaaggagaaggtggatacacgcactccgaaggccaagcggggaaccgcccagatcatggaggttaccgcgaagtggctctggggctttctgtcccgcaacaagaagccccggatttgtacgcgcgaggagttcacccgtaaggtgcggtctaacgccgccatcggggccgtgttcgtcgacgagaatcagtggaactccgcgaaggaggccgtagaagacgagcggttctgggacctggtgcaccgcgagcgggagctccataagcaggggaaatgcgcgacctgcgtttacaacatgatggggaaacgcgaaaagaagctgggggagttcggtaaggccaaggggagccgggccatctggtacatgtggctgggcgcgcgcttcctcgagtttgaggccctgggcttcatgaacgaggaccactggttttccagggagaactcgctctccggggtagaaggcgaggggctacataagctgggttacatcctgcgcgacatctctaagattcctggaggtaacatgtacgccgacgacacagctggctgggacactcggatcacggaggacgacctccagaacgaggccaagatcaccgatataatggagcccgagcacgcgttactggccaagagtatcttcaagctcacttaccaaaacaaggtggtccgggtgcagcggccagccaaaaacgggacggttatggacgtaatcagccgccgcgaccagcgcggatccggccaagtgggcacatacgggctgaacactttcacaaacatggaggcccagctgatccgccagatggaaagcgaagggatcttttcccccagcgagctcgagacgcccaacttggccggcagggtgctggattggctcgagaagcacggtgtcgagcgactgaaacggatggcaatctccggcgacgactgcgtggtaaagcccatcgacgacagattcgccaccgcgttaacggccctcaacgatatgggtaaagtccggaaggacatcccgcaatgggagcccagcaagggctggaatgactggcagcaggtccccttctgcagccaccacttccaccagctgatcatgaaggacggccgcgagatcgtggtcccctgccggaatcaggacgagctcgtgggacgcgcccgggtgagccagggcgcggggtggtctctccgcgagacagcctgcttaggcaagtcctacgcccaaatgtggcagctgatgtacttccatcggagggacctccggctggccgcgaacgccatctgttctgccgtcccggtagactgggtgcccacgtcccggaccacctggagcatccacgcccaccaccagtggatgaccacggaggacatgttgtccgtatggaatagagtgtggatcgaggagaatccctggatggaggacaagacccacatcagctcttggggagacgtaccctacctcggcaagcgcgaggaccagtggtgcgggagcctgatcgggctgacagcccgggcgacctgggccacaaacatccaagtcgctataaatcaggtgcgccgcctcatcggcaacgagaattacctggactacatgacctccatgaaacggtttaagaacgagagtgatccggaaggggccctttggtaa

SEQ ID NO: 24146 - RNA, 9879 nt, synthetic construct
  misc_feature 1..9879: note = derived and/or modified CDS sequence (opt11) from DENV-1__FJ182036__SS-prME
  source 1..9879: mol_type = other RNA
tccgtgaccatgctgttaatgctgatgcccaccgcactggccttccatttaaccacccggggcggggagccccacatgatcgtgtcaaagcaggaacggggcaagagcctattgtttaagacaagcgccggggtgaacatgtgcaccctcatcgcgatggacttgggcgagctctgtgaagacaccatgacctataagtgtccacggatcaccgaaaccgaacccgacgatgtggactgctggtgcaatgccacggacacgtgggtgacctacgggacctgttctcagaccggcgaacaccggcgggataagcggtcagtggcactcgcgccccatgttggcctgggcctggagacccgtaccgagacctggatgagcagtgagggcgcctggaagcagatccaaagagtcgagacgtgggccctccggcaccctgggttcaccgtgatcgcccttttcctggcccacgcgattggtactagcataacccagaaggggataatctttatactactgatgttagccacgcccagcatggcaatgcggtgcgtgggcatcggcagcagggacttcgtcgagggtctctccggagccacctgggtggacgttgttctggaacacgggtcttgtgtgaccaccatggccaaggacaagcccacgctggatatcgagctcctgaagactgaagtgaccaaccccgcagtcctgaggaagctctgcatcgaggccaagatatccaacaccactaccgacagccgctgcccgacgcagggcgaggcgaccctggtggaggagcaggatgcaaacttcgtgtgccggcgcacgttcgtagaccgggggtgggggaacggctgcgggttgttcggcaaggggtccctcatcacatgcgccaagttcaaatgtgtgaccaagctagagggcaagattgtgcagtacgagaatctgaagtacagcgtcatcgtgaccgtgcacacgggcgatcaacatcaggtcgggaacgagtccacagagcacggtaccaccgcgaccatcacgccccaggcccccactacggagatacagctcaccgattacggggccctgacgctggactgcagcccgcgcaccggcctcgactttaacgagatggtgttgctgaccatgaaggagaagtcctggctcgtccacaagcaatggttccttgacctgcccttaccctggaccagcggggccagcacttcccaggagacctggaaccggcaagacctgctcgtgacattcaagaccgcccacgcgaagaaacaagaggtggtcgtgctcggctcccaggagggagccatgcacacggccctaaccggcgctacagagatccagacctctggcacgactaccatcttcgctgggcacctgaagtgtcgcctcaaaatggacaagctgactctgaaaggcatgtcctacgtaatgtgcaccgggtcctttaagctcgagaaggagctggcggagacccagcacggcaccgtcctggtacagatcaagtacgagggcaccgatgccccctgcaagatccccttctccacacaggacgagaagggggtgacccagaacgggcggctgatcacagcaaaccctatcgtcaccgataaggagaagcccgtgaacatcgaggccgaaccgcccttcggggagtcctacatcgtgatcggagcgggcgagaaggccctcaagctgtcgtggtttaagaagggcagcagcatcggcaagatgttcgaggccacggcccgcggggcccggcgcatggcgatactgggcgacaccgcctgggacttcgggtcaatcggcggcgtcttcacctctgtggggaaactcgtgcaccagatcttcggcaccgcctacggggtactgttctcaggcgtatcgtggactatgaagattgggatcggcgtcctgctcacgtggctgggcctgaacagtcgcagcacctccctcagcatgacttgcatagccgtggggctggtgacgctgtacctcggcgtgatggtccaggccgattccgggtgcgtgatcaactggaagggccgggagctgaagtgcgggagcggcattttcgtgaccaacgaggtacacacctggaccgaacagtacaaattccaggcggacagcccgaagcgcctgtccgccgccatcggaaaggcctgggaggagggtgtgtgcggcatccggtcagccacccgcctcgagaacatcatgtggaagcaaatctccaacgagctgaaccatatcctactcgaaaacgatatgaagttcacggtagttgtgggagacgtagcaggcatcctagcccaggggaagaagatgatccgcccccagcccatggaatacaaatactcatggaaatcctggggcaaagccaagattatcggcgccgacgtacagaacaccacattcatcatcgatggtcccaacaccccggagtgccccgacgatcaacgcgcgtggaacatctgggaagtggaggattacggcttcgggatcttcacgaccaacatatggctgaagctgcgggacagctatacccaggtgtgcgaccaccgcctgatgtcggctgccatcaaagatagcaaagccgtccacgccgacatgggctactggatcgagtccgagaagaatgaaacgtggaagctggcgagggcctctttcatcgaggtgaagacttgcatctggcccaagagccacaccctctggagtaacggcgtgctggagtccgagatgatcatccccaagatatatggggggccgatgagccagcacaactatcgccctgggtacttcacacagaccgccggaccttggcatctggggaagctcgagctggatttcgacctatgtgagggcacgaccgtcgtcgtagatgaacactgcgggaaccgagggccatccctccggaccaccacggtcaccggcaagatcatccacgagtggtgctgccggagctgcaccctgcccccccttcgcttccgcggggaggacggctgctggtacgggatggagattcgcccagtgaaggaaaaggaagagaaccttgtcaagtcaatggtctcagccggatccggcgaagtggattccttcagcctggggcttctctgcatctccatcatgatcgaggaggtgatgcggagccggtggtcccgtaagatgttaatgaccggcacgctggccgtctttttcttactgatcatggggcagctgacctggaacgacctcattcgcctgtgtatcatggtcggcgcgaacgccagcgaccgcatggggatgggcaccacctacctggccctcatggccacgttcaaaatgcggccgatgttcgcggtggggcttctgttccgccgtctcacctccagggaggtattactgctaaccattggtctgagcctggtggcgtcagtggagctccccaatagcctggaggagctgggcgacgggctcgccatgggcattatgatcctgaagctgctcaccgacttccaatcacaccagctatgggccacgctgctcagcctgaccttcatcaagaccaccttctccctgcactacgcctggaagacaatggcgatggtccttagcatcgtgtcgctgttccccctgtgcttgagcaccacttcccagaagaccacctggctccccgtcttactcggcagcttagggtgcaaacctctgaccatgtttctcatcgcggagaataaaatctggggtcggcggtcgtggccactgaatgagggaatcatggccgtgggcatcgtgtccatcctgttgtcgagcctgctgaagaacgacgtccccctcgcaggacccctgatcgccggcggcatgctaatcgcatgctacgtgatcagcgggtccagcgccgatctctccctggagaaggctgcggaggtaagttgggaggaggaggccgagcatagcggagcgtcgcataacatcctcgtcgaggtccaggacgatggtacgatgaagatcaaggacgaagagcgggacgacactctcaccatcctgttgaaagccacgctcctggccgtgtcgggcgtttatcccctgtccatccccgccaccctcttcgtttggtacttctggcagaagaagaagcagcggagtggagtgctctgggacacacccagcccgccggaggtcgagcgggcagtgctggacgacggcatctacaggattatgcagcggggcctcctcggtcgctcccaggtgggggtcggagtgttccaggagaacgtgtttcacaccatgtggcatgtaacgagaggcgcggtgctgatgtatcagggcaagaggctggagcccagctgggcctccgtgaagaaggacctcatcagctacggcggcgggtggcggctgcaaggctcctggaataccggggaggaggtccaagtgatcgccgtggagccaggcaagaaccccaagaacgtccaaaccgctcccgggaccttcaagacgccagagggcgaggtgggcgccatcgcgttagactttaagcccgggaccagcggatcccccatcgtgaaccgcgagggtaagatcgtcggcctctacggtaacggggtggtgaccaccagcggcacgtacgtcagcgccatcgcccaagcgaaggcgtcccaggagggaccgctgcccgagatcgaagatgaagtgttccggaagcgcaacttaaccatcatggacctccaccccggctcagggaaaacccggcgctacctgccggccatcgtgcgggaggccatcaagcgcaagctgcgcaccctcatcctggcccccacccgggtagtggcatccgagatggcggaggccctgaagggcatgcccatccgctaccaaacaaccgccgtgaagagcgagcacaccggtaaggagatcgtcgacttgatgtgccatgccacgtttacgatgcggctgctatcgcctgtgcgcgtgccgaactataacatgataatcatggacgaggcccacttcacagaccccagctcaatcgcggcccgggggtatataagcacccgcgtgggaatgggggaggcggccgccattttcatgacggcgacgccgcccggctccgtggaggccttcccgcagagcaacgccgtgatccaggatgaagagcgggacatccccgagcgatcctggaacagcgggtacgagtggatcaccgacttcccgggcaagaccgtgtggttcgtgccgtcaataaagtcgggcaacgacatcgccaactgcctcagaaaaaacgggaagagagtgatccagctgagcaggaagacgttcgacaccgagtaccagaagaccaagaacaacgactgggactacgtcgtgaccacggacatcagcgagatgggcgcgaacttccgtgccgaccgggtgatcgacccgcgcagatgcctcaagcccgtcatcctcaaggatggtcccgaacgcgtgatcttggccggccccatgccggtgaccgtagcctccgctgcgcagaggcgcgggcggatcggtcggaaccacaacaaggagggcgaccagtacatctacatggggcagcccctgaacaacgacgaggaccatgcccactggacagaggccaagatgctcctggacaacatcaacaccccggagggcatcatccccgcgctgttcgagccggagcgcgagaagtccgccgcgatcgacggggagtaccggctgagaggcgaggcacggaagacgttcgtggagctgatgcgccgcggggacctgcccgtttggctctcctacaaggtcgccagcgaaggttttcagtacagcgaccgccgctggtgcttcgatggcgagcgcaacaaccaggtgttggaggaaaacatggacgtcgagatctggaccaaagagggggagcgcaaaaagctgcgcccccggtggctcgacgccaggacatactccgacccgctagccctccgggagttcaaagagttcgcggccggccgccggagcgtgagtggcgatctcatactagagatcggcaagttaccgcagcatctcacccagcgggcccaaaacgcgctggacaatttggtgatgctccacaatagtgagcaaggcgggcgggcgtaccgccacgccatggaggaactgcccgacaccatcgaaaccctgatgttgctggccctgatcgccgtcctcaccggcggggttaccctgttcttcttatccggccgtgggttaggaaagaccagcatcggcctgctgtgcgtgatggcctccagcgtactcctgtggatggcgtccgtggagccccactggatcgccgccagcattatactagagtttttcctcatggtcctgctgatccccgaaccggaccggcaacggacgccccaggacaaccagctcgcctacgttgtgatcgggctgctgttcatgatcctcactgtggcggcgaacgagatggggttactcgagaccaccaagaaagatctcgggataggccatgtcgcagtagagaaccaccaccacgccgcaatgctggacgtggacctgcatcccgcctccgcgtggacgctctacgccgtcgcaaccaccatcatcacccccatgatgcgccatacgatcgaaaataccaccgccaacattagcttgaccgccatcgcgaaccaggccgccatcctgatggggctcgataagggctggcccatctccaagatggacatcggcgtgcctctgctcgccctcgggtgctacagccaggtcaaccccctaacgctgaccgcggccgtcctcatgctggtggcccactacgccatcataggcccggggctgcaggctaaggcaacccgcgaggcccagaagcggaccgccgctggcatcatgaagaaccctacggtggacggaatcgtcgctatagacctggacccagtggtgtacgacgcgaagttcgaaaagcagctaggccagatcatgctgctcatcctgtgcacgtcccagatcctgctcatgcgcaccacctgggccctgtgcgaaagcatcacactggccaccggccccttaaccaccctttgggaggggtccccgggtaagttctggaacacgacgatcgccgtcagcatggccaacatcttccgggggtcatacctggcaggcgccggcttggccttcagcctgatgaaatccctcgggggcgggcgcagagggaccggtgcccaaggtgagacacttggcgagaagtggaagcgccagttgaaccagctgtccaagagcgaattcaacacgtacaagcgcagcgggatcatggaggtggaccggagcgaggcgaaagagggactcaagcggggcgagaccacaaagcacgccgtgtcccgcggcaccgctaagttacggtggttcgtcgagcgtaaccttgtgaaaccggagggcaaggttatcgacttaggctgcggccgcggcggatggagctactactgcgccgggctcaagaaggtcacggaggtgaaaggctacacaaagggaggcccgggccacgaggagcccatcccaatggccacctacgggtggaacctggtgaaattacactccggcaaggacgtcttcttcatcccgcccgaaaagtgcgacaccctcttgtgcgacatcggggagagctcccccaacccgacgatcgaggagggccgcaccctgcgggttctcaagatggtggagccctggctgcgggggaaccagttctgcatcaagatcctcaacccctacatgcccagcgtagtcgagaccctcgagcagatgcagcggaagcacggcggcatgctggtaaggaaccccctgtcccggaactccacccacgagatgtactgggtctcgtgcgggactggtaacatcgtgagcgcggtgaatatgacgtcccgcatgctcctgaacagatttaccatggcccaccggaagcccacctacgagcgcgacgtcgacctgggggccggtacccggcacgtggccgtggagcccgaggtcgctaacctcgacatcatcggccagcgcatcgagaacatcaagcacgaacacaagagcacgtggcactacgacgaggacaatccctacaagacctgggcgtaccatgggtcctacgaggtgaagccgagcggctccgccagcagcatggtgaacggggtcgtcaagctgctgaccaagccttgggacgttatccccatggttacccagatcgccatgacggacaccacccctttcgggcagcagcgagtgttcaaggagaaggtcgatacccgcacgccgaaggccaagcgtgggacggcacagatcatggaagttaccgcgaagtggctatggggcttcctgtcccgcaacaagaagccacggatctgcacccgggaagaatttactcggaaggtgcgcagcaacgccgccatcggtgccgtcttcgtggacgaaaaccagtggaactccgcgaaggaggccgtcgaggacgagcggttctgggacctggttcatagggagagggagttacacaagcagggaaagtgcgcgacctgcgtgtacaatatgatgggcaagcgcgaaaagaagttgggggagttcggcaaggcgaaggggagccgggctatctggtacatgtggctgggcgcgcgctttttggagttcgaggcactgggcttcatgaacgaagaccactggttctcccgggagaactcactgagcggggtggagggcgagggtctccacaaactgggctatatcctgcgcgacatcagcaagatccccgggggcaatatgtatgccgacgacactgccggctgggacacccggatcacggaggacgaccttcaaaacgaggcgagaatcaccgatatcatggagccggagcacgctctactggccaaaagtatcttcaaattaacctaccagaacaaggtagtgcgtgtgcagcggcccgctaagaacgggaccgtcatggatgtgatttcccgtcgggaccagcgcggctccggccaggtgggtacttacggcctgaacaccttcaccaatatggaggcgcagctgattcggcagatggagagcgaggggattttctcaccctctgagttggagacacccaacctggccaaacgcgtcctcgactggctcgagaagtacggcgtggagcgtctgaagaggatggcaatctccggggacgactgcgtggtcaaacccattgatgacagattcgccacggccctgacggccctcaacgacatgggcaaggtgcgcaaggacatcccccagtgggagcccagcaaggggtggaacgattggcagcaggttcccttctgctcccaccacttccaccagcttatcatgaaagacggccgggagatcgtcgtaccgtgccgcaaccaagacgagctggtgggccgggcccgtgtcagccagggggcgggctggagtctccgggagaccgcctgcctagggaagtcctacgcccagatgtggcagctgatgtacttccaccgccgggacctgcgcctggccgcgaacgccatctgcagcgccgtgcccgtggactggatccccacctctcggacgacctggagcatccacgcccaccatcaatggatgaccaccgaggacatgctgtccgtctggaacagggtttggatagaagagaacccctggatggaagacaaaacccacatctcttcctggggcgacgtgccatacctggggaagagggaggaccagtggtgcggcagcctcatcggtcttactgcccgggcgacttgggccaccaacatacaggtcgccatcaaccaggtgcgccggctcatcgggaatgagaactacctggactacatgacctccatgaagcgctttaagaatgagagcgaccccgagggcgccctgtggtga

SEQ ID NO: 24147 - RNA, 9879 nt, synthetic construct
  misc_feature 1..9879: note = derived and/or modified CDS sequence (opt11) from DENV-1__FJ205876__SS-prME
  source 1..9879: mol_type = other RNA
tccgtaactatgctgctcatgctcatgccaaccgccctggcctttcacctcaccacccggggcggggagccccacatgattgtgagtaagcaggagcggggcaagagcctattattcaaaacgtcagccggggtgaacatgtgcacccttatagccatggacctgggcgagctgtgcgaggatacaatgacctataaatgtccccggatcaccgagaccgagccagacgacgtggactgctggtgcaacgccacggacacctgggtgacctatgggacctgtagccagacaggggagcacaggcgggacaagcggtccgttgccctcgcgccccacgtgggcctcgggctagaaacccgcaccgagacctggatgagctccgaaggggcctggaagcagatccagcgcgtggagacgtgggccctccgtcaccccggcttcaccgtcatagccctgttcctggcccacgctatcggcaccagcattacccagaaggggatcatctttattctcctcatgttggttactccgtccatggccatgcgatgcgtgggcataggctcacgggatttcgtggaggggctctccggcgccacctgggtggacgtcgtgctcgaacacgggtcctgcgtaaccaccatggccaaagacaagcccacgctggacatcgagctactgaaaaccgaggtgacaaatccagctgtgctgagaaagctctgcatcgaggcgaagatttctaacacgacgaccgacagccgctgcccgacccagggcgaggccaccctggtggaggagcaagacgccaacttcgtctgccggcgcacgttcgtggatcggggatggggtaacggctgcggactgttcgggaaggggtccctaattacctgcgccaagttcaaatgcgtgaccaagctggagggaaaaatcgtccagtacgaaaacctgaaatacagcgtgatcgtgactgtccacacgggcgaccagcaccaagtggggaacgagtccaccgagcatggaaccaccgccacgatcacgccacaagcccccaccacggagatccagctaaccgattacggcgctctgaccctggactgtagcccacgcaccggcctcgacttcaacgagatggtgctgctgaccatgaaggagaagtcctggctcgtgcataagcagtggttcctggacctgcccctcccttggacaagcggagccagcacgtcccaggagacctggaatcggcaggacttactcgtgacattcaagacagcccacgcgaagaagcaagaagttgtggtgctcggctcccaggagggggcgatgcacactgccctaaccggggccaccgagatccagacctcaggcacgaccactatcttcgccgggcacctgaagtgccgcctcaagatggacaagctgactctgaaggggatgtcttacgttatgtgtacggggtccttcaagcttgaaaaggaggtggccgaaacccagcacggcaccgttctggtgcaaataaagtacgagggcaccgacgcgccctgcaagattcccttctcgacgcaggacgaaaagggggtgacccagaacggacggctgattaccgcaaacccgattgtaaccgataaggagaaaccggttaacatcgaggccgaaccgccgttcggcgagtcctacatcgtgatcggtgctggcgagaaggcgctgaagctcagctggttcaagaagggctccagcattggcaagatgttcgaggccacggccaggggggcccggcgcatggccatcctgggcgacactgcctgggacttcgggtccataggtggagtgttcaccagcgtcggcaagctggtgcaccagatattcggcaccgcctacggcgtgctgttctcaggcgtcagctggacgatgaagatcgggattggcgttctgctgacttggctcggtctgaactcccgcagcacctcgctgagcatgacctgtattgccgtcgggctcgtcacgctgtaccttggcgttatggtgcaagccgactccgggtgcgtgataaactggaagggccgggagcttaaatgcgggagcggcatcttcgtgaccaacgaagtgcacacctggactgagcagtacaagttccaagccgatagcccgaagcgactttccgcggccatcggcaaggcatgggaggagggggtttgcggcatccggagcgccacccgcctggagaacatcatgtggaaacagatctccaacgaactgaatcacatcctgctagagaatgacatgaaattcacggtggttgttggggacgtggcaggcatcctcgcgcagggaaagaagatgataagaccccagccaatggagtataagtattcatggaagtcgtgggggaaggcaaagatcattggcgctgatgtgcagaacacgaccttcatcatcgacgggcccaacaccccggagtgcccggacgaccagcgcgcctggaacatctgggaggtagaggactacggctttgggatctttacgacaaatatttggctgaagctgcgtgactcttacactcaggtgtgcgaccaccgcctcatgtccgcagccatcaaggatagcaaggccgtccacgcagacatgggatactggatcgagagtgaaaagaacgaaacctggaagctggccagagcgagctttattgaggttaaaacatgcatctggcccaagtcccatacactgtggagcaacggcgttctagagtccgagatgatcatccccaagatctacgggggtccgattagccaacacaattatcggcccgggtacttcacacagacagccggcccctggcacctaggcaagctggagctcgatttcgacctatgcgaaggcaccaccgtggtcgtggacgagcactgcggcaaccgtgggccgtccctgagaaccaccaccgtcacggggaagatcatacacgagtggtgctgtcggagctgcaccctgccccctctccgctttcgcggggaggacggctgctggtacgggatggagatacgccccgtgaaggaaaaggaggagaacctcgttaaatccatggtaagcgcaggaagcggcgaagtcgacagtttcagcttgggactgctgtgcatctccatcatgattgaggaggtgatgcggagccgctggtccagaaagatgttgatgaccggcacattagccgttttcttcctactcatcatgggccaactgacctggaatgacctgatacggctctgcatcatggtcggcgccaacgcgagcgaccgcatggggatgggcaccacatacttggccctgatggccacgttcaagatgcggccgatgttcgccgtgggactcctgttccgccggctgacctcccgcgaggtactcctgctgacgatcgggctcagcctcgtggcctccgtggagcttcccaacagcctcgaggagctgggagacgggctggcaatggggatcatgatcctcaaactgctgaccgattttcagtcccaccagctctgggccacgctgctatcactcacgtttatcaagaccacattctccctgcattatgcctggaagaccatggccatggtcctatcgatagttagtctcttccccctgtgcctaagcactacctcccagaagaccacgtggctccccgtgcttctggggagcctcggctgcaagccgctcacaatgtttctgatcgcggagaataagatatgggggcggcgatcctggccactcaatgaggggataatggcagttggcatcgttagcattctgctgagcagcttgctgaagaacgatgtgcccctggccgggcccctcatcgcaggcggcatgctcattgcctgctacgtcatcagcggcagttctgcggacctctccctcgaaaaagctgcggaggtgagctgggaagaggaagccgagcactccggcgcctcccacaacatcctggtggaggtccaggacgatgggaccatgaaaatcaaggacgaggaaagagatgacaccttgaccatccttctgaaggccacgctactcgccgtttcgggagtgtacccgctgagcattcctgccaccctgttcgtctggtacttttggcagaaaaagaagcaacgctccggggtcctctgggacacccccagcccgcccgaagtagagagagccgtcttagacgacggcatataccgtatcatgcagcgggggctgctggggcgctcccaggtgggcgtcggggtctttcaggagaacgtgttccataccatgtggcacgtgacgcggggggccgtcctcatgtaccagggcaaacgcctggagccatcgtgggcgtccgtgaagaaggacctgatcagctacggcggagggtggcggctccagggctcctggaacaccggtgaagaagttcaagtcatcgccgtggagcccggcaaaaaccccaaaaacgtgcagacggcccccgggaccttcaaaacgcccgagggcgaggtcggcgccatcgccctggacttcaaacccggaacttccggctcccccatcgtgaaccgcgaggggaaaatcgtgggcttgtatggcaacggcgtagtgaccacgtcaggaacgtacgtcagcgcgatagcccaggccaaggcctcccaggaggggccgctccccgagatcgaggacgaggtcttccgcaagcgcaacctaaccataatggacctgcacccaggcagcgggaagacacgccgctatctcccagcgatcgtgcgtgaggccattaagcgcaagctgcgcaccctgatactcgccccaacgcgagttgtcgcgtccgaaatggccgaggctctgaaaggcatgcctattcgctaccagaccaccgccgttaagagcgagcataccggaaaggagatcgtggacttaatgtgccatgccactttcaccatgcggttactgtccccggttcgagtgccgaactacaacatgatcatcatggacgaagcgcacttcaccgaccccagctccatcgcagcgcgggggtatatcagcactcgcgtgggcatgggggaggcggccgccatcttcatgacggccacgccgcccggctccgtcgaggcgttcccgcaaagcaacgccgtgatccaggacgaggagcgtgacatcccggagcgcagctggaacagtgggtatgaatggattactgactttcccggcaagaccgtgtggtttgtccccagtatcaagagcggcaacgacatcgcaaattgcctgcggaagaacgggaagcgcgtgattcagctctcccggaaaacgttcgacaccgagtaccagaagaccaagaacaacgactgggactacgtggtcaccacggacatcagtgaaatgggtgccaactttagggcggaccgggtgatagatccccgccggtgcctgaaaccggtaatcctgaaggatgggcccgagcgcgtaatcctcgccggccccatgcccgtcaccgtcgcctctgccgcccagcggagaggccggatcgggagaaaccacaacaaggaaggcgaccagtacatttatatggggcagccccttaacaacgacgaagaccacgcgcactggactgaggccaagatgctgctcgacaacatcaatacccccgaggggatcatccccgccctgtttgagccggaacgcgagaagagtgccgccatcgacggggagtaccggctgagaggtgaggctcggaagacgttcgtggagctgatgcgccgcggggacctgcccgtgtggctgtcctacaaagtcgctagcgagggattccaatactctgaccgacggtggtgtttcgacggcgagcggaacaaccaggtactcgaggaaaacatggacgtggaaatctggaccaaggagggggaaagaaaaaagctgcggcctcggtggctggacgcccgcacgtattccgatcctctcgccctgcgggaatttaaggaattcgccgcgggacgcaggagcgtctcaggggacctgatcctcgaaatcggaaagctaccccagcacctgacacagcgtgcccagaacgccttagataatctggttatgctgcacaattccgagcagggcgggcgggcctaccgccatgcgatggaggagttacctgacacaatcgagacccttatgctgctcgccctgatcgccgtgctcacaggcggggtaaccctgttctttctgtccggccgggggctggggaaaaccagcatcggcctcctgtgcgtgatggcatccagcgtgctgctctggatggcgtccgtcgagcctcactggatcgctgccagcatcatcctagagttcttcctgatggtgctcctgatccctgagcctgatcgccagcggacgccccaagataatcaactggcatatgtggtcatcgggctccttttcatgatcctgaccgtggccgctaacgagatgggcctcctcgagaccaccaagaaggacttggggatcgggcacgtggcggttgagaaccaccaccacgccgccatgttggacgtggatctgcaccctgcctccgcctggactctgtacgcggtggctaccaccattatcaccccgatgatgcgccacacgatcgagaacaccaccgcgaatatctcgctcactgccatagccaaccaggctgctattctgatggggctcgacaagggctggcccatctccaagatggacataggcgtccccctactggccctcgggtgttacagccaggtgaatccattaacgctgactgccgcggtgctgatgttggtcgcccactacgccatcattggaccaggtctgcaggccaaggccacccgcgaggcgcagaagaggactgctgccggcatcatgaaaaatccgacggtggacggtatcgtggcgatcgatctggaccccgttgtgtacgacgccaagttcgagaagcaactcggccaaatcatgctgctgatcttgtgtacctcccaaatcttgctgatgcgcacaacctgggcgctttgtgagtctatcacgctggcaaccggccctttgacgaccctctgggagggaagtcctggcaagttctggaacacgacaatcgcagtgagcatggccaatattttccggggatcctacctggccggcgcgggcttagcatttagcctcatgaagtcgctcgggggcggacgccgtgggaccggggcgcagggcgagaccctgggcgagaaatggaaacgccagctcaaccagctgtccaagagcgagttcaatacgtacaaacggtcagggatcatggaggtcgaccgaagcgaggctaaggagggcctgaagcgcggagagaccactaagcacgcggtgtccagaggcaccgctaagcttcggtggttcgtggagcgcaatctggtcaagcccgaggggaaggtgattgaccttggttgcggccgcggggggtggagctattactgcgccggtctgaagaaagtcacggaggtaaaagggtacaccaagggaggccccggccacgaggagcccatcccaatggccacgtacggatggaacctcgtgaaactgcactccgggaaggacgtcttcttcatcccgcccgaaaagtgcgatacgttgctctgtgatataggggagagctcccccaacccgacgatcgaggagggccgcaccctgcgggtccttaagatggtggagccgtggctccgcggaaaccagttctgtatcaagatactgaacccatacatgccctcagtggttgagaccctcgagcagatgcagcgtaagcacggcgggatgctcgtgagaaacccgttaagtcggaacagcactcacgagatgtattgggtgtcctgtgggactggcaacatagtctccgccgtaaacatgacttcccgcatgctgttgaaccgttttacaatggcgcacagaaagcccacctacgagcgtgatgtggacctgggggcaggcacccggcacgtcgccgtggaacctgaggtggccaacctggacatcatcggtcagcgtatcgagaacattaagcacgagcacaagagtacgtggcattacgacgaggacaacccctacaagacatgggcctaccacgggtcctacgaggtcaagccgtctgggtccgcaagctccatggtgaacggggtcgtaaaactcctgaccaagccctgggacgttatccccatggtcacccaaatcgcaatgacggatacgactccctttggccagcagagggtgttcaaggagaaggtggacacgcgcactccgaaggcgaagcgggggaccgcacagatcatggaggtcactgccaagtggctgtggggtttcttgtcccgcaacaaaaagccccggatctgcacgcgcgaagagttcacccgtaaggtgcgcagcaacgcagccatcggggccgtgttcgtcgacgaaaaccaatggaactccgctaaggaggcggtagaggacgagcggttctgggacctggtccatcgcgagcgggagctgcataaacaggggaagtgcgcgacgtgcgtctacaacatgatgggcaagcgcgagaagaagctcggggaattcggcaaggcgaaggggtctcgggccatctggtatatgtggctgggagcccgcttcctggagttcgaggcgctcggcttcatgaacgaggaccactggttcaaccgggagaattccttaagcggtgtggagggcgaggggctccacaagctcggctacatcctgcgtgacatatccaagatccccgggggcaacatgtacgccgacgacacggccggatgggatacccggatcacagaggacgacctgcagaacgaagcccgcatcacggacataatggaaccggagcacgccctcctggcgcgcagcatctttaagctgacctatcagaacaaggtagtccgggtgcagagacccgccaagaacgggacggtgatggacgtgatctcccggcgcgaccagcgggggagtggacaggtgggaacttacggcctaaacaccttcaccaatatggaggctcaactgatcaggcagatggaatccgagggaatcttttctccttccgagctggagacacccaaccttgccgagagagttctggactggctcgagaaatacggcgtcgagaggctgaagcggatggccatcagcggggacgactgcgtcgtgaagccgatagacgacagattcgcgacagccctgactgcactgaacgacatggggaaggtccggaaagacataccccagtgggagcccagcaaagggtggaacgactggcagcaggtccccttctgcagccaccacttccaccagttaataatgaaggatggccgtgaaatcgtggtcccgtgccggaaccaggatgaactcgtgggacgcgcccgagtgtcccagggcgctggctggtcactgcgcgagaccgcgtgtctggggaagagctacgcccagatgtggcagctgatgtacttccaccggcgcgatctgcgtctcgcagctaatgctatctgctcagccgtcccggtggactggatccccaccagcagaacgacctggtccattcacgcacatcaccagtggatgacaaccgaggacatgttgagcgtgtggaatcgtgtctggatcgaggagaacccctggatggaggataagacccacatctcaagttggggagacgtaccgtacctaggaaagcgggaggaccagtggtgcggctccttgatcggcctgaccgccagggctacttgggcaacgaacatccaggtggccataaaccaggtgcggagactgatcgggaatgagaactacctcgattacatgacgagcatgaagcggttcaagaacgagtccgaccccgaaggcgcactgtggtag

SEQ ID NO: 24148 - RNA, 9879 nt, synthetic construct
  misc_feature 1..9879: note = derived and/or modified CDS sequence (opt11) from DENV-1__FJ024455__SS-prME
  source 1..9879: mol_type = other RNA
agcgtgaccatgctgctgatgctgatgcccacggccctggcctttcacctcaccacgcggggcggggaaccgcacatgatagtgagcaagcaggagcggggcaagagtctactgttcaagactagcgtgggtgtgaacatgtgtaccttaatcgcaatggacctgggcgagctgtgcgaggacacaatgacctacaaatgcccccggatcaccgaaaccgagcccgatgacgtggactgctggtgcaacgccacggacacctgggtcacctacggcacctgtagccaaacgggcgagcaccggcgggacaagcggagtgtggccctcgcgccccacgtcggcctgggcctggaaacgcgcaccgaaacctggatgagctccgagggcgcctggaagcagattcagcgggtagagacgtgggcgctccggcaccctggttttacagtgatcgccctattcttagcccacgccatcgggactagcattacacagaaggggatcatctttatcctcctgatgctggtcacgccctccatggcgatgcggtgcgtgggcataggtagcagggatttcgtcgaggggctctccggcgccacgtgggtcgatgtggtgctggaacacggcagctgcgttaccaccatggccaaggacaaacccacgctggatatcgagctcctgaagaccgaggtgaccaaccccgccgtgctgcggaagctctgcatcgaggccaagatctccaacaccactacggacagccgctgccccactcagggagaggcgacactggtcgaggagcaggacgccaactttgtctgccggcgcacgttcgtggaccggggatgggggaacgggtgcgggctgttcggtaaggggtcccttatcacgtgcgccaagtttaagtgcgtcaccaagctggaagggaagatcgtccagtacgagaacctgaagtatagcgtgatcgtcaccgtgcacacgggtgaccagcaccaggtagggaacgagtccaccgagcacggcacaacggccaccattacgccacaggccccgaccaccgagatccagctcaccgactacggggcgctgaccctggattgtagcccgcgcacaggccttgacttcaacgagatggtgctgttaaccatgaaggagaagtcgtggctcgttcacaagcagtggttcctggacctgccgttaccgtggaccagcggcgcctccacgtcccaggagacctggaaccgtcaggacctcctggtcaccttcaagaccgcccacgcgaagaaacaagaggttgtggtcctcggcagtcaggaaggagcaatgcacacggcgctgactggggccaccgagatccagacgtcaggcaccaccacgatctttgccgggcacctgaagtgccgcctcaaaatggataagctgacgctcaagggcatgtcttacgtcatgtgcaccggatccttcaagctcgagaaggagctggcggagacccagcacggcacggtacttgtccagatcaagtacgagggcacagacgcaccctgcaagatacccttcagcacgcaagacgagaagggggtgacccagaacggtagattgataaccgcgaatcccatagtgaccgacaaggagaagcccgtcaatatcgaggccgaaccgcccttcggcgagtcctacatcgttatcggcgcgggcgagaaagccttaaagctgtcctggttcaagaagggttcctccatcggaaaaatgtttgaggctacggcccgaggggctagaagaatggccatcctgggcgacacagcctgggacttcggctccataggcggcgttttcacctccgtcggtaagctcgtgcaccaaatctttggcacagcgtacggggtactgttttccggcgtttcatggacgatgaagataggaatcggcgttttgctcacatggctgggcttgaacagtcgaagtacctccctcagcatgacctgcatcgccgtgggtctagtcactctttaccttggagtgatggtgcaggctgactccgggtgcgtcatcaactggaaaggccgggagctgaagtgtgggagcggaatctttgtgaccaacgaggtccacacatggacagagcagtacaagttccaggccgactccccgaagcgcctgtccgccgcgataggtaaagcctgggaggaaggggtttgcgggatacggagcgccacacgcctcgagaatatcatgtggaagcagatctccaacgagcttaaccacatcctcctcgaaaacgacatgaaattcacggtggtagtcggtgacgttgccggcatattagcccagggaaagaagatgatccggccccagcccatggagtacaagtacagctggaagtcttgggggaaggcgaagataatcggtgctgacgtacagaacactacctttattatcgatgggccgaacaccccggagtgccccgacgatcaaagggcgtggaacatctgggaggttgaagactacggcttcggtatctttacgaccaatatctggttgaagctccgggactcttatacacaggtctgcgaccaccgactgatgtcggccgcgatcaaggacagcaaagctgtccacgccgacatggggtactggatcgagtccgagaagaacgaaacgtggaagttggcccgggcttccttcatcgaggtcaaaacatgtatctggccaaagtctcatactctctggagcaatggtgtgctagagtccgaaatgataatacccaagatctacgggggcccgattagccaacacaactaccgccccgggtacttcactcagaccgcgggcccatggcacctggggaagctcgaattagacttcgacctctgcgagggtacgaccgtggtcgtagacgagcactgcggtaaccggggcccgagcctccgcaccacaacagtgaccggcaagataatccacgaatggtgctgtcggagctgcaccctgcctcctcttcgcttccgcggggaagacggctgctggtacgggatggaaattaggccggtcaaggagaaggaggagaacctggtgaaaagtatggtgtctgccggaagcggcgaggtagatagctttagcctgggtctgctctgcatatcaatcatgatcgaggaggtcatgcgaagccgctggtcccggaagatgttaatgacggggacactggccgtgttctttctcctcatcatggggcagctgacttggaacgacctaatccgcctgtgtataatggtgggcgccaacgccagcgaccgcatggggatgggcacaacttaccttgcactcatggccacgttcaagatgcgacctatgttcgccgtaggcctgctctttcgccgactcacttctcgcgaagttttactgctcaccatcgggctctcgctggtcgcttccgtggagctccccaacagcctggaggagctgggtgacggtctagctatgggaatcatgatccttaagctgctcacggattttcagtcacatcagctgtgggcgacgctgctttcccttacctttatcaagaccacgttcagcctgcactacgcctggaaaacgatggcaatggtcctttcgatcgtctcactgtttccactatgcctcagtacgacctcccagaagaccacgtggttacccgttctgctcggcagcctggggtgcaagcccctcaccatgttccttatagcagagaacaagatttgggggcgccgctcctggccccttaacgagggcatcatggcggttggcatcgtgtccatcctgctaagctccctgctgaagaacgacgtccccctcgcgggacccctgatcgccggtggaatgctgatagcctgctacgtaatcagtgggagctcggccgatctctccttggagaaggcggccgaggtctcctgggaggaggaggcagagcattctggcgcgagccacaacatcctggtggaagtccaagatgacgggacgatgaagattaaagacgaggagagggacgacaccctcaccatccttctgaaggcaacgctcctggcggtgtcgggcgtgtacccgcttagcatccccgcaaccctcttcgtctggtacttctggcagaagaagaaacagcggtccggggttctgtgggacacacctagtccacccgaggtggaacgggccgtcctggacgacgggatataccgaatcatgcagcggggcctgctcgggcgcagccaagtcggcgtgggagtcttccaggagaacgtatttcacactatgtggcacgtgacgcgtggcgccgttctgatgtatcaggggaaacgcctagagcccagctgggcctccgtaaagaaggacctcatcagctacggcggagggtggcggctgcagggatcctggaacaccggggaggaagtgcaggtcatcgcggtcgagccaggcaagaaccccaagaacgtgcagaccgcgcccgggacttttaagacgcccgagggagaggtgggcgccatcgctctggacttcaagcccgggacgagcggctcccccatcgtaaaccgcgagggtaagatcgttggtctctacgggaacggcgtcgtcaccacctctggcacttacgtcagcgccatcgcgcaggcaaaagcatcccaggaggggccgccccctgaaatcgaggatgaggtcttccggaagcgcaacctgactatcatggacctgcatccggggagcgggaagacccgtcgctacctccccgccatcgtgagggaagctatcaagagaaagttgaggactctgattcttgcccctacgcgggtggtcgcctctgagatggcggaggcgttaaaggggatgcccatacggtatcaaactactgctgtcaaaagcgaacacaccggtaaggagatcgtggacctgatgtgccacgccacgttcacgatgcgattactgtccccggtgcgggttcccaattacaacatgatcatcatggacgaagcccatttcaccgaccccagctcgatcgccgcccgggggtacatcagcacaagagtggggatgggggaggccgccgccatcttcatgactgccaccccacccggctcagtcgaggcattcccacagagcaacgcggtgatacaagacgaggagcgggacattccagagcggagttggaacagcgggtacgagtggataaccgacttccccggtaagactgtgtggtttgtcccctcgataaagagcggcaacgacatagccaactgtctgcgcaagaatgggaagcgcgtgattcagctctcccgaaagacattcgacacagagtaccagaagaccaagaataacgactgggactacgtggtcaccacggatatcagcgaaatgggcgccaacttccgcgccgaccgggtgatagacccccgccggtgcctgaaaccagtcatcctgaaggacgggcctgaacgtgtcattctcgcgggcccgatgcccgttaccgtcgcgtccgctgctcagcggcgcggcagaatcggccgcaaccacaataaggagggcgatcagtacatctacatggggcagccgcttaacaatgacgaggaccacgcccactggacggaggcgaaaatgctgttggacaacatcaataccccggagggaattatcccggccctcttcgagcccgagcgggagaaaagcgccgccatcgatggagagtaccggcttcgcggcgaggcccgtaagacgttcgtagaactcatgcgccgcggggacctccccgtgtggctgtcctataaagttgcgagcgagggctttcagtacagcgaccgccggtggtgcttcgacggcgagcgcaataaccaggttctagaggagaacatggatgtggagatatggacgaaggagggggagcggaagaaattgaggccccggtggctggacgcccgcacttactcggatccgctcgccctacgggagttcaaagagttcgccgcgggccgccggagcgtctctggcgacctgatcctggaaattggcaagctgccacaacatctgacccaaagagcgcagaacgccctagacaacctggtcatgctgcacaacagcgagcagggcggtcgtgcatataggcacgccatggaggaactgcccgacacgatcgaaaccctgatgttgcttgcgctgatcgccgtgctgaccggaggggtcaccctcttcttcctttccgggcgggggcttggcaagacctcaatcggcctactgtgcgtgatggcctccagcgtgctgttgtggatggcatccgtcgagccccactggatcgccgcgagcatcattttagagtttttcctgatggtgctcctgattccggagcccgacaggcagcggacgccccaggataaccaactggcctatgtggtcatcgggctcttgttcatgatcctgactgttgccgctaacgagatgggcctcttggaaacgaccaaaaaggacttaggtatcggccatgtggcggtcgagaaccatcaccacgcggcgatgctcgacgtggacctgcaccccgcgtccgcctggacactgtacgccgtcgcgaccaccatcatcacccccatgatgcgccatacgattgagaacaccacagctaacatctcccttaccgccatcgcaaatcaggccgcgatactaatggggctggacaaaggctggcccatctccaagatggacatcggcgtgcccctcctggccctggggtgctattcacaagtgaacccgctcacgttaacggccgccgtgctgatgttggtcgcgcattacgccatcatcggccctggattacaggccaaggccacccgcgaggcccagaagcggacagcagccggcatcatgaagaacccaacggtggacgggatcgttgccatagatttagaccctgtcgtgtacgatgccaagttcgagaagcaactaggccagattatgctactgatcctctgcacctcccagatcctgctgatgcgcaccacatgggccttatgcgaaagcatcacgctagcgactggcccgctgacaaccctctgggagggtagtcccggcaagttctggaacacgactatcgccgtgtctatggccaacatcttccgggggtcctacctggccggcgccggactggcgttcagcctcatgaagtcccttgggggcgggaggaggggtaccggggcccagggtgagaccctgggcgaaaagtggaagcgccagctcaatcagcttagtaagtcagagttcaacacctacaagcggtctgggatcatggaagtcgatcgcagcgaagccaaggaggggctaaagcgcggggaaaccaccaagcacgccgtgtcacgcggcaccgcgaagctccggtggttcgtggagagaaacttggtcaagcccgaagggaaggtcatcgatctagggtgcggcagagggggatggagctactactgcgccgggctgaagaaggtaacggaagtaaaaggctacaccaaaggtggacccggtcacgaggagccgatccccatggcgacatatggttggaacctcgtgaaactccattccggaaaggacgtgttctttatcccgcccgagaagtgcgacaccctgctctgcgatataggggagagctccccgaaccccacgatagaggagggcagaaccctgcgggtcctgaagatggttgagccatggctccgaggtaaccagttctgtatcaagatcctcaacccatacatgcccagcgttgtcgagacactcgagcagatgcagcggaaacacggcggcatgctcgtgcgcaaccccctctctaggaactcaacccacgagatgtactgggtgagctgcggaaccggcaacatcgtcagcgccgtcaacatgacgagtcgaatgctgctcaaccgcttcaccatggcccaccggaagcccacctacgaacgcgacgtggacctgggcgcgggtacccggcacgtcgcggtggagcccgaggtggcaaacctcgacatcataggccagcgaatcgagaacatcaaacatgagcacaagagcacgtggcactacgatgaggacaacccgtacaaaacctgggcctaccacgggtcgtacgaggtgaaaccaagcggttccgcctctagcatggtaaatggcgtcgtgaagttgctgaccaagccctgggatgtgatcccgatggttacccagatcgcaatgacggacactacccccttcggccagcagcgtgtgttcaaagaaaaggtggatactcgcacgcccaaggcaaagcgggggaccgcacagattatggaggtcacggctaagtggctctggggcttcctctcccgcaacaagaaacctcgcatctgcaccagggaggagttcacgcggaaggtgcgcagcaatgcagcgataggagccgttttcgttgacgagaatcagtggaactccgcaaaggaggccgtggaggacgagcggttctgggatctcgtccaccgcgaacgggagctgcacaaacagggtaaatgcgctacttgcgtatacaacatgatgggtaagcgcgagaaaaagctcggggagttcggcaaagccaagggaagccgggcaatctggtacatgtggctgggcgcgcgcttcctggagtttgaggctctcgggttcatgaacgaggaccactggttctcccgggagaacagcctgtccggcgtagagggcgaggggctgcacaaactaggctacatcctgcgggacatcagcaagatccccgggggcaacatgtacgcggatgacaccgccggctgggacactcggatcacggaggatgacttacaaaacgaagcccggattaccgacattatggagccagaacatgcactcctggccaaaagcatattcaaattaacctaccagaacaaggttgtccgtgtgcaacgacctgcgaagaatgggaccgtaatggacgtcatcagccgccgggaccagagaggctccggccaggtcggcacgtacggcctcaacaccttcactaacatggaagcccaactcattcggcagatggagagcgaagggatttttagtccaagcgagctggaaaccccgaacctcgccgagcgcgtgttagactggctggagaaatacggtgtcgagcgtctcaaacgcatggccatctccggcgacgactgcgtggtgaagcccatagacgaccggttcgccacggcgctgaccgcgctaaacgatatgggcaaggtccgcaaggacattccccagtgggaacccagcaagggctggaacgattggcaacaggtcccgttctgctcccaccacttccaccaactcatcatgaaggacggccgggagatcgtggtcccctgccgcaaccaagacgagcttgtgggccgggccagggtgagccaaggggctggctggagccttcgggagaccgcctgcctgggaaagagctacgcccagatgtggcagctgatgtacttccaccgccgggacctgcgtctcgccgctaacgcaatttgcagcgcggtcccggtggactggatccccacttcgcggacgacctggagcatccatgcccaccaccaatggatgacaacagaggatatgctgtccgtgtggaaccgcgtgtggatcgaagagaacccttggatggaggacaaaacgcacatcagcagctggggtgacgtgccctacttagggaagcgcgaggaccagtggtgcggtagcctcatcggcctgacggcccgggccacctgggccaccaacatccaggtagctatcaaccaagtccgccggctaattggtaacgagaactaccttgactacatgacttcgatgaagcgtttcaaaaacgagagcgatcccgagggcgccctttggtga

SEQ ID NO: 24149 - RNA, 9879 nt, synthetic construct
  misc_feature 1..9879: note = derived and/or modified CDS sequence (opt11) from DENV-1__FJ024456__SS-prME
  source 1..9879: mol_type = other RNA
agcgtgaccatgttgttgatgctgatgcccactgctctggccttccacctcaccacccggggcggggaaccccacatgatcgtgacgaagcaggagcgggggaagagcctgctgttcaagaccagcgcgggggtaaacatgtgcatcctcatcgctatggacctgggcgagctgtgcgaggataccatgacctacaagtgcccccggatcaccgaggcagagcccgacgatgtggattgctggtgcaacgccaccgacacctgggttacctacgggacatgcagccagacaggcgagcaccggcgcgataagcggagcgtggccctcgcgccccatgtgggcttggggctggagacacgcaccgagacgtggatgtcctcagagggcgcatggaagcagatccaacgggtagagacctgggccctccggcaccccgggtttacggtgatagccctgttcctggcgcacgcaatcggtaccagcatcacccagaagggaatcattttcattctcctgatgctagtgacgccgagtatggcaatgcggtgcgtcggcatcggctcccgcgacttcgtggaggggctcagcggcgccacgtgggtggacgttgtgttagagcatggttcctgcgtgacgaccatggccaaggacaagcccaccctggacattgagctcctgaagacggaggtcaccaacccagcggtgttacggaaactctgtatcgaggccaagatcagcaacaccacaacggactcccgctgccccacccagggcgaggcaaccctcatggaggaacaagacgctaacttcgtgtgccggcgcaccttcgtggaccgggggtgggggaatggatgcgggctgtttggcaagggaagcctcatcacgtgcgcgaagttcaagtgcgtgactaagctggagggcaagatcgtgcagtacgagaacttgaagtactccgtcatcgtgaccgtgcacactggcgaccagcaccaggtcgggaacgagagcacggagcatggcaccaccgcgaccatcacgccccaggcgcccacgtccgaaatacagctcaccgattacggggccctgaccctggactgcagccctcgcacgggcctagacttcaacgagatggtgctgctgacgatgaaggagaagtcctggctcgtccacaaacaatggttcctggacctgccgctcccctggacctccggggcaagcacctcccaagagacgtggaaccggcaggaccttctcgtgacgttcaaaaccgctcatgcgaagaagcaggaggtggtcgtgctcggaagccaggagggcgccatgcacaccgccctaaccggggccacggagatccagacctccggaacgaccacgatcttcgcggggcatctgaaatgtcgcctcaagatggacaagctgaccctgaaaggcatgtcatacgtgatgtgcaccggttccttcaagctcgagaaggaagtcgcggaaactcagcatggtacggtattggtgcagatcaaatacgagggcactgatgcaccttgcaagatcccgttcagcacccaggacgagaagggggtcatccagaacggccggctgatcaccgccaacccgatagtgacggacaaagaaaagcctgtgaatatagaggccgagccgcccttcggagagtcctacatcgtcatcggagtgggcgagaaagcactgaagctgagctggtttaagaagggctcctcgataggcaagatgttcgaggccaccgcccgcggtgccaggcgcatggccatcctgggcgacaccgcatgggacttcgggtccatcggcggcgttttcaccagcgtcgggaagctggtgcatcagatctttggcacggcctacggggtcctgttctccggcgtctcctggaccatgaagatcggaattggagtgctgctaacctggctcggcctgaactcccgcagcaccagtctgagcatgacgtgcatcgccgtcgggctcgttaccctgtacctgggcgtgatggtgcaggccgactccgggtgcgtcatcaactggaaaggacgggagctcaagtgcggaagcggcattttcgtcaccaacgaggtgcacacctggacggagcagtataagttccaggccgacagcccgaaacgactgtctgcggccatcggaaaggcctgggaggagggggtctgcggcatccggagcgcaacccgcctggagaacatcatgtggaagcaaatctccaacgagttgaaccatatactgctggagaacgacatgaagtttaccgtggtagtcggggacgtggtaggcatcctcgctcaagggaagaagatgatacggcctcagcccatggagcacaagtatagctggaagtcctggggcaaggcgaagatcatcggcgccgacgtccagaacaccaccttcattatcgacgggccaaacacgccggaatgccccgacgaccagcgcgcctggaacatctgggaggtggaggactacggcttcggtatcttcaccacaaacatttggctgaagctgcgggattcctacacccaagcctgcgaccacagactaatgtccgcggccatcaaggacagcaaggccgtacacgccgacatgggctactggatcgaatcggagaagaatgaaacgtggaaactggctcgggcgagcttcatcgaggtcaagacctgcatctggcccaagtcccacacactgtggagcaacggcgtgctggagagtgagatggtgattcccaagatctacgggggccctattagccagcacaactaccgcccggggtattttacccaaacggccggcccgtggcacctggggaagctggaacttgacttcgacctgtgtgaaggcaccacagtcgtggtggatgagcactgtggcaaccggggtccatccctgcgcaccacgaccgtcaccggcaagatcatccatgagtggtgctgtcgtagctgcaccctgccgccccttcgcttcaagggggaggacggctgttggtacgggatggagatccggcccgtgaaggagaaggaggagaacctggtgaagtccatggtctctgcgggcagcggcgaggtggattctttcagcctgggtcttctgtgcatttccatcatgatcgaggaggtgatgcgcagccggtggagccgcaagatgcttatgacgggcactctggcggtcttcttgcttctgattatggggcagctaacctggaacgacctcatccgactgtgcatcatggtgggcgccaacgcgagcgaccgtatggggatgggcaccacctacctggccttaatggccaccttcaagatgcgcccgatgttcgccgtggggctgctgttcagacgcttaacttcccgcgaggtcctgctgctcaccatcgggctgagcctggttgcctccgttgagctgcccaacagcctggaggagctgggcgatgggcttgcgatgggcatcatgattctgaagctgctcacggacttccagtcccaccagctgtgggccacactgctcagcttgacattcattaagaccacgctgtccctccactacgcctggaagaccatggccatggtgctgagcatcgtgtccctgttccccctctgcctgagcaccacctcccagaagacaacctggctgcccgttcttctgggctctctggggtgcaagccgctaaccatgttcctgatcgcggaaaacaagatttggggccgcaagtcctggccgctgaacgaggggatcatggccgtgggagtggtcagcatcctcctgagctccctgctcaagaatgacgtgcccctggccgggcccctcatcgccggcggcatgctcatcgcctgctacgtgatcagcggcagctcagcggacctgtccctggagaaggctgccgaggtcagctgggaagaggaggccgagcactccggcgccagccataacatcctcgtggaggtacaggacgacgggaccatgaaaataaaggacgaggagcgggacgatactctcacaatcctgctcaaggcgacgctgctggccgtgtccggcgtttacccgctcagcatccccgccaccctgttcgtgtggtacttctggcagaagaagaagcagcgctcaggggtcctgtgggatacccccagcccgcccgaggtagagcgggcagtactggacgatggcatttaccgcatcatgcagcggggcctcctagggaggtctcaggtcggggtgggcgtgttccaggaaaacgtcttccatacgatgtggcacgtgacgcggggcgccgtcctgatgtaccaggggaagcgcttggagcccagctgggcgtcagtcaagaaggatctgatctcctacggtggcggctggcggctacagggctcatggaacaccggggaggaggtccaagtgatcgccgtcgagcccggcaagaaccccaagaacgtgcagaccgcccccgggacgttcaagacccccgagggcgaggttggagccatcgccctcgacttcaagcctgggacgagcgggtcccccatcgtcaaccgcgagggcaagattgtgggcctgtacggcaacggggtggtcacaacgtccggaacctacgttagcgcgatcgcccaggccaaggcctcccaagaggggccgctgcccgagatagaggacgaggtgtttcggaagcgcaacctcaccatcatggacctgcaccccggaagcggaaagacgcggcgctacctgccggcgatagtccgggaggccatcaagcgcaagttgcggacgctgatactggctcccacccgcgtggtggccagtgaaatggccgaggcgctaaagggcatgcccatacgctatcagaccacagccgtcaagtcagaacacacaggcaaggagatcgtagacctcatgtgccacgccaccttcaccatgcggctgctatcacccgtgcgcgtcccgaactacaacatgatcatcatggacgaggcccacttcaccgaccccagctccatcgctgcgcgggggtacatctccactcgcgtaggcatgggggaggccgccgccatcttcatgacggccacgccacccggctccgtggaggctttcccgcagagcaacgccgtcatccaagatgaggaacgggacatcccggagcggtcatggaacagcggctacgaatggatcactgacttccccggcaaaacggtgtggttcgtgccctcaatcaagagcggcaacgacattgccaactgcctgcgtaagaatgggaagcgggtcattcagctgagccggaagaccttcgacaccgagtaccagaaaaccaagaataatgactgggactacgtcgtaacgactgacatcagcgagatgggcgcaaacttccgcgcggaccgggtcatcgatccgcgccggtgcttgaagcccgtcatcttaaaggacgggcccgagagggtcatcctggccggccccatgcctgtaaccgtggccagcgccgcgcagcgccgcgggcggatcggccgcaaccataacaaggagggcgaccagtacatctacatggggcagccgctcaacaacgacgaagaccacgcgcactggacggaggccaagatgcttttggacaacataaacacgcccgaaggcatcatccccgccctctttgagccagagagggagaaatccgcggccatcgacggggagtaccgcctgcgcggcgaagcgcggaagacctttgtcgagttgatgcgccgcggggacctccccgtgtggctgtcctacaaggtcgcctcggagggcttccaatacagcgaccgccggtggtgcttcgacggcgagcgcaacaaccaggtcctggaggagaacatggacgtggagatctggacgaaggagggggaacggaagaagctcaggcctcggtggctggacgcccgcacctactccgatcccctagccttacgggagttcaaggagttcgccgcgggccggcggagcgtgtccggcgatctgatcctggagatcggcaagctcccgcagcatctaacgcagcgcgcccagaacgcgctggacaatctcgtcatgctgcacaatagcgagcagggcgggcgggcctaccgccacgcgatggaggagctgcctgacactatcgagaccctcatgctcctggcgctcattgcagtgctcacagggggggtgacgctgttcttcctctccggccggggcctgggcaagacatcgatcggcctcctctgcgtaatggcgtccagcgtgctgctgtggatggcctccgtggagccacactggatcgcggcatccatcatcctcgagttcttcctaatggtcctgctcatccccgagccggaccgccagcggacgcctcaagacaaccaactggcctacgttgtgatcgggctcctcttcatgatcctgaccgtcgcggccaacgagatgggcctcctcgagaccacgaagaaggacttgggtatcggccatgtggcggtggaaaaccaccaccacgccaccatgttagacgtcgacttacaccccgcctccgcatggaccctgtacgccgtggcgaccacgattatcactccgatgatgcgtcacaccattgagaacaccaccgccaacatctcgctgactgccatcgccaaccaagccgcaatcctaatggggcttgacaaaggctggcctatctcgaaaatggacatcggcgtgccgctgctcgccctgggctgctatagccaggtcaaccctctgaccctaaccgccgccgtgctgatgctggtagcccactacgcaatcatcggaccggggctccaggcaaaagccacccgggaggcccagaagcgcaccgcggccggcatcatgaagaaccccaccgttgacgggatagtggccatcgacctcgatcccgtagtctacgacgccaagttcgagaagcagctggggcagatcatgctcttaatcctttgcacctcccagattctgcttatgcgcacgacctgggccctgtgcgaatcaatcacactcgcgaccggcccattgacgaccctgtgggagggatccccgggcaagttctggaacacgacgatcgcagtgagcatggccaacatcttccgggggtcttacctcgctggcgccggcctagcgttctcgctgatgaagtcactcgggggcgggcgccggggcacgggggcccagggcgagaccctgggcgagaaatggaagcgccaactgaaccagctctccaagagcgagttcaacatctacaagcggtccgggatcatggaggtggaccgcagcgaagcgaaggagggcctaaagcgcggggagacaacccgtcacgccgtctcgaggggcaccgccaagctgagatggttcgtggagcggaacctggtcaagcccgaggggaaggtcatcgacctcggctgcggtcgcggaggctggagctattactgtgccgggctgaagaaggtgacagaggtgaagggatacaccaagggcggtcctgggatggaggagcccatcccgatggccaccaatgggtggaacctggtaaagctccactccggcaaggacgtgttcttcacgccgcccgagaagtgcgacaccttgctgtgcgacatcggagagagctcccccaacccgaccatcgaggaaggccggaccttacgcgtattgaagatggtcgagccctggctgcggggaaaccagttctgcatcaagatcctaaacccctacatgcccagcgttgtggagacgttagagcaaatgcaacgcaagcacggcggcatgctggtgcggaacccactctcccgcaacagcactcacgagatgtactgggttagttgcggtaccggcaacatagtgagcgccgtcaacatgaccagccgaatgctgctgaaccgcttcaccatggcccaccgcaagcccacgtacgagcgggacgtggatctcggggcaggcacccgccatgtggccgtagagcccgaggtggccaacctggacatcatcggccagcggatcgagaacatcaagcacgagcacaagagcacgtggcactacgatgaggacaacccctacaagacgtgggcctaccacgggtcctacgaggtcaagccgagcggctcagcgagctccatggtgaacggggtagtcaaactgctgacgaagccctgggacgttattcccatggtgacccagatcgcgatgaccgatacgacgcccttcggccagcagagagtcttcaaggagaaggtggacacccggaccccgaaggccaagcgcgggaccgcacagatcatggaagtcacggcccggtggctgtggggcttcctctccagaaacaagaagccccggatttgtacccgcgaggagttcacccggaaagtccgcagcaacgccgcgataggcgccgttttcgtagacgagaaccagtggaattccgccaaggaagccgtcgaggacgagcggttctgggacctcgtgcagaaggagcgcgagctgcataagcaggggaagtgcgcaacctgcgtgtacaacatgatgggcaagcgggagaagaagctgggtgaattcggcaaggccaaggggagccgtgccatttggtatatgtggctcggcgcccggttcctagagttcgaggccctgggctttatgaacgaagaccactggttctcgcgcgagaacagcttgtccggggtcgagggcgaaggtctgcacaagctgggctacatcttacgggacatcagcaagatccccggggggaacatgtacgcggacgacacagccggctgggacacccgcatcaccgaagacgacctgcagaacgaggccaagatcaccgatataatggaaccggagcacgccctgcttgccacgtccatcttcaagctgacctaccagaacaaggtggtgcgggtccaacgccccgcgaagaacgggacggtgatggacgtgatcagccgccgggaccagaggggctctgggcaggtcggcacctacggcctgaacacgtttaccaacatggaggcccagctgatccggcagatggagagtgaggggattttcctgccctccgagctggagacacccaacctcgccgaacgcgtgctggactggctggaaaagcacggagtggagcggctcaagcgcatggccatctcgggtgacgactgcgtcgtaaagccgatcgacgaccggtttgccaccgcgctgacggccctgaacgatatgggcaaggttcgtaaggacatcccccagtgggagccctccaagggatggaacgactggcagcaggtccccttctgcagccaccactttcaccagctcatcatgaaggacggccgggaaatcgtggtcccgtgcaggaaccaggacgagctggtcgggcgggcgcgcgtatcccagggggcgggctggtcactgcgggagaccgcttgcctcggcaagagctacgcgcagatgtggcaactgatgtacttccatcgccgggacctgcgcctagccgccaatgccatctgttctgcggtcccagtcgactgggtgcccaccagccggaccacgtggagtatacacgcccaccaccaatggatgaccaccgaggacatgctgtctgtttggaacagagtttggattgaagaaaacccctggatggaggacaaaacccacgtatcaagctggggcgacgttccctacctggggaagcgggaggaccagtggtgcggctccctcatcggcctgacggcccgcgccacctgggcaagcaatattcaggttgcgataaatcaggtgcgtcggctgatcgggaacgagaactacttagattacatgaccagtatgaagcgcttcaagaacgagggcgacccggaaggggccctgtggtga

SEQ ID NO: 24150 - RNA, 9879 nt, synthetic construct
  misc_feature 1..9879: note = derived and/or modified CDS sequence (opt11) from DENV-1__FJ024457__SS-prME
  source 1..9879: mol_type = other RNA
agcgtgaccatgctgctcatgctgatgcccaccgccctggccttccacctcaccacgcggggcggggaaccccacatgatcgtgagtaagcaggagcggggcaaaagcctgctgtttaagacaagcgcaggggtgaacatgtgcaccttaatcgctatggacttgggcgagttatgtgaagacacgatgacttataagtgcccccggataaccgagacggagcccgatgacgtggactgctggtgcaacgccacggatacctgggttacctacgggacctgcagtcagactggcgagcatcgtcgagacaagcggtccgtggccctcgcgccccatgtgggcctggggctagagacccgcacggaaacctggatgagctccgagggcgcttggaaacagatccagcgggtcgaaacgtgggcactcaggcatcccgggttcaccgtgatcgctttattcctagcacatgccatcggcacctcaattacccagaagggaatcatcttcatcctcttaatgctggtgacgccgtccatggccatgcgttgcgtcggcatcggcagccgagacttcgtggagggactgtccggcgccacctgggtggacgtcgtgctggagcacgggtcgtgtgtaacaaccatggccaaggacaagcccacgctggacatcgagctactgaagaccgaggtcaccaatccggccgtgctgcgtaagctctgcatcgaggcgaagatcagcaacaccacgaccgacagtcgatgcccgacacagggcgaggccacccttgtggaggagcaggatgccaactttgtctgccgccgcacgttcgtggacaggggctgggggaacggttgcgggctgttcggcaagggctccttaataacttgtgccaagttcaagtgcgtgaccaagctggaggggaaaatcgtccagtacgagaacctgaagtacagcgtgatcgtgaccgtccacacgggcgaccaacaccaggttgggaacgagtccaccgagcacggcaccactgcaaccatcacgccccaggcgcccacgaccgagatacagctcaccgactacggagccttaactctagactgcagtccccgcacaggcctcgatttcaacgagatggtactgctgaccatgaaggaaaagtcatggctcgtccacaaacaatggtttctcgacctgcccctcccctggaccagcggggcctcgacgtcccaagaaacctggaaccggcaggatctgctggtgacgttcaaaaccgcccacgccaagaagcaggaggtcgtggtgctaggcagccaggagggggcgatgcacacggccctgaccggggcaaccgagatccagacctccggcacaaccaccatcttcgccgggcacttaaagtgccgcctcaagatggacaagctgaccctgaagggcatgagttacgtcatgtgtacggggtccttcaagttagagaaggaggtagccgagacccagcacggcaccgtgctggtccagatcaagtatgagggcaccgacgcgccctgcaagatccccttcagcacgcaggacgagaagggggtcacacagaatggccggctgatcaccgcgaacccgatcgtgaccgacaaggagaagcccgtcaacatagaggccgaaccgccctttggggagtcctacatcgtgatcggcgccggcgagaaagcgctgaagctctcttggttcaagaaggggtccagtatcggcaaaatgttcgaggccacagccaggggggcccgccgcatggctatcctgggcgataccgcgtgggacttcggctccattggtggggtgtttaccagcgtcgggaagttggtgcaccagatctttggcaccgcctacggggtgcttttctccggggtcagctggaccatgaagatcggtatcggtgtgctgctgacatggctcggcctgaattcccgttcaacctccctgagcatgacctgcatcgccgtggggctagtcaccctgtacttaggcgtgatggtgcaggcggactccgggtgtgtcatcaattggaagggccgggagctcaagtgcgggagcggcatcttcgtgaccaacgaagtgcacacctggaccgagcagtacaagtttcaggccgacagcccgaagcgcctgagcgcggccatcggcaaggcatgggaggagggggtctgcggtatacggagcgccacccgcctggagaacatcatgtggaaacagatctccaacgagctcaatcacatcctgctggaaaacgacatgaagttcactgtggtcgtgggggacgtggcaggtatcctcgcgcagggaaagaagatgatccggccccagcccatggaatacaaatatagctggaaatcctggggcaaggccaagataatcggcgccgacgtgcagaataccaccttcatcatagacgggcccaacaccccggaatgcccagacgaccagcgcgcctggaacatatgggaggtcgaggactacggctttgggatattcacgaccaacatctggctgaagttaagggacagctacacccaggtttgcgaccaccgcctcatgtccgcggccatcaaagatagcaaggccgtacatgccgacatgggctactggatcgagtccgagaagaacgagacatggaagctggcacgggcgagcttcatcgaggtcaagacgtgcatctggccgaaatcccacaccttgtggagcaacggggtgcttgaatccgaaatgatcatccccaagatctatgggggcccgatctcgcagcataactaccgccccgggtacttcactcaaaccgccggtccctggcacctggggaagctggagctggacttcgacctgtgtgagggtacgaccgtggtcgtggatgagcactgtggaaaccgggggccgtccctgagaaccaccacggttaccggcaagatcatccacgagtggtgctgccggtcctgcaccctgccgcctctccgcttccgcggggaagacggctgctggtacgggatggagatccgcccagtcaaggaaaaggaggagaacctggtgaagtccatggtgagcgccggctcgggcgaggtcgactccttcagcctcggtctgctgtgcatctccatcatgatcgaggaagtgatgcggagccggtggtcacgaaagatgctcatgactggcacgctggccgttttcttcctgctcatcatggggcaactgacctggaacgacctgatccgcctctgcatcatggtcggcgccaacgcgagcgaccgcatggggatgggcaccacctacctggccctgatggctacgttcaagatgcggccgatgtttgccgttggcctcctgttcaggcgcctgacctcacgtgaggtgctcctgctgaccatcgggttgagcctggtcgcctccgtagagctccctaacagcctcgaggagctgggcgacgggctggcgatgggcatcatgatcttgaagctcctgaccgatttccagagccaccagctctgggccacgctgctgagcttaaccttcatcaagaccaccttctctctgcactacgcctggaagaccatggccatggttctgagcatagtgagcctcttcccactgtgcctcagcaccacctcccagaagaccacgtggctacccgtgctactgggcagcctcgggtgcaaaccgctgaccatgttcctgatcgcggagaacaaaatttggggccggcgctcctggcccttgaacgaggggatcatggccgtcggcatcgttagcatccttctttcttccctccttaagaacgacgtcccactggctggtccactcatcgccggaggaatgctgatcgcatgttatgtcatcagcgggtccagcgcggatctgtccctcgaaaaggccgcggaggtgagctgggaggaggaggctgaacactccggcgctagccacaacatcctggttgaagtccaggacgacggaaccatgaaaattaaggacgaggagcgtgacgacaccctgaccatcctcctgaaggcgacgctgctcgccgtgtccggcgtttacccgctgagcatcccggcaaccctgttcgtctggtacttctggcagaagaagaagcagcgttccggggtgctctgggacacccccagcccgccggaggtggagcgggccgtcctggacgacggaatctaccgcatcatgcagcggggcctgctggggcggtcccaggtgggcgtgggggtattccaagagaacgtgttccacaccatgtggcatgtgacgcgtggcgcagtcctcatgtaccaggggaagcgcctggagcccagctgggcgtccgtgaaaaaggacttaatctcttatggcggcggctggcggcttcaggggtcatggaacaccggggaggaggtgcaggttatagccgtggagccaggcaagaaccctaagaacgtgcagactgcgcccggcaccttcaaaacgcccgaaggtgaggtcggcgcgatcgctctggacttcaaacccggaaccagcggctcccccatcgtgaaccgcgagggaaaaatcgtgggcctttacggcaacggggtcgtgaccaccagcgggacgtacgtgagcgccatcgcccaggccaaggcgtcccaggagggacccctccccgagattgaggacgaggtcttccggaagcgcaacctgactatcatggaccttcaccccggcagcggcaagacacggcgctacctcccggcgatcgtgcgggaggcaatcaaacgcaagctgcgcaccctgatcctcgcacccacgagggtagttgcgagcgagatggcagaggcgctgaagggaatgcccatccgctatcagaccaccgccgtcaagtctgagcacacgggtaaggagatcgtggacctgatgtgccacgccacattcaccatgcggctactgtcccccgtccgtgtccctaactacaacatgattataatggacgaggcccacttcaccgacccaagttccatcgccgcgcgggggtacatcagcacccgcgttggcatgggcgaggccgcggctattttcatgacggccacgccacccggatcggtcgaggcattcccgcagagcaacgccgtgatccaggatgaggagcgggatatccccgagcggtcctggaacagcgggtacgagtggatcacggacttccccggaaagaccgtgtggttcgtcccttccatcaagtcgggcaatgacattgccaactgcctgcgaaagaatgggaagcgcgtgatacagctctccaggaagacattcgacaccgaataccagaaaaccaagaacaacgattgggactacgtggttaccacggacatcagcgagatgggcgccaacttccgcgcggaccgggtaatcgacccccgccggtgcctaaagcccgtgatactgaaagacgggcccgaacgcgtgatcttggccggccccatgccggtcaccgtcgcgtccgccgctcaacggcgcgggcggatcggccgcaatcacaacaaggagggtgaccagtacatctatatggggcagccgttaaacaacgacgaggaccatgcgcattggaccgaggctaagatgctgctcgacaacatcaatacccccgagggcattatacccgccctcttcgaaccggagcgcgaaaagtccgccgcgatcgacggggagtaccggttacgcggcgaggcgcggaagacgttcgtggagctcatgcgccgcggggacctgcccgtgtggttgtcctataaggtcgcctcggaaggcttccagtacagcgaccgccggtggtgcttcgacggcgagaggaacaaccaggtgttggaggagaacatggacgtcgagatctggaccaaggagggggagcgtaagaagttgcgcccccggtggctggacgcacgaacctactccgacccgctggccctgcgagagttcaaggagttcgccgcgggtcgccgcagcgtctcgggggacctgatcttagaaatcggcaagctgccgcagcacctgacccagagggcccagaacgccctcgacaacctggttatgctgcataacagcgagcagggcgggcgggcctatcgccacgcgatggaggagctccccgacacgatcgagaccctcatgctactcgccctgatcgccgtgctcaccggcggggtcaccctctttttcctgagcggccgggggctgggtaaaactagcatcggactcctgtgcgtcatggcctcctctgtgctgctatggatggcatccgtcgagccccactggatcgcggccagcatcatactggaattcttcctgatggtgctcctgatccccgagccggaccgccagcggacgccccaggacaaccagctggcctacgtggtaatcgggctcctgttcatgatcctgacagtggccgccaacgagatgggcctgctggagaccaccaagaaggacctggggatcggccacgtagcggtcgagaaccatcaccacgccgccatgctcgacgtggacctgcaccccgcctcggcctggacgttgtacgcggtggccaccaccataatcaccccgatgatgcgccatacgatcgagaacaccaccgccaacattagcctcaccgccatcgccaaccaagcggccatcctgatggggctagataagggctggcccatctccaagatggacattggcgtccctctcctggcactagggtgttacagccaggtgaaccccctcacgctgacagccgcggtgctgatgctcgtcgcccactacgcaataatcggcccggggttgcaggccaaggcaacacgcgaggcgcaaaaacggaccgccgctggcatcatgaagaaccccacggtggatgggatcgtggccatcgacctggaccccgtcgtctacgacgctaaattcgagaagcagctcggccagataatgctgctcattctctgtacctcccagatcctgttgatgcgcaccacctgggcgctctgcgagagcatcacactggcaaccggccccctcaccaccctttgggagggatccccgggtaagttttggaacacgaccatcgccgttagcatggccaacatcttccgggggtcttacctggccggcgcgggactggccttcagcctcatgaagagtctcgggggtgggcgccgggggacgggggcccagggcgaaaccctgggggagaagtggaaacgccagctcaaccagctgtccaagagcgagttcaacacctacaaacggtccggtatcatggaagtcgacagatccgaggccaaggagggcctgaagcgcggggagaccactaaacacgcggtgtcccgcggaaccgctaagctccggtggttcgtggagcgcaacctggttaagcccgaggggaaggtcatcgacttaggatgcggccgagggggctggagctactactgcgccgggctgaagaaggtgactgaggtcaagggctacaccaagggcggccccgggcacgaggagcccatcccgatggcgacctacgggtggaatctcgtgaagctgcactccggcaaggacgtgtttttcatcccacccgagaagtgcgacaccctgctctgcgacatcggggagtcctccccaaacccgacaatcgaggagggccgcaccctgcgggtccttaagatggtggagccctggcttcgcgggaatcagttctgcatcaaaatcctcaacccctacatgccctcggtggtagagaccctggagcagatgcagcgcaagcacggcggcatgttagtgaggaacccgctttcccggaacagcacacacgagatgtactgggtgtcgtgcggaaccggcaacatagtaagcgccgtgaacatgacctcccgcatgttactcaaccgcttcaccatggcgcaccgcaagcctacctacgaacgcgatgtggacctgggggctggcactcggcacgttgccgtggagcccgaggtggccaaccttgacatcatcggccagcgcatcgagaacatcaagcacgagcacaagagcacgtggcactacgacgaggacaacccttacaagacatgggcataccatgggtcctatgaagtcaagccgagcggttccgcgagcagcatggtgaacggggtcgtgaagctcctgaccaaaccctgggatgttatccccatggtcacccagatcgccatgacggacaccaccccctttgggcagcaacgggtgttcaaagagaaggttgacacccgcacaccgaaggccaagcggggtactgcccaaatcatggaagtcaccgccaagtggctgtggggcttcttatcccgcaacaagaagcctcggatatgcacccgcgaggagttcactcggaaggtgcgcagcaatgcggccatcggcgctgtgttcgtcgacgagaaccagtggaacagcgccaaggaggccgtggaggatgagcggttttgggatctggtacaccgcgagcgggagctgcataagcaggggaagtgcgcgacctgcgtctacaacatgatgggcaagcgcgagaagaagctcggtgagttcggcaaggctaaggggagccgggccatctggtacatgtggcttggcgcccggtttctggagttcgaggccctcggcttcatgaacgaggatcactggttctcacgggagaactccctgtccggcgtagaaggagaagggctccacaagctcggatacatcctgcgcgacatcagcaagatacccggaggcaacatgtacgccgacgataccgccggctgggacacccggatcacggaagacgacctgcagaatgaggcccgcatcaccgacatcatggaaccggagcacgccctcctggcgcgctccatcttcaagctcacctaccagaacaaagttgtcagggtgcagcgccccgccaagaacgggaccgtgatggacgtcataagtcggcgagaccagcggggctccggccaggttgggacgtacggcctcaacaccttcaccaacatggaggctcagctgatccgccagatggagagcgaggggatattttcaccctcagaactggagactcccatcctcgcggagcgcgtgcttgactggctggagaaatacggagtcgagcgcctcaaacggatggccatctctggggacgattgtgtggttaagcccatcgacgaccggtttgcgaccgcactgaccgccctcaacgacatgggcaaggtccgtaaggacatcccccagtgggagcccagcaagggctggaacgactggcaacaggtccccttctgctcccaccacttccaccagctcatcatgaaggacggccgcgagatagtcgtcccgtgccggaaccaggacgagctggtgggccgcgcccgggtcagtcagggcgccgggtggagcctgcgcgagaccgcgtgcctcgggaagagttacgcccagatgtggcagctgatgtacttccaccggcgcgacctgcggctcgccgccaatgcgatttgcagcgccgtccccgtggattggatccccaccagtcgcacaacgtggagcatccacgcccatcatcagtggatgacgaccgaagacatgctatccgtgtggaaccgcgtctggatcgaggagaatccctggatggaggacaagacgcacatcagctcctggggcgatgtaccgtatctggggaagagagaagaccagtggtgcggcagcctcattggcctgaccgcgcgggccacatgggcgacaaacatccaggttgccatcaatcaggtacggcgcctgatcgggaacgagaactaccttgactacatgacctccatgaagcggttcaagaacgagagcgaccccgagggcgccctgtggtga

SEQ ID NO: 24151 - RNA, 9879 nt, synthetic construct
  misc_feature 1..9879: note = derived and/or modified CDS sequence (opt11) from DENV-1__FJ205881__SS-prME
  source 1..9879: mol_type = other RNA
agtgtgacgatgctgttgctgctaatgcccaccgccctagcgttccacctgaccacccggggcggggagccccacatgatcgtttctaagcaggaacggggcaagtctctcctgttcaagacgtcggcaggggttaacatgtgcacactgatcgccatggacttaggcgagctttgcgaggataccatgacctacaagtgcccccgcatcacagagaccgagcccgatgacgtggactgctggtgcaacgccaccgacacctgggtcacctacgggacgtgcagccagacaggtgagcacaggcgggataagcggtccgtcgctctagcgccccacgtgggtctggggctcgagacccgtaccgagacctggatgtctagcgagggcgcctggaagcagatacagcgggtcgagacgtgggcattacggcaccccgggttcaccgtgatcgccctgttcctcgcccacgcgatcgggaccagcattacccagaaggggatcatcttcatactgcttatgctcgtgacgccttccatggcaatgcggtgcgtaggcatcggcagccgggacttcgtggagggcctgagcggtgccacctgggtggacgtcgtgttggagcacgggagttgcgtgactaccatggctaaggataagcccaccctcgacatcgagctgttaaagacagaggtcaccaaccccgccgtactccgtaagctgtgcatcgaggcgaagatctcaaataccactacggacagccgctgccccacgcagggggaggccacgctcgttgaggagcaggatgccaacttcgtctgtcggcgcactttcgtggatcggggctgggggaacggctgcggtctgtttggaaaggggtccctgattacgtgcgccaaattcaaatgcgtgactaaactggagggcaagatcgtccagtatgagaaccttaagtacagcgttatcgtgaccgtccatacgggggaccagcatcaggttgggaacgagagtactgaacacggtacaaccgccaccattacgccccaggcgcccaccaccgaaatccaactgaccgactacggggccttaacgctcgactgctcgccccgcaccggccttgacttcaacgaaatggttctgctaaccatgaaggagaagtcttggctggttcacaagcagtggttcctggacctcccactgccctggaccagcggggcaagcacgtcccaggaaacgtggaatagacaggatcttctcgtgaccttcaagacagcccacgcgaagaagcaggaggtcgtggtgctgggtagccaggagggcgcgatgcacacggccctaaccggggccacggagatccagacatccgggacgacaaccatattcgccgggcacctcaagtgcaggctgaagatggacaagctgaccctcaagggaatgagctacgtcatgtgtacggggtccttcaagctggaaaaggagctggccgagacccagcacgggaccgtgctagttcagatcaagtacgagggtaccgatgctccctgcaaaattccctttagcacacaggacgagaagggggtcacacagaacggccggctcatcaccgccaacccgatcgtgaccgacaaggagaagcccgtgaacatcgaggccgagccccccttcggggagtcctacatcgtcataggcgccggcgagaaggcgctgaagctgtcctggttcaagaaagggtccagcatcggtaagatgttcgaggccacggcgcgtggggccaggaggatggccatactcggcgacaccgcgtgggactttgggtccattggcggtgtgttcacgagcgtgggtaagctagtccatcagatctttggcaccgcctacggggtactgttctccggcgtatcctggacgatgaagatcggtatcggggtcctcctgacctggcttggactcaattcccgctcgacctcgttgagcatgacctgcatcgccgttggcctggtaacactctacctgggcgtcatggtgcaggccgatagtggctgcgtgatcaactggaagggccgggagctgaagtgtggaagcggcatcttcgtcaccaacgaggtgcacacctggaccgagcagtacaagttccaagccgacagccctaagaggctctccgcggccataggcaaggcctgggaggaaggagtttgcggcatccggagcgccacccgcctggaaaacataatgtggaagcagatctccaacgagctgaatcacatactcctggagaacgacatgaagttcacggtcgtagtaggggacgtcgcaggcatcttagcgcaagggaagaaaatgattcggcctcagcccatggagtacaagtacagctggaagtcctggggcaaggccaaaatcatcggcgctgacgtccagaacacgaccttcatcatagacgggcccaacaccccggagtgccccgacgaccagcgtgcctggaacatctgggaggtggaagactacggcttcgggatcttcacgaccaacatctggctcaagcttcgcgactcatacacccaggtctgcgaccaccgcttaatgtccgcggccatcaaggacagcaaggcggttcacgccgacatgggctactggatcgagtccgagaagaacgagacctggaagctcgcaagagcgagtttcattgaagttaagacgtgcatttggcccaaatcccacaccctgtggagtaacggcgtgctggagtccgagatgatcatacccaagatctatgggggcccgatctcacagcacaactaccgccctgggtatttcacccaaaccgctggaccctggcacttgggaaagctggagctggatttcgatctctgcgagggcacgaccgtggtggtagatgagcattgcgggaaccgcgggccgtcattacgcaccaccacggtgactggcaaaatcatccacgagtggtgctgccggagctgcaccctaccgccgttgcggttcagaggggaagacggctgttggtacgggatggagatacgccccgtgaaggaaaaggaagagaacctggtaaaatccatggtcagcgccggcagcggggaagtagactccttttcgctcgggctcttgtgtatcagcatcatgatcgaagaggtcatgcggagtcgctggtcccggaaaatgctgatgacgggcacgcttgccgtgttcttcctgttaatcatggggcagctgacgtggaacgacctgatccgcctgtgcattatggtgggcgccaacgcgagcgatcgaatggggatgggcaccacctacctcgccctgatggcgaccttcaagatgcggcctatgttcgccgtcggcttactcttccgacggctgacctccagagaggtccttctcctgaccatcgggctgagtctcgtggccagtgtcgaactccccaacagcctggaggagctcggggatgggctggcgatgggcatcatgatcttaaagctcctgaccgacttccaaagccaccagctgtgggccacgttactgagcctgaccttcattaagaccaccttctcgctccactacgcctggaagacgatggccatggtcctgagcatcgtctccctgtttcccctctgcctgtcgaccacctcccaaaagaccacgtggctgccggtgttgctcggcagcctagggtgcaagccgctcaccatgttcctgatcgcggagaacaaaatctggggacggcgttcctggcccctaaacgaagggattatggcagtgggcatcgtcagcattctcctgagttcgctccttaaaaacgacgtgcccctggccggccccctgattgccggcggcatgctcatcgcctgctacgttatctcagggtcctctgcggacctctccttagagaaggccgccgaggtaagctgggaggaggaggccgagcacagcggcgcgagtcacaacatcctcgtggaggttcaggacgacggtaccatgaagatcaaggacgaggagcgggacgacaccctgaccatcctgctcaaggcgacgctgctcgccgtctccggcgtgtacccgctctctatccccgccacattatttgtgtggtacttctggcaaaagaagaaacagcgctccggtgtcctgtgggatacccccagtccgcccgaggtcgagcgggcagtgctggacgacggcatctaccgcatcatgcagcggggcttgctggggcgctcccaagtcggagtgggtgtgtttcaggagaacgtgtttcacacaatgtggcacgtgacgcggggcgccgtgctgatgtaccaaggcaagcgcctcgagcccagctgggcgtccgtcaagaaggacctgatcagctacggcggcgggtggcggctgcagggctcttggaataccggagaagaggtccaagtgatcgccgtcgagcctggcaagaaccccaaaaacgtgcagaccgcccccggaaccttcaagacgcccgagggcgaggttggcgccatcgccctcgacttcaagccaggcacgagcggctcccccatcgtcaaccgcgaggggaagatcgtcggcctctatggcaatggggtggtcacgaccagcggcacatacgtttccgcgatcgcccaagccaagacctcccaggaggggccgctgcccgaaatcgaggacgaagtgttccggaagcgtaatctcacgatcatggatctgcatcccggcagcgggaagactagaagatacctgccggccatcgtccgggaggcgatcaagcgcaagcttcgcacgttgatcctggcccccacccgagtcgtggcctctgagatggccgaagcgttaaagggcatgccgatccgatatcaaaccaccgcggtcaagagcgagcacacggggaaggagatcgtagacctgatgtgccacgccacctttaccatgaggctgctctcccccgtacgcgtcccgaactataacatgatcatcatggatgaggcccacttcaccgaccccagctccatcgccgcccgggggtacatctccacgcgcgtgggcatgggtgaggcggcagcgattttcatgaccgccacgcctcccggcagcgtggaggccttcccgcaaagcaatgcggtcatacaggatgaagagcgggacatacccgagcgcagttggaacagcgggtacgagtggataacagacttccccggcaagacggtgtggttcgttccgtcaatcaagtctggcaacgacatcgctaattgcctgcggaagaatgggaagcgcgtcatccagctttcaagaaagaccttcgacaccgaataccagaagaccaaaaacaacgattgggactatgtcgtgaccaccgacatcagcgaaatgggcgccaactttcgcgccgaccgggttatcgacccgcgccggtgcttaaagcctgtgatcttaaaggacgggcccgagcgcgtaatcctggcgggccccatgcctgtcaccgtcgcctccgccgcccaacggcgcggccgaatcggccgcaaccacaacaaggagggcgatcagtatatctacatggggcagcccctcaacaatgacgaggaccacgctcactggacggaagctaagatgctgctggacaatatcaatacgcccgaggggatcatacccgcccttttcgaaccagagagggagaaatccgcggcgatcgacggggagtaccggcttagaggcgaggccaggaagaccttcgtcgagctgatgcgccgcggggaccttcccgtttggctgtcctacaaggtggcgagcgagggctttcagtacagcgaccgccggtggtgcttcgacggcgagcgcaacaaccaagtcctggaagaaaacatggacgttgagatctggaccaaggagggggagcggaagaagctgcgcccgcgttggctggatgcccgcacctactctgaccccctggccctacgggagttcaaggagttcgcagctggccgccggagcgtgtccggggacctgatcttagagattggcaaactcccgcagcacctgacgcagcgcgcgcaaaacgccctggacaacttggtcatgctgcacaacagtgagcagggaggtagggcctaccgccacgcgatggaggagctgcccgataccatcgagaccctcatgctactggcgctcatagccgtgctcaccggcggggttaccctgttcttcctatcagggcgggggttgggaaaaacttctatcggactgctatgcgtcatggcatccagcgtcctgctgtggatggcatccgtggaaccccactggatcgccgcgagtatcatccttgagttcttcctcatggtattgctcatccccgagcccgaccgccagcggacgccccaggacaaccaactggcctacgtggtgatcgggctcctcttcatgatcctgaccgtcgccgccaacgaaatgggcttactcgaaaccacgaagaaggacctggggatcggccacgtagccgttgagaaccatcaccacgcggccatgctggacgtggacctccaccccgcctccgcgtggaccctgtacgccgtcgctaccactattatcacaccgatgatgcggcacaccatcgagaataccacggcgaatatcagcctgacggccatcgccaatcaagccgcgatcctcatggggttagacaagggctggccgatctccaagatggatattggcgtgcccctgttggccctgggttgctacagccaagtcaatcccctcaccctaaccgcagctgtcctgatgctggttgcgcactacgccataatcggccccgggctccaggccaaggccacccgcgaagcacagaagcggaccgccgcgggcatcatgaaaaaccccaccgtcgacggtatcgtggccatcgacctggaccccgtggtgtacgacgccaagtttgagaagcagcttggacaaatcatgctcctgatcctgtgtacctctcagatcctcctgatgcgcactacgtgggccctgtgcgaaagcatcacactcgcaactggccccctgaccacgctgtgggaagggtctcccggaaaattctggaacaccacgatcgccgtcagcatggctaatatcttccgcggttcctacctcgcgggcgccggcttagcgttcagcctgatgaagagtctcggtggcgggcggcggggaaccggggctcagggggagacgttaggcgagaagtggaagcgccagttaaaccagctatcgaagtctgagttcaacacctataagcggtcggggatcatggaggttgaccgctcggaagcgaaggaggggctgaaacgcggggagaccacgaagcacgccgtctcccgcggtacggcgaagctgcggtggttcgtggaacgcaacctggtgaaaccggaggggaaagtcattgacctcggctgcggccgcggcggatggtcctactattgcgccgggttaaagaaggtaacggaggtgaaggggtacaccaagggcggccccggccacgaagaaccgatccctatggccacgtacgggtggaacctggttaagctccactccggcaaggacgtgttcttcataccgcctgagaagtgcgatactctgttgtgcgacatcggggagtcctcccccaacccgaccatcgaagaaggcagaaccctccgagtgcttaagatggtcgagccctggctgcgaggcaaccaattctgcatcaagatcttaaacccctacatgcccagcgtggtcgagaccctggagcagatgcagaggaagcacggcggcatgctggtccgcaacccgctctcccgaaatagcacccatgaaatgtactgggtgtcatgcgggacgggcaatatcgtgagcgcagtgaacatgacctcccgcatgctgctgaacaggttcactatggcccaccggaagcccacctacgagcgcgacgtggatctcggggcgggcacaaggcacgtggccgtcgagccggaggtggccaacctggacatcatcggccagcgcatagagaacatcaagcacgagcacaaaagcacctggcactatgacgaggacaacccctataagacctgggcttatcacgggtcctacgaggtgaagccgagcggctccgcctcttcgatggtcaatggggtggtcaagcttctcacaaagccctgggacgtcatcccaatggtgacgcagatcgcgatgaccgataccactccgttcggacaacagcgggtctttaaggagaaagtggacacgcgcaccccgaaagccaagcgtgggacggcacagataatggaggtgaccgccaaatggctgtgggggtttctatcccgcaacaagaagccccggatttgcacgcgcgaggagttcactcggaaggtccgctctaacgccgcgatcggcgccgtgttcgtggacgagaaccagtggaattccgccaaagaggccgtcgaggacgagcggttctgggatctcgtacatcgggaacgggagttacacaagcagggaaagtgcgctacctgcgtgtacaacatgatgggcaagcgtgagaagaagttgggggagttcggcaaggccaaggggagccgagccatctggtacatgtggctcggcgcccgcttcctggagttcgaggccctgggcttcatgaatgaggaccactggttttcccgggagaacagtctatccggggtcgaaggcgaagggctgcacaagctgggctacatcctccgcgacatcagtaagatccccggcggcaacatgtacgcggacgataccgcagggtgggacacgcggatcaccgaagacgacctccagaacgaggcccgaatcaccgacataatggagccggaacacgccctgctcgccaagtccatcttcaagttgacctatcagaacaaagtcgtacgcgtccagcggcccgcgaaaaacgggacggtcatggacgtgatatcgcgccgggaccagcgcggctccgggcaggtcggcacctacggcctaaataccttcaccaacatggaggcccagctcatccggcagatggagagcgaggggatcttttcccccagcgagcttgagactcctaacctggccgaacgcgtactcgactggctggagaagtatggcgtggagcggctcaaacgcatggccatatccggagacgactgcgtagttaaaccgatcgacgacagattcgccaccgcgctcaccgccctgaacgacatgggcaaggttagaaaggacatcccccagtgggagcccagcaagggctggaacgactggcagcaggtccccttctgctcacaccacttccaccagctaatcatgaaagacggccgggagatcgtggtgccttgcagaaaccaagacgagctcgtcggccgtgcgcgcgtgtcacaaggggccggctggagcctgcgggaaaccgcctgtctggggaagtcctacgcgcaaatgtggcagttaatgtattttcaccgccgggacctgcgccttgccgcaaacgcaatctgcagcgcggtgcccgtcgactggatccccacgagccggaccacgtggagcatccacgctcaccaccagtggatgacaacggaggacatgttatcggtgtggaacagagtctggatcgaggaaaacccctggatggaggacaagacccacatctcaagctggggcgacgtgccgtacctgggtaagcgcgaggaccagtggtgcggtagcctgatcggactcacggcccgggccacttgggcgaccaatatacaggttgcgatcaaccaggtgcgccggctgatcgggaacgagaactacctggattacatgacgtcaatgaagcgcttcaagaacgaaagcgaccccgagggcgccttatggtga

SEQ ID NO: 24152 - RNA, 9879 nt, synthetic construct
  misc_feature 1..9879: note = derived and/or modified CDS sequence (opt11) from DENV-1__FJ205882__SS-prME
  source 1..9879: mol_type = other RNA
agcgtcaccatgctactcatgctgatgcccacggccctagctttccacctgactacacggggtggggaaccccacatgatcgtgagcaagcaggaacggggcaagtctctgcttttcaagacaagcgcgggcgtgaacatgtgcactttaatcgccatggacctgggcgaactatgcgaagacactatgacctacaagtgcccgcgcataaccgaggccgagcccgacgacgtggactgctggtgcaacgccaccgatacatgggtaacctatggaacctgttcacagactggtgagcaccgccgcgacaagagaagtgtggccctcgcaccccatgttggcttagggcttgagacgcgcaccgagacctggatgagctcggagggcgcctggaagcagatccagagggttgagacgtgggcactgcgccaccccgggttcaccgttatcgccctgttcttagcgcatgcgatcggcactagcatcacccagaaagggatcatcttcatcctcctgatgttggtgaccccctccatggccatgcgctgcgtcggcatcggctcacgcgacttcgtggaggggttgtcgggcgccacatgggtggatgtcgtgctggaacatgggagctgtgtgacaaccatggcaaaagacaagcccacgctggacatagaactcctaaagaccgaggtcaccaaccctgcggtgctgaggaagctctgcatcgaggcgaagatttccaataccactacggatagtcgctgtcccacgcagggcgaggcgaccctagtggaagaacaggacgccaattttgtctgtcggcgcaccttcgtggaccgaggctgggggaacggctgtggcctgttcggcaaggggagtctcatcacgtgcgctaagtttaagtgcgtaaccaagttagagggcaagatcgttcagtacgagaacctgaagtactcagtaatcgtgaccgtacacactggagatcagcaccaggttgggaacgagtccactgaacacggcaccaccgcgaccatcacgccccaggcccccagtacggagatacagctcaccgattacggggccctgaccttagattgcagtccacggacgggactagactttaacgaaatggtcctgctgacgatgaaggagaagtcctggctcgtgcacaaacagtggttcttagacttacccctcccttggacgagcggggcgtcaactagccaggagacatggaaccggcaggacctactggtgacgtttaaaaccgcccacgccaagaagcaggaggttgtggtgctcggcagccaggagggagccatgcacaccgctttaacgggggccaccgaaatccagacgtccggcacgacgacgatcttcgctggtcacttgaagtgcagactcaaaatggacaaacttacgctgaagggcatgtcctacgtaatgtgtaccgggagcttcaagctcgagaaagaggtggcggagacccagcacggcacggtcctagtacagatcaagtacgagggcactgacgccccctgcaagatccctttttccactcaagacgagaagggtgtaacgcagaacggccggcttatcacggccaaccccatcgtgaccgacaaggagaagcctgtcaacatcgaggccgaaccgcccttcggggaaagctatatcgtgatcggcgctggcgagaaggccctgaagctctcctggttcaaaaagggcagctcaataggcaagatgttcgaggcaaccgcccgtggggcaaggcgcatggcgattctcggggacactgcgtgggattttgggagcatcgggggcgttttcacgtcggtcgggaagctcgtacaccagatattcgggaccgcctatggggtgctgttctccggcgtatcctggaccatgaagattgggatcggcgtactgctgacctggctcggcctgaacagccgctccacgagcctgtcgatgacttgcattgccgtaggcctcgtcacactgtaccttggcgtgatggttcaggccgacagcggctgcgtcatcaactggaagggacgggagctaaaatgtgggtctggcatattcgtcacgaatgaggtgcacacgtggaccgagcaatataagttccaggcggattccccgaaacgactcagcgcagccattggcaaggcctgggacgagggggtctgcggcattcggagtgccacgcgcctagagaatatcatgtggaaacagatctctaacgagctcaaccatattctattggagaacgacatgaagtttaccgttgtggtcggagacgtggcgggtatcctcgctcaggggaaaaagatgatacggccccaaccaatggagtataagtattcctggaagtcctggggcaaagccaaaataatcggcgccgacgtgcagaacaccactttcattatcgacgggcctaacacccctgagtgcccggacgaccaacgtgcgtggaacatatggaaagttgaggaccatggctttggaatcttccccaccaatatctggctgaagctgcgggactcttacacccaggtttgcgaccaccgcctcatgagcgctgctatcaaggattccaaagccgtgcacgccgacatgggctactggatagaaagcgaaaagaacgagacgtggaaactcgcccgagcctccttcatcgaggtcaaaacctgtatctggcccaaaagccacactctgtggtccaacggagtgctcgaaagcgagatgatcataccgaagatctacggagggcctatatcccagcacaattatcgccctgggtattttactcagacggctggcccttggcacctggggaagctggagctcgactttaacctatgcgagggtaccaccgtcgtggtggacgagcactgcggcaaccgggggcccagcctgcgcaccacgacggtgaccggtaaaatcatccacgagtggtgttgccgtagctgcaccttaccgcccctccgcttcaagggggaggacgggtgctggtatgggatggagatccgtccagtgaaggagaaggaggaaaacctggtcaaaagcatggtctccgcaggttccggggaggtcgatagcttcagcctcggactgctgtgcatcagcatcatgatagaggaagtgatgcgctcccggtggagccgcaaaatgctcatgacaggcacactggcggtgttcttcctgctaatcatgggacagttaacttggaacgacctgatccggctctgtatcatggtcggtgcgaatgcaagtgaccgcatggggatgggcacaacgtacctggcgctaatggccaccttcaaaatgcgcccgatgctggccgtggggttactgttccggcggctgacgtccagggaggtgttgctgcttacgattgggttgtccctcgtcgctagcgtggagctgcccaactccttagaagaattaggcgacgggctcgccatgggtatcatgatcctgaaactgctcacggacttccagtcccaccagctatgggctacgttactctccctgactttcatcaagaccacgtattctttgcactatgcatggaaaaccatggcgatggtgttatccatagtgagcctgttccctttatgcctatccacgaccagccaaaagacgacttggctgcctgtgttgctcggctccctggggtgcaagcccttaacaatgttcctaatcgccgagaataagatctggggccgaaagtcctggcctctgaatgaggggatcatggccgtaggcatcgtcagcatcctgctctcctcactgctgaaaaacgacgtccctttagccggaccgttaatcgccggaggcatgctaatcgcgtgctacgtcatctccgggagctccgccgacctctccctggagaaagcagcagaggtgtcctgggaggaggaggcggaacatagcggcgcgtcccacaacatcctagtagaggtccaagacgacggtaccatgaagattaaggacgaggagcgggacgacacgcttacaatcttactgaaagccaccttactcgccgtaagcggcgtgtaccctctatcaatccccgcaaccctttttgtctggtacttctggcagaagaagaagcaacgcagcggggtgctgtgggacaccccctcgccgcccgaggttgagcgggccgtcctggacgacggcatttaccgcatcatgcaacggggcctgctgggacgctctcaagtgggtgtgggggtttttcaggagaacgtgttccacacaatgtggcatgtaacccggggcgcggtcctaatgtaccaggggaagcgcctggagccctcctgggcaagcgtgaagaaggacctgatatcctacggcggcgggtggcggcttcagggtagctggaacaccggggaagaggttcaagtcatcgccgtggaaccgggcaaaaacccgaagaacgtacagaccgcacccggcacgttcaagacttccgagggcgaggtcggcgccatcgcgctcgacttcaagccaggcaccagcggttcacctatcgtgaatcgtgaagggaagatagtgggcctctacggaaatggcgtcgtgaccacgtccggcacatacgtatcggccatcgcccaggcaaaagcgtcccaggagggcccgctcccagagatcgaaaatgaagtttttcggaaacgcaacctgaccatcatggatcttcacccgggtagcggcaagacccgccgctacctgccggctatcgtgcgggaggccataaagcgcaaactgcggacgctcatcctcgcccccacccgggtagtcgcttccgagatggccgaggcgctaaaagggatgcctatccgctaccagaccaccgctgtcaagagcgagcacactggcaaggagatcgtggacctcatgtgtcacgcaaccttcaccatgcggcttctgtcccccgtccgcgttccgaactacaacatgatcataatggacgaagcccactttaccgatcccagctccattgcggcgcgggggtacatttctacgcgcgtgggcatgggggaggctgccgccattttcatgaccgcgacaccgcccggatccgtagaggccttcccgcaatctaacgccgttatccaggacgaggaacgggacatccccgagcgctcttggaacagcggatacgagtggattaccgatttccccggtaagaccgtgtggttcgtcccgtccatcaagagcgggaacgacattgccaattgccttcgtaagaacggaaagagggtgatccagttatcccggaagaccttcgatacagaataccagaagaccaaaaacaacgactgggactacgtggtaacaacggacatctccgagatgggcgctaatttccgcgcagacagagtgatcgacccgcgccggtgcctgaagcctgtgattctcaaagatggacccgaacgcgtaatcctggccggccctatgccggtgaccgttgcttccgccgcacagcggcgcgggaggattggccgcaatcacaataaggagggcgaccagtacatatacatgggccagccactaaataatgacgaagatcacgcacactggacggaggcgaaaatgctcctggacaacattaacacacccgagggcatcatcccagccctgttcgagccggagcgcgagaagtcggccgcgatcgacggggagtaccgcctccgcggcgaggctcgcaagacctttgtggaactgatgcgccgaggggacctgcccgtctggctcagctacaaggtcgcgtcggagggcttccagtactccgacaggcgatggtgcttcgatggcgagcgcaataaccaggtcctggaagagaacatggacgttgagatctggacaaaggagggagaacggaagaagctgcgaccaaggtggctcgacgcccgcacgtactcggaccctctggccctacgtgagttcaaggagttcgcggccggccgcaagagcgtctctggggatctcatcctggagatcggtaagctgccccagcacctgacgcagcgggcccagaacgctctggacaaccttgtaatgctccataacagcgagcagggagggcgcgcgtaccggcacgcgatggaggaacttcctgacaccatcgaaaccctgatgctcctggccctgatagctgttctcactggcggggtcacgctattctttctgtcgggtcgcgggttaggaaagacctccataggcttgctttgcgttatggcgtcatcggtgctcctgtggatggcctcggtcgagccacattggattgccgccagcatcatcctggagttcttcctcatggtgctgttgatacccgagccggaccgccagcgcacgccacaagataatcagctcgcctatgtggtgatcggactgctgttcatgatcttgaccgtggccgcgaatgagatgggcttgttggaaaccaccaagaaggacttagggattggccacgtggcggtcgaaaaccaccatcacgctgccatgctggatgtagacctgcaccctgcctccgcgtggactctctacgccgtggcgaccactatcataacacccatgatgcgccacacgatagagaataccaccgccaacatcagcctgacagccatcgctaaccaggccgcaatccttatgggactcgataaaggctggccgatttccaaaatggacatcggggtacccctgctcgcccttggctgttatagccaggtgaaccccctgaccctgaccgcggccgtgcttatgctcgttgcccattatgccatcatcgggccagggctgcaggctaaggcaacccgcgaggcgcaaaaacggacggccgccggcatcatgaaaaatcccaccgtggatgggatagtggcgatcgacctagatcccgtagtgtacgacgcgaagttcgagaagcagctcggccagatcatgctgctcatcctgtgcacttcccagatcctgctcatgcgcacaacgtgggccctgtgcgagagcatcacactggccaccggccccctcaccaccctgtgggaagggtccccgggtaaattttggaacacgacgattgccgtgagcatggctaacatctttcgagggtcatacctggcgggcgcgggccttgctttttcgttgatgaaatccttaggtgggggacgacgcgggacgggggcccaaggcgagacgctcggagaaaagtggaagcgacagctgaatcagctgtccaaaagcgagttcaacacctataagcgttccggtattatggaggtggaccggagtgaggccaaggagggcttaaaacgaggggagaccaccaaacacgcggtgagtagaggtacagcgaagttacgctggttcgtggaaagaaacctagtaaagcccgaaggcaaagtgatcgacctgggatgcggacgcggcggctggtcatactactgcgccgggctaaagaaggtgaccgaagtcaagggctacacaaagggagggcccgggcatgaggagcccataccgatggccacttacgggtggaaccttgtaaaactacactccggcaaggatgtattcttcatcccgccagagaaatgcgacacgttactgtgcgacataggggagtcatcccccaatcccaccatcgaggaaggccgtaccctgcgcgtgctcaagatggtcgagccctggctgcggggtaaccagttctgtatcaagatcctgaacccctacatgccaagtgtagtcgagacactcgagcagatgcagcgcaagcacggcggcatgttagtacgaaacccgctgtcccgcaacagtacccacgagatgtattgggtgtcctgcgggaccggtaacatcgtcagcgcggtaaatatgacctcacgcatgttgctgaaccgctttaccatggctcaccggaaacccacctacgagagagacgtggacctgggagccggcacgcgccatgtcgcggtagagcccgaggtggcgaacttagacataatcggccagcggatcgagaacattaagcacgagcataagagcacttggcattacgatgaggacaacccttacaagacatgggcataccacggttcctacgaggtgaagccgagcggcagcgcgtccagtatggttaacggggtcgttaagctgctgacgaagccctgggatgtgataccgatggtcacgcagatcgcgatgaccgataccaccccatttggccaacagcgcgtctttaaggagaaggtggacactcggaccccgaaggccaagcgcgggaccgcccagatcatggaagtgaccgcaaagtggttatggggctttctgtccagaaacaagaaaccccgcatctgcacgcgcgaggagtttacgaggaaggtgcggtccaacgccgccatcggcgcggtgtttgtggatgagaatcaatggaactccgccaaagaagccgtagaggatgagaggttttgggacctggtccaccgggagagggagctccacaagcaagggaagtgcgctacgtgcgtatataacatgatgggcaagcgggagaagaagctgggggagttcggaaaggccaaggggagccgcgcgatctggtatatgtggttaggcgcgcggttcttggagttcgaggcgctaggttttatgaatgaggatcattggttctcaagggaaaatagtttatccggggtggagggcgaggggttacataagttgggttacatcctacgggatatcagtaagatccctgggggcaacatgtacgcggacgacaccgccggatgggatacccgcataaccgaggacgatctccaaaacgaggccaagatcaccgacatcatggagccagaacacgcgctactggccaagagcatcttcaagctaacctaccagaacaaggtggtccgggtgcagaggccagctaagaatggaacggtgatggatgtcatcagccggcgcgaccagagaggctctggccaggtggggacctacggtttgaacaccttcaccaacatggaggcacaactgatccggcagatggagagcgaggggattttctccccatcagagctcgaaacgccaaacctggccggccgcgtcctggactggctcgaaaagcacggggtggagcggctgaagcgcatggccatctccggagacgattgcgtggtgaaaccaatcgacgaccggttcgcaaccgctctaaccgccctgaacgatatggggaaagtccgcaaggacatccctcagtgggagcccagcaagggctggaacgactggcagcaggtcccattctgcagccatcacttccatcagttgatcatgaaggacggccgtgagatagtcgtaccatgccgaaatcaggatgagctcgtgggacgcgcccgcgtgtcccagggcgcggggtggtccctgagagagaccgcctgtctgggcaagagctacgctcagatgtggcaactgatgtacttccacaggcgggatctgagactggccgcgaatgccatctgttccgccgtaccggtggactgggttcccacgtctcggacgacttggagcatccacgcacaccatcagtggatgacgactgaagatatgctatccgtctggaacagagtgtggatcgaggagaacccatggatggaggacaagacccacatcagctcctggggagatgtgccttacctcggcaagcgtgaggaccagtggtgcgggagcctgatcggcctgaccgcacgggcgacctgggcgacgaacatccaggtagccatcaaccaggtgcggcgccttatcggcaacgagaactacctggactacatgacctccatgaagcgcttcaagaacgaatcagaccccgaaggggctctgtggtga

SEQ ID NO: 24153 - RNA, 9879 nt, synthetic construct
  misc_feature 1..9879: note = derived and/or modified CDS sequence (opt11) from DENV-1__FJ390388__SS-prME
  source 1..9879: mol_type = other RNA
agcgtcaccatgctgctaatgctgatgcccaccgcccttgccttccacctcaccaccaggggcggggagccacatatgatagtgagcaagcaggaacggggcaaaagcctgctgttcaagacaagcgctggggtgaacatgtgtaccttgatcgccatggatctgggcgagctgtgcgaagacaccatgacctacaagtgccccagaatcaccgagaccgaacccgacgacgtggactgctggtgcaacgccacggacacctgggtgacctacgggacctgcagccagacgggcgagcaccggcgcgacaagaggtccgtggccttggccccccacgtgggcttagggctggagacccgcacagaaacctggatgagctccgagggcgcctggaagcagatccagcgggtcgagacgtgggcactcaggcaccccgggttcaccgtgatagccctgttcctggcacacgcgatcggcaccagcatcacccagaaggggatcatcttcatcctactgatgcttgtgacgcccagcatggccatgcgctgcgtgggcatcggcagccgcgacttcgtagaggggctctccggcgccacctgggtggacgtcgtgctggagcacgggagctgcgtgaccaccatggcaaaggacaaacccactctagacatcgagctcctcaagaccgaggtcactaaccccgccgtgctgcggaaactatgcatcgaggcgaagatctccaacaccaccaccgactcacgctgtccgacccagggcgaggccactctggtggaggagcaggacgccaacttcgtttgtcggcgcacattcgtggaccggggctgggggaacggctgcgggctgttcggcaaggggagcttaatcacatgcgccaagttcaagtgcgttaccaagctcgagggcaagatagtccagtatgagaacctgaagtacagcgtgatcgtgaccgtccacacgggcgaccagcaccaagtggggaatgagagcacagagcacggcaccaccgccactatcacgccccaggcccccaccaccgagatccagctcaccgactacggagccctgacgttagactgcagcccccgcactggcctcgacttcaacgagatggtgctcctgaccatgaaggagaagtcctggctcgtacacaagcagtggttcctggacctgcccctcccctggaccagcggggccagcacgtcccaggagacctggaaccgacaggacctgctggtgaccttcaagaccgcccacgccaaaaagcaggaggtcgtggtgctcggcagccaggagggcgcgatgcacacggccttgaccggggccacagagatccaaacctccggcacgacgacaatcttcgccggccacctcaagtgcaggctcaagatggacaagctcaccctgaaaggcatgagctacgtcatgtgcacgggctccttcaagctcgagaaggagctggccgagacccagcacggcaccgttctggtacaaatcaagtatgagggaaccgacgcgccgtgcaagatccccttctcgacgcaggacgagaagggggtcacccagaatggccggttaatcaccgccaacccgatcgtgaccgacaaggagaagcccgtgaacatcgaggccgagccgcccttcggggagtcatacatcgtcatcggcgccggcgagaaggcgctcaagctgagctggttcaagaaggggtccagcatcggtaagatgttcgaagccacggcccgcggtgcccggaggatggcgatcctgggcgacaccgcgtgggacttcggctccattggcggcgtgttcaccagcgtggggaaactcgtccaccagatcttcggaacagcgtacggggtgctgttttccggcgtcagctggacgatgaaaatcgggatcggcgtcctgatgacctggctcggcctgaattcccgcagcacctccctcagcatgacctgcatcgccgtcgggctcgtaacgctctacctgggcgtcatggtgcaagccgactccgggtgcgtgattaactggaagggccgggagctcaagtgcgggtctggcatatttgtcacgaacgaggtacacacatggaccgagcagtacaagttccaggccgatagtccgaaacgcctgtccgcagctatcggcaaggcctgggaggagggggtgtgcggcatccggagcgccacccgtttggagaacatcatgtggaagcagatctccaacgagcttaaccacatcctgcttgaaaacgacatgaagtttactgtcgtggtgggggacgtcgccggcatcctcgctcaagggaagaagatgatccggccccagcccatggagcacaagtactcgtggaagtcctggggtaaggccaagatcatcggcgccgacgtgcagaacaccaccttcatcatcgacgggcccaacaccccggaatgccctgacgaccagagagcatggaacatctgggaggtggaagactacggctttgggatcttcaccaccaatatttggcttaagctgcgggacagctacacccaggtctgcgaccaccgcctcatgtccgcggccatcaaggacagcaaggccgttcacgccgacatgggctactggatcgagtccgagaagaacgagacctggaagctggcccgggctagcttcatcgaggtgaagacgtgcatctggcccaagtcccacaccctgtggtccaacggcgtcctcgagtccgagatgatcatccccaagatatacgggggaccgatctcacagcacaactaccgccccggttatttcacccagaccgccggcccctggcacctagggaagctggagttggacttcgatctgtgtgagggaacgaccgtggtggtcgacgagcattgcggcaaccgggggccgtccctgcgtaccacaaccgtgaccggcaagatcatccacgagtggtgctgccggagctgcaccctacctcccctccgcttccgcggggaagatggctgctggtatgggatggagatacgccccgtcaaggagaaggaggagaatctggtaaagtccatggtgagcgccggcagcggcgaggtggattccttttctctcgggctgctgtgtatctccatcatgatcgaagaggtcatgcggtcgcgctggagccggaagatgctcatgaccggcacgctggccgtgttcttcctgctcatcgtggggcagcttacgtggaatgacctgatccgcctctgtataatggtcggcgccaacgcgagcgaccgtatggggatgggcaccacctaccttgccctgatggccacgttcaagatgcggccgatgttcgccgtggggctcctgttccgccggctgacctccagagaggttctcttactaaccatcgggctcagcctggtcgcctccgtggagctgcccaactccctcgaggaactcggcgacgggctggcgatggggataatgatccttaagttgctgacagacttccaatcccatcagctctgggccactctgctcagcctcaccttcattaagaccacattctccctgcattacgcctggaagacgatggccatggtcctgagcgtcgtctccttattccctctgtgccttagcaccacctcccagaagaccacgtggctccccgtgctgctgggcagcctggggtgcaagccacttaccatgttcctgatcgcagagaacaaaatctggggccggcgctcctggcccctgaatgaggggataatggccgtgggcatcgtcagcatcctgctgagctccctcctgaagaacgacgtcccgctggccgggcctctcatagccggcggcatgctcatcgcctgctacgtgattagcgggtccagcgcggacctgtccctcgagaaggccgccgaagtaagctgggaagaagaggccgagcactccggcgccagccacaacatcctggtcgaggtccaggacgacgggacgatgaagataaaggacgaggagcgagacgacaccctgaccatcctcctgaaggcgacgctgttagccgtgtccggcgtctacccgctgagcatccccgccaccctgtttgtgtggtacttctggcagaagaagaagcagcgctccggggtgctctgggacacccccagcccccccgaggtcgagcgggccgtgctagacgacggcatctaccggatcatgcagcggggcctgttagggcgctcccaggtgggcgtcggggtgttccaagagaacgtcttccacaccatgtggcacgtcacgcggggcgccgtgttgatgtaccaggggaagcggctggagcccagctgggcgtccgtgaagaaggacctgataagctacggcggcgggtggcggctccagggctcctggaataccggggaggaggtccaggtgatcgcagtggagcccggtaagaaccccaagaacgtccagaccgcccccgggaccttcaagacgcccgaaggcgaggtcggcgccatcgccctggacttcaaacccgggaccagcggctcccccatcgttaatcgcgagcgtaagatcgtcgggctgtacggcaacggagtggtcacaaccagcgggacgtatgtcagcgcgatcgcccaggccaaggcctcccaggagggcccgctccccgagatcgaggacgaggttttccgcaagcgcaacctgactatcatggacctgcatcccgggagcggcaagacccgcaggtacctcccggcgatcgtgcgcgaggccatcaagcgtaaactgagaactctgatcctcgcacccacgcgcgtcgtggcatccgagatggctgaggcgctgaaggggatgcccatcaggtaccagaccaccgccgttaagagcgagcacaccgggaaggagatcgtcgacctgatgtgccacgccacgttcaccatgcgccttctgtcccccgtgcgggtgcccaactacaacatgatcatcatggacgaagcccacttcaccgaccccagctccatcgctgcgcgcggctacatcagcacccgggtcgggatgggcgaggccgccgcgatcttcatgacggccaccccgcccggctccgtggaggcgttcccgcagtcgaacgcagtgatacaggacgaggagcgcgacatccccgaacggtcctggaatagcggctacgagtggatcaccgacttccccggaaagaccgtctggttcgtgcccagtatcaaaagcggcaacgacatcgccaactgcctgcgcaagaacggcaagcgggtgatccagctctcccgcaaaacgttcgacactgagtaccagaagactaagaacaacgactgggactacgtcgtcaccacggacatcagcgagatgggggctaacttccgggcggatcgcgtgatcgacccgcggcggtgcctgaagcccgtaatccttaaggacggccccgagcgagtgatcctcgccgggcccatgccggtcaccgtcgcgagcgccgcgcagcgccggggccgcatagggcgcaaccacaacaaggaaggcgatcagtacatctacatgggccagcccctgaacaacgacgaggaccacgcgcactggaccgaggccaaaatgctgctcgacaacatcaacacccccgaggggatcatccccgccctgttcgagccggagagggaaaagtccgccgctatcgacggcgaataccgcctgcgcggggaggcgcgcaagacgttcgtagagctcatgcggcgcggcgacctgcccgtctggctgtcatacaaggtggccagcgaggggttccagtacagcgaccggaggtggtgcttcgacggcgaacggaacaaccaggtgctagaggagaatatggacgtcgaaatctggaccaaagagggcgagcgcaagaagctgcgtccccgctggctggacgcccggacatactccgaccccctcgccctgcgcgagttcaaggagttcgccgcaggccggcggagcgtgtccggcgacctgatcctcgagatcgggaagctgccgcagcacctgacccagcgggcccagaacgccctcgacaacctggtcatgctgcacaactccgagcagggtggccgcgcctacaggcacgcgatggaggagctccccgacactatcgagaccctcatgctgctcgccctgatagccgtccttactgggggagtgactctcttcttcctgtccggccgcggcctggggaaaacctctatcggcctcctgtgcgtgatggcctccagcgtcctgctctggatggcctccgtggaaccccactggatcgcggccagcataatcctggagttcttcctgatggtcctcttaatccccgagccagaccggcagcgcaccccccaggacaaccagctggcctacgtagtgatcggcctcttattcatgatccttacggtggccgccaacgagatggggctcttagaaaccactaagaaggacctgggcattgggcacgtcgcagtggagaatcaccaccacgccgccatgctcgacgtggaccttcaccccgcatccgcctggacgctgtacgcggtcgccaccaccataatcaccccgatgatgcgccacacgatcgagaacaccaccgccaatatcagcctcacagccatcgcgaaccaggcggcaatactgatgggcctggacaaaggatggcccatctccaaaatggacatcggcgtgccgctactggccctaggctgttacagccaggtgaaccccctcacgctgacagccgcggtcctgatgctcgtagcccactacgccatcatcgggccggggctgcaggccaaggccacccgggaagcgcaaaagcgtaccgccgccgggatcatgaagaaccccacggtggacggcatcgtcgccatcgacttagaccccgtggtttacgatgccaagtttgagaagcagctcggtcagatcatgttgctgatcctctgcacctcccagatcctgttaatgcggaccacctgggcgctctgcgagagcatcacactggccaccggcccactgacgaccctctgggagggctccccagggaaattctggaacacgaccatcgccgtcagcatggccaacatctttcgcggatcgtacctggccggggcgggcctggcctttagtctcatgaagtccctgggcggaggcagacgcgggaccggcgcccagggggagaccctgggtgagaagtggaagcggcagcttaatcagctgtccaagagcgagttcaacacgtacaagcgctccgggatcatggaggtggaccgaagcgaggcgaaggaggggttgaagcggggcgagaccaccaagcacgcggtgagccgggggaccgccaagctcaggtggttcgtcgagcggaacctcgttaagcccgagggcaaggtgatcgacctgggttgcggccgcggcgggtggagctattactgtgcaggcctgaagaaggttacggaagtgaaggggtacactaagggtgggcccggccacgaggaacctataccgatggccacctacggctggaacctcgtgaagctgcactccgggaaggacgtcttcttcatcccgcccgaaaagtgcgacaccttgctctgtgacatcggcgagagctctcccaacccgacgatcgaggagggacgcaccctgcgcgtgctgaagatggtggagccatggctccggggcaaccagttctgcatcaagatcctgaacccctatatgcccagcgtcgtggagaccctggagcagatgcagcgcaagcacgggggcatgctcgtgcggaatccgctgtcccgcaacagcacccacgaaatgtactgggtctcctgcggcacggggaacatcgtgagcgccgttaacatgacgtcccgcatgctgctcaaccggttcaccatggcccaccgcaagcccacctacgagcgggacgtcgacctgggcgcggggacccgccacgtggccgtcgagcccgaagtcgccaaccttgatatcatcggccagcggattgagaacataaagcacgagcacaaaagcacgtggcactacgatgaggacaacccctacaagacctgggcctaccacggctcctacgaggtgaaaccaagcgggtctgcgagcagcatggtaaacggcgtggtgaagctgctgaccaagccctgggacgtcatccccatggtgacgcagatcgccatgacggacacgacccccttcggtcagcagcgagttttcaaggagaaggtcgacacccggaccccgaaggctaagcgcggcaccgcccagattatggaggtgacggctaagtggctgtgggggttcctatccagaaacaagaaaccgcgcatctgcacccgggaggagttcacgcgcaaggtgcggagcaacgcagctatcggtgccgtcttcgtggatgagaaccagtggaactccgccaaggaggcggttgaggacgagcgcttttgggacctggtccacagagagcgcgagctgcacaaacagggcaagtgcgcgacctgcgtgtacaacatgatggggaagagggagaagaagctaggcgagttcgggaaggccaagggctctcgcgccatctggtacatgtggctgggggcacggttcctcgagttcgaagctctcggcttcatgaacgaggatcactggttctcacgcgagaactcgctgtccggcgtcgaaggggaaggcttgcacaagctcgggtacattctgcgggacatcagcaagatccccggagggaacatgtacgccgatgacacggccggctgggacacccggatcaccgaggacgacttacagaacgaggcgcgtatcaccgacataatggagccggagcacgccctcctggcgaagtccatcttcaagctgacctaccaaaacaaggtcgtgcgtgtgcaacgcccggccaaaaatgggaccgtcatggacgtgatcagccgacgcgatcagcgtgggtccggccaagtggggacgtacggcctcaacacctttaccaatatggaggcccagctgatccggcaaatggagagcgagggcatattctcccccagcgaactggagacgcccaacctcgccgagcgggtcctggactggctggagaagtacggggtggagcgcctcaagcggatggctatctccggagacgattgcgtggtcaaaccgatcgacgaccgcttcgccacggccctgaccgccctgaacgacatggggaaggtgcggaaggatattccccagtgggagcccagcaagggctggaacgactggcaacaggtccccttctgttcccaccacttccaccaactcatcatgaaggacgggcgcgagatcgtcgtgccgtgcagaaaccaggacgaactggtggggcgcgcccgggtctcgcaaggcgccgggtggtcgctgcgcgagaccgcctgcctcggcaagtcctacgcccagatgtggcagctgatgtacttccatcgaagggatcttcggctcgcggccaacgccatctgcagcgccgtgcccgtggactggatccccacctcccgcacgacctggtcgattcacgcccaccaccagtggatgaccaccgaggacatgctgtccgtctggaacagggtctggatcgaggagaacccctggatggaggacaagacgcacatcagctcctggggcgacgtgccgtacctgggcaaacgggaggaccagtggtgcgggtcgctcatcggccttaccgcgcgcgccacatgggcgaccaacatacaggtcgccataaaccaggtgcgtcgcctgatcggcaacgagaactacctcgattacatgacctccatgaagcggttcaaaaacgagagcgaccccgagggggccttatggtga

SEQ ID NO: 24154 - RNA, 9879 nt, synthetic construct
  misc_feature 1..9879: note = derived and/or modified CDS sequence (opt11) from DENV-1__FJ024464__SS-prME
  source 1..9879: mol_type = other RNA
agcgttaccatgctgctgatgctgatgcccaccgccctggccttccacctcaccacgcgtggcggtgagccccacatgatcgtgagcaagcaggagcggggaaagagcctgctgttcaagaccagcgccggagtgaacatgtgcaccctcatcgccatggacctgggcgagctatgcgaagacacgatgacctacaagtgcccccggattaccgagaccgagcccgacgatgtggactgctggtgcaacgctacagacacctgggtgacctacgggacctgcagtcagacgggcgagcaccggcgggacaagcggagcgtggccctagctccgcatgtgggcctgggtctggagacccgcaccgagacctggatgtcctcggagggcgcgtggaagcagatacaacgggttgagacgtgggcactccggcaccccgggttcaccgtgatcgccctgttcctggcccacgcgatcgggacgagcatcactcaaaaggggatcatcttcatcctcctgatgctggtgacgccgtccatggccatgcgatgcgttggcatcggcagccgcgacttcgtggagggcctctccggtgccacctgggtggatgtcgtgctagaacatggatcatgcgtgaccaccatggcgaaggataagcccacgctagacattgagttgctgaagaccgaggtcacgaaccccgccgtgctcagaaagctctgtatcgaagcaaaaatatccaacactacgaccgacagccgctgcccgacccagggcgaagccacactggtggaggagcaagacgccaactttgtctgtcggcggaccttcgtggaccggggctggggaaacggctgcgggctgttcggcaagggctccctcatcacgtgcgctaagttcaagtgcgtgacaaagctggaggggaagatcgtccagtacgagaacctaaagtacagtgtgatcgtgaccgttcacacgggcgaccagcaccaggtcgggaatgaatccaccgagcacggcaccactgcgaccatcacgccacaggcgcccaccaccgagatccaactcaccgattacggtgccctgaccttggactgcagcccccgcactggcctcgacttcaatgagatggttttgttaactatgaaggagaagtcctggcttgtccataagcaatggtttctggacctgcccctaccttggaccagcggggccagcacgtcccaggaaacgtggaaccggcaagatctgctggtgacgttcaaaacggcccatgccaaaaagcaggaggtcgttgtgttgggcagccaagagggcgcgatgcatacggctctgaccggagcgaccgagatacaaaccagtggcacgaccacaatcttcgcggggcacctgaagtgccgcctaaagatggacaaactgaccctgaaaggcatgagctacgtcatgtgcactgggtccttcaagctcgaaaaagagctggccgagacccagcacggcacagtactggtgcagatcaagtacgaaggcaccgacgccccctgcaagatcccgttcagcacgcaggacgagaagggggtcacccaaaacggccgcctcatcaccgcgaatcctatcgtgaccgacaaggaaaagcccgtgaacatcgaggccgagcctccctttggagagtcctacatcgtcatcggcgccggcgagaaggcactcaagttgagctggtttaagaaggggtccagcatcggcaagatgttcgaggccacggcgcgtggcgtaaggcgcatggccatcctgggcgacacggcctgggacttcgggtccataggcggggtgttcacctcagtcgggaaactagtgcatcaaatctttgggaccgcttacggggtgctcttctccggtgtcagttggacgatgaagatcgggataggcgtgctgctcacctggctgggcctgaactcccgaagcacttccctgagcatgacctgcatagccgtgggactggttaccttatacctcggcgtgatggtgcaggccgactccggctgcgtaatcaactggaagggccgggagctgaaatgcgggtcgggcatcttcgtgaccaatgaggtccacacctggacggaacagtacaagttccaggcggacagcccgaagcgcttatcagccgctataggcaaggcatgggaggagggggtctgcggcatacggagcgccacccgcctagagaacattatgtggaagcaaatcagcaacgaactgaaccacatactgctcgagaacgatatgaaattcacggtggtggtcggggacgtggcaggcatcctggcacaggggaagaagatgatccggccccaacccatggaatataagtacagctggaagtcctggggcaaggctaagatcatcggcgccgacgtgcaaaataccaccttcatcatcgacgggcccaacactccggagtgccccgatgaccagagggcctggaacatctgggaggtcgaggactacggctttgggatcttcacaaccaatatttggctgaagttacgcgacagctatacccaggtctgcgaccatcgcctgatgtccgccgcgatcaaggactctaaggcagtgcacgcagacatgggctattggatagaatctgagaaaaacgaaacctggaagctcgcccgggccagtttcatcgaggtaaagacgtgtatttggccaaagtcccacaccctctggagcaacggcgtcctggaatccgagatgatcatccctaagatctacgggggcccgatgtcccagcacaactaccgccccgggtatttcacccaaaccgcgggcccctggcacctgggcaagctggagctggactttgacctgtgcgagggcacgaccgtggtcgtggatgagcactgtggtaaccgggggccgtcgttacgcaccactacggtcactggcaaaatcattcacgagtggtgctgccggagctgcaccctgccgcccctgagattccggggggaggacggctgttggtacggcatggaaatccgccccgtcaaggagaaggaggagaacctcgtcaagtccatggtgtcagccggcagcggcgaggtcgactccttcagcctgggcctgctctgcatctccatcatgatcgaggaggtgatgcggagcagatggagccggaagatgctgatgaccggcacgctggcagtgttctttttgctgatcatggggcaactgacctggaacgacctgatccgcctgtgcatcatggtcggcgccaacgcctcggacagaatgggaatggggaccacctatctggccttgatggccacgttcaagatgcggcctatgtttgccgtcggactactattcagacggctgacctcccgcgaggtgctgcttctcaccatcggactgagcctggtcgcgtcggtagagctccccaacagtctggaagaactgggcgacggactcgccatgggcatcatgatcttgaagctgctcacggatttccagtctcatcagctgtgggcgacgcttctcagcctgacctttatcaagaccaccttctccctgcactacgcctggaagacaatggccatggtgctcagcatagtgtccctgtttcccctgtgcttatcgacgacctctcagaagaccacttggctgcccgtgctgttaggcagcctcgggtgcaagccgttgaccatgttcctcattgcagagaacaagatctggggccggcgctcctggcccctgaacgaggggatcatggcggtcggaatagtaagtatcctccttagttctctgctgaagaacgacgttcctctagccggtcccctgatagcaggcggcatgcttatcgcgtgctacgtcatcagcgggtcaagcgcagacctatccctggagaaagcggccgaagttagctgggaggaggaggccgagcactccggcgccagtcacaacattcttgtggaggtccaggacgacggcaccatgaagattaaggacgaggaacgggacgacactttaaccatcctgctcaaggccacgctcctggcggtgtccggcgtgtacccgctgagcatccccgccaccctcttcgtatggtacttctggcagaagaagaagcaacggtccggtgtgctgtgggataccccctcgccgcccgaggtcgagagagccgtcctggatgacggcatttaccgcatcatgcaaaggggcctgctcggcagatcccaggtcggcgtgggcgtattccaggagaacgtgttccacaccatgtggcacgtgacgagaggggccgtcttgatgtaccaggggaagcgcctggagcccagctgggcctccgtgaagaaggacctcatatcatacggcggcgggtggcggctgcagggctcctggaacaccggggaagaggttcaggtcatagcggtagagcccggtaagaaccccaaaaatgttcagaccgccccggggaccttcaagacccccgagggcgaagtcggcgcaatcgccctggacttcaagcccgggaccagcggatcccccatcgtgaaccgcgagggaaagattgtaggcctctatggcaacggggttgtgactaccagcggcacctatgtgagcgcaatcgcgcaggctaaggcgtcccaggaggggccgctgccggagatcgaggacgaggtcttccggaagcgcaacctgacgatcatggatctccatcccggcagcgggaagacccggcgttacctcccagctatcgtgcgggaggccatcaagcgcaagctgaggaccctaatcctggcccccacgcgggtggtagccagtgagatggccgaagccttaaaaggcatgcccatccgctaccagaccacggcggtcaagagcgaacacaccggcaaagagatcgtggatctcatgtgccatgctacattcaccatgcgcctgctgtcccccgttcgcgtgccgaactacaacatgatcataatggacgaggcccacttcaccgaccccagcagtatcgccgcccggggctacatctctacacgcgtgggcatgggggaagcggccgccatcttcatgacggccacgccgccgggcagtgtagaggccttcccccagagcaacgccgtgatccaggacgaggagcgggacatccccgagcgctcctggaatagcgggtacgagtggatcaccgatttccccggcaagaccgtttggttcgtcccatccataaagtcaggcaacgacatcgccaactgcctacgaaagaacgggaagcgcgtgatccagctgtcccggaagacgtttgacacggagtaccagaagaccaagaacaacgactgggactacgtggtcaccacggatataagcgagatgggcgccaatttccgggctgaccgggtgatcgacccacgcaggtgccttaagccggtgatcctcaaggacgggcccgagcgcgtcatcctggcgggccccatgcccgtaaccgtggcctccgccgcccagaggcgcgggcgaatcggtaggaaccacaataaagagggcgaccagtacatctacatggggcaaccattgaacaatgacgaggaccacgcccactggaccgaggcgaagatgctcctcgacaacatcaacacaccggagggcatcatccccgccctgttcgagccggagcgcgagaagtcggcggccatcgacggcgagtaccggctccgcggcgaagcccggaagacgttcgtggagctgatgcgtaggggggacctgcccgtgtggctctcatacaaggtcgcctcggagggattccagtactctgaccgccggtggtgcttcgacggcgagcgcaacaaccaagtgcttgaggagaacatggacgtagagatctggactaaggagggggagcgtaagaagctgcgcccccgatggctagacgcgcgaacctacagtgaccccctggcactgcgggaattcaaggagttcgccgccggcaggcggtcggtctccggggatcttattctggagattggcaagctcccccagcacctcacccaacgcgcacagaacgctctggataacctagtgatgctccataatagcgagcaaggagggagagcctataggcacgccatggaggagctgcccgacactattgaaaccttgatgctcctggcgctgatcgccgtgctaaccgggggggtcaccctttttttcctgtccggtagagggctcggcaagaccagcataggcctgctgtgcgtgatggcctccagcgtgctcctgtggatggcctctgttgagccccactggatcgccgcgagcataatcctggaattctttctaatggtgttgctgatccccgagccggaccgacagcggacgccccaggacaaccagcttgcctacgtggtcattgggctgctgttcatgatcctcaccgtggccgccaacgagatgggcctgctggaaacaaccaagaaggatctcggtatcggccacgtggccgtcgagaaccaccatcatgcggccatgctcgacgtcgacctgcacccggcctcggcctggaccctctacgccgtggcgaccaccattatcaccccgatgatgaggcatacgatcgagaataccaccgccaacatctctctgaccgcgatcgccaaccaggccgcgatcctcatggggctcgacaagggatggcccatctcaaagatggacatcggagtgcccttgctggccctcgggtgctatagccaagtgaaccccctgacattgaccgccgccgtgctaatgctggtagcgcactacgcaatcataggcccggggttgcaggccaaagccactagggaagcacagaagcgtaccgcggccggcatcatgaagaatcccacagtcgacgggatcgtggcgatagacctcgaccccgttgtctacgatgccaagtttgagaaacagctaggccagatcatgctgctcatcctctgcacatcccagatcctgctcatgcgcaccacctgggccctatgtgaaagcatcacactggcgaccggccccttaaccaccctgtgggaaggttcaccgggtaagttttggaacacgaccattgccgtgagcatggccaacatcttcaggggctcctacctggctggtgccggcctcgccttcagcttgatgaaatccttgggaggcgggaggcgggggaccggcgcgcagggagagaccctcggcgagaagtggaagcgccagctaaaccaactgagcaaatctgagttcaatacttacaagcgttccgggattatggaagtggaccgctcggaggccaaggagggactcaagagaggggagaccacaaagcacgccgtctcccgcggcaccgcgaagctgcggtggttcgtggagcgcaatctggtcaagcccgagggcaaggtgatcgacctgggctgtggccgcgggggctggagctactactgcgccgggctgaagaaggtaacggaggttaaggggtatacaaagggcggccctggtcatgaggagcctatcccgatggccacatacgggtggaacctggtgaagctccactctggaaaggacgtgttctttatccctcctgagaagtgcgacaccttactttgcgatataggggaatcgtcccccaatccgacgatcgaggagggccgcaccctgcgggtgcttaagatggtggagccgtggctgcgggggaaccagttctgcatcaagatcctgaatccctacatgccctctgtggtcgaaaccctcgagcagatgcagcggaagcacggcggcatgctggtgcgcaatcccctgtcccggaatagcactcacgagatgtactgggtgtcctgcggaaccggcaacatcgtctccgccgtgaacatgacgtcccgtatgctcttgaaccgcttcacgatggcccaccggaagcccacgtacgagcgcgatgtggatttgggggcgggtacccggcacgtggccgtggagcccgaggtcgccaacctcgacatcataggtcagaggatcgaaaacataaagcacgagcacaagagcacttggcactatgacgaggacaacccctacaagacctgggcctaccacgggtcctacgaggtgaagcctagcggctccgccagcagcatggtaaacggggtcgtgaaactattaaccaagccctgggacgttatccccatggttacccagatcgcgatgacggacacaacccccttcggccagcagcgggtgttcaaggagaaggtggacacccgtacgccgaaagccaagcggggaaccgcccaaatcatggaggtcaccgccaagtggctctggggattcctgagtcgcaacaagaaaccccggatttgcaccagagaagaatttacgcgcaaggtccgctcaaacgccgcgatcggcgcggttttcgtcgacgaaaaccaatggaactccgccaaggaggccgtggaggacgaacggttctgggacctagtgcaccgcgaacgggagctccacaagcaaggcaaatgcgcgacctgcgtctacaacatgatgggaaagcgggagaagaagctcggggagttcggcaaggctaaggggagccgggctatatggtacatgtggcttggtgctcgcttcctcgagttcgaggcgctggggttcatgaacgaagaccactggttctcccgggagaacagcctgtccggggtggagggcgaggggctacataaattgggctacatcctgcgcgacattagcaagatccccgggggcaacatgtatgcggacgacaccgccggctgggacacacggatcacggaggatgacctacagaatgaggcccgcatcaccgacatcatggagccggagcacgccctgctggccaagagcattttcaagttgacctaccagaacaaagtggtccgcgtacagcggcccgcaaagaacggaaccgtgatggatgtaatctcgcgccgggaccaaaggggctctggccaggtggggacgtacggcttgaacacctttacaaacatggaggcccagctgatccggcagatggagagcgaggggattttttcccccagcgagctcgagacccccaacctggccaaacgcgtgttggactggctcgagaaatacggcgtagagcggctgaagaggatggccataagcggggacgactgcgtggtgaaaccgatcgacgaccgcttcgccacggctttgaccgcccttaatgacatgggcaaggtacgcaaggatatcccacagtgggaacccagcaaggggtggaacgactggcagcaggtccccttctgctcccatcactttcatcaactgatcatgaaggacggtagagagatcgtggtcccttgtcgaaatcaggacgagttagtggggcgggcccgtgtcagccaaggggccggctggagccttcgggagaccgcctgcctaggcaaatcttatgcgcagatgtggcagctgatgtatttccaccgccgggatctccggctggcagcaaatgccatctgcagcgcggtccctgtggattggatccccacctccagaacgacctggagtatccacgcccaccaccaatggatgactacagaggacatgttgagcgtgtggaaccgcgtctggatcgaggaaaacccctggatggaggataagacccacatcagctcctggggcgacgtgccgtacctcgggaagagggaggaccaatggtgcggcagcctcatcggcctgacagcacgtgcaacctgggccacaaacattcaggtggcgatcaaccaggtccgccggctcatcggcaatgagaactacttagattacatgacgtccatgaagcgcttcaagaacgaaagcgaccccgagggcgctctgtggtag

SEQ ID NO: 24155 - RNA, 9879 nt, synthetic construct
  misc_feature 1..9879: note = derived and/or modified CDS sequence (opt11) from DENV-1__FJ410191__SS-prME
  source 1..9879: mol_type = other RNA
agcgttaccatgctgttgatgctaatgcccaccgccctggccttccacctcacgacccggggcggggagccccacatgatcgtgtccaagcaggaacggggcaagtccctgctgttcaagacctccgctggcgtgaacatgtgcacgctgatcgccatggaccttggtgagttttgcgaggataccatgacttacaagtgcccccgtatcaccgaggctgaacccgacgatgtggattgctggtgtaacgccacagacacctgggttacctacgggacctgcagccagaccggcgagcaccgacgcgacaagcggtccgtggccctggcgccccatgtgggcctcgggcttgaaacgcgcaccgagacctggatgtcctccgagggcgcctggaagcagatccaaaaggtagagacctgggccctacgacacccggggtttacggtgatagccctctttttggcgcacgccatcggcacctcgatcacgcagaaggggatcattttcattctccttatgcttgtgaccccctccatggccatgcgctgcgtcggcatcggcagccgggacttcgtagaggggctatccggcgccacttgggtggacgtcgtgttagagcatgggagctgcgtgaccaccatggccaaagacaagcctaccctggacatagagctactcaagaccgaggtcaccaaccccgccgtgttacgcaagctgtgcatcgaggccaagatttccaacaccaccacggatagccgatgcccgacccagggcgaagccaccctcgttgaggagcaggacgcgaacttcgtctgcaggcggaccttcgtggatcgcggctggggcaacggttgcgggctgtttgggaaggggtccttaatcacgtgcgctaagttcaaatgcgtgaccaaactcgaaggcaaaaccgttcagcacgagaacctgaagtacagcgtgatcgttacagtccatacaggcgaccagcaccaagtgggcaacgagtcaaccgagcacggcacgaccgcgacgatcacaccccaggcccccagcaccgagatccagcttaccgactatggggccctcaccctggactgcagcccccggacgggcctggacttcaacgaaatggtattattgacaatgaaggagaagtcctggttggtgcacaagcagtggttcctcgacctgcctctgccgtggacaagcggggcgtcaacctcacaagaaacttggaatcgcaaagacctcctggtgaccttcaagacagctcacgcgaagaagcaggaagtcgttgtgctggggtcccaggagggcgccatgcacaccgcacttacgggtgccaccgagatccagactagcggcacaacgaccatcttcgccgggcacctgaagtgccggctcaagatggacaagctaactttaaaggggacctcctacgtcatgtgcacagggagtttcaagctggagaaggaggtggcggagacccagcacggtactgttctcgtacaaatcaaatacgaaggcaccgacgcaccctgcaagattcccttcagcacgcaggacgagaaaggggtgacccaaaacggcaggctgatcaccgccaacccgatagttaccgacaaggagaagcccgtgaacattgaagccgagccgccctttggcgagagctacatcgtgattggcgctggtgagaaggccctgaaactgtcgtggttcaagaagggcagctccatcggtaaaatgtttgaggccacggctcgtggggctcgccggatggcgatcctcggtgacaccgcctgggacttcgggagcatcggcggcgtgttcacatccgtcgggaagctggtacaccaaatcttcggcaccgcctacggggtgctgttcagcggcgtctcctggactatgaaaatcgggatcggggtgctcctgacctggctgggcctcaacagccgctccaccagcttatccatgacgtgcatcgccgtggggctggttacgttatacctgggcgtaatggtacaagccgattcgggatgcgtaattaattggaagggcagggagctgaagtgtgggtcaggaatcttcgtaaccaacgaagtacacacatggaccgagcaatacaagtttcaggcggacagtccgaagcggctctcggccgcgatcggcaaggcctgggaggagggcgtctgtggcatccgctccgctaccagactggaaaacatcatgtggaaacagatatctaatgagctgaaccacatccttttggagaacgacatgaaatttacggtggttgtgggggacgtggcgggcatcctggcccaggggaaaaagatgatacgcccacagccaatggagtacaagtactcctggaaatcctggggcaaggccaaaatcatcggagctgacgtgcagaacactaccttcatcatagatgggcccaacacacccgagtgccccgacgaccaaagggcgtggaacatatgggaggtcgaggactatggttttgggattttcacgacaaacatctggctcaagctacgcgacagttacacccaggtgtgcgaccaccggctgatgagcgctgccataaaagacagtaaagccgttcacgccgacatgggatactggatagagagcgagaagaatgagacctggaaactcgcgcgggcatcctttattgaggtcaagacgtgtatatggcccaagagccacacactgtggagtaacggcgtcctggagagcgagatgattatccccaagatctacgggggcccgacctcccaacacaactaccggccaggttactttacccaaacggccggcccctggcacctcggtaaactggaactggacttcgacctctgcgaaggcaccaccgtggtcgtagacgagcactgcggcaaccgcgggccgagcctgcggactaccaccgtgaccggcaagatcatccatgagtggtgctgcagatcctgcaccctgccgcccctgaggtttaagggggaggacggctgctggtacgggatggagatccgcccagtcaaggagaaggaggagaatctagtcaaaagcatggttagcgccggctccggagaggtcgacagcttctccctgggattgttgtgtatcagcatcatgatcgaggaagtgatgcggtcccgttggagccggaagatgctgatgacggggaccctcgccgtgttctttttgctgatcatggggcagctcacttggaatgacctgatccgcttgtgcatcatggtcggtgccaacgccagcgaccggatgggaatgggcaccacgtatctcgccctgatggcaaccttcaagatgcgcccgatgttcgccgtggggctccttttccgcaggttaaccagccgcgaggtgctgctcctgaccatcggtctttccctcgtggccagcgtggagctgccaaattccctggaggagctcggcgatggactggccatggggatcatgatcctcaagctcctaacggacttccagagtcaccagctgtgggccaccttattgtccctgaccttcatcaaaaccacgtttagcctccactacgcatggaagaccatggcaatggtcctgtccatagtgagcctgtttcccctctgcctgtcaacaaccagccagaagacgacctggttacccgtgttactgggatccctggggtgcaaacccctcaccatgttccttattgccgagaataagatctggggccgcaaatcttggcccctgaatgaggggatcatggccgtaggcatcgtgagcatcctcctctcctcccttctcaagaacgacgtgcccctggccgggcccctgatcgccggtggcatgctcatagcgtgctacgtcatctccggcagcagcgctgacctgagcttagagaaagctgctgaggtgtcctgggaggaagaggccgaacacagcggggctagccacaacatcctcgtggaagtacaggacgatgggaccatgaagatcaaggacgaggagcgcgacgataccctgacgatcctgctcaaagctaccctgctggcggtgagcggagtttatccgctcagtatcccggccacactgttcgtatggtacttctggcagaagaagaagcagagaagcggcgtgctgtgggacacccccagtccacccgaggtggagagggcggtcctcgacgacggtatctaccggatcatgcagcgcgggctgctcgggcggtcgcaggtaggagtgggggttttccaggaaaacgtattccacacgatgtggcacgtgacccgcggcgcagtccttatgtaccaagggaagcggcttgagccctcatgggcctctgtaaagaaagacctaatctcctacggcggagggtggcgcctacagggcagttggaacacgggggaggaggtgcaagtgattgctgtggagccgggcaagaaccccaagaacgtgcagacagcacccgggacttttaagaccagtgagggggaggtcggcgcgatcgcgctcgacttcaagcccgggacaagtggctctcccatcgtgaaccgtgaggggaagatcgtgggcctctacggcaacggggtcgtgaccacgtcgggcacctacgtcagcgccatcgcccaggccaaagcgtcccaggaggggcccctgccggagatagaggacgaggtcttcagaaaacggaacctcaccatcatggacctccatccgggcagcgggaagacccgccgctacttacccgccatcgtccgcgaggcgatcaagcggaagctaagaacgctgatactggccccgacgcgcgtggtcgcgtccgagatggcagaggctctcaagggcatgccaatccgctaccagactacggccgtaaaaggagagcatacggggaaggagatcgtggatctgatgtgccacgcaacctttactatgcgcctgctcagccccgtgcgtgtccccaactacaacatgattataatggatgaagcccactttaccgacccgtcctcgatcgcggctcgcggctacatctctacgcgggtcgggatgggcgaggctgcggccatatttatgacagcgacgccacccggtagcgtcgaggccttcccccagtccaacgctgtgatccaggacgaggagcgcgatatccccgagcggagctggaactcgggctatgagtggatcaccgacttcccaggcaagaccgtgtggttcgtcccctcaatcaagtccgggaacgacattgcgaactgtctgcgcaagaacggcaagagggtgattcagctgagccgcaagaccttcgacactgaatatcaaaagaccaagaacaacgactgggactacgtggtaacgaccgacatctccgagatgggggcaaactttcgggccgaccgcgtgatcgacccccggcgctgcctcaagccggtcatcctgaaggacggccccgaacgggttatactggccgggcccatgcccgtgaccgtcgcctcggccgctcagcgacggggcagaatcggcaggaaccacaacaaggagggggaccagtacatctacatggggcagccgctcaacaatgacgaggaccacgcccactggaccgaagccaaaatgctgcttgacaacattaacacccccgaggggatcatccctgccctcttcgaaccggaacgcgagaagtccgccgcgatcgacggcgagtaccggcttagaggggaggcccgcaagacctttgtggaactcatgcgccgcggcgacctccccgtatggttatcatataaagttgcatccgagggctttcaatactctgaccggcggtggtgcttcgatggcgagcggaacaaccaggtgttggaagagaacatggatgtggagatctggaccaaggagggcgagcggaagaagctccggcctaggtggctggacgcccggacctacagcgaccccctggccctccgcgagttcaaggaatttgcggccgggcgccgctccgtctcgggggatttgatcctggagatcggcaaacttccccagcacctgacgcagcgggcccagaacgccctggacaacttagtgatgctgcacaactcggaacagggaggtcgcgcgtaccggcacgccatggaggagctcccggacaccattgagaccctcatgttactggccttgatcgccgtgctgaccggtggcgtcaccctgtttttcctctcagggcgcggcctggggaagacgtccatcgggttgctctgcgtaatggccagctccgcgctgctgtggatggccagcgttgagccgcattggatcgccgcctccatcatcctcgagttcttcctgatggtcctcttgatccccgaacccgaccgccagcgtacccctcaggacaaccagctggcctacgtcgtgatcggcctactattcatgatcctcacagtcgcagctaacgaaatgggactgctcgagaccacgaaacgagacctgggcatcggacacgtggccgtggagaaccaccaccacgccgccatgctggacgtggacctgcatcccgcgagcgcctggaccctgtacgctgtagccaccaccatcatcacgccaatgatgcggcataccatcgagaacactaccgccaacatctccctgacagcgatagccaaccaggccgccatcctcatgggcctggacaagggctggcctatcagcaagatggacatcggggtcccactgctcgcgcttggttgttactcccaggtcaacccacttaccctcaccgccgcggtgctgatgctggtggcccactatgcgatcatcgggcccggcttgcaggccaaggccacccgggaagcgcagaagcgcaccgccgccggtatcatgaagaacccgaccgtcgacggcatagtggccatcgacctggaccctgttgtctacgacgccaagttcgagaagcagctgggccagattatgctgctggtactatgcacgagccagatcctactaatgcgcaccacgtgggccttatgcgaatccatcaccctcgccaccgggcccttgaccacgctctgggagggcagccccgggaagttttggaacaccaccatcgccgtgtccatggcaaatatcttccgtggatcctacctcgcaggcgccgggctggcgttcagccttatgaaaagtttaggcggaggcagacgcggaaccggcgcgcaaggcgagactctgggagagaagtggaagcgccagctgaaccaactcagtaagtccgagttcaacacctacaaacggagcggaataatggaagtcgaccgctccgaggcgaaggaggggctgaagcggggcgagaccacgaaacatgccgtgagccgcgggactgccaagttacggtggttcgtggagcgcaacctcgtcaaaccggaaggcaaggtgatcgacctgggctgcgggcggggcggatggtcatattactgcgccggcctgaagaaggttaccgaggtgaaagggtacaccaagggtggtccgggtcacgaggagcccatcccgatggcgacctacgggtggaacctagtgaagctccacagcgggaaagacgtattctttatcccgcccgagaagtgtgacacgttgctgtgcgatatcggcgagtccagccccaatccgaccatcgaagaggggagaactctccgtgttttaaagatggtggagccgtggctgaggggcaaccaattttgtatcaagatcctcaacccctacatgccctccgtggtcgagaccctggagcagatgcagcggaagcacggcgggatgctggtacgcaacccccttagccgaaattccacacacgagatgtactgggtttcgtgcggcacggggaacatcgtctccgctgtgaacatgaccagccgcatgctgctgaaccggttcaccatggcacaccgcaaaccgacttacgagcgcgacgtagacttaggggccggcactcggcacgtcgccgtggagccggaggtcgcgaacctggacatcataggtcagagaattgagaatattaaacacgagcacaagtcgacctggcactacgacgaggacaatccatacaagacctgggcctaccacggatcgtacgaggtcaaaccttccggtagcgccagctccatggtgaacggcgtggtgaaactgctcacaaagccgtgggacgtgatccccatggtcacgcagatcgcaatgaccgacaccacccccttcggacaacagcgtgtcttcaaagaaaaggtggacacgcgaacacccaaagcgaaacgagggaccgcgcaaatcatggaagtcacggccaagtggctgtggggcttcctgagccgaaataagaagccgcggatttgcacgcgcgaggaatttacccggaaagtgaggtccaacgcagccatcggtgcagtgttcgttgacgagaatcagtggaacagcgccaaggaggctgttgaggacgaacggttctgggacctcgtgcaccgtgagcgagagttacataagcagggcaagtgcgcgacttgcgtctacaacatgatggggaagcgcgagaaaaagctaggggagttcggaaaggccaagggttccagggcgatctggtacatgtggctcggcgcccgtttcctggagttcgaggcactgggcttcatgaacgaagatcattggttctccagggaaaacagtctctccggcgttgagggggagggcctgcataagctgggatacatccttcgagacatatccaagatcccgggcggcaatatgtacgcagacgacaccgctggctgggatacgaggattaccgaggacgacctgcagaacgaggcaaagatcactgacatcatggagcccgagcatgcactgcttgcaaagagcatttttaagctgacttaccaaaataaggtggtccgcgtccagcggccagccaagaacggaacggttatggatgtgatcagtcgtcgcgaccaacgggggagcggccaggtgggcacctacgggctgaacaccttcaccaacatcgaggcccagctcatccgccagatggagtccgaggagatcttcagcccgtcagagctggaaacgcccaacctggcgggccgggtgctagactggctggagaagcatggtgtcgagcgcctaaagcgtatggccatctcgggcgacgactgcgtggtgaaacccatcgacgaccgattcgccaccgccttgaccgccctgaacgacatggggaaggtccggaaggacattccgcagtgggagccatccaagggctggaacgactggcagcaggtccccttctgtagccaccatttccaccagctgattatgaaggacggcagggagatcgtggtgccttgtcggaaccaagacgagctcgtgggccgagcgcgggttagccaaggcgcggggtggtccctgcgcgagaccgcgtgcctagggaaatcctacgcacagatgtggcagctcatgtacttccaccggcgggacctgcggctagctgccaatgccatctgcagtgccgtcccggtggactgggtgcccaccagtcgcaccacctggtccatccacgcccaccaccagtggatgaccacggaagacatgctcagcgtctggaaccgggtgtggattgaggagaacccctggatggaggacaagacccacatatcctcgtggggcgacgtgccctacctgggtaagcgcgaagaccagtggtgcggctccttaattgggctcaccgcgcgtgcaacatgggcgaccaacatccaggtcgccatcaaccaagtgcgccgcctcatcgggaacgagaactacttagactacatgacgtcgatgaagcggttcaagaatgagtccgatcctgagggggccctctggtga

SEQ ID NO: 24156 - RNA, 9879 nt, synthetic construct
  misc_feature 1..9879: note = derived and/or modified CDS sequence (opt11) from DENV-1__FJ432723__SS-prME
  source 1..9879: mol_type = other RNA
agcgtgaccatgctgctcatgctgatgccgaccgccctggcattccatttgacgacgcgagggggggagccgcatatgatcgtgacgaagcaagagagggggaagagcctgctatttaagaccagcgcgggcgtgaacatgtgcaccctcatagccatggacttgggtgagctgtgcgaggataccatgacctacaagtgccccagaatcacggaggctgagcccgacgacgtcgattgctggtgcaacgccacggacacttgggttacctacgggacctgctcccagacgggagagcaccggcgcgacaagcggagcgtggcccttgccccccacgtcggcctagggctggagacccgtacggagacctggatgtccagcgagggcgcgtggaagcagatacagagagtcgagacatgggccctcagacaccccgggttcaccgtgattgccctgttcctggcccacgccattggtacctccatcacccagaagggtataatcttcattctcctgatgctggtgacgcccagcatggcaatgcgttgtgtaggcatcggctcccgtgactttgtggaggggctctctggagctacttgggtggacgtcgtgctggaacatgggtcttgcgtgaccaccatggcaaaggacaagcccacgctggacattgagctcctgaagaccgaggtcaccaacccagcggtgctacgaaagctctgcatcgaggccaagatcagcaacacaacgaccgactctcgctgccctactcagggcgaggcaaccctgatggaggagcaagatgcgaacttcgtatgccgacgaacattcgtcgaccggggctggggaaacggctgcgggctgttcggtaaggggagcctcattacgtgcgcaaagttcaaatgcgttaccaagttggaggggaagatcgtgcagtatgagaatctgaaatattcagttattgttacagtgcacacgggcgaccaacatcaggtcggtaacgagagcacagagcacggcacaacggccactatcacgccgcaggcaccgacctccgagattcagctcacggactatggggcgctgactctagattgctcgccccgcacaggactagacttcaacgagatggtgctgctcacaatgaaggagaagtcctggctcgtccacaaacagtggttcctggacttacctttaccctggaccagcggggcctccaccagccaggagacctggaataggcaggacctgctggtaaccttcaagaccgcccacgcgaaaaaacaggaggtagttgtgctcggcagccaggagggagccatgcataccgccctgacgggtgcaaccgagattcagaccagcggcaccacaactatattcgcagggcacctgaagtgtcgcctcaagatggacaagctgacccttaagggcatgagctacgtgatgtgtaccggctccttcaagctcgagaaggaggtcgcggagacgcagcacggtaccgtgctagtgcagatcaagtatgaggggaccgacgccccgtgcaagatcccctttagtactcaggatgagaagggggtgacgcagaacggacggctgatcaccgccaacccgatcgtcaccgacaaggaaaaacccgtcaacatagaagcagagccgcccttcggggagtcctacatcgtgatcggcgcgggagagaaggccctgaagctcagctggtttaagaagggatccagcatcggaaagatgttcgaggccacagcccgcggggcccggcgaatggcgatcctcggcgacacggcctgggacttcgggagtatcggcggcgtgttcactagcgtggggaagctggttcaccagatctttggcacagcgtacggggttctgttctccggcgtgtcttggacaatgaagatcggcatcggcgtcctcctgacctggctcggcctgaactcccgcagtacgtcactgagcatgacctgtatcgccgtcggattggttaccctgtacctcggcgtcatggtgcaggccgactccgggtgcgtgatcaactggaaggggcgagagctcaagtgcgggtccgggatcttcgtcactaacgaggtgcacacctggactgagcagtacaagttccaggcggacagcccgaagcgcctgtccgccgcgatcggcaaagcgtgggaggaaggggtgtgcgggatccggagcgccacccggctggagaatatcatgtggaagcagatatccaacgagctcaaccacatcctgcttgagaacgacatgaagttcaccgtagttgtcggggatgtcgtggggatcctagcgcagggcaagaagatgatccggccccaacccatggagcataagtacagctggaaatcctggggcaaggccaagatcatcggggccgacgttcagaacacgaccttcatcatcgatgggcccaacaccccggagtgccccgacgaccagcgtgcttggaatatctgggaggtagaagactacggctttgggattttcaccacaaatatctggctgaagctgcgggacagctacacccaggtgtgcgaccatagactcatgtccgcggcaatcaaggacagcaaggccgtgcacgccgacatgggctactggatcgagtctgagaagaacgaaacctggaaactggcccgggcgtcatttatcgaagtaaagacctgtatctggcccaagtcccacacattgtggagcaacggtgtgctcgagtccgagatgatcattcccaagatctacggggggccgatcagtcaacacaactaccgccccggttacttcacccagaccgccggcccttggcaccttgggaagctggagctcgacttcgacctgtgcgagggcactacggtggtcgtagacgagcactgcggcaaccgggggccatccctacgcaccaccaccgtgacgggcaagataatccacgagtggtgctgccgcagctgcactctgccgccccttcgcttcaagggggaagacggctgctggtacggtatggaaatccggcccgtaaaggaaaaggaggagaacctagtaaagagtatggtctccgcgggcagcggggaggtcgattccttcagcctcgggctgttatgtatctcgatcatgattgaggaagtgatgcgcagccgctggtcacgcaagatgctcatgaccggcacgttggccgtgtttttgctcctcatcatggggcaactgacgtggaatgacttgatccggctgtgcatcatggtcggcgcgaacgcatcggaccgcatggggatgggcacgacgtacctggccctcatcgctaccttcaagatgcgcccgatgtttgccgtgggtctgctcttccggcgcctcacatccagagaggtgctgctcctcaccatcgggctgagcctggtcgcgagtgtggaactcccgaacagcctggaggagctgggtgacgggctcgcgatgggcattatgatcctgaagctgctgaccgacttccagtcccaccagctgtgggccaccctcctgagcttcacgttcataaagaccactttatccctgcactacgcctggaaaaccatggccatggtccttagcatcgtgtccctgttccctctgtgcctcagcacgaccagtcagaagaccacttggctgcctgtgctgctaggcagtctggggtgcaaaccgctgacgatgtttctcattgcggagaacaagatctggggccgcaagtcgtggccactgaacgagggcattatggccgttggagtggtgagcatcttactcagctccctgcttaagaacgacgttccactcgccgggcctttaatcgccggcggcatgctaatcgcctgctacgtgattagtggctccagcgcggacttgtccctggaaaaggccgccgaggtgagctgggaggaggaggccgagcactccggcgcctcgcataacattttggtcgaagtgcaggacgacgggactatgaaaatcaaggacgaagagcgggacgacaccctcaccatcctgctgaaggcgaccctcctggcagtttccggcgtgtacccgctaagcatccccgcgaccctattcgtgtggtatttctggcagaagaagaagcagagatcaggcgtcttatgggacaccccctcgccgcctgaggtagagcgagctgtgctggacgacggcatttatcgcattatgcagcgggggctgctcgggcgctcccaagtgggcgtcggggtgttccaggagaatgtgtttcatactatgtggcacgtaacacgtggcgccgtgctaatgtatcaggggaagaggctggagccttcgtgggcgtccgtgaagaaggacctcatctcttatggcggcggatggcggttacagggttcgtggaatacgggcgaggaggtacaggttatagccgtggaacctgggaagaacccaaagaacgtccagaccgcccctgggacattcaagactcccgagggcgaggttggcgcgatcgctctggatttcaagcccggaacgtcgggcagtcccatcgtgaatcgcgaggggaaaatcgtcggcctctacggcaacggggtggtaaccaccagtggcacctacgtcagcgctatagcccaagcaaaggcctcccaggagggtccgctgccagagatcgaggacgaagtattccggaaacggaacctgacgatcatggacctccaccctggcagcgggaagacccgccgttatctgcctgcgatcgtgcgggaggccatcaagcgcaagctgcggaccttgatcctggcccccacccgcgtagtggcctccgagatggccgaggcactgaaggggatgcctatccggtatcaaacgaccgccgtcaaaagcgaacacaccggcaaagagattgtagacctcatgtgtcatgccacatttacgatgcgactcctgtctcccgttcgcgtgccgaactacaacatgattattatggatgaggcccacttcactgaccccagctctatcgccgcacgagggtacatcagtacccgcgtcggcatgggggaggccgccgcgatattcatgactgcgacaccgcccggctctgtcgaggcgttcccgcaatccaacgcagttatacaagacgaggagcgcgatattcccgagcgctcctggaatagcgggtacgagtggatcacagacttccctggcaagacggtctggttcgtgcccagcatcaagagcggcaacgatatcgcaaactgcctaaggaagaacgggaagagggtaattcagctgtcaagaaagaccttcgacacggaataccagaagaccaagaacaacgactgggattacgtggttaccaccgacatcagcgaaatgggcgccaatttccgcgcggaccgcgttatcgacccccgcagatgtctgaagccagtaatcctgaaggacggccccgaaagagtgatattggccggaccaatgccggtcacggtggcctccgccgcccagagacgcgggcggatcgggcgaaatcacaataaggagggcgaccagtacatctacatgggccagcctctgaataacgacgaggaccatgcgcactggaccgaagccaagatgcttctcgacaatattaacaccccagagggtataatacccgccctgttcgaaccggagcgggaaaagtccgccgccattgatggtgagtaccgccttcgcggcgaggcgcggaagactttcgttgagctgatgaggcgaggggacctccccgtctggttgtcttacaaggttgccagcgagggcttccagtacagcgaccgacggtggtgcttcgacggcgaacgaaacaaccaggtactggaagagaacatggacgtcgagatttggaccaaggagggtgagcgcaagaagctccgcccacgttggctcgacgcccgtacctattcagacccgctggccctgcgggagtttaaagagttcgccgccggccgccggagcgtatcgggtgatctcatacttgaaatcggcaagctgccgcagcacttaacccaaagggcccagaacgccctcgataacctggtgatgctccacaacagcgagcagggagggcgcgcgtatcggcacgcgatggaggaactgcccgatacgattgagacgctgatgctcctggccctgattgccgtcctcaccggcggggtgactctgttcttcctatccggccgggggctcggaaaaactagtataggtttactgtgtgttatggcctcctcagtcctactgtggatggcctccgtcgagccccattggatcgccgccagcatcatcctggagttcttcctaatggtgttgttgatacccgagccggacaggcagaggacgcctcaggataatcagctcgcctacgtcgtgatcgggttgctattcatgatactcacggtcgccgcaaacgagatgggcctgctagagaccaccaagaaagacctcgggatcggtcacgtcgcggtcgagaatcatcaccatgccaccatgctggatgtggatctgcaccccgcctccgcgtggacactctacgcggtagcgactaccatcataacaccgatgatgagacatacgatagagaacacaaccgccaacatctcactgaccgctatcgcgaaccaggcggcgatcctgatgggtcttgacaagggctggcccatttccaagatggatatcggcgtgccccttctggctctcggttgttacagccaggtgaaccccctgacgctgacggccgcagtcctcatgttagtcgcacactacgccatcattggaccgggactacaggccaaggctacccgggaggcccaaaaacgcaccgcggcgggcatcatgaagaaccccaccgtagatgggatcgtcgcaatcgacctcgatccagtggtgtacgacgcaaagttcgaaaaacagctgggtcaaatcatgctgctcatcctatgcacctctcagattttactcatgcgcaccacctgggccctgtgcgaatccatcacgcttgcgaccggtcccttaaccaccctctgggaagggtctccgggcaagttctggaacacgaccatcgcggtcagcatggccaatattttccgtggatcctacctggccggcgctggacttgcgttcagcctgatgaagtctctggggggtggtcgtcgggggaccggggcccagggggagaccctaggcgagaagtggaagcgccagctgaaccaactgtccaagagcgagttcaacacgtacaagcggtccgggatcatggaggttgaccgttcggaggctaaggagggcctcaaaaggggggagacaaccaggcacgccgtatcccggggcaccgcgaagctgcgctggttcgtcgaacgtaacctggtaaagccggaggggaaagtaatcgacctgggttgcggtcgtgggggctggtcttactactgcgccgggctcaagaaggtcactgaggtgaaggggtacaccaagggcgggccgggccacgaggagcccatcccgatggcaacctacgggtggaacctggtgaagctgcactccgggaaggacgtcttttttactccccccgagaaatgtgatactctactgtgtgacatcggggagagctcccccaatcccactatagaggaggggcggaccctccgagttttaaagatggtggagccctggctgcggggcaaccagttctgcatcaagatcttgaacccttacatgcccagcgtcgtggagaccctcgaacagatgcagagaaaacacggcggcatgcttgtgagaaacccactgtcccgcaacagcacacacgagatgtactgggtcagctgcgggacgggcaacatcgtgagcgcggtgaatatgacgtcccggatgctcttgaatagattcaccatggctcatcgcaagccaacctatgagagagacgtagacctgggggcaggcacgcgtcacgtagctgttgagcccgaggtagccaatttagacataataggccaaaggatagaaaacatcaagcacgaacacaagagtacctggcactacgacgaggacaacccctacaagacctgggcgtatcacgggtcttacgaggtgaaaccatctggttcagcctcgagcatggtcaatggcgtggtgaagttgctgactaagccctgggacgtaatcccaatggtaacgcagatcgctatgaccgacaccacgcctttcggccagcagcgagtgttcaaagagaaggtcgacacgcggaccccgaaggccaagcgcgggaccgcccagataatggaggtgacagccaagtggctatggggattcctgagccgcaacaagaagccccgcatttgcacgcgggaggaattcaccagaaaggtgcggtcgaacgcagcgatcggcgccgtcttcgtggatgagaaccagtggaacagcgctaaggaggccgtggaggatgagcgcttctgggaccttgttcagaaggagagggagctccataagcaggggaagtgcgcaacttgcgtctacaacatgatgggcaagcgagaaaagaagctgggggagttcggtaaggccaaagggtcacgggctatttggtacatgtggctgggcgctcgcttcctcgaattcgaggccttaggcttcatgaacgaggaccactggttcagtcgggagaacagcttatccggagtggaaggcgaggggctacacaagctgggatacatcctgcgcgacatttcgaagatccccgggggcaacatgtacgcggacgacaccgccggctgggacacaagaatcaccgaggacgacctccaaaacgaggccaagatcactgacataatggaaccggagcacgccctgctggccacctccatcttcaaactaacttaccagaacaaggtcgtgagagtacagcggcccgccaaaaacggcaccgtgatggatgtaatcagtcgccgcgaccagcggggctccggccaggtcggtacctacgggctgaacaccttcacgaacatggaagcccagctgattcgacaaatggagagtgagggtatattcttgcccggcgagctggagacgccgaatctggccgaacgggtcttagactggctagaaaagtacggggtggagaggctgaagcggatggccatatccggtgatgactgcgtagtcaaaccaatcgacgatcgctttgcgaccgcgctcaccgccctgaatgacatggggaaggtcagaaaggacatcccccagtgggagcccagcaagggttggaacgactggcagcaggtccccttctgctcccaccacttccaccagctgatcatgaaggacggacgggagatcgtcgtgccatgtcggaaccaggacgagttagtcgggcgcgctcgggtcagccagggtgccggatggagcctgagggagacggcgtgcctgggcaagagctacgcgcagatgtggcagctcatgtacttccacaggcgtgacctccgactggccgccaacgctatatgttctgcggtgcccgttgactgggtccctaccagccgcaccacttggagcatccacgcccatcatcagtggatgacgacagaggatatgctcagtgtgtggaaccgggtgtggatcgaggagaacccctggatggaggacaagacccacgtctcgtcctggggcgacgttccgtacctgggaaaacgggaggatcagtggtgcggaagcctgatcgggctcactgccagagccacgtgggcctctaacatccaggtcgcgatcaaccaggtcagacgactcatcggcaacgagaactacctggactatatgacgagtatgaagcgttttaagaatgagggggaccccgagggagccttatggtga

SEQ ID NO: 24157 - RNA, 9879 nt, synthetic construct
  misc_feature 1..9879: note = derived and/or modified CDS sequence (opt11) from DENV-1__FJ410192__SS-prME
  source 1..9879: mol_type = other RNA
tcagtgaccatgctgttgatgttaatgccaaccgccttggccttccacctgacaacgagagggggggagccacacatgatcgttagcaagcaggagcgagggaagagcctactgttcaaaactagcgccggggttaatatgtgtaccctcatagccatggacttaggcgagctgtgcgaggacaccatgacctataagtgcccccgaatcacagagaccgagcccgacgacgtggactgctggtgcaacgccaccgacacctgggtgacctacggaacctgcagccagacgggcgagcaccggcgagacaagcggagcgttgcattggcccctcacgttggcttggggttggaaacccgcaccgaaacctggatgagctctgagggcgcctggaagcaaatacagcgggtcgaaacatgggccctcagacacccggggttcacagtgatcgcccttttcctggcccacgctatcgggacctcaatcacccaaaaggggatcatctttatcctcctgatgctggtcactccctccatggccatgcggtgcgtcggcatcgggagccgcgatttcgttgaggggctctctggcgccacgtgggtggacgtggtactggagcacggaagttgcgtgactacaatggccaaggataagcccacgctggacatcgagctcttaaaaactgaagtgacgaaccccgccgtccttcgcaagctctgcatcgaggcaaagatctccaatacgacgacagacagccgctgtccgacccagggcgaagctaccctggtggaagagcaggacgctaacttcgtgtgccggcgcaccttcgtagacaggggctggggaaacggctgcgggcttttcggaaaggggtccctcatcacttgtgccaagttcaagtgtgtgaccaaactggagggcaagatcgttcaatacgagaacttgaagtacagcgtgatcgtgacagtccacacgggcgaccagcaccaggttgggaacgaatcaaccgagcacggaaccaccgcgactattacgccacaagcccccacgaccgagatacagctcaccgactacggtgccctgactctggactgcagccccaggaccggattagatttcaacgaaatggtcctgctgacgatgaaggaaaagtcctggctcgtgcacaagcagtggttcctggacctgcctctcccatggactagcggggcctccacgtcacaggagacctggaatcggcaggacttattggtgacgttcaagacagcccacgccaagaagcaagaggtggtggtcctcggcagtcaggagggcgcgatgcacaccgccctgaccggtgcgaccgagatccaaacctccggcactaccacaattttcgccggtcacctgaagtgccgcctcaagatggacaaactgaccttgaagggtatgagctacgtcatgtgcacgggttccttcaagcttgagaaagagctggccgagacccagcacggcaccgtgctggtgcagatcaagtacgaaggcaccgacgcgccctgtaagatcccgtttagcacgcaggacgagaaaggggtcactcagaacggccgcctgataaccgctaacccgatagtcaccgacaaggagaagccggtaaatatcgaggcagagcccccctttggagaatcatacatcgtgatcggtgccggcgagaaggcgctcaagctgagctggttcaagaagggctccagcattggcaagatgttcgaggccacggcccgcggcgctcgccgcatggccatcctgggtgatactgcgtgggacttcggtagcatcgggggcgtgttcacctcggtcggcaagctcgtccaccagattttcggcacggcctacggggtgctgttcagtggcgtgagctggaccatgaagatcgggatcggcgtcctgctcacctggctgggcctgaactcccgctctacatcgctcagtatgacctgcatcgccgtggggctggtgacgctgtacctcggcgtcatggtccaggccgactccggctgcgtgatcaactggaaagggcgggagctgaagtgtgggtctggcatcttcgtaactaatgaggtccacacctggaccgaacagtacaagttccaggccgactccccgaagcgattatccgcggccatcgggaaggcgtgggaagagggggtatgcggcatcagaagcgcaacgagactagagaacatcatgtggaagcagatatccaatgagctgaatcacatcctgcttgagaacgatatgaaattcacggtcgtggtcggcgatgttgccggcatcctagcgcaggggaagaagatgatccggcctcaacccatggaatacaagtactcctggaagtcctggggcaaggccaagatcatcggtgcggatgtgcaaaacaccaccttcattatcgacgggcccaataccccggagtgcccggacgaccagagggcctggaacatctgggaagtggaggactacggctttgggatcttcacgacaaatatctggttgaagctccgggacagctatacccaggtttgcgatcaccgcctgatgtccgcggcaataaaggactcgaaagcggtgcatgcagacatgggttactggatagagtccgagaaaaacgagacttggaagttagcacgggctagcttcatagaagttaagacgtgcatctggcccaagtcccacaccctctggagcaacggcgtcctggagtccgagatgataatacccaagatatacggcggaccgatcagccagcacaactaccgccccgggtacttcacccaaaccgccggcccctggcacctcggcaaactcgaactggacttcgacctgtgcgagggtacgaccgtggtagtcgacgaacactgcggcaaccgcgggccgtccctacgtactaccactgtgaccggcaagatcattcacgagtggtgctgtcgcagctgtaccctgccgcccctacgcttccgcggggaggacggctgctggtatggaatggagattcgcccagtcaaagagaaggaggagaacctcgtcaaatctatggtgagcgccggcagtggcgaagttgactccttttcactggggctcttgtgcatcagtatcatgatcgaagaggtcatgaggagccgctggtcccggaagatgctgatgaccggcacgctggccgtgttcttcctcctgatcatggggcagctgacctggaacgatctaatcagactgtgtataatggtgggtgccaacgcgagcgaccgtatggggatgggcactacctaccttgccctcatggccactttcaagatgcggccgatgttcgccgtgggactgctgttccgccggctcacctccagagaggtgttactgctcaccataggactgtcgctggtggcaagcgtcgagctccctaacagcctagaggagctgggcgacgggctcgcgatgggaatcatgatcttaaagctgctgactgacttccagtcgcaccagctgtgggcgacgctgctctcccttacattcatcaagaccacgttcagcttgcactacgcctggaagactatggccatgatcttgagcatcgtgtcgctgttccccctctgcctcagcaccacatcccagaaaactacctggctgcccgtcctgctaggctcgcttgggtgcaagccgctgacgatgttcctcattgcggagaacaagatctggggccgtcgctcctggccgcttaacgaagggatcatggcagtgggcatcgttagcatccttctcagctcactgctgaagaacgacgtaccgctcgccggaccactgatcgcgggcggcatgctgatcgcctgctacgtgatatcagggagtagcgcggacctctccctggagaaagctgccgaagtgagctgggaggaggaggccgagcacagtggcgcaagccataacatcctggtcgaggtgcaggacgacgggaccatgaaaattaaggatgaggagcgggacgataccttaaccatcctgctcaaggcgaccttgctagcggtgagtggcgtctaccctttaagcatcccggcgaccctctttgtgtggtatttctggcaaaagaagaagcagcgcagtggggtgctgtgggatactcccagcccgccggaggttgagcgggctgtgcttgacgacggcatataccgcatcatgcagcggggcctgcttggacgctcccaggtcggggtaggcgtgttccaggagaatgtgttccacaccatgtggcatgtaacgcgcggcgcggtgttgatgtaccagggcaaacgcctggagcctagctgggcgtccgtgaagaaagacctcatcagctacggcggtgggtggcggctgcagggatcctggaataccggggaggaggttcaggtcatcgccgtggagccaggtaaaaaccccaagaacgtacagaccgctcctggaaccttcaagacgcccgagggcgaggtgggcgccatcgccctcgacttcaaacccgggacaagcgggtcccccatcgtaaaccgcgaggggaagattgtcggcctctacggcaacggggtggtgactactagcggcacttacgttagcgcgattgcccaggcaaaggcctcccaggaggggccgctacccgaaatcgaggacgaggtgtttcggaagcgaaacctgaccataatggatctccaccccggcagtggtaagaccagacgctacctgccggcgatagtgcgggaggccatcaaacgcaagttgcgcacccttatcctggcaccaacgcgggtcgtggcatccgagatggccgaggcgctaaagggcatgcccatccgctatcagaccaccgccgtgaagagcgagcacaccggcaaggagatcgttgacctcatgtgccacgccactttcaccatgcggctgctttccccggtgcgagttccgaattataacatgatcatcatggacgaggcccactttacagaccctagcagtatcgccgcgagggggtacatttcgaccagagtcgggatgggtgaggccgctgccatctttatgactgccacgccgcccggctccgtggaagcgttcccgcagtctaatgccgtgatccaggacgaggagcgagatatacccgagcgcagttggaacagcgggtacgaatggatcaccgacttccccgggaagacggtctggttcgtgccctcaataaagagcggcaatgacattgctaattgcttacgaaaaaacgggaagcgcgtgatccagctgtcgagaaagacgtttgatacagaataccagaaaactaagaataacgactgggactacgtcgtgaccacggacatctccgagatgggtgcaaattttcgcgcggaccgggtaattgaccctcgccggtgtcttaagcccgtcatcctgaaggatgggcccgagcgcgtgatcctggccggccccatgccggtgaccgtggcctccgcggcccaacggagggggcggataggccgcaatcacaacaaagagggcgaccagtacatttacatgggccaacctctgaacaatgacgaggaccacgcgcactggaccgaggccaagatgttactggacaatattaacacacctgaggggataatcccggccctgtttgagccggagcgggagaagtccgccgccatcgacggggagtaccggctacgcggcgaggcgcggaaaacgttcgtggagctgatgcgccgcggtgacctgccggtgtggctctcctacaaggtggcgtcggagggcttccagtacagcgaccgccggtggtgcttcgatggggagcgcaataaccaagtactggaggagaacatggatgtcgaaatttggaccaaggagggggagcggaagaagttacgcccccggtggctggacgcccgcacatactccgacccactagccctgcgggagttcaaggagttcgcagcggggcgacgatcggtatccggggacctgatactggagattggcaagttaccgcagcacctcacccagcgggcccagaacgcacttgacaatctagtaatgctccacaactctgagcagggcgggcgggcttatcgtcacgctatggaggagctgcccgacacgatcgagaccctgatgctcctggcccttattgcggttctcaccggcggcgtgacccttttcttcctgtctggccggggtctcggcaaaacctcgataggactattatgcgtgatggcttcctcagtcttgctctggatggcgtcggtggagccgcactggatcgcggcatctatcatccttgagttcttcctcatggttctgctgatccccgagcccgaccgccaacggactcctcaagacaaccagctcgcctatgtcgtgatagggctgctgttcatgatactcaccgtcgcggcgaacgagatgggcttgctggagaccaccaaaaaagacctggggatcggccacgtagcggtggagaaccaccaccacgccgctatgctagacgtggacctacaccccgcctcggcctggacgttatacgccgtcgcgaccaccataatcacccccatgatgcgccacacaatcgaaaataccaccgccaacatcagcctgaccgccattgccaaccaggctgctatcctaatgggcttagataagggctggccgataagcaaaatggacatcggtgtacccctgctggcactcgggtgttacagccaggtgaacccactgacacttaccgccgcggtgctcatgctcgtggcccactacgccatcataggcccgggcctgcaggccaaggccacacgcgaggcgcagaaaaggaccgctgcgggcatcatgaagaaccccacggtggacggcatcgttgccatcgacctcgaccccgtggtctatgacgccaagttcgaaaagcaactgggccaaataatgttactcatcctgtgtacctcccagatactactcatgcggaccacctgggcgctgtgtgagagcatcactctagcaactggcccactaaccaccctgtgggaaggatcccccggcaagttttggaacacgaccatcgccgtttcgatggccaacatattccggggatcctacctagcaggggcgggtctcgccttcagcctaatgaagtccctcgggggcgggcgcagggggacaggcgcccagggcgagaccctcggcgagaaatggaagcgccagctgaatcagctctcaaagagtgaattcaatacctataagcggtcaggtatcatggaggtagatagaagcgaagccaaggagggtctcaagcgcggggagactaccaaacacgcagtgtcacgcgggaccgccaaactgcggtggttcgtagagcgcaacctggtgaagcccgaaggaaaggtgatcgacctgggctgcggcagaggcgggtggagctactactgtgccgggctcaaaaaggtgacggaggtgaaaggatacacaaaaggcggccccggacacgaggagcccatacctatggccacctacgggtggaacctggtgaaactgcactcgggtaaggacgtcttcttcatcccccccgagaagtgcgacaccctcctgtgcgacatcggggagagctccccgaacccgacgatcgaagagggcaggacgttgcgcgtgctaaagatggtggagccctggctgcgcgggaaccagttctgcatcaagatcttaaacccctacatgccatccgtcgtggagactctcgagcagatgcagcggaagcacggcggcatgctggtgaggaacccgctatcgcggaacagcactcacgaaatgtactgggtctcctgtgggaccggcaacatagtcagcgccgtgaacatgacgtctcgcatgctactgaaccgcttcaccatggcacaccgtaagccaacctacgagcgcgacgtcgacctgggggcgggcacccggcacgtggccgtggaaccggaggtagccaacctcgatatcatcggccagcgaattgaaaacataaagcacgagcacaaaagcacgtggcactacgatgaggacaacccttacaagacctgggcctatcacggatcctatgaagtgaagccgagtggtagcgcgagcagcatggtaaatggcgtcgtgaagttgctgacgaagccctgggacgtcatccccatggtgacccaaatcgctatgaccgacaccacaccctttggccagcagcgtgtgttcaaagagaaagtggacacccgcacgccgaaggccaagcgtgggaccgcccagataatggaggtcaccgccaagtggctctggggcttcctctcccgcaacaagaagcccaggatatgtacccgcgaggagttcactcgcaaggtgcgcagcaacgcggcgataggagctgtcttcgtggacgagaaccagtggaacagcgccaaagaggccgttgaggacgagcgtttctgggacctggtccaccgcgagcgggagttacacaagcaggggaagtgcgcaacctgcgtgtacaacatgatggggaaacgagagaaaaagctaggagaattcggcaaggccaaaggtagcagagccatctggtacatgtggctgggcgcccgcttcctggaatttgaggctcttgggttcatgaacgaggaccactggttctccagggagaacagcctgtccggggtcgaaggcgaagggctccacaagcttggttatatacttagggacatcagcaagatccctgggggcaacatgtacgccgacgacactgcaggctgggacacacgtatcacggaggacgatctgcagaacgaagcccgcataactgacatcatggagccggaacacgctctactggcgaagtctatcttcaaactcacctaccagaacaaggttgtgcgcgtgcagagccccgccaaaaacggtacagtcatggacgtgatctcccggcgagaccagcggggcagcggccaagtgggaacgtatggtctgaacaccttcactaacatggaggcgcagctgatccggcaaatggagagtgaggggatctttagcccgtctgagctcgagacacccaaccttgcagagcgggtccttgactggctcgaaaagtacggcgtggagagactgaaacgtatggccataagcggggacgactgcgtcgtgaagccgatcgatgatcgctttgcgaccgctctgacagccttaaatgacatgggcaaagtgaggaaggacatcccccagtgggagccctccaaggggtggaacgactggcagcaggtccccttttgtagccaccatttccaccagctgatcatgaaggatggccgagagattgttgtgccgtgcagaaatcaggacgaactggtaggccgcgcccgggtatcgcagggggctggctggtcgctccgtgaaacggcttgccttggaaagagctatgcccagatgtggcagctgatgtactttcaccggcgcgatctacggctagccgccaacgcgatctgctccgccgttccagtggattggatacccaccagccgcacgacctggtccattcatgcccaccaccagtggatgactacagaggacatgctgtctgtctggaaccgggtatggatcgaagagaacccctggatggaagacaaaacgcacatctcctcctggggcgacgtgccttacctcgggaagcgcgaggaccagtggtgcggatccctaatcggcctgacggcccgcgccacctgggcgaccaacattcaggtcgccatcaaccaggtgcggcgcctaatcgggaacgagaactacctggactacatgacaagcatgaagagatttaagaacgaatccgaccctgagggtgccctatggtga

SEQ ID NO: 24158 - RNA, 9879 nt, synthetic construct
  misc_feature 1..9879: note = derived and/or modified CDS sequence (opt11) from DENV-1__FJ410194__SS-prME
  source 1..9879: mol_type = other RNA
agcgtgacgatgctgctcatgttaatgcccacggccctggccttccacctcaccactaggggtggggaaccccatatgatcgtcagcaagcaggaacggggcaagagcttgctattcaagacgagcgccggggtgaacatgtgcaccctcatcgccatggacttgggcgaactgtgcgaggacacaatgacttacaagtgcccgcgcatcaccgagaccgagcccgacgacgttgactgctggtgcaacgccacggatacctgggtgacctacgggacctgcagccagactggtgagcaccggcgcgataaacggagcgtcgccctcgcgccgcacgtgggcctggggctggaaacccgcaccgaaacctggatgagctccgagggcgcgtggaaacagatccagcgggtcgagacgtgggccctccgccacccagggttcaccgtgatcgccctgttcctggcccacgcgatcggcaccagcatcacccagaaggggatcatcttcatcctcttgatgctggtgacgccctccatggccatgcggtgtgtcggcataggcagtcgggacttcgtggaggggctgtcaggtgccacgtgggtggacgtggtgctggagcatgggagctgcgtgaccaccatggccaaggacaagcccacgctggacatcgaactgctaaagactgaggtaaccaaccccgccgtgctgaggaagctctgcatcgaggcgaagatctccaacaccacgaccgacagccgctgccccacgcaaggcgaggccaccctggtggaggaacaggacgcaaacttcgtctgccggcgtacgttcgtggaccggggttggggtaacggctgcgggcttttcggcaaggggtccctcatcacttgcgccaagttcaagtgcgtgaccaagctggagggcaaaatagtccagtatgagaacctgaagtacagcgtgattgtgactgtccacacgggcgaccagcaccaggtggggaacgagtcgactgagcacgggaccacggccaccatcacgccccaggcgcccaccactgagatccagctgaccgactacggggccctgacgctggactgttcaccccgcaccggcctcgacttcaatgagatggtcctgctgacgatgaaggagaagtcctggctcgtgcacaagcagtggttcctggacctgccactcccctggaccagcggggcgagcacgtcccaggaaacctggaaccgacaggacctcctggtgacgttcaagaccgcgcatgccaagaaacaagaggtcgtagtgctcggtagccaagagggggcgatgcatacggccctgaccggtgccaccgagatacagacctccggaacgacaaccatattcgccggtcacctcaaatgccgtctcaagatggacaagctcaccctgaagggtatgtcctacgttatgtgcacggggtccttcaaacttgagaaggaggtggccgagacccagcatggcaccgtgctggtgcaaatcaagtacgagggaaccgacgcgccctgtaagatccccttcagcacgcaggatgagaagggggtgacccaaaacggccggctgatcaccgccaacccgatcgtgactgataaggaaaaacccgttaacatcgaggccgagccacccttcggggagtcctacatcgtcatcggcgcaggcgaaaaggcgctgaagctcagctggttcaagaaggggtcctccatcggcaagatgtttgaggcgacggcccgcggtgcccggcgcatggccatcctgggcgacaccgcgtgggacttcgggtccataggcggcgtgttcacctccgtcggtaagctggttcaccagatcttcggaaccgcgtacggggtactcttctccggcgtcagctggacgatgaagatcgggataggcgtgctgctgacatggctcggtctgaactcccgtagcacatccctgagcatgacctgcatagccgtggggctcgtcacgctgtacctgggcgtgatggtacaggccgactccggctgcgtcattaactggaagggcagggaactcaagtgcggcagcggcatcttcgtgacaaacgaggtgcacacctggaccgagcaatacaagttccaggcggacagtcctaagaggctgtccgcagccatcggcaaggcctgggaggaaggggtgtgcggcatccggagcgccacccgcctggagaacataatgtggaagcagatctccaacgagctcaaccacatccttttagagaatgacatgaagtttacggtggtggtcggggacgtggcgggcatcctcgcgcaggggaagaagatgatccggccccagcccatggagtataaatacagctggaaatcgtggggcaaggccaagataatcggtgcagacgtgcaaaacacaactttcatcatcgacgggcccaacaccccggagtgccccgatgaccagcgcgcctggaacatctgggaggtcgaggactacggtttcgggatcttcacaaccaacatctggttgaaactgcgggacagctacacccaagtgtgcgaccaccgcctgatgtccgcggccattaaggattccaaggccgtgcacgccgacatgggctactggatagagtccgagaagaatgagacctggaagctggcccgagcgtctttcatcgaggtaaagacttgcatatggcccaagagccacaccttatggagcaatggcgtgctcgagtccgaaatgatcattcccaagatttacggtggccccattagccagcacaactaccgcccggggtacttcacgcaagccgccggcccctggcatttagggaagttagaactcgatttcgacctgtgcgaggggacgacggtggtggtggatgaacattgcggcaaccgagggccgtccttgcgcacaacaactgtgactggcaagatcatccacgagtggtgctgcagaagctgcaccctgcctcccctccgctttagaggggaggatggatgctggtacggaatggagatccgtccggtcaaggagaaagaggagaacctggtgaagtccatggtgagcgcaggctcgggcgaggtagactccttcagtctcgggctgctgtgcatctccatcatgatcgaggaggttatgcggtcgaggtggtctcggcgcatgctcatgaccggcaccctggcggtgttcttcttactcataatggggcaactgacgtggaacgacctgatccgcctctgcatcatggtcggtgcgaacgccagcgaccgaatggggatgggcacaacctacctggcactgatggcaacgttcaagatgcgcccgatgttcgccgtgggcctcctgttccgtcgcctgacgtcccgggaagtgttactgctgaccatagggctcagcctcgttgcgtccgtggagctgcccaacagcctcgaggagctgggcgacgggctggccatggggattatgattctcaagctgctgaccgacttccaatcccaccagctctgggccaccctgttaagcctcacgttcatcaaaaccaccttctccctgcattacgcctggaagaccatggcgatggtcttaagcatcgtgtccctctttcccttatgcctgagcacgacttcccagaagacgacctggctccccgtgctgttgggcagcctcgggtgtaagccgctgacgatgttcctgatcgccgagaacaagatctggggcagacggtcctggcccctcaatgaggggataatggctgtcggaatcgtgagcatcctgctgagcagtctcctgaaaaacgacgtgcccctagcagggccactcatcgccggtggcatgctgatcgcgtgctacgtcatcagcggttcctccgccgatctgtccctagagaaggccgccgaagtgagctgggaggaggaggctgagcactccggcgcgagccacaatatcctggtggaggtccaagatgacgggaccatgaagatcaaggacgaagaacgcgatgacacgctgaccatcctcctgaaggccacactactcgcggtgtccggcgtgtacccactaagcattccggctacgctgttcgtgtggtacttctggcagaagaagaagcagcggtccggggtgctctgggacaccccatccccgcccgaggtagaacgcgccgtcctggacgacggaatctaccggatcatgcagcgcggcctgctggggcggagccaggtgggcgtgggggtcttccaggagaatgtgttccacaccatgtggcacgttacccgcggcgcggtcctcatgtaccaggggaagcggctggagcccagctgggcatccgttaagaaggacctgatcagctacggcggcggctggcgcttgcagggctcctggaacacgggcgaggaggtccaggtcattgccgtggagcccggcaagaacccaaagaacgtgcagaccgcccccgggactttcaagacccccgaaggcgaggtcggcgccatcgcgctagactttaagcccgggacgagcggctccccgattgtgaaccgggaggggaaaatcgtggggctgtacggcaatggggtagtgaccaccagcggcacatacgttagcgccatcgcccaggctaaggcgtcccaggaggggccactccccgagatcgaagacgaggtcttccgcaaacggaacctgacgatcatggatttgcaccccggtagcgggaaaacacgccggtacctcccagccatcgtgcgcgaggccatcaagaggaagctgcgaaccctgatcctcgccccgacccgcgtggtagcatccgagatggcggaagccctaaagggcatgcccatccggtaccagacgaccgccgtcaaatccgagcacactgggaaagaaatcgtggacctcatgtgccacgccaccttcacgatgcgcctcttgtcccccgtccgggtgccgaactacaatatgatcatcatggacgaagcccactttaccgacccgtcgagcatcgcagctcgcgggtacatcagcacgcgcgtgggaatgggggaggcagccgccatcttcatgacagcgacgccgcccggctccgtggaggccttcccgcaaagtaacgccgtgatccaggacgaggagcgcgacattcccgagcggtcctggaacagcgggtacgagtggatcaccgactttcccggcaagactgtgtggttcgttccctcgatcaagagcggcaacgacatagccaactgcctgcgcaagaacggtaagcgggtgatccagctgtccaggaaaaccttcgatactgaataccagaagaccaagaataacgactgggactacgtggtcaccaccgacataagcgagatgggcgcgaacttccgggccgaccgggtcatcgatccgcggcgctgcctgaagcccgtgatactgaaggacggtcccgagcgggtcatcctcgccggccccatgccggttacggtcgcctccgccgcgcagcgccgggggcgcatcggccgcaaccacaacaaagagggagaccaatatatctacatgggtcaacccctgaacaacgacgaggaccatgcccactggaccgaggccaagatgctgctcgacaacatcaacacgccggaaggcatcatccccgccctcttcgagccagagagggagaagtccgccgctatcgacggggagtatcgcctgagaggggaggcacgcaagacgttcgtggagctcatgcggcgcggggacctgcccgtgtggctttcctacaaagtcgccagcgagggcttccagtacagcgatcggcgctggtgtttcgacggcgagcggaacaatcaggtgctcgaggagaacatggacgtagagatctggacgaaggagggggagagaaagaagctgcgaccccggtggctggacgcccgaacctactccgaccccttagccctgcgcgagttcaaggagttcgccgccggacggcgcagcgtctccggagacttgattttagaaatcggcaagctaccgcaacacctgacacagcgggcccagaacgctctcgataatctggtcatgctccacaacagtgagcagggtgggcgcgcataccggcacgccatggaggagctacccgacactatcgagacgctcatgctgctcgcccttatcgctgtgctgaccggcggggtcacactcttctttctgtccggccgcgggctaggcaagaccagcatcggtctcctgtgcgtcatggcctcctcagttctgctgtggatggcgtccgtagagccgcactggatcgccgccagcatcatcctggagttcttcctgatggtactcctgatacccgaaccggaccggcagcgtacgcctcaggacaaccagctcgcctacgtggtcatcgggttactgttcatgatcctgacggtggccgcgaatgagatgggcctccttgagacgaccaagaaggacctcgggatcggccacgtggctgtagagaaccaccatcatgccgccatgctcgacgtggacttacaccccgcctccgcttggaccctgtacgccgtggccactacaatcatcacccctatgatgagacacaccatcgagaatacgacggcaaacatcagcctcaccgccatcgcgaaccaggccgccatcctaatggggctggacaagggctggcccatatccaagatggacatcggcgtccccctgctggccttggggtgctattctcaggtgaatcccctcaccctgacggcagccgtgctcatgctcgtcgcccactatgccataataggtccggggctgcaggccaaggcgacccgggaggctcagaaacgaaccgccgcaggcataatgaaaaatcccaccgtagacgggatagtggccatcgacctggaccccgtcgtgtacgacgcgaagttcgagaagcagctcggccagattatgctattgatcctctgcacgtcccagatcctgctgatgagaaccacctgggccctctgcgaatcaatcacgctggccacgggccccctgaccacactctgggaggggagtccggggaagttctggaataccacgatcgccgtaagcatggccaacatcttccgcgggtcctacctggcgggcgccggactggccttcagcctcatgaaatccctcggagggggtcggcggggtaccggcgcccagggcgagacgctaggcgagaaatggaaacggcagctcaaccagctgtccaagagtgagttcaacacctacaagcgctccgggatcatggaggtcgataggagtgaggccaaggagggtctgaagcgcggggagacgaccaagcatgccgtgtcccggggcaccgccaaactccgctggttcgtggagcggaacctggtcaaaccagaggggaaggtgatcgacctgggctgcggccgagggggctggtcgtactactgcgccgggctgaagaaggttaccgaggtcaaaggctacactaagggcgggccgggacacgaggagcccatccccatggcaacctacgggtggaacctggttaagctgccctccggcaaagacgtgtttttcatcccgcccgagaagtgcgacaccctcctctgcgacatcggggagagctccccgaaccctacgatcgaggagggtcggacgctgcgcgtcctgaaaatggtggagccctggctccggggtaaccagttttgcattaaaatcctgaatccctatatgccgagcgtggtcgagaccttggagcagatgcagcgcaagcacggcggcatgctcgtgcggaaccccctctcgcgcaacagcacccacgagatgtactgggtgtcctgcggtacaggcaatatcgtcagcgcggtgaatatgacgtccagaatgctgttaaaccggtttaccatggcccacaggaagcccacctatgagcgggacgtggatctgggtgcgggaacccgtcacgtcgccgtagaaccagaggtggcaaatctggacataataggccagcggatcgagaacatcaagcacgaacacaagagcacctggcactacgacgaagacaacccgtacaagacgtgggcgtatcacgggtcctacgaggtcaagcccagcggctccgcgagctcaatggtgaacggggtcgtaaaactcctgacaaagccctgggacgtgatccccatggtcacccagatcgccatgaccgacacaaccccgttcggacagcagcgcgtgtttaaggagaaggtggacacccggacccctaaggctaagcgcggtacggcccagattatggaagtcaccgcgaagtggttatggggcttcctctcccggaacaagaagccccgcatctgcacccgggaggagttcacgaggaaggtgcggagcaacgccgccatcggggcagtgtttgtcgacgagaaccagtggaacagtgcgaaggaagcagtggaagacgagcgcttctgggacctggtacaccgggagcgagagctgcacaagcaggggaagtgcgcaacgtgcgtgtacaacatgatgggtaagcgggagaagaaacttggagagtttggcaaagccaaggggtcgcgcgccatctggtacatgtggctgggtgcgcggttcctggagtttgaggccctcggcttcatgaacgaggatcactggttttccagggagaatagcttaagtggggtggagggcgaggggctgcacaagctaggctacatccttcgggacatcagcaagatccccggaggcaacatgtacgcggacgacacggccggctgggacacccgcatcacggaggatgacctgcagaacgagccccgcataacggacataatggaacccgaacacgccctcctggcgaagtccatattcaagctgacctaccagaacaaggtcgtccgcgtgcaaagccccgccaaaaatggaaccgtgatggacgtcatatcccggagagaccagcgcggtagcggccaggtggggacctacggcctcaacacgtttaccaacatggaggcccagctgatccggcagatggagtccgaggggatcttttcgccgtccgagctggaaacccccaacctagccgagcgcgtgctggattggctggagaagtacggcgttgagaggctcaaacgtatggccatcagcggggacgactgcgtggttaagcccatcgacgaccggttcgcgaccgccctgacggccctgaacgacatgggcaaggtccgcaaggacatcccccagtgggaaccgtctaaggggtggaacgactggcagcaagtgcctttctggagccaccatttccatcagctcatcatgaaggacggcagagagatcgtggtcccctgccgcaaccaggacgagctggtgggccgtgcacgcgtgagccaaggggcaggttggtccctgcgggagaccgcgtgcctcgcaaagagctacgcccagatgtggcagctaatgtatttccaccgcagggacctgcgcctcgctgcgaacgcaatctgctcagccgtcccagtggactggatcccgaccagccggaccacgtggtccatacacgcccaccaccagtggatgaccaccgaggatatgctgtctgtgtggaaccgggtatggatcgaagagaacccctggatggaggacaagacccatatctccagctggggcgacgttccgtacctgggcaagcgcgaggaccagtggtgcgggagcctcatcggcctgacggcgcgggcgacctgggccaccaacatccaggtcgcaatcaaccaggtccgccggttgatcggtaacgagaattatctcgactacatgaccagcatgaagcgcttcaagaacgagtccgaccccgagggggccctgtggtga

SEQ ID NO: 24159 - RNA, 9879 nt, synthetic construct
  misc_feature 1..9879: note = derived and/or modified CDS sequence (opt11) from DENV-1__FJ432725__SS-prME
  source 1..9879: mol_type = other RNA
agcgtgaccatgctactcatgctgatgcccaccgccttagcgttccacctcacgactcgaggaggggaaccccacatgatcgtaagcaagcaagagcggggcaagagcctgctgttcaagacctcggccggggtgaacatgtgcaccctcatcgccatggatctgggcgagctgtgcgaagacactatgacctataagtgcccccgcatcaccgagaccgaacccgacgacgtagactgttggtgcaacgccacggacacctgggtcacctatgggacgtgcagccagactggggagcaccggcgcgataagcggtccgtggctttggcgccgcatgtgggactgggcctggagacccgcaccgagacctggatgagctcagaaggggcctggaagcaaattcagcgggtggagacgtgggccctacgccaccccgggtttacggtcatcgcactgttccttgcccacgcgattggcaccagcatcacccagaaaggtatcatcttcattctcctgatgctggtgacgccttccatggccatgcggtgcgtgggcatcggcagcagggacttcgtggagggcctctcaggtgccacctgggtggacgtcgtgctagagcacgggagctgcgtcaccactatggctaaggacaagcccacgttggacatcgagttgctcaagacggaggtcaccaacccggcggttctgcgcaagctctgcatcgaggctaagatctcgaataccaccaccgacagtcgctgcccgacccagggcgaagcgacgctggtggaggagcaggacgccaactttgtgtgccggcgcactttcgtggaccggggctggggaaacgggtgcgggctgttcggcaaggggtccctcatcacatgcgccaagttcaagtgcgtgactaagttggagggcaagatcgtccagtacgaaaacctcaaatattcggtgatcgtgaccgtccacacgggtgaccagcaccaggtggggaacgaatccaccgagcacggcactaccgccaccatcacaccccaggctcctaccaccgagatccagctcaccgactacggggccctgacgcttgactgtagccccagaaccggcctcgacttcaacgagatggtactgctgaccatgaaggagaaaagttggttagtccacaaacaatggtttctggatttgcccctgccctggaccagcggggcctcgacgtcccaggaaacttggaaccggcaggacctgctggttacgttcaagactgcccacgccaagaagcaggaggtcgtagtcctcggctctcaggagggtgcgatgcatacagccctgaccggggccaccgagatccaaacaagtggtacgacaactatcttcgccgggcacttaaagtgccgtctgaagatggacaagctgaccctgaagggtatgagttacgtcatgtgtacaggatccttcaagctcgaaaaagaggtggcagaaacccaacacggcaccgtgttggtccagattaagtatgaaggcaccgacgccccgtgcaagatcccctttagcactcaggacgagaagggggtgacccagaacggcaggctgataaccgccaacccgatcgtgaccgacaaggaaaagcccgtcaacatcgaagccgaaccgcccttcggggagagttacatcgtgatcggcgccggcgagaaggcgttgaaactcagctggttcaagaaggggtcctcgatcggcaagatgttcgaggccacggcccgcggggcccggcggatggccattctgggcgacaccgcgtgggatttcgggtccatcggtggcgtgttcaccagcgttggaaagctggtgcaccaaatcttcggcactgcctacggggtcctgttctccggcgtcagctggacgatgaagatcgggatcggcgtactgcttacctggctcggcctcaactcccgaagcacgtcactgagcatgacctgtatcgccgttgggctcgtcacgctttacctgggggtgatggtccaggctgactcggggtgcgtcatcaactggaagggcagggagctcaaatgcgggagcggaatctttgtcacaaacgaggtgcacacatggacggagcagtataagttccaggctgacagcccgaagcgcctgtccgcggcaatcggcaaggcttgggaggagggcgtgtgcggcatccggagcgccacccgcctagaaaacatcatgtggaagcagatctccaacgagctcaaccacatcctgctagagaacgacatgaagttcaccgtggtagtcggggatgtggctggcattcttgcgcaaggtaagaagatgattcggccccagcccatggagtacaaatacagctggaagtcctggggaaaggccaagatcatcggagcggacgtgcaaaacaccaccttcatcatcgacgggcccaataccccggagtgccccgacgaccagcgtgcttggaacatctgggaggtggaggactacgggttcgggattttcacgacgaacatatggctaaaactccgggacagctacacacaggtgtgcgaccatcgtctaatgtccgctgccataaaggactcgaaagctgtgcacgccgacatgggctactggatcgagtccgagaagaacgaaacctggaaacttgcccgggccagctttatcgaggtcaagacttgcatctggccaaagtcccataccctgtggagcaacggcgtgctggagagtgagatgatcatcccgaagatctatgggggccccatcagccagcacaactaccgtccgggctacttcacccaggcagccggaccatggcacctgggaaagctggagctcgacttcgacctatgcgaaggcacaacggtggtcgtcgacgagcactgtggtaaccggggtccgtccctgcgcaccaccaccgtgaccggcaagatcattcacgagtggtgctgccggagctgcaccctgccacccctccggttccgcggggaagatggctgctggtacggaatggagatccgccccgttaaggagaaggaggagaacctggtgaagtcaatggtgagcgccggaagcggtgaggtagacagtttcagcttagggctactgtgcatctccatcatgatcgaggaagtgatgaggagccgttggtccaggcgcatgttaatgacgggcaccctggccgtgttcttcctcctaataatggggcaactgacgtggaacgatctgatccgcctttgcatcatggtcggcgcgaacgccagcgaccggatggggatgggcacgacctacctggccctgatggcaaccttcaagatgcgccccatgtttgccgtgggactcctgtttcggcgcctaacgtcccgggaggtcctcctgctgacgatcgggctcagcctagtcgcgtccgtagagctgcccaacagcctcgaggaactgggggacgggctggcaatgggcatcatgatactaaagctgctgaccgacttccagtcccaccaactctgggcgacgctgctgagtctcacgttcatcaagaccaccttctccctccattatgcctggaaaaccatggcgatggtcctgagcatcgtctcccttttccccttgtgcctgagcacaacctcccagaaaacgacctggctgcccgtgttgctcggtagcctcgggtgcaagccgctgacgatgttcctgatcgctgagaacaagatctggggacgccggagttggccgctcaacgagggtatcatggccgttggcatcgtgagcattctgctgagctccctcctgaagaacgatgtgccactggccgggccactcatcgccggcggcatgctgatcgcatgctacgttatctcggggagcagcgccgacctgtcactcgagaaggctgcagaggtgagctgggaggaagaggccgagcactccggcgccagccacaacatcctagtggaagtccaggatgacgggactatgaagattaaggacgaggagcgtgacgacaccctgaccatcctcctgaaggctacactgctcgccgtaagtggcgtgtaccctctatctattcccgccacgctgttcgtatggtacttctggcagaagaagaagcagcgttcaggggtgctctgggacacccccagcccgcccgaagtggagcgcgccgtcctagacgacggcatctaccggatcatgcagcgcggcctattagggagaagccaggtgggcgtgggagtgtttcaggagaacgtgttccacaccatgtggcacgtgacccgaggcgcggtgcttatgtaccaggggaagcgcctcgagccgagctgggcctccgtcaagaaagacctgatatcatacggcggcgggtggaggctccagggttcgtggaacacgggcgaggaggtccaggtcatcgctgtagagccgggtaaaaaccctaagaacgtgcaaaccgcccccgggacgttcaagactccggaaggtgaggttggggccattgctttagacttcaagcccggtacgagcggatctcccatcgtgaatcgggagggaaagattgtgggcctgtatggtaacggggtcgtaactacaagcggcacctacgtgagcgccatcgcccaagccaaggcgtcgcaggaggggccgctcccagagatcgaagacgaagtcttccgcaaacggaacctgactatcatggacctgcatcctggcagcgggaagacccgtcggtacctgccggccatcgtgcgcgaagctatcaaacgcaagctacggactcttatccttgctcccacccgcgtggtcgcctccgagatggcggaggccctgaagggcatgcccatccggtaccagacgactgccgtcaagagcgagcataccggaaaggagatcgtagaccttatgtgccacgccaccttcacgatgagactccttagccccgtccgcgtgccgaactacaacatgatcattatggacgaggcgcacttcaccgatccgagctccatcgcggcccgcgggtacatcagcacacgcgtcggcatgggggaggccgccgccatctttatgaccgcgacgccgcccggctccgtcgaggcctttcctcagtcaaacgccgtaatccaggacgaagaacgcgatatccccgaacggtcgtggaacagcgggtacgagtggatcaccgacttccccggcaagaccgtttggtttgtcccctccatcaagagcggtaacgacattgccaactgtctgcgcaagaacgggaagcgggtaatacagctctccaggaagaccttcgatacggagtaccagaagactaagaacaatgactgggattacgtggtcaccaccgatatctccgagatgggcgcgaactttagggccgaccgcgtaatcgacccgcggcggtgtctgaagcccgtaatcctgaaggacgggcccgagcgagtcatcctcgctggcccaatgcccgtcaccgtcgcctccgctgcgcagcgtcggggacgcatcggccgaaaccataacaaagagggcgaccagtacatttatatggggcagcccctgaacaacgacgaggaccacgcccactggaccgaggccaagatgctgttagacaacatcaacacccccgagggcatcatcccagcactgttcgagcctgagcgggaaaagtccgccgcgatagacggggagtaccgcctgcgcggtgaagcccgcaagacattcgtggagctcatgcggagaggggacctccccgtctggctatcctacaaggtcgccagcgagggcttccagtactcagaccggcgatggtgcttcgacggcgagcgcaacaaccaggtgctggaggagaacatggacgtggagatctggacgaaggagggggagcgcaagaagctgaggccgcgctggctggacgctcgaacctattccgaccccctggccctgcgagagttcaaagagtttgctgcaggccggcgctcagtatctggagacctgatcctcgaaatcgggaagttgccgcagcaccttacccagcgggcgcagaatgcacttgataacttggtaatgctgcacaacagcgaacagggcggccgtgcgtaccggcatgccatggaggagttaccagacaccatagagacgctcatgctgctcgccctgatcgccggcgtgaccgggggagtcaccctggtcttcctcagcgggcgcggcctgggcaaaacctccatcgggcttctctgcgtgatggcctcctctgtcttattatggatggcgtccgtggagccccactggatcgccgcctcgattatattggagttctttctgatggtgctgcttatccccgaaccggaccggcagcgcacgccccaggacaatcagcttgcgtacgtcgtgataggccttctcttcatgatcctgacggtggccgcgaacgagatgggactactcgagaccaccaagaaggacctgggcatagggcacgtcgccgtcgagaaccaccaccacgccgccatgctggacgtggatctccacccagcctccgcgtggactttatacgccgtcgccaccaccatcatcaccccgatgatgcgccacacgatcgagaacaccaccgccaacatcagcctgaccgcgatcgcgaaccaggccgccatcctgatgggtctggccaagggctggcccatttccaaaatggacatcggggtgcccctgctcgcgctgggctgttacagccaggtgaaccccctgaccctcacggcccccgtcctgatgctggttgcccactacgccatcatcggacccggcctccaggccaaggcgacgcgcgaggcccagaagcgtacagccgcaggaataatgaagaaccccaccgtggatggcattgtagccatcgaccttgaccccgtggtgtacgacgcgaagttcgagaagcaactgggccagatcatgctcttaatactgtgcacttcccagatcctcttgatgcggaccacctgggccctgtgtgagtcgatcaccctcgccacggggccgctgaccacgttatgggaggggtcccccggcaaattctggaacaccaccatcgcggtcagcatggccaacatcttcaggggctcctatctcgcgggagcagggctagccttcagcctaatgaagtccttaggcgggggccggcgcgggacgggcgcccagggcgagactttaggtgagaaatggaagcggcagctgaaccagttaagcaaaagcgagttcaacacctacaagagatccggaatcatggaggtggaccggtctgaggcgaaggaggggctgaagcgcggcgaaacgaccaagcacgccgtgtcccgagggactgccaagctgcgatggttcgtcgagcggaacctcgtgaagcccgaggggaaggtgatcgacctgggctgcggacgcgggggttggagctattactgcgcgggcctgaaaaaggtcaccgaagtaaaaggatacactaagggcggccccggacacgaggaaccgatcccgatggcaacctacggatggaacctggttaagctgcactcggggaaggacgtcttcttcataccacccgagaagtgcgacacccttctatgcgacattggcgaaagctcaccgaaccccaccatcgaggaggggcggaccctccgcgtgctcaaaatggtggaaccctggctgcggggcaatcagttctgtatcaagattctgaacccctacatgccgtctgtcgtggagaccttggaacagatgcagcgcaagcacggtgggatgctggttcggaacccgctctcccgcaatagcacccacgagatgtattgggtcagctgcggaaccgggaacatcgtgagcgcggtgaacatgacctcccgtatgttactcaacaggtttacgatggcccatcgcaagcccacgtacgaacgggacgtcgacctcggagccggcccccgccacgtggccgtggagccggaggtcgccaacctggatatcatagggcagcgcattgagaacatcaagcacgagcacaagagcacctggcactacgatgaggacaacccatacaaaacatgggcctatcacggctcatacgaggttaagcccagtggctccgccagcagcatggtcaatggcgtcgtaaagctgctcacgaagccctgggatgtcatcccgatggtgacccaaatcgccatgaccgacaccacgccattcgggcaacagagagtttttaaagaaaaggtcgacacccgtacgcccaaggccaaacgtggcaccgcgcagatcatggaggtgacggcgaagtggctatggggcttcctgtcccggaacaagaagccgcgcatctgcacccgggaggagttcacccgtaaggtgagaagcaacgccgccattggggctgttttcgtggatgagaaccagtggaactccgcgaaggaagccgttgaggacgagcgcttctgggacctcggccaccgggagcgcgaactccacaaacaggggaagtgcgcaacctgcgtcagcaacatgatgggcaagcgggagaagaaacttggggagttcggcaagcccaagggttcgcgccctatctggtacatgtggttaggagcacggttcctcgagttcgaggccctgggattcatgaacgaggaccactggttcagccgggagaactcccttagcggggtagagggcgaggggctgcacaagctgggctacattcttcgagacatctccaagatccccgggggcaacatgtatgcggacgacacggccggctgggacacccgcatcactgaggacgatctgcagaacgaggccagaattaccgacatcatggagccggagcatgcattactcgccaagagcatcttcaagctgacgtatcagaacaaggttgtccgggtgcagcggcccgccaagaatgggactgtgatggatgtaatatcaagccgggaccagcgcggctccggtcaggtggggacctacggcctcaatacgttcacgaacatggaggcccagctcatcaggcagatggagagcgaagggatattcagtccctccgagctggaaacccctaacctggccgagcgcgttcttgactggttagagaagtatggcgtcgagcggttgaaacgcatggcaatctccggggacgactgcgtggtgaagccgatcgatgatcggttcgcaaccgcgcttaccgctctgaacgacatgggcaaggtccgaaaggacattccacagtgggagcccagcaagggttggaacgactggcagcaggtcccgttctgcagccaccacttccatcagctgatcatgaaggatgggcgtgaaatagtggtgccgtgccgcaaccaggacgagcttgtgggcagagcacgggtgtcccaaggcgccggctggagcctccgggagacggcctgcctggggaagtcctatgcgcaaatgtggcaactcatgtacttccaccgccgggacctgcgcctagcggccaacgcgatctgcagcgcggtccccgtggactggatcccaacctccagaaccacctggagcatacacgcccatcaccagtggatgacgaccgaggacatgctctctgtgtggaaccgcgtctggatagaggagaacccctggatggaggacaaaacccacatcagctcctggggcgacgtaccgtacctgggcaagcgtgaggaccagtggtgcgggtctctgatcggtcttaccgcccgggccacgtgggccaccaatatccaggtggccatcaaccaggtcagacggctgatcgggaacgaaaactacctggactacatgacctccatgaagcgcttcaagaacgagagcgaccctgagggcgcactctggtga

SEQ ID NO: 24160 - RNA, 9879 nt, synthetic construct
  misc_feature 1..9879: note = derived and/or modified CDS sequence (opt11) from DENV-1__FJ432729__SS-prME
  source 1..9879: mol_type = other RNA
tcagtgacgatgctgctcatgcttatgcccaccgccctggctttccacctcaccacccggggcggcgaaccacacatgatcgtgactaaacaggagcggggcaaaagcctgttattcaaaaccagcgccggggtgaacatgtgcacgctcatcgccatggacctgggcgaactgtgcgaggacactatgacctacaaatgcccccggatcactgaggccgagcccgacgacgtggactgctggtgtaacgccacggatacttgggtcacctatgggacctgcagccagacgggcgaacatcgacgcgacaagcggtcagttgccctcgcaccccacgtgggcctgggccttgaaacgaggacggagacctggatgtccagcgaaggcgcctggaaacagatccagcgggtagaaacgtgggccctccgccatcccgggtttaccgttatcgccctgttccttgcgcatgtgataggcacctccatcactcagaaggggatcatcttcatcctcttaatgttggtcacgcccagcatggccatgcgttgtgtggggatcggctcccgcgacttcgtggaggggctcagcggtgccacttgggtcgacgttgttttagagcacgggtcctgcgttactaccatggccaaggacaagcccacgttagacatagagctcctgaagaccgaggtcaccaatccggccgtgctgcggaaactatgcatcgaggcgaagatcagcaataccacgaccgactcccgctgccccacccagggcgaggccacgctaatggaggagcaggacgccaatttcgtctgccggaggacgttcgtggacagggggtggggcaacggctgcgggctgttcggcaaggggagcttaattacatgcgccaagttcaagtgcgtgactaagctggagggcaagatcgtccagtatgagaacctgaagtactccgtgatcgtgaccgtccacactggcgaccaacaccaggtggggaacgaatcaaccgagcacggcaccatcgccacgattacgccgcaggcgcctacgtccgagatccagctcaccgactacggggccctgactctggactgcagcccccgcaccggcctcgactttaatgagatggtcctgctgacaatgaaagagaaatcctggctcgtgcacaagcagtggttcctggacctcccgctcccctggaccagcggggccagcacatcccaggagacctggaaccggcaggaccttctcgtgacgttcaagacggctcatgccaagaagcaggaggtcgtggtgttgggctcgcaggagggggcgatgcacaccgctctgacgggggccacggagatccaaacatccggcacaacgaccatctttgccgggcatttaaagtgtcgcctcaagatggacaagctgaccctgaagggcatgagttacgtcatgtgcaccgggtcctttaaactcgagaaggaggtggccgagacacagcacggcaccgtgctggtccagataaagtatgagggcaccgacgcgccctgcaaaatccccttctctacccaagacgaaaagggtgtgacccaaaacggccggctcataacagccaacccgatcgtgaccgataaggagaagcccgtcaacatcgaggccgagccgcccttcggggagtcctacatcgtaatcggcgccggcgagaaagcgctcaaactgagttggttcaagaaagggtccagcatcggcaaaatgttcgaggccaccgccagaggggctagacgcatggccatcctgggtgataccgcgtgggacttcggatcgatcggtggggttttcactagcgtcgggaagctggtgcaccagatcttcggtaccgcctacggagtcctgttcagtggagtgagctggacaatgaagatagggatcggtgtgctgttgacttggctcgggctgaactcccgcagcacctccctgagcatgacttgcattgccgtcggtctcgtgacgctgtacctgggcgtgatggttcaggccgattccgggtgcgtcatcaactggaagggccgggagttgaagtgcgggagcggaatcttcgtgaccaacgaggtgcacacgtggaccgagcagtacaagttccaagccgacagccccaagcgcctatctgcggccataggaaaggcatgggaggagggggtctgcgggattcggagcgccacccgcctagagaacatcatgtggaagcagatttccaatgagctcaaccatatccttttagagaacgacatgaaattcactgtcgtggtcggtgacgtggtgggaatcctggctcaggggaaaaagatgattcggccccaaccaatggagcacaaatactcgtggaaatcatggggcaaggcgaagatcatcggcgcggacgtccagaacaccacgttcatcatcgacgggcccaacaccccggagtgtcccgacgaccagcgcgcctggaacatatgggaggtggaagactacggcttcgggatttttaccaccaacatctggctgaagctacgggacagccatacccaggtgtgcgaccatagactcatgtcggccgcgataaaggactctaaggccgtccacgcagacatgggctactggattgagagtgaaaagaacgagacatggaagctggcgcgggccagctttatcgaagtgaaaacctgtatctggccaaagtcccataccctgtggagcaacggcgtgctcgagagtgagatgatcatccccaagatttacgggggcccgatcagccagcataactaccgtcccggttacttcacgcagaccgcgggaccctggcacctggggaagctggagctcgacttcgacctttgcgagggcaccaccgtggttgtggatgagcactgcggaaaccgggggccgagcctgcggacaacgacggtcaccggcaaaatcatacacgagtggtgctgccggagctgcacgctgccgccccttcgcttcaagggggaggacggctgctggtacgggatggagatccgacccgtgaaggagaaggaggagaacttagttaagtccatggtctccgcgggcagcggggaagtggactccttcagcctcgggctgctgtgcatttccatcatgatcgaggaggtgatgcgctcccggtggtccaggaagatgctcatgaccggcacgctggcggtcttcttactgttgatcatgggacagctcacatggaacgacctgatccggctgtgtatcatggtgggggccaacgccagtgaccgcatggggatggggacgacgtacctggcgttaatggccaccttcaagatgcgccccatgttcgccgtgggactgctttttcggagacttacctcgcgggaggtgctactgctaaccatcgggctgtcgctggtggccagcgtcgaactacccaactcactggaggagcttggtgacggactcgccatgggcatcatgatcctcaagctgctcaccgatttccagtctcatcagttgtgggcgactctgctcagcctgaccttcatcaagacgacattgtccctccactacgcctggaagaccatggccatggtgctgtccatcgtttccctgttccccctctgcctgagcaccaccagtcaaaagaccacgtggctgcccgtcctactgggcagcctggggtgtaagccgctcgccatgctgttgatcgcggagaacaaaatctggggccgcaagtcctggcccctcaacgagggtatcatggccgttggcgtagtctctattctgttgagctccctactgaagaacgacgtgccactggccgggcccctcatcgccggcgggatgctgatcgcctgctacgtgatcagcgggtccagcgcggatctgagtctcgagaaggccgccgaggtcagctgggaggaggaggccgagcattccggcgcaagccacaacatcctggtagaggtgcaggacgacgggaccatgaagataaaggacgaggagcgggacgacaccctgaccattttgctgaaggcgaccttactcgccgtctcaggcgtgtatccgctgagcatccccgctacgctgttcgtgtggtatttctggcagaaaaagaagcagcgctccggagtcctatgggacactcctagcccgccggaggtggagcgggccgtgctcgatgatggtatttaccgcatcatgcagcggggtctgctggggcgctcccaagtcggagtaggagtgttccaggagaacgtcttccacactatgtggcacgttacccgaggcgcagtgttgatgtatcaggggaagcggctggaacccagttgggcctccgtcaagaaggatctgatctcttatggaggagggtggcggctccaaggctcctggaacaccggggaggaggtccaggtgatcgccgtcgagcctggcaagaaccccaagaacgttcagaccgcccccgggacgtttaagacccccgagggcgaggttggcgccatcgccctggactttaagcccgggaccagcggctcacccattgtcaatcgcgagggtaagatagtgggcctgtacggcaacggggtggtgacgacgagcggtacctacgtgtccgcgatcgcccaggccaaggcatcccaggagggcccgctccccgagatcgaggacgaggtttttcggaagcgcaaccttaccattatggatctgcaccccgggagcggaaagacccggcgctacctccccgcgatagtccgggaagccatcaagcggaagctgcggacgctgatcctcgcccccacccgcgtggtggcctcggagatggcagaggctttaaagggcatgcctatccgctaccagaccaccgccgtcaagagcgagcacacgggcaaggagatcgtggacctaatgtgccacgcgacctttaccatgcggctcttgtcgcccgtgcgcgtcccgaactacaacatgatcatcatggacgaggcccacttcaccgaccccagctccatcgccgcgcgggggtacatctccacacgcgtgggcatgggggaagccgccgccatcttcatgaccgccacgccacccggctccgtggaggcgttcccgcaaagcaacgctgtaatccaggacgaggaacgggacatacccgagaggtcctggaatagcgggtacgaatggatcaccgacttccccggcaagacggtgtggtttgtgccctccatcaagagcggcaacgatatcgcgaactgcctaaggaagaatggcaagcgcgtcatccagctcagtcggaagacattcgacaccgagtatcagaagaccaaaaacaacgattgggactatgtggtgacgaccgacatcagcgaaatgggcgccaacttccgagcggatcgggtcatcgatccgcgccggtgcctgaaaccggtcatactgaaggacgggcccgaacgcgtcatcctcgcgggccccatgccggtcaccgtggcctccgccgcccagcggcgcgggagaataggccgcaaccacaacaaggagggcgaccaatacatctacatggggcagccgttgaataacgatgaggaccacgcgcactggaccgaagccaagatgcttctcgacaacataaacacacccgaggggatcatccccgccctgtttgagcctgagcgggagaagtccgccgccatcgacggggagtaccgcctacgcggcgaggcacggaagaccttcgtagagttaatgcgccgaggggacctgcccgtgtggctgtcctataaagtggctagcgagggcttccaatatagcgatcgccggtggtgttttgatggcgagcgcaacaaccaggtcctggaggagaatatggacgtagagatctggaccaaggagggtgagcgcaagaagctgcgcccccgctggctcgacgcccgcacttacagcgaccccctcgccctccgtgagttcaaggagttcgccgcgggacgccggagcgtgtccggggacctgatcctggagatcggcaagctcccgcagcacctcactcagcgcgcccagaacgccctagacaacctggtcatgttacataacagcgagcaaggcgggcgcgcataccgccacgcgatggaggagctccccgacaccatcgagacgctgatgctgctcgctctcatcgccgtgctgactggcggggtgacactcttcttcctgagcggccgtggtctgggcaagaccagcatcggcctcctctgtgtcatggccagcagcgtgctgttgtggatggcctcggtggagccccactggatagcggccagcattatcctagagttcttcctgatggtcctcctgatacccgagccggaccgccagcgtacaccccaggacaaccagctggcctacgtggtgatcgggctcctgttcatgatactaaccgtcgccgctaacgagatgggcctcctggaaactaccaagaaggacctggggatcgggcacgtggcggtagagaaccaccatcacgccacgatgctcgatgttgacctacaccccgcctccgcgtggaccctgtacgcagttgcgacaacgattatcaccccgatgatgcgccatactatcgaaaacactacggccaacatcagcttaactgcgatagccaaccaggccgctatcctaatgggcttggacaagggctggcccatttctaagatggatatcggcgtgcccctcctggccctggggtgctactcgcaagtaaacccccttaccctcacggccgcggtgctgatgctggtggcgcactacgcaatcatcgggccggggttgcaagccaaggccacgcgggaagcccagaagcgcaccgcagcaggcatcatgaagaaccccactgtcgacgggatcgtcgccatcgacctggaccccgtggtctacgacgccaagtttgagaagcagctcgggcagattatgctgctgatcttgtgcacctcccagatcctgcttatgcgaacgacctgggcactatgcgagagcattaccctggcgaccggccccctgacgaccctctgggaggggtccccgggcaaattctggaacactaccatcgccgtgagcatggcaaacatcttccgtgggagctatctggctggcgctggcttagccttcagcctcatgaagtctctcgggggcgggcgcagaggcaccggggcccagggggagaccctgggcgagaagtggaagcgccagctcaaccagctgtcaaagagcgagtttaatatatacaagcggtccgggatcatggaggtggacaggagcgaagccaaagagggcctgaagagaggggaaactacgcgccacgccgtctcccgcgggactgcgaagctccgctggttcgtggagcgtaacctcgtgaagcccgaggggaaggtgatcgaccttgggtgcggccgcgggggctggagctactactgtgccgggctgaagaaagttaccgaggtcaagggatacacgaagggcgggccaggccacgaggagcccatcccgatggccacgtatggttggaacctcgtcaagctgcactccgggaaggacgttttcttcactccgcccgagaagtgtgacaccctgctctgcgacatcggggaaagctctcccaatcccacaattgaggagggccggaccctgagagttctgaagatggtcgagccctggctccgggggaaccaattctgcattaagatcctgaacccgtatatgccctcagtggtggagactttagagcagatgcaacgcaaacacggcggcatgctcgtccggaacccgctgagtcgcaatagcacccacgagatgtattgggtgtcatgcggtacaggcaacatcgtcagcgctgtcaacatgacttcccggatgcttctcaaccgcttcaccatggcccaccgcaagccgacgtatgaacgagatgtggacctgggggcgggcactcgccacgtggccgtcgagcccgaggtggccaacttagacattatcggccaacggattgagaacatcaagcacgagcacaaatctacttggcactacgacgaggacaacccctacaagacctgggcctaccacgggtcctacgaggtcaaaccgtcaggttctgccagcagcatggtaaacggggtggtcaagctcttaactaagccatgggatgtgatccccatggtgacccagatagcaatgaccgacaccacgcctttcggccagcaacgggtcttcaaggagaaagtggacacccggacaccaaaggcgaagcgagggaccgcccaaataatggaggtgacggcccggtggctgtgggggttcctctcccggaacaagaagccccggatctgcacgcgtgaagagtttacccgaaaggtccgcagcaacgccgcgataggcgccgtgttcgtggacgagaaccagtggaactccgccaaggaggccgtcgaggacgagcggttctgggatctggtgcagaaggagcgcgagttacacaagcaggggaagtgcgcgacatgcgtgtataacatgatgggcaagcgggagaagaagctcggggagttcggtaaggccaaggggagccgcgccatatggtacatgtggctgggcgcgaggttcctggagttcgaggccctcggcttcatgaacgaggaccattggttctcccgcgagaacagcctgagcggggtcgagggcgaggggctacacaagctcggctatatcctacgggatatcagcaagatcccagggggcaacatgtacgcggacgacaccgccggctgggacacccgcataaccgaggacgacttgcagaatgaggcgagaatcacagacataatggagccggagcacgcacttctggcaacgtcgatcttcaaactgacttaccaaaataaagtggtgcgcgtccagcgccccgcgaagaacgggaccgtgatggacgtgatttcccggagggaccagcggggctctggtcaggtcggcacctatggcctaaatacgttcaccaacatggaagcccagctgatccgccagatggagagcgagggaatcttcctgccctctgaactcgagacccagaacctcgcggaacgggtgctggactggctcgagaagtatggcgtggaacgcctgaagcggatggccatcagcggggatgactgcgtggtaaaaccaatcgacgaccgcttcgccactgctttaaccgccctcaatgacatgggtaaggtgcgaaaggacatcccgcagtgggagccctccaagggctggaacgattggcagcaagtccccttctgcagccaccactttcaccaactgatcatgaaggacggacgcgagattgtggtgccatgccggaatcaggacgagctggtcggcagggcccgagtgagtcagggcgccggttggtccctccgggaaacagcttgcctgggaaagagctacgcgcagatgtggcagctgatgtacttccaccggcgcgacctccgtctagccgcgaacgccatctgctccgcagtgccggtcgactgggtgcccactagccgcacgacgtggtccattcacgcgcatcaccagtggatgacgacagaggacatgctgtcggtgtggaaccgcgtctggatcgaggagaacccgtggatggaggataagacgcacgtgagcagctggggagacgtgccctaccttgggaaacgcgaagaccagtggtgcggctccctgatcggcctgacggcccgcgccacctgggcaagcaacatccaggtcgcgataaaccaggttcggcgccttattggtaacgagaactatctggactacatgacctccatgaagcgcttcaagaatgagggcgacccggaaggagccttgtggtga

SEQ ID NO: 24161 - RNA, 9879 nt, synthetic construct
  misc_feature 1..9879: note = derived and/or modified CDS sequence (opt11) from DENV-1__FJ432730__SS-prME
  source 1..9879: mol_type = other RNA
agcgtgaccatgctgctcatgctaatgcccacggcactggccttccacctcaccacccgggggggggagccccacatgattgtgtcaaagcaggagcgggggaaaagcctgctgttcaagaccagcgccggagtgaacatgtgcaccttaatcgccatggacctgggcgagttctgcgaagacacgatgacctataaatgcccccgcatcacagaggccgagcccgacgacgtcgactgctggtgtaatgccaccgacacgtgggtgacctacggcacctgcagccagacgggcgaacaccggcgagacaagcggtccgttgccctcgcgccccacgtgggcttgggactagagacacgcaccgagacgtggatgagctccgagggcgcatggaagcagatacagcgagtggagacttgggccctgaggcaccccgggttcactgtgatcgccctcttcctggcgcacgctatcggcacctctatcacccagaaaggcattatcttcatcctgctgatgctcgtgacaccctccatggcgatgcggtgcgtaggtatcggcagccgtgacttcgtggaagggctgtccggggccacgtgggtggacgtcgtgctagagcatgggagctgcgtcacgaccatggccaaggacaaaccaacccttgacatagagctgttgaaaaccgaggtcacaaaccccgcggtgctgcggaagctgtgcatcgaggccaagatctccaacaccaccacggacagccgctgcccaacccaaggagaggccacactcgtcgaggaacaggacgccaacttcgtctgccggcgcacctttgtggaccgaggctgggggaacggctgcgggctgttcggcaaggggtctctgatcacgtgcgccaagttcaagtgtgtgaccaagctggagggcaagacggttcagtacgagaaccttaaatacagcgtgatcgtgaccgtccacacaggcgatcagcaccaggtggggaacgagtccaccgagcacggtaccaccgcgacaatcacgccccaggctccctcgacggagatccagctgaccgactacggggccctcaccctggattgcagcccccggacgggtctggatttcaacgagatggtcctcctgaccatgaaggagaagtcctggctggtccacaagcagtggtttctcgacctgccgctgccatggacctccggcgccagcactagccaagagacgtggaacagaaaggacctcctggtcacctttaagaccgcccatgcgaagaagcaggaggtcgtagtcctgggctcgcaggagggcgccatgcacaccgccctaacgggggctaccgagatccagaccagcggcatgaccacgatcttcgccgggcacctgaagtgccgcctgaagatggacaagctcaccctgaagggtatgagttacgtcatgtgtaccgggagttttaagctggagaaggaggtggcggaaacccaacacggcacagtgctcgtccagataaagtacgagggcaccgacgccccctgcaagatccccttttccacccaggacgagaagggggtgacccagaacgggcggctaattactgcgaacccgatcgtgacggataaggagaagcccgtcaacatcgaggccgagcccccgttcggcgagagctacatcgtgatcggggcaggcgaaaaggccctgaagctctcctggttcaagaagggtagctccatcgggaagatgttcgaggccaccgcccgcggtgccagaaggatggcgatcctcggcgacaccgcctgggactttgggagcatcggcggcgtttttaccagcgtcggtaagctggtgcaccagattttcggcaccgcctatggggttttgttcagtggcgtctcctggacaatgaagatcggcatcggcgtgctcctgacctggttaggactaaacagccgctccacgagcctgtccatgacgtgcatcgccgtgggcctggtcacgctctacctgggcgtgatggtgcaagccgatagtggatgcgtcatcaactggaagggccgggagctgaagtgcgggagtggcatcttcgtcaccaacgaggtgcacacgtggaccgagcagtacaagttccaggcagactccccgaagcgcctcagcgccgccatcggcaaggcctgggaggagggggtctgcggcatacggtccgccacccgactggagaatatcatgtggaaacagataagcaacgagctgaaccacatccttcttgagaacgacatgaagttcactgtggtggtaggggacgtagcgggaatactggcccagggcaagaagatgatcaggccccagcccatggagtacaagtactcctggaagtcctggggcaaggccaagatcatcggcgccgacgttcagaacaccacattcatcatcgacgggcccaacaccccggaatgccccgacgaccaacgcgcgtggaacatctgggaggtcgaggattacggcttcggaattttcaccaccaatatctggctgaagctgcgggactcctacacacaggtgtgcgaccaccgcctgatgagcgccgcaatcaaggactcaaaggccgttcatgccgacatgggctattggatcgaaagcgagaagaacgagacgtggaagctagcacgtgcgtcattcattgaggtaaaaacctgcatctggcccaagagccacaccctatggtccaacggcgtgctggagagcgagatgatcatacccaagatatacgggggcccgatctcccagcataactatcgacccgggtacttcactcagacggccggtccctggcacctcggcaagctggagctggatttcgacctctgcgagggcaccaccgtggtggtggacgagcactgcgggaatcggggaccgtcactgagaacaactaccgtgaccgggaagatcatccacgagtggtgctgtcgatcctgcacgctccctcccctgcgcttcaagggggaggacggctgctggtacgggatggagatccggcccgtcaaggagaaggaggagaacctggttaagagcatggtttctgccggctccggcgaggtcgatagcttctcgctggggctcctgtgcatatctatcatgatcgaggaggtgatgcgctcccggtggagccgcaagatgctgatgaccggcactctcgccgtgttcttcctcctgatcatggggcagctcacctggaacgacctgatccggttatgcatcatggtcggcgcgaacgcctccgatcgcatggggatggggacgacctacctcgccctgatggccaccttcaaaatgcggccgatgttcgccgtgggcctcctgttccggcgcctgaccagccgggaggtgctgctcctgacgatcgggttatccctcgtcgcgtccgtggaactgcccaactctctggaagaactcggcgacgggctcgccatgggcataatgatcctgaagctcttaaccgacttccagagccaccagctctgggccaccctgctgtccctcaccttcatcaagacgaccttcagcctccactacgcctggaaaaccatggcgatggtcttgtcaatcgttagcctgtttccactgtgcctgtccaccacaagccagaaaaccacctggctgcccgtgctcctcggctccctggggtgcaagccgctcaccatgtttctgatcgccgagaacaagatatggggccgcaagagctggccccttaacgaggggatcatggccgttggcatcgtgagcatactgctgtcctctctgctcaagaacgacgttcccctagcagggcccctgattgccggcggcatgctcattgcgtgctacgtcatatcagggtcatccgccgacctgagcctggagaaagccgcagaagtgtcatgggaggaggaggccgaacacagcggcgcgtcccacaacatcctggtggaggtccaggacgacgggacgatgaagattaaggacgaggagcgggatgacacactgaccattctgctcaaggccaccctgctggcggtgagcggcgtctacccgctcagcatccccgccaccctgttcgtctggtacttctggcagaagaagaagcagcgcagcggggtgctgtgggacacgccaagcccgcccgaggtagaacgagccgtcctggacgacggcatttacaggattatgcagcggggcctgctgggccggtcacaggtgggtgtgggggtctttcaggaaaacgttttccacaccatgtggcacgtgacgagaggggccgtcctaatgtaccaggggaagcgcctcgagccctcctgggccagcgttaagaaggacttaatctcctacggcggagggtggcggctgcagggcagctggaacaccggggaggaagtgcaggtaattgcggttgagcccggtaagaaccccaaaaacgtgcagacggcccccgggaccttcaagacctctgagggcgaggtcggcgccatcgcactcgactttaagcccggcacatcgggcagccccatcgtgaaccgcgaggggaagatcgtgggcctgtacggcaacggggtcgtcacaacctccggaacatacgtgtctgccattgcccaagcgaaggcgtcccaagaggggcccctgcctgagatcgaggacgaggtcttccgtaagcgcaacctcaccatcatggacctgcaccccggcagcggcaagacgcggcgctatctcccagccatagttcgagaggccatcaagcgtaagctccggaccctgatcctggctccgacccgcgttgtcgcctccgagatggctgaggccctcaagggcatgcccattcgttaccagacaacggccgtgaagagcgagcacactggcaaggaaatcgtggatctgatgtgccatgccacattcaccatgaggctgctgtcccccgtacgcgtacccaactataacatgatcatcatggacgaggcacacttcacggacccgagctccatcgcggcacgggggtacataagcacccgcgtcggcatgggggaggccgccgccatatttatgacggcgacgccgcctggatccgtcgaggccttcccccaaagcaacgccgttatccaggacgaggagcgggatatcccggaacgcagctggaatagcgggtacgaatggatcacggatttccccggcaagaccgtgtggtttgtcccctccatcaagagcggcaacgacattgccaactgtctcagaaagaatgggaaacgcgttatccaactgtctcggaaaactttcgacaccgagtaccaaaaaacgaaaaataacgactgggactacgtggtcaccacagacatcagcgagatgggcgccaattttcgtgccgatcgggtgatcgacccacgccggtgcctcaagccggtgatcctgaaggacgggcccgaacgcgtcatcctagcgggccccatgcccgtgaccgtcgccagtgccgcccagcggcgtgggcggatcggccgtaaccacaacaaggagggcgaccagtacatctacatggggcagccgctcaataatgatgaagaccacgctcactggacggaggccaaaatgctgcttgataacattaacacccccgagggcatcatacccgcgctctttgaaccggagcgggaaaagtccgctgcgatcgacggggagtacaggctgaggggcgaggcccggaagaccttcgtggagttgatgcgccgcggggacctgcccgtatggctgtcgtacaaggtagcctccgagggcttccagtacagcgaccggcggtggtgcttcgacggcgagcggaacaaccaggtcctggaggaaaacatggacgttgagatctggaccaaagaaggggagcggaaaaagctacgcccgcggtggctcgacgctcgcacgtactccgaccccctggccctccgggagttcaaggagttcgcggccggccgccggagcgtgtccggggatttgatcctggagatcggcaagctcccgcagcacctgacccaacgcgcgcagaacgccctggacaacctcgtgatgctgcacaactccgagcagggggggcgggcgtaccgccacgccatggaggaactgccggacaccatcgagaccctaatgctgctggccttgatagccgtgctgacaggcggggtcacactgttcttcttgtccggccgggggctgggcaaaaccagcatcggcctgctctgcgtaatggcctcgagcgttctgctgtggatggcatccgtcgagccccactggatcgccgccagcatcattctcgaattcttcctgatggtgctactcatacccgagcccgaccgccagcggactccgcaggacaatcagctggcctatgtggtcatagggctcctcttcatgatcctgaccgttgccgcgaacgagatgggcctgctcgagacaaccaagaaggacctgggtatcggccacgtggccgtcgagaatcatcaccacgccgccatgctggacgtggacctgcaccccgcctccgcatggaccctatatgccgtagccactacgatcatcacccccatgatgcgccacaccatagaaaacaccacggccaacatcagcctgacagcaattgcgaaccaggccgccatcctcatggggctggataagggctggccgatctccaagatggacatcggcgtccccctgctcgcactcgggtgctacagccaggtgaaccccctcaccctcaccgccgccgtgctgatgctggtcgcccactacgccatcatcggccctgggctccaggctaaggccacgcgggaggcccagaagcgcaccgctgcaggcatcatgaagaacccgacggttgacggtatcgtggccattgacctcgaccccgttgtgtatgacgcgaagttcgagaagcagttaggccagatcatgctcctgatcttatgcacctcccagatcctcctgatgcgcacgacctgggccctgtgcgaaagcatcaccctggccacggggcccctgacgacactgtgggaagggtcccccgggaagttttggaacaccaccatcgccgtgtccatggccaacatcttccgggggagctacctcgcgggcgctggcctggccttctccctgatgaagtcgctcgggggtgggcgccgtggcacgggggcccagggcgagaccctaggcgagaaatggaagcgccagctgaaccaactctccaagtccgaattcaacacctataagcggtccggtatcatggaggtcgatcgcagcgaggcgaaggagggcttaaagcgcggggagaccacgaagcatgccgtgtcacgcggcaccgctaagcttcggtggttcgtggagcgcaatctcgtaaaacctgaagggaaagtgatagacctgggctgcggcagaggggggtggagctactattgcgccgggctgaagaaggtgaccgaggtcaaggggtataccaagggtggacccggccacgaggagccaatcccaatggccacctatggttggaacctggtgaagctccactccggcaaggacgtctttttcataccgcccgagaagtgcgacaccctactgtgcgacatcggggagagctcccccaaccccaccatcgaggagggccgcaccttacgggtcctgaagatggtggagccgtggttgcgcgggaaccagttttgtatcaaaatactcaacccctacatgccgagtgtggtcgagacgctggagcagatgcagcggaagcacggcggcatgctggtgcgcaaccccctctcccggaactctacacacgagatgtactgggtatcctgtgggaccgggaacatcgtcagcgcggtgaacatgacttcgcgcatgcttttaaacaggtttaccatggcccatcgcaagcccacgtacgagagagacgtggacctcggggccgggaccagacatgtcgccgtggagcccgaggtggccaacctggacatcatcggccagaggatagagaacatcaagcacgagcacaagagcacatggcactatgacgaggacaatccctacaagacttgggcgtaccacggctcctatgaggtcaagcctagcggcagcgcctcttcgatggtgaacggggtcgtgaagctgctcacgaagccgtgggacgtgatccctatggtcacccagatagccatgaccgacaccacacctttcgggcagcaacgcgtgtttaaagagaaggtagatacccggacccccaaggccaaacggggcaccgcccagatcatggaggtcacggcgaagtggctgtggggttttctgtcccgcaacaagaagccgcgcatctgtacccgcgaggaattcacccggaaggtgcgcagcaacgctgccatcggcgcagtgttcgtcgacgagaaccagtggaactccgcgaaggaggccgtggaggatgagcggttttgggacctcgtgcatcgcgagcgggagctccataagcaggggaaatgtgcgacttgcgtctacaacatgatgggaaagcgggaaaagaagctgggggagttcggcaaggccaaggggtctcgggcgatctggtacatgtggctcggcgcgcgcttcctggagttcgaggccctcggcttcatgaacgaggaccactggttctcccgggagaacagcctctccggggtggagggcgaagggctgcataagctgggctacatactcagagacatcagcaagattcccgggggcaacatgtacgccgacgacacagccggctgggatacccggatcaccgaagatgacctgcagaacgaggccaagatcaccgacatcatggaaccggaacacgcgctgctcgccaagtcgatcttcaagctgacgtaccagaacaaggtggtgcgcgtccagcggccggccaagaacgggaccgtgatggacgtcatcagccgccgcgaccagcggggcagcggtcaggtgggcacatatggcctcaatacgttcacgaacatggaagctcagctcatacgccagatggagtcggaggggatcttctccccgagcgagctggagacccccaacctggccaggcgcgtgctcgactggctggagaagcacggcgtcgagcggctgaagcgcatggcgatatccggggacgactgcgtggttaagcccatcgacgaccggttcgccaccgccctcaccgccctgaacgacatgggaaaggtccgcaaggacattccgcagtgggagcccagcaaagggtggaacgactggcagcaagtccccttttgcagccaccactttcaccagctgattatgaaggacggccgcgagatcgtggtcccctgccgcaaccaggacgaactcgtgggccgggcgcgcgtgtcccagggggcaggctggagcctgcgggaaacagcctgcctggggaagtcgtacgcccagatgtggcagctcatgtactttcaccgccgggacctgcgcctggccgcgaacgccatttgtagcgccgtcccggtggactgggttcccacctcccggaccacctggagcatacacgcccaccaccagtggatgacgaccgaagacatgctctctgtctggaaccgcgtgtggatagaggagaacccctggatggaggataagacccatatcagctcctggggtgatgtgccctaccttgggaagcgggaggaccagtggtgcggcagcctgatcggcctcaccgcccgcgcgacgtgggcaaccaacatccaagtcgccatcaaccaggtgcgccggctgatcgggaacgagaactacctggattacatgacctccatgaagcgcttcaagaacgagtccgacccggagggggccctctggtga

SEQ ID NO: 24162 - RNA, 9879 nt, synthetic construct
  misc_feature 1..9879: note = derived and/or modified CDS sequence (opt11) from DENV-1__FJ432732__SS-prME
  source 1..9879: mol_type = other RNA
tcagtcactatgctgctcatgctaatgcccaccgccctggccttccacctcacgactcggggcggggagcctcacatgattgtctcgaagcaggaacgaggcaagagcctacttttcaagacctcggccggggtgaacatgtgcaccctgatcgccatggacctgggcgagctgtgcgaggacaccatgacttacaagtgtcccagaatcaccgaaaccgagcccgacgacgtggattgttggtgcaacgccaccgacacatgggtgacctatggaacctgcagtcaaacgggcgagcaccggagagataagcggtccgtcgccctcgcgcctcatgtgggcttagggctggagacccgtaccgagacgtggatgagctccgaaggcgcgtggaagcagatccagcgggttgagacttgggccttacgacaccccgggtttaccgtgatcgccttattcctggcccatgtgatcggcaccagcattacccaaaaggggattatcttcatcctcctgatgctggtcacgccgtccatggcgatgcggtgcgtgggcatcggcagccgcgactttgtggaggggctctccggcgccacctgggtcgacgtggtgctggaacacgggagctgcgtcaccacgatggccaaagataagcccacgctggacatcgaactcctgaagaccgaggtgaccaaccccgccgtactgcggaagttatgcattgaagccaagatcagtaacaccaccaccgacagccgctgcccgacccagggtgaggcgactttggtcgaggagcaggacgccaacttcgtgtgccgtcgcacattcgtggaccggggctgggggaatggctgcgggttattcggcaaggggtcccttatcacgtgcgccaaatttaagtgcgtcacaaagcttgagggcaagatcgtacagtacgagaacctgaagtacagcgtgatcgtcactgtgcacacgggcgaccagcaccaagttggaaacgagtccaccgagcacggtacgacagccactatcacgccgcaggcccctaccaccgagattcagctcaccgattacggggcgctgacgctggactgcagccctcgcaccggattagactttaatgaaatggtgctactgacaatgaaggagaagagttggctcgtgcacaagcagtggttcttagacctgccgctcccgtggacaagcggagccagcacatcccaggaaacctggaacagacaagatctgctggtgaccttcaagaccgcccacgccaagaagcaggaggtagtggtcctcggcagccaggagggcgccatgcacacggcgctcacgggggccaccgagatccagacctccggcactaccaccatcttcgctggccacctgaaatgccgcctcaagatggacaagctgaccctgaaaggcatgagctacgtgatgtgcacggggtccttcaagctcgagaaagaggtggccgagacccaacacggaactgtcctggtgcagattaagtacgagggcaccgacgccccgtgtaagatccccttcagcacgcaggatgagaagggggtcacccagaacggccggttaataactgcgaacccaatcgtcacagacaaggagaaaccggtcaatatcgaggccgaaccgcccttcggggaatcctacatcacaatcggcgccggcgagaaggccctgaagctcagctggttcaagaaggggtctagcatcgggaagatgtttgaggcgaccgcccgcggggcccggcgcatggccatcttaggcgacacggcctgggatttcggctcaatcggcggagtgttcaccagcgtaggaaaactggtgcaccagattttcggcacagcgtacggggtcctgtttagcggcgtcagctggaccatgaaaatcgggataggcgtcctcctgacctggctcggcctgaactccaggagcacttccctgtcaatgacgtgtatagccgtgggtctcgttaccctttacctgggagtgatggtgcaggccgacagtgggtgcgttatcaactggaagggtcgggaattaaaatgcggaagcggtatattcgtgaccaacgaggtccacacctggaccgagcagtacaaatttcaggccgacagccccaaacgcctgtccgccgcgattggcaaggcatgggaggaaggggtttgcggaatacggagcgctacgcgcctggaaaatatcatgtggaaacagatatccaacgagctcaaccacatactgctggagaacgatatgaagttcaccgtggtggtaggggacgtggcaggcatctttgcccagggaaaaaagatgatccgaccccaacccatggagtacaaatacagctggaagagctggggcaaggctaagatcatcggagccgacgtgcagaacacgacctttatcatcgacggccccaacacgcccgaatgccccgacgaccagcgagcctggaatatatgggaggtcgaggactacggcttcgggatcttcacgaccaacatctggctcaagctgcgggattcttacacccaggtgtgcgaccaccgcctcatgtccgccgcgataaaggacagcaaggcggttcatgccgacatgggctactggattgaatccgagaaaaacgagacttggaagctagccagggccagcttcatcgaggtcaaaacctgtatctggcccaagtcacacacactttggagcaacggcgttctcgaatccgagatgatcatacctaaaatctacggggggccgatcagccagcacaactaccgacccggatatttcacccaaactgcggggccctggcatctcgggaagctggagctggatttcgacctttgcgaagggaccaccgtggtcgttgacgaacactgcggcaaccgggggccgtccctgcgcaccacgaccgtaacgggaaagatcatccacgagtggtgctgccggagttgcaccctgccgcccctgcgcttccgcggggaggacggctgctggtatgggatggagatacggcccgtcaaggagaaggaggagaatctggtgaagtccatggtaagcgccggcagcggcgaggtcgactccttttcgctaggactcctgtgcatctccatcatgatcgaggaggtcatgcggagccgttggagccggaagatgctgatgactggcacactcgcagtgttcttcctgctcatcatggggcaactcacctggaatgacctgatccgcctgtgcataatggtcggagcgaacgccagcgaccgtatggggatgggcacaacgtacctcgctctgatggccaccttcaagatgcgacccatgttcgcggtgggcctcctctttcgccggttaaccagtagagaggtgttgctactgacaatagggctgagcctagtcgcctccgtggagttgcccaacagcctggaggagctcggcgacgggctggcgatgggcatcatgatcctgaagctcctcacagacttccagtctcaccagctgtgggcgaccctcctgtccctgacttttatcaagacaacgttctcgttacactatgcctggaagaccatggcaatggtgcttagcatcgtatccttgtttccactctgcctgagcaccacctcccagaagacgacctggcttcctgtgctcctgggtagcctggggtgcaagccgctcaccatgttcctgatcgccgagaacaagatctggggccggcgctcttggccactgaacgaggggataatggcggtcggcatagtgagcatcttactcagcagtctgctcaaaaacgacgtgccgctcgccgggcccctgatagccggcggaatgttgatcgcctgctacgtcatctctgggtcctcagccgacctgtccctggaaaaggcggccgaggtgagctgggaggaggaagcagagcactccggcgcctcacacaacatcctcgtcgaagttcaagacgacggtaccatgaagatcaaggatgaggagcgggacgataccttaacgatactgctcaaggcgaccctgctggcggtgtccggcgtctatccgctctccatccccgccacccttttcgtctggtatttctggcaaaagaagaaacaacgctccggggtgctgtgggatacgccgagcccgcccgaagtggagcgcgccgtcctcgacgacggcatctaccgcatcatgcagagaggtttgctggggcgctctcaggtgggcgtcggtgtcttccaggagaatgtctttcacacgatgtggcacgtgactcggggcgccgtcctgatgtatcaaggcaagcgcctcgagcccagctgggcctccgtcaagaaagacctgatctcatacggcggcggatggaggctgcaggggtcctggaacacaggggaggaagtgcaggtcatcgcggtggagcccggtaagaaccccaagaacgtgcagaccgcccccgggacattcaagacccctgaaggcgaggttggggccatcgccctcgatttcaagcccggtaccagcggctcccccatagtgaaccgcgaggggaagattgtgggcctgtacggtaacggggtcgtgaccacgagcggtacctacgtgagcgccattgcgcaagccaaggcctcccaggaggggccactgccagaaatcgaggacgaggttttccggaagcggaatctcaccattatggacctgcatcccggcagcgggaagacccggcgctatctgccggccatcgtgcgggaggcgattaaacgcaagctaagaacacttatcctggcgccaacccgtgtcgtggcctcagagatggccgaggccctcaagggaatgcccatccgctaccagactaccgcggtcaaaagcgagcacacgggcaaagagatcgtggaccttatgtgccacgccaccttcaccatgcgactgctcagtcccgtccgcgtgcctaactataatatgattatcatggacgaagcccacttcaccgacccaagctccattgccgcccgggggtacatctcgacgcgcgtgggcatgggggaggcggccgccatcttcatgacggccaccccacccggatcggttgaggctttcccgcagagcaacgcggtgatccaggacgaggagcgggatatccccgaacgctcgtggaatagcgggtacgagtggataaccgacttcccaggcaagacggtgtggttcgtcccctccatcaagagcgggaacgacattgcaaactgcctgcggaagaatggaaagcgcgtgatccagctgtcccggaagacctttgacaccgagtaccagaagacgaagaacaacgactgggattatgtggtcacgaccgacatctccgagatgggcgcaaacttccgcgcagaccgggtgatcgacccgcgtagatgcctcaaaccagtcatcctgaaggacgggcctgagagggtcatcctggcgggccccatgcctgtgaccgtagcctccgccgcacagcggcgagggcggatcggccggaaccacaacaaggagggcgaccaatacatttatatgggacaaccactcaacaacgacgaggaccacgcacactggaccgaggcgaagatgctgctggacaacatcaatactcccgagggcattatccccgccctcttcgagccggaacgcgaaaagtcggccgccatcgacggggaataccggctgaggggcgaagcacggaagacgttcgtagagctgatgcgccgaggggacttgcccgtttggttgtcgtacaaggtggcaagcgagggattccagtacagcgaccgtcgatggtgcttcgacggcgagcgcaacaaccaggtgctggaagagaacatggacgtggaaatctggaccaaggagggggagcggaagaagctccgcccacggtggctcgacgcccgcacctactcagatcctttggccctccgggagtttaaggaattcgctgctggccgcagaagtgtctccggggacctgatcctagagatcggcaagctcccgcagcatctgacgcagcgcgcccagaacgcgctagataacctcgtgatgctgcacaacagcgagcagggcgggcgggcctaccgccacgccatggaggagctgccagacaccatcgaaaccctgatgctgctggcgctgatagcagtgcttacaggcggggtcactctgttcttcctctctggccgcgggctggggaagacgtccatcggtctgctctgtgtgatggcctccagcgtcctgctctggatggccagtgtggagccccactggatcgccgcgagcatcatcctggagttcttcctcatggttctgctcatccccgagcccgatcgccagcggactccccaggacaaccagctggcctatgtggttatcggactgctattcatgatcctgacggtggcggccaacgagatgggcctgctcgagactactaagaaggacctggggatcggccacgtagccgtcgagaaccaccaccacgcggctatgctggatgtggaccttcaccccgcatccgcctggaccctatacgccgtggcgacaaccatcatcacgccgatgatgcgccacacgatcgaaaacaccacggcaaacatcagcctgacggcaatcgccaaccaagccgcaatccttatggggctggacaagggctggcccatctccaagatggacattggcgtccccctgctggccctggggtgctacagccaagtcaaccccctgaccctcaccgcggccgtgttaatgctcgttgctcactacgccatcatcggcccagggctccaagcaaaggccacccgcgaggcccaaaagcggacggcggcaggcatcatgaagaaccccacagtggacgggatcgtcgccatcgatttagaccccgtcgtgtacgacgcgaagtttgagaaacagctgggccagattatgctcctgatcctgtgcacgtctcaaatccttctaatgcgcacaacatgggccctgtgcgagagtatcacactcgccacaggccccctgaccaccctgtgggagggttccccgggcaagttttggaacaccaccatcgccgtgagcatggccaacatcttcagggggtcttacctcgccggcgccggcctagcgttctccttaatgaagagtttggggggcgggcgcaggggcaccggggcgcagggagagacgctgggcgaaaaatggaagcggcagctgaaccagctctccaaaagcgagtttaacacgtacaagcgtagcgggatcatggaggtcgatcgcagcgaagccaaggagggcctgaagcgcggcgagaccacaaagcatgccgtatcccgcggcacggcgaaactgcgttggttcgtggaacgtaatctcgtcaagcccgaggggaaggtgatcgacctgggctgcggcaggggcggatggagctactactgtgccgggctaaagaaggtgactgaggtgaaggggtacacaaagggtggcccgggccacgaagagcccatcccgatggcaacctacgggtggaacctggtgaagctccactccggcaaggacgtgttctttatccctcccgaaaaatgcgatacgctgctgtgcgacattggtgagtcttcccccaaccctactatagaggagggccgtaccctccgggtcctgaaaatggtggagccctggctcaggggcaaccagttctgcattaaaatcctcaacccctacatgccgagtgtggtggagacactggagcagatgcagcggaagcacggcggcatgctggttcgcaatcctctatctcggaattccacgcacgaaatgtactgggtatcctgtgggacgggcaacatcgtcagcgccgtgaacatgacatcccgcatgttgctgaaccgtttcacaatggcccaccgtaagcccacctacgaacgcgacgtggacctcggggcgggaacccggcacgtcgccgtggagcccgaggtggccaacctagatatcatcggccagcggattgaaaacatcaagcacgagcacaagtcaacatggcactacgacgaagacaacccctacaagacctgggcctaccacgggtcctacgaggtaaagccatccggctcagcctctagcatggttaacggggtcgtgaaacttcttaccaaaccctgggacgtaatacccatggtcacgcagatcgcgatgaccgataccacccccttcggccagcagcgggtgttcaaggagaaggtggacacacgaactcccaaggccaagagagggacagcccaaatcatggaggtaaccgccaagtggctgtggggctttctgtcccgcaacaagaaaccccggatctgcacgcgcgaggagtttacccggaaagtgcgctccaacgccgcgatcggtgcggtgttcgtagacgagaaccagtggaactccgcgaaggaggccgtggaggatgagcgcttctgggacttagtacaccgcgagcgggagctgcacaaacagggaaagtgcgctacctgcgtctataacatgatgggcaagcgcgagaagaagctgggggaattcggcaaagcaaaggggagcagagccatctggtatatgtggctcggggcccgtttcctggagttcgaggcgctgggattcatgaacgaggaccattggttctcccgtgagaacagcctctccggggtggagggcgaaggcctgcacaagctgggctatatcctccgcgatattagcaagatccccgggggcaatatgtatgccgacgacaccgccggctgggatacgcgcatcaccgaggacgacctgcagaatgaggcccgaatcaccgacatcatggaaccggagcacgccttgctcgccaagagtattttcaagctgacctaccagaataaggtggtcagagtacagcggcccgcgaagaacgggacggtgatggatgtcatctcacgccgggatcagagagggagcggtcaggtgggtacttacggcctgaacaccttcaccaacatggaggcccagctgatcagacagatggagtcggagggaatattctccccctcggagttagagacaccaaaccttgccgagagagtgctagactggctggagaagtacggcgtcgagcgtctgaaacgcatggccatctccggggacgattgcgtggtgaagccgatcgatgacagattcgccaccgcgttgaccgcccttaacgacatgggcaaggtccgcaaggacatcccccagtgggagccctcaaaggggtggaacgactggcagcaggtccccttctgctcgcatcacttccaccagctgatcatgaaggatggcagagagattgtagtgccgtgccgcaaccaggacgagctcgtaggccgcgccagggttagccagggcgcaggctggagcctaagagagaccgcctgcctggggaagtcctacgcgcagatgtggcagttaatgtacttccaccgcagagacctgcgcctggccgccaacgctatctgcagcgcggtccccgtagactggatcccaacgtcccggaccacctggtccattcacgcgcaccaccagtggatgaccactgaggacatgctctccgtgtggaaccgcgtttggatcgaagagaatccctggatggaggacaagacccatatctcctcctggggcgacgtgccgtacctggggaaacgcgaagaccagtggtgtggcagcctgattggcctcaccgccagagccacgtgggccaccaatatccaggtcgccatcaaccaggtccgacggctgatcgggaacgagaactacttggattacatgacttccatgaagagattcaagaacgagtccgaccccgagggggccctctggtga

SEQ ID NO: 24163 - RNA, 9879 nt, synthetic construct
  misc_feature 1..9879: note = derived and/or modified CDS sequence (opt11) from DENV-1__FJ432733__SS-prME
  source 1..9879: mol_type = other RNA
agcgtaactatgctgctcatgcttatgcccaccgccctagccttccacctcaccacccggggtggggaaccccacatgatagtgaccaaacaggagcggggaaagagcctgctattcaagaccagcgccggggttaatatgtgcaccctcatcgccatggacctcggcgagctgtgcgaggacaccatgacctataagtgcccacggatcaccgaggtggagcccgacgacgtagactgctggtgcaacgcgacggacacctgggtgacctacggaacctgtagccaaacgggagagcaccggcgcgataagcggagcgtggccctcgctccccatgtaggcctgggcttggagacccgcacagagacctggatgtccagcgagggcgcctggaagcaaatccagcgtgttgaaacgtgggccctccgccaccccggcttcacagtgatagccttgtttctggcccatgttatcggcacatccattacccagaagggaatcatattcatcctcctgatgctcgtgacgcccagcatggcgatgcggtgcgtgggcatcgggtcccgggacttcgtcgagggtctcagcggggccacctgggttgacgtcgtcctggagcacggcagctgtgtgaccaccatggcgaaggacaagccgacgctggatatcgaacttctgaagaccgaagttacgaatcctgccgtcctgcggaagttgtgcattgaggctaagatttctaacacaacaactgactcccgctgccccacccagggcgaggcaacccttatggaagagcaagacgcaaacttcgtgtgcagacgcacgtttgtggatcgcgggtggggaaacgggtgtggcctgttcggcaagggcagcctcatcacgtgcgccaagttcaagtgtgttacaaaactggagggcaagatagtccagtacgagaatttaaagtactccgtaatagtgaccgttcacacgggcgaccagcaccaggtagggaacgagagcaccgaacatggcaccatcgccaccatcacgccacaggcgcctacgtctgagatacagctcacagactacggggcgctgacgcttgactgcagcccccgcactggcctcgactttaacgaaatggtgctgcttacgatgaaggagaaatcctggctcgtccacaagcagtggttcctggacctcccattaccctggacgtctggggcgtcgaccagccaggagacctggaatcggcaggacctgctggtaacgttcaagacagcacacgccaagaagcaggaggtggtagttctcggctcccaagaaggcgccatgcacaccgcgctcaccggggccacggagatccagacctccggcaccaccacgatcttcgccggtcatctgaaatgccgcctcaagatggataagctgacgctgaagggcatgtcatacgtgatgtgtacggggtccttcaaactcgagaaggaggtggccgagacccaacacggcacggtcctcgtgcagattaagtatgaaggcaccgatgcaccatgtaagatcccctttagtacacaagacgagaagggggtgacccaaaacgggcgtctgatcacggcgaacccgatcgttacggacaaggaaaagcccgtaaacatcgaggccgagccgccattcggggaatcctacattgtgatcggtgccggcgagaaggccctgaagctcagctggttcaagaaggggtccagcatcggcaagatgttcgaggcgactgcccgcggtgcccggcggatggctattttgggcgacaccgcgtgggacttcgggtccatagggggagtcttcacttcagtagggaaactggtgcaccaaatcttcggcaccgcgtacggagtcctcttctccggggtgagctggaccatgaaaatcgggatcggcgttctgctgacgtggctcggtcttaattcccggagcacctcgttgagcatgacctgcatcgcggtcgggcttgtgacattatacctgggcgtgatggtccaggccgatagcgggtgcgtgatcaactggaaggggcgggaactcaagtgcggtagtggcatcttcgtgaccaacgaggtacacacctggaccgaacagtacaagttccaggcagacagcccgaagcgcctgagcgccgcaatcggcaaagcctgggaggaaggtgtgtgtggcattcggtcagcaacacgcctggagaacattatgtggaaacaaatctccaacgagctcaatcacattctactggagaacgacatgaagtttaccgtggtcgtgggtgatgtggtcggcatcctcgcccaggggaagaaaatgatacgtccgcagcccatggaacacaagtattcctggaaatcctggggcaaggccaagattatcggcgcggacgtgcagaacaccacgttcataatagacgggcctaacacgccggagtgtccagacgaccagcgagcctggaacatctgggaggtcgaggactacggcttcgggatcttcacgactaacatctggttaaaactgcgggatagccacacgcaagtttgtgaccaccgcctcatgtccgccgccatcaaggatagtaaggcggtacatgccgacatgggctactggattgagtcagagaagaacgaaacttggaagttagcccgcgccagcttcatcgaggtaaagacctgtatctggcccaagtcccataccctttggagcaacggcgtcctcgagtccgagatgatcatccccaaaatctacgggggcccgatatcacagcacaactaccgcccagggtacttcacgcaaaccgcagggccatggcatctgggtaagttggagctcgatttcgacttatgcgagggcaccaccgttgtggtcgacgagcattgcggcaaccgggggccgagcctgcgcacgaccaccgtgacaggcaaaataatccacgagtggtgctgccggagctgcactctgccgcccctacgcttcaaaggggaggacggctgctggtacgggatggagatccgtcccgtcaaggagaaggaggagaacctcgtcaagagcatggtctcggccggctcgggtgaagtggacagtttcagtcttgggcttttgtgcatttccatcatgatcgaagaggttatgcgaagcaggtggtccaggaagatgctgatgaccggaacactggcggtcttcctgttactgatcatgggacaactcacctggaacgacctgatccggctttgcatcatggtgggcgccaacgcctcggaccgcatggggatgggcaccacatacctggccctcatggcgactttcaaaatgcgcccgatgttcgccgtcgggctgttattccggaggctcacctctcgggaggtgctgctactcacgatcggactgagccttgtcgcatccgtggagctcccaaacagcctggaagagttaggggacgggctagccatgggcataatgatcctgaaactgctcaccgacttccagtcccaccagctttgggctaccctgctgagcctcactttcataaagacgaccctgtcccttcattatgcctggaagacgatggccatggtgctgagcatcgtctccctattcccgctctgtctgtctaccacttcccagaagaccacctggcttcccgtgctcctgggcagcctggggtgcaaaccgctggccatgctgctgatcgccgagaacaaaatttggggacgcaagtcctggcccctcaatgagggtattatggcggtgggcgtcgtgtctatcctgctgtcatccctccttaagaacgacgtgccccttgccgggcccctcatcgcgggtgggatgctgatcgcatgttacgtgatcagcggctccagcgccgatctgtccctcgagaaggcggccgaagtaagctgggaggaagaggccgagcactccggtgcttcgcacaacatcctggttgaggtccaggacgatggcactatgaaaatcaaggacgaggagcgggacgatacactaacaatcctcctgaaggcgacgcttctcgcagtgtctggcgtgtatccgctgtctatccccgccacactgtttgtttggtatttctggcagaagaagaagcagcgctcgggggtactgtgggacacccccagcccgcccgaggtggagagggccgttcttgacgatggaatctaccgcatcatgcaacggggcctgctcggtcgctcccaggtgggggtgggggtcttccaggagaacgtgtttcacacgatgtggcacgtaacacggggcgccgtcctaatgtaccaggggaagcgactggagcccagttgggcctccgtaaagaaagacctcatcagttacggtggcgggtggcgcctgcagggcagctggaataccggggaagaagtgcaggttatcgcggtggagcccggcaagaacccaaagaatgtgcagaccgcccccgggacgttcaagacccccgagggagaggtcggcgcgatcgccctggatttcaaacccgggacctcgggctccccgatcgtaaaccgcgaaggaaagatagttggcctgtacggcaacggtgtcgtgaccaccagcggaacttacgtgagcgcaatcgctcaggcaaaagcctcccaggaggggccgctccccgagatcgaagacgaggtgttccggaagcgaaacctgaccatcatggacttacatcccggttccgggaagactcggagatacttgcccgccatcgtgcgggaggcgataaagcgcaaactccggacgcttatcctggcacccactcgcgtggtagcctccgagatggccgaggccctgaagggcatgccgatccgctatcaaactaccgcggtgaaaagcgagcacacagggaaggagatcgtcgacctgatgtgccatgccacgttcaccatgagactcctgtcccccgtgcgcgtgcctaactacaacatgatcatcatggacgaagcccactttacggacccgagctcgatcgccgcccgggggtacatctcaacgcgcgtgggcatgggggaagcggctgccatcttcatgaccgccacgccgcccgggagcgtcgaggcattcccccaaagcaacgcggtgatccaggacgaggagcgggacatccccgaacgctcctggaatagcgggtatgagtggatcaccgacttccctggaaagacagtgtggttcgtcccgtccatcaagtcaggcaacgacatagccaattgcttaaggaagaacgggaagcgcgtgattcagctatcccggaagaccttcgacactgagtaccagaagactaagaacaacgattgggactacgttgtcactactgatattagcgagatgggcgcgaacttccgtgccgaccgggtgatagacccacgccggtgcctgaagcccgtcatcttgaaggacgggcccgaacgcgtcattctcgcgggcccgatgccggtgacggtcgcgtccgccgcccagcggagggggcggatcggacgcaatcacaacaaggagggcgatcaatacatctatatggggcaacccctaaacaacgacgaggaccacgcacattggacggaagctaagatgctgttagacaacatcaatacgcctgagggcatcatccctgccctgttcgagcctgagcgggagaaatccgccgctatcgacggggaataccgcttgcgcggtgaggctagaaagacattcgttgaactcatgcggcgcggggacctccccgtgtggctttcctacaaggtcgcgagcgagggatttcagtatagcgaccgccggtggtgtttcgacggcgagaggaacaaccaggtcctcgaggagaacatggacgtggagatctggaccaaggagggtgagcgtaaaaaactgcgcccccggtggctggatgccaggacttattcagacccactcgccctgcgggagttcaaggaattcgccgctgggagaagaagcgtttccggcgacctgattttggagataggcaagctgccgcagcacctgactcagcgcgcgcagaacgccctcgacaacctagtcatgctgcacaactcagagcaaggcgggcgggcctaccggcacgccatggaggagcttccggacacgatagaaacactgatgctgcttgcgctgattgccgtcctaaccggcggggttaccctgttctttctgtccggccgtgggctgggtaagacctccattggcctcctgtgcgttatggcctctagcgtgttgctctggatggcctccgtcgagccccactggatcgctgccagcatcatactggaattcttccttatggtgctcctaatccccgagcccgaccggcagagaacgccccaggacaaccagctcgcgtacgtggtcatcgggctcctgtttatgatcctgaccgtggctgccaacgagatggggctcctagaaacgacgaagaaggacctggggatagggcacgtggccgtagagaaccaccatcacgcgacgatgctcgacgtggatctccaccccgcctccgcctggaccctctacgctgttgccactacgattatcaccccgatgatgcgccatacaatcgaaaacactacggcgaatataagccttacggccatcgcaaaccaggccgctatcctaatggggctagacaagggctggcccatatccaaaatggacatcggcgttccactcctggcgctgggctgttacagccaggtgaaccctctcacgctcaccgccgccgtcctgatgctcgtcgcgcactacgcgatcattggaccggggctgcaggctaaggccacgcgcgaggctcagaagcgcaccgccgcaggcatcatgaagaaccccaccgtggatggcatcgtcgccatagacttggaccccgtcgtgtatgacgccaagttcgagaagcagctcggccagattatgctgttgattctctgcactagtcagatactactgatgcgcactacctgggccctttgtgagtctatcaccctggccaccggtcccctgacgaccctatgggagggttcccccggcaagttctggaataccaccatcgcagtatcaatggcgaacatcttccgcgggtcctacctggctggcgccggactggccttttcgctaatgaagagcctagggggaggtagacgggggacgggggcgcagggcgagaccctgggcgaaaagtggaaacgccagctaaaccagctgtccaaaagcgaattcaacatctacaagcggtccgggatcatggaggtcgaccgctccgaggcgaaggagggtctgaagcgcggggagactacccgacacgccgtgtcccggggcacggcgaagctccgctggtttgtggagcgtaacctggtcaagcccgagggtaaggtgatcgacctgggctgcggtcgcggaggttggagctattattgtgcggggctgaagaaggtgaccgaagtcaagggctacaccaagggcgggcctggccacgaagagcccatcccgatggccacctatgggtggaacctagtgaaactgcattcgggcaaagacgtgttcttcaccccgccagagaagtgcgacacattactctgcgacatcggggagtcatctcccaaccccaccatcgaggaaggccggaccctgcgcgttctgaagatggttgagccttggctccgggggaaccagttctgtattaagatcctgaatccatacatgccctcggtcgtcgaaaccctggagcaaatgcagcgtaaacatggaggcatgctcgtacggaacccgctctcccggaatagcacccacgagatgtactgggtatcctgcgggaccggcaacatcgtttcggccgtgaatatgaccagccgtatgctgctcaaccgctttaccatggcgcaccggaaacccacgtacgagcgggacgtggacctgggggccggaaccaggcacgtcgcggtcgagccggaggttgcgaacctggacatcatcggccagcggatcgagaacatcaagcatgagcataagagcacctggcactacgacgaggacaacccatataagacctgggcctaccacgggtcctacgaggtcaagcccagcggctctgctagcagcatggtgaacggggtcgtgaagttgctaacgaagccctgggacgtgatccccatggtcactcagatcgccatgaccgacaccacacccttcggccagcagcgcgtattcaaagagaaagtcgacacccggacacctaaagctaagcgcgggacggcccagatcatggaggtgactgcccgatggctgtggggcttcctcagtcgtaacaaaaagccgcggatctgcacacgcgaagagttcacccggaaggtccgatctaacgccgcaatcggggcggtttttgttgacgaaaaccagtggaactccgccaaagaggccgtggaagatgaacggttctgggacctggttcagaaggaacgagagttacacaagcaggggaagtgcgcaacgtgcgtctacaatatgatgggcaagcgcgagaagaagttgggtgaattcggtaaggcgaaggggagccgcgccatttggtatatgtggttgggagctcggttcctggagttcgaggccctcggctttatgaacgaggaccattggttctcccgagagaacagcctgtctggagtggagggcgagggcctgcacaagctcggctacattctacgggacatctcgaaaatccccgggggcaatatgtacgcagacgacaccgcgggctgggacacaaggatcaccgaagacgacctgcaaaacgaggcacggatcaccgacattatggagccagaacacgccctcctggccacgtcaatctttaaactgacctatcagaacaaggtggtaagagtgcagcgccccgccaagaatggcaccgtgatggatgtcatatcccggagggaccaacgaggctccggccaagtgggcacctacggactcaatacgtttaccaatatggaagcgcagctgattcgccaaatggagagtgaggggatctttttgccctccgagctcgagacccaaaacctggccgagcgggtgctggattggctagagaagtacggcgttgaacgcctgaagcggatggccatctccggggacgactgtgtggtgaagcccatcgacgacagatttgccaccgccctgacggcgctgaatgacatgggcaaggtgcggaaggacatcccgcagtgggaaccatccaaggggtggaatgactggcagcaagtccccttctgtagccatcacttccaccagctaataatgaaggacggcagagagatcgtggtgccctgtcggaaccaggatgagctcgtgggccgcgcccgggtgtcccaaggggcgggctggagcctccgcgagaccgcctgcctgggcaaaagctacgcccagatgtggcaactgatgtactttcaccgtcgcgacctccggctggcagcaaacgcaatctgcagcgccgtcccggtagactgggtgcccacgtcccgcactacgtggtccatccacgcgcatcaccagtggatgaccacagaggacatgctgagcgtctggaaccgggtgtggattgaggagaatccctggatggaggacaagacccatgttagttcttggggtgacgtcccctacttgggaaagcgcgaggaccagtggtgcggatccctcatcggactgacggctagagccacctgggcctcaaatatccaggtggcgatcaaccaggtgcggcgcctcatcgggaacgagaactacctggactacatgacctccatgaagcggtttaagaacgaaggcgacccggagggagcgctgtggtga

SEQ ID NO: 24164 - RNA, 9879 nt, synthetic construct
  misc_feature 1..9879: note = derived and/or modified CDS sequence (opt11) from DENV-1__FJ410196__SS-prME
  source 1..9879: mol_type = other RNA
agcgtgacgatgctattaatgctgatgcccaccgcgttagcgttccacctcaccacccgggggggcgagccccacatgatcgtgagcaagcaggaacgggggaagtcgctgctcttcaagacgtcagccggggtcaacatgtgcaccttgatcgccatggacctcggcgagctatgcgaagacacaatgacctacaaatgcccccgtatcacggagaccgagcccgacgatgtggactgctggtgcaacgccactgacacctgggttacctatgggacctgcagccagactggagagcatcggcgcgacaagcgttccgtggctctcgcgccccacgttggcttagggctggagacccgcaccgaaacctggatgagcagcgagggcgcgtggaagcagattcagcgggtggagacgtgggccctccgccacccagggtttaccgtgattgccctgttcctggcccacgcaatcggcaccagcatcacccagaagggaatcatcttcatactcctgatgttagttacgccctcgatggccatgcgttgcgtcggcatcggctctcgcgacttcgttgaggggctctcaggcgctacatgggtggacgtcgttctggagcacgggagctgtgttaccaccatggccaaggacaagcccacactggacatcgagctcttaaagaccgaagtcacgaacccagccgtgctacggaagctgtgcatcgaagcgaagatctccaacacaacgaccgacagccgctgtccgacgcagggcgaggcaaccctcgtagaagagcaggatgcgaatttcgtctgccgacgcacattcgttgaccggggctggggtaacggctgcgggctgttcggcaagggctcgctaatcacgtgcgccaagttcaaatgcgtaactaagctggagggaaagatcgtccagtatgagaacctaaagtatagcgtgatagttactgtccatacgggtgaccagcaccaggttggcaacgaatccacagagcacgggaccacagccaccataacaccccaggcgccgaccaccgagatacaactcaccgactacggggccctgacgctggactgcagcccccgcaccggcctcgacttcaacgagatggtccttctgaccatgaaggagaagtcctggctcgtgcacaagcagtggttcctggacttgcccttgccttggaccagcggggcttccacgtcccaggagacctggaacaggcaggaccttctggtgaccttcaagaccgcgcacgcgaagaagcaggaggtagtggtgttgggcagccaggagggcgcgatgcacacggccctgaccggagccaccgagattcagacctccggaacgaccaccatcttcgctgggcacctgaagtgtcgccttaagatggacaagctgaccctgaagggcatgagctacgtgatgtgcacgggatcgttcaagcttgagaaagaggtggccgagacccagcacggtaccgtgctcgtgcagatcaagtacgagggcaccgacgcgccctgcaagatcccattcagcacacaggacgagaagggggtgacccagaacggacggctgatcaccgcaaatccgatcgtgaccgacaaagagaagcccgtcaatatcgaggccgagccgcccttcggggaatcctacatcgttatcggcgccggtgagaaggcactgaagctcagctggttcaagaaggggtcatccattggcaagatgttcgaggccacggcccgcggggcccggcgcatggcaatcctgggcgataccgcttgggacttcgggtccatcggtggagtgttcacctctgtcgggaagctggtgcaccagatctttggcaccgcctatggagtcctgttctccggagtctcatggacaatgaagatcggtattggagtattgctgacgtggctcggactgaactcccgaagcacctccctgagcatgacatgcatcgccgtggggctcgtcactctgtatcttggcgtgatggtgcaggcagactccgggtgcgtcataaattggaaaggccgagaactaaagtgcgggagcgggattttcgtcacgaacgaggtacacacctggaccgagcagtacaaattccaggccgacagcccgaagcgcctgtccgctgctataggcaaggcttgggaggagggggtctgcggaattcgctccgccacccgcctggagaatatcatgtggaagcaaatctcgaacgagctcaaccacatcctactggagaacgacatgaaattcacggttgtggtaggggacgttgccggcatcctcgcacaagggaagaagatgatcaggccccagcccatggagtacaagtacagttggaagagttggggcaaggccaaaatcatcggtgccgacgtgcagaacacaacctttatcatcgatgggcccaacactccggagtgtcccgacgaccagcgcgcctggaacatctgggaggtagaggactacgggttcgggatcttcactaccaacatctggctgaagctgagagacagctacacccaggtgtgcgatcatcgcctcatgtctgcggccatcaaggacagcaaagcagtacacgccgatatgggctactggatagagtcggagaagaacgagacgtggaagctggcccgggcgagcttcattgaggtcaagacgtgtatctggcccaagtcccataccctgtggagcaacggcgtgctcgagtccgagatgatcatcccaaagatctatggtggcccgatcagtcaacataactaccgccccggttacttcacgcaggccgctggcccctggcacctggggaagctggagctcgactttgacctgtgtgaaggcaccacggtcgtcgtggacgagcattgcggcaacagaggtccgtctttgcgtactaccaccgtgacgggaaagatcatccacgagtggtgctgccgaagctgcactctgccgccactccgcttccgcggcgaggacggctgttggtacgggatggagatccgccccgttaaggagaaagaggagaacctggtgaaatccatggtgagtgccggtagcggcgaggtcgactccttcagcctcgggctgctatgcatatccatcatgattgaagaggtgatgcggtcccggtggtcccgacgcatgctcatgaccgggaccctggccgtgttcttcctgttaataatggggcaattgacgtggaatgatctgatacgcctatgtatcatggtcggagcgaatgcgagcgaccgtatggggatggggaccacctacctggccctaatggccaccttcaagatgcgccctatgttcgccgtgggattgctgttcagacgcctgacgtcccgggaggttctgctgctcaccatcgggctcagtttagtcgcgtcggtggaactgcccaacagcctcgaggagctgggggacggactggccatgggcatcatgatcctcaagctattgaccgatttccagtcccaccaactctgggccaccctgctgtccctcacgtttattaagaccaccttctccctgcactatgcttggaagaccatggcgatggtactgagcattgtgtccctcttccccctgtgcctgtctacgacatcgcagaagacaacctggctgccggtgctgctgggcagcctcgggtgcaagcctctgacaatgttcctcatcgcagagaataagatctggggccgccggtcctggcccctcaacgaggggatcatggccgtcggcatcgtgagcatcctgctgagctcgttattaaagaatgatgtacccctggccgggcccctcatcgcaggaggcatgctgatcgcctgctacgtcatctctgggtccagcgccgacctgagtctagagaaggctgccgaggtgtcgtgggaggaggaggcagagcatagtggcgcgagccacaatattctagtggaggtccaggacgacgggacaatgaagatcaaggacgaggagagagacgacaccttaaccatcctcctgaaagcaactttgcttgccgtgtccggcgtttacccgctgagcatccccgctacactgttcgtctggtacttctggcagaagaagaagcagcggtcgggggtgctctgggacacccccagcccgcccgaggtcgagcgcgcagtcttggacgacggcatctaccggataatgcagcgcggcttacttggccggtcccaggtgggcgtcggggttttccaagagaacgtgtttcacacaatgtggcacgttacgaggggcgcggtgcttatgtaccaagggaagcgcctcgagcccagctgggcctccgtgaagaaggacctgatcagctacggcggtgggtggcgcctccaaggtagttggaacacgggggaagaggtgcaggtcatcgctgtggagcccggcaagaaccccaagaacgtgcagaccgccccagggaccttcaagacgcccgagggcgaggtcggcgccattgcgctggactttaaaccagggaccagcggctcccccatagtgaatcgggagggtaagatcgtgggcctgtacggcaacggagtcgtcaccactagcggaacttacgtgagcgccatcgcccaggccaaggcgtcccaggaggggccgctccccgaaatcgaggacgaggtattccgcaagcggaacctgacgatcatggacttacaccccggtagcgggaagacccgacggtacctcccggccatcgtccgcgaggccatcaaacgcaagctgcggaccctgatcctcgcccccacccgagtagtcgcctccgagatggctgaagccctgaagggcatgcccatccggtaccagacaaccgccgtcaagagtgagcacaccggcaaagaaatcgtagacctgatgtgccacgccactttcacgatgcgcctgttgtctcccgtccgggttccaaattacaacatgattatcatggatgaagctcatttcaccgacccgttctcgatcgcggcccgcgggtacatttccacccgtgtaggcatgggggaggccgctgccatcttcatgaccgcgacaccgcccggaagcgtcgaggcctttccacaatccaacgccgtgatccaggacgaggagcgcgacattcccgaacggagctggaactccggttatgagtggatcacagacttccccggcaagaccgtgtggttcgtccccagcatcaagtctggcaatgatatcgccaactgcctgcgaaagaacgggaaacgggtgatacagctttctcgcaaaacctttgacacggagtaccagaagaccaagaacaacgactgggactacgtggtcaccaccgacatctccgaaatgggcgcgaacttccgggcagaccgcgtgatcgatccaagaagatgtttaaagcccgtaatcctgaaggatggtcccgaacgggttatcctcgcaggacccatgcctgtgaccgtcgcctcagccgcacagcgccgggggcgcatcggtcgcaaccacaacaaggagggcgatcagtacatctacatgggacagcccctgaacaacgacgaggatcacgcacactggactgaagccaagatgctgctcgataacatcaacaccccggagggcatcatccccgccctctttgagccggaacgggagaagtccgccgctatcgacggggagtaccgcctgcggggcgaggcccgcaaaaccttcgtggagttaatgcggcgcggggatctacccgtctggctgagctacaaggtcgcctccgagggctttcagtatagcgaccgtcgctggtgctttgacggcgaaagaaacaaccaggtgcttgaggaaaacatggacgtagagatttggacgaaagagggggagcgcaagaagctacggccccgctggctggacgcccgtacctatagcgatcccctcgccctccgggagttcaaggaattcgcggccggcaggcgctccgtcagctcggatctgattttggagatcggaaagctgccgcaacacctgacccagcgcgcccagaacgccctcgacaacttggtgatgctgcacaacagcgagcagggtggccgcgcgtatcggcacgcaatggaggagctccccgatacaatcgagacgctaatgctgctcgcactcatcgcagtgctgaccgggggcgttaccctctttttcctgtccggccgcggccttgggaagacctccatcggtctcctgtgcgtcatggccagcagcgtgttgctgtggatggcgtctgtcgagccccactggatcgccgctagcatcatcttagagtttttcttaatggtactcctgatccccgagccggatcggcagagaacgccccaggataaccagctagcctacgtggtcataggcctcctgtttatgatcctgacggtcgccgcgaacgagatggggttgctggagaccaccaagaaggaccttggcatcgggcacgtggccgtcgaaaatcaccaccacgccgcgatgctcgacgtggacctgcaccccgcctccgcgtggaccctgtacgccgtggctacgaccatcatcacgcccatgatgcgccataccatcgagaatacgactgctaacatcagcctcaccgccatcgcgaaccaggcggccatcttgatgggcctggacaaggggtggcccatcagtaagatggacatcggcgtccccctcctggccctgggctgctacagccaggtgaaccccctcacgctgacagcggcggtgctgatgctcgttgcccactacgcgatcataggaccaggccttcaggccaaggcgacaagggaggcccaaaagcgcacggccgcagggattatgaagaaccccacagtggacggcattgtggctatcgacctggaccctgtcgtgtacgacgcgaagttcgaaaagcaactcgggcagatcatgcttctgatcctgtgcacgtcccagatcctgctgatgcggaccacctgggccctatgcgagagcatcaccctggccacgggccccctgactactctctgggaggggtcaccggggaagttctggaacacgacgatcgctgtgagcatggccaacatcttcaggggctcctatctagcgggtgcaggcctggccttttcgctcatgaagtccctgggcgggggccggcgagggaccggcgcacagggggagaccctgggcgagaagtggaagcggcagctgaaccagctgtccaagagcgagttcaacacctacaagcgctctggtatcatggaggtcgatcggtcagaagcgaaagagggactgaagcgcggtgagacgaccaaacatgccgtgtcccgtgggacggccaagttgcgctggtttgtcgaacggaaccttgtcaagcccgagggcaaggtgatcgacctggggtgcggccgcggcgggtggagctactactgcgccggcttaaaaaaagtgaccgaggtcaagggatacacgaagggcgggcccggacacgaggagcccattccgatggccacctacggctggaacctcgtgaaattacattccggcaaggacgtcttctttatcccacccgaaaagtgcgacaccctgctctgcgacatcggcgagagctcccccaatccaactatcgaggaagggcggacgctgcgcgtgctgaagatggtggaaccctggctcagaggcaaccagttctgtatcaagatattgaacccgtacatgccatcggtggtcgagacgctggagcagatgcagcgcaaacacggaggcatgctcgtgcgaaacccgctgtcccgaaacagcacccacgagatgtactgggtgtcatgcggcaccggcaacatcgtctctgcggtcaatatgacttctcgtatgctgctcaatcggttcacgatggcccaccgtaagcccacttacgagcgggatgtagacttgggcgccgggaccaggcacgttgcagtcgaaccggaggtggcgaacctggatatcattgggcagcggatcgagaacatcaagcacgagcacaagtctacatggcactacgacgaagacaacccctacaagacgtgggcgtaccacggctcctacgaggttaagccgagcgggtcggcgagcagcatggtgaacggcgtcgtaaagttactgacaaagccctgggacgtgatccccatggtcacccagattgccatgaccgacacgacccccttcgggcagcaacgcgtgttcaaggaaaaggtggacacccggaccccgaaggccaagcgcggcactgcacagatcatggaggtgaccgcgaagtggctgtgggggttcctgtcccggaacaagaaacccagaatctgcacccgggaggaattcaccagaaaggtacggagcaacgcggccataggcgccgtctttgtggacgagaaccagtggaacagcgcgaaggaggcagtggaggacgagcgcttctgggacctggtgcaccgggagagggaactgcacaagcagggcaaatgtgccacgtgtgtctacaatatgatgggaaaacgggaaaagaagctcggcgagttcgggaaagccaaggggtctcgcgccatctggtatatgtggctgggcgcacggttcctggagttcgaagccctcggcttcatgaacgaggaccactggttctcacgcgagaacagcctgtcgggtgtggagggggaaggcctacacaagctcggttacatccttcggggcatctcaaagatccccgggggcaacatgtacgccgacgacacagccggttgggacacgcgcataaccgaggacgaccttcagaacgaggcccgcatcacggacatcatggaaccagagcacgcgctcctagccaagtcaatcttcaagctgacgtaccaaaacaaagtagtgcgggtgcagcgccctgccaagaacgggacggtgatggatgtcatttcgcggcgagaccagcggggatccgggcaggtgggaacctacggcttgaacacgttcaccaacatggaggcccagctcatcaggcagatggagagcgaagggatcttctccccaagcgagctggagaccccgaatctcgccgagagggtattagactggctggagaaatacggcgttgagcgcttaaagcggatggcaatctccggcgatgattgcgtggtaaagccgatcgacgaccgcttcgccaccgccctcaccgccctgaacgacatgggtaaggtccggaaggatatcccccagtgggagcccagcaaggggtggaacgactggcagcaggtcccgttttgctcgcatcacttccaccagcttatcatgaaagacggcagggagattgtggtcccatgccggaaccaggacgagctcgtgggtcgggcccgggtgtcacagggagcgggctggtctctacgcgagaccgcttgtctagggaagagttatgcccaaatgtggcagctgatgtacttccaccggcgcgacctgcggctcgcagcgaatgcgatctgcagcgcggtgccggtggactggatccccacctcccgcacaacgtggtcgatccacgcccaccaccagtggatgacaaccgaggacatgttgtcagtttggaatcgcgtctggatcgaggaaaatccttggatggaggacaagacccacatcagctcctggggcgacgtgccctacctagggaagcgggaagatcagtggtgcggctctttgatcggcctgacggcccgcgctacctgggccaccaacatccaggtcgccatcaaccaggtccgtcgcctcattgggaacgagaactacctcgactacatgacctccatgaagcggttcaagaatgagagtgaccccgagggcgccttatggtga

SEQ ID NO: 24165 - RNA, 9879 nt, synthetic construct
  misc_feature 1..9879: note = derived and/or modified CDS sequence (opt11) from DENV-1__FJ432734__SS-prME
  source 1..9879: mol_type = other RNA
agcgtgacaatgctgctcatgctgatgcccaccgccctagcgtttcatctgaccacgcgcggcggggagccccacatgatcgtgagcaaacaggagaggggcaaaagcctgctcttcaagacctccgccggtgtgaacatgtgtaccctcatagcaatggacttgggggagctgtgcgaggacacgatgacctacaaatgcccgcgcatcaccgaagccgagcccgatgatgtagactgttggtgcaatgccaccgatacgtgggtgacctacggtacatgcagccagactggtgaacataggcgcgacaagcggtccgtggctctcgcgcctcatgttggacttgggctggagacgcgcactgaaacctggatgtcgtcggagggtgcctggaagcagatccagcgggttgagacatgggtactccgccaccccgggttcaccgtgatagccctttttctggcacacgcgattggcactagcatcactcagaagggtatcatcttcatcctcctgatgctggtgaccccctccatggccatgcgttgcgtcggcatcggtagccgcgacttcgtggagggactgtccggcgccacgtgggtcgacgtggtgctagagcacggttcttgcgtgaccacgatggccaaggacaagcccaccctggacatcgagctgttgaagacggaggtcaccaatcccgccgtgctgcgcaagctatgtatcgaggcgaagatatcaaataccaccacggacagccgatgcccgactcagggcgaggccaccctcgtggaggagcaggacgccaatttcgtgtgcagacgcaccttcgtcgaccggggctggggcaatggctgcgggcttttcgggaaaggctcgttgatcacttgcgccaaatttaagtgtgtcaccaagctggagggcaagatcgtccaatacgagaacctgaagtacagcgtgatcgtcaccgtgcacaccggcgaccagcaccaggtcgggaacgagtcgacggagcacggtaccaccgccacaataacgccccaggcccccaccaccgaaatccaattgaccgattacggggcgctcaccctggactgcagcccccgcacgggcctcgacttcaacgagatggtgctgctgacaatgaaagaaaagtcatggcttgtgcacaagcagtggttcctggatctgccgctcccttggacgagcggggccagcacctcgcaggagacttggaacagacaggacctgctggtcactttcaagaccgcccacgcgaaaaagcaggaggtggtggtcctgggatctcaggagggcgcgatgcacacagccctgacgggggccacagaaatccaaacctccggcaccacgaccatcttcgcggggcacctgaaatgtcgtctcaaaatggacaagctaaccctgaaggggatgagctacgtgatgtgcacggggagcttcaaattggagaaggaagtggctgagacccagcacgggaccgtccttgtgcaaatcaagtacgagggcaccgacgcgccctgcaagatccccttcagcactcaggatgagaagggggtgacgcagaatggacggctgatcaccgccaaccctattgtaaccgataaggagaaaccagtaaacattgaggcggaaccgccattcggggagtcgtatatcgtgatcggggccggggagaaggcgctgaaactaagctggttcaagaagggctccagcatcggcaagatgttcgaagccactgcacgcggagcccgaagaatggccatcctgggcgacacagcgtgggatttcgggtccataggcggcgtgttcaccagcgtggggaagctggtgcaccagatatttggcaccgcctatggggtcttgttctccggcgtgtcttggacaatgaagatcgggataggcgtgctgctaacctggctgggtctgaactccaggagcacctccctgagcatgacctgcatcgccgtcggcctcgtcacactgtacctgggcgttatggtccaggccgactcagggtgcgtcatcaattggaagggcagagagttgaagtgtggaagcggaatcttcgtgaccaacgaggtccacacgtggaccgagcagtacaagtttcaagccgattccccgaagagactgtccgcggccatcggcaaagcgtgggaggagggagtttgcggaatacggagcgccacccgactggagaacattatgtggaagcagatcagcaacgagctcaaccacatcctcctagagaacgacatgaagctcaccgtggtcgtgggggatgtggcaggtatcctggggcagggcaaaaagatgatccggccgcagcccatggagtacaagtatagctggaagtcctggggcaaggctaagataatcggggccgacgcccaaaacacgaccttcatcatagatggccccaacacaccggagtgccctgacgaccagcgagcctggaacatctgggaagtcgaggactatggcttcggcatgttcaccaccaacatctggctgaaactacgggacagctacacccaggtgtgcgaccataggctgatgtcagcagcgattaaagatagcaaggccgtacatgccgacatgggctactggatcgagagcgagaagaacgagacttggaagttagctagagccagtttcatcgaagtgaagacctgtatctggcccaagagccacacgctctggtcgaacggggtgctggagagcgagatgattatccccaagatatatggcggtccaatctcccaacacaactaccggcccggttatttcacgcagaccgctgggccctggcacctgggcaagttagagctcgactttgacctgtgcgagggaaccacggtagttgttgacgaacactgcggtaacaggggcccgtccctgcgcaccaccaccgttacgggaaagatcatccacgaatggtgctgccggagttgcaccctgccgcccttgcgcttccggggagaggatgggtgctggtacggcatggagattcgccccgtcaaggaaaaggaggagaacctcgtgaagtccatggtgtcagccggcagcggggaagtcgactcctttagcttaggcctgctctgcatctccatcatgatcgaagaggtgatgcgaagcagatggtcccgcaagatgctgatgacagggaccctagccgtcttcttcctcctgatcatgggccagcttacgtggaacgacctcatccgcttatgcatcatggtcggggccaacgctagcgaccgtatgggtatgggcacaacctacctggccctcatggccaccttcaagatgcggccgatgtttgccgtggggctgctgttccgcaggctcacgtcccgcgaggtgcttctgcttaccatcggcctgtcactggtcgcctccgtagagctccccaactccctggaggagctgggggatggcctcgcgatgggcatcatgatactcaagctgttaaccgacttccagtcccaccagctgtgggccaccctactcagtctgacgttcatcaagaccaccttctcacttcactatgcctggaagaccatggccatggtcctcagcatagtgtctctgttcccgctgtgccttagcacgacctcccaaaagaccacctggctccccgtgttactcgggagccttggatgcaaaccgctcacgatgttccttatcgcggagaacaagatatgggggcgcaagagttggcctctgaacgaaggcattatggcagtcgggatcgtaagcatactgctcagcagtctgctgaagaacgacgttcccttggccggcccactgatcgccggcgggatgctgatcgcctgctacgtcataagcggcagctcggctgacctcagtctggagaaggccgccgaggtgtcttgggaggaggaggcagaacactccggggcatcccacaatatactggtggaggtacaggatgatggcactatgaagatcaaggacgaggaaagagacgacacactcaccatcctgttgaaggcgaccctactggccgtgtccggggtgtaccctttaagcatccctgcaaccctcttcgtctggtatttctggcaaaagaagaaacaacgttccggcgtgctgtgggacacacccagcccgccggaagtcgagcgcgctgtcctggacgacggcatctaccggatcatgcagcgcggcctactcggccggtcccaggttggcgtgggcgtattccaggagaacgtgttccacaccatgtggcacgtgacccgcggcgccgtcttgatgtaccagggcaaacggctggagcccagctgggcatccgtgaagaaagacctaatttcctacggagggggctggcgcctcagagggtcctggaacacgggcgaagaggtccaggtcatagccgtcgaaccggggaagaatcctaagaacgtgcagaccgcccccggcacctttaagacgcccgagggcgaggttggagcgatcgcactggactttaagcccggcacaagcgggtcccccatcgtgaaccgcgagggcaagatagtgggtctctacggaaacggcgttgtgaccaccagcgggacctacgtgagcgcgatcgcccaggccaaagcctcccaagagggcccgttacctgagatcgaggatgaagtctttcgaaaacgcaacctgacgatcatggatctccacccagggagcggcaagacccggcggtacctgccggcgatcgtgcgggaggcgataaaacgcaagctgcgcacgctgattctggcacccaccagagtggtcgccagtgaaatggccgaggcattgaagggcatgcccattaggtatcaaactaccgccgtcaagagcgagcacacggggaaggagatcgttgacctgatgtgccacgcaacattcacgatgcggctgctttcccccgtacgcgtgcctaactacaacatgatcatcatggacgaggcccacttcactgaccccagctccatcgcagcaaggggctacatcagcacccgcgtggggatgggcgaagcggccgctatcttcatgactgcaacgccgccggggtccgttgaggcattcccgcaaagcaacgcggttatacaagacgaggagcgggacatccccgaacgatcctggaacagcggctacgagtggataaccgacttcccgggaaaaacagtatggttcgtcccctcgataaaaagcggtaacgatatcgcgaactgcctccggaaaaatggcaaacgcgttatccagttatcccgaaagaccttcgacactgagtaccaaaagaccaaaaacaacgactgggactacgtggtgaccaccgacatcagcgagatgggagccaacttccgggcggaccgcgttatcgacccgcggcggtgcctgaagccagtgatcttaaaggacggacctgagcgcgtaatccttgccgggcccatgccagttacggtggcttccgccgcgcagcggagaggccgtataggccggaaccacaacaaagagggggaccagtacatttacatggggcagcccctgaacaacgacgaggatcacgcgcactggaccgaagccaagatgctgctggataacatcaacacccccgaggggatcatacccgcgcttttcgagcccgagcgcgagaaatccgcagcggtggacggcgagtaccggctccggggggaggcgcgcaagaccttcgtggagctgatgcgccggggggacctccccgtctggttatcctacaaggtggctagcgagggcttccagtacagtgaccggcggtggtgcttcgacggggagcgtaacaatcaagtacttgaggagaacatggatgtggagatttggactaaagagggcgaacggaagaagttacgcccaaggtggctcgatgccaggacctactccgatcccctggctctgcgggagtttaaggagttcgccgcggggcgtagatccgtgtccggcgacctcattctggagatcggcaagctgccacagcatctcacccagagagcccagaacgctctggacaatctggtgatgctacacaacagcgagcagggcgggcgggcttaccgtcacgcgatggaggagctacccgacaccattgagacgctgatgctcttggccttaattgctgtactcacggggggcgtgaccctgttctttctgtccgggcgggggctcggcaaaactagcatagggctgctctgtgtgatggcgtccagcgtcctcctgtggatggcttccgtggagcctcactggatcgcggcctcgattatcctggaattctttctcatggtgcttctgatccccgagccggaccgccagaggactccccaggataaccagttggcttacgtcgtgatcggcctcctgttcatgatcctcaccgtggccgccaatgagatggggctgctggagaccacgaagaaggacctcggtatcgggcacgtggcggtggaaaatcatcatcacgccgccatgctggacgtggatctgcaccccgcgtcagcctggactctctacgccgtggcaaccaccatcatcaccccgatgatgaggcataccatcgagaacacgaccgcgaatatcagcttaaccgcgattgccaatcaggcggccatacttatgggcctcgacaaaggatggccgatcagtaagatggatatcggggtgcccctattggcccttggctgctacagccaggtaaacccactgaccctgaccgccgcggtcctcatgctggtggcccactatgccatcatcgggccaggcctgcaggccaaggccacccgagaggcgcagaagcggacggccgcagggattatgaagaacccgaccgtggatggcatcgtcgccatcgatctggaccccgtggtgtacgatgccaagttcgagaagcagctggggcaaatcatgttgctaatcctgtgcacgtcccagatacttctcatgcgcacgacctgggcgctatgcgaaagcattacgcttgccacgggtcccttgacgaccctgtgggaagggtcccctgggaaattctggaataccacaatcgccgtcagcatggccaacatcttccggggctcctacctggcaggcgcggggctcgccttttccctgatgaagtctctgggcgggggccgtcgggggaccggcgcacaaggcgaaaccttgggggagaagtggaaacgccaactgaaccagctatcaaaaagcgaattcaacacctacaagcggagcggcatcatggaggtcgaccgaagcgaggccaaggagggactcaagagaggcgagacgactaaacatgcggtatctcgcgggacagccaagttaaggtggttcgtcgagaggaatctggtcaagcccgaaggcaaggtgatcgacctcggctgcgggcggggaggctggagctactactgtgctggcctcaaaaaggtgacggaggtgaagggatacactaaaggcggccccgggcacgaggaaccgataccgatggccacttacggatggaacctggtgaagttacactccgggaaggacgtgttcttcatcccgcccgagaagtgcgacaccctcctgtgtgatatcggtgagtcgtcccccaacccgaccattgaggaggggcgtacgctgcgggtgttaaagatggtcgagccttggctgcggggcaatcagttctgtattaagatcctgaacccctatatgcctagcgtcgtggagaccttagagcaaatgcaacggaaacatggcggaatgcttgtgcgcaacccgttgtcacggaacagcacacacgaaatgtactgggtctcctgtggcaccgggaacatcgtgtctgcagtgaacatgacgtcccgcatgttacttaacagattcactatggcgcaccggaaacccacctacgagcgcgacgttgacctgggcaccggaaccaggcacgtggcagtggagccagaagtcgccaacctcgatattatcgggcagcgcattgagaacataaagcacgagcacaagagcacgtggcactacgacgaagacaacccgtacaagacctgggcctaccacggatcctacgaggtaaagccgagcggctccgcaagctccatggtgaacggcgtggtgaagctgctgacaaagccatgggacgtcatccccatggtgactcagatcgcgatgacggataccacccccttcgggcagcagagggtgtttaaggagaaggtcgacacgcgcacgccgaaggcaaagcggggcacagcccagatcatggaggtgaccgccagatggttgtggggattcttgtcaagaaataagaagccccgcatatgcacccgggaagagttcacgcgaaaggtccggagtaatgccgcgatcggcgccgtcttcgtggatgaaaaccagtggaacagcgccaaggaggccgtggaagatgagcgcttctgggatttagtccatcgcgagcgggagcttcacaaacagggcaaatgcgcgacctgcgtgtataacatgatggggaaacgggagaaaaaactgggggagtttgggaaagccaagggcagcagggccatctggtacatgtggctaggagcaagattccttgagttcgaggccctggggtttatgaatgaggaccactggttctcccgcgagaactcactgtccggcgtggagggggagggcctccacaaactggggtacatcctgcgggacatctcaaagataccaggcggcaacatgtacgcggacgacaccgcggggtgggatacacgcatcacggaagacgacttacagaacgaggcgaagatcacggatattatggaaccggaacacgccctgctcgccaaggctatcttcaaactcacctaccagaacaaggtcgtgcgcgtgcagcggcctgccaagaacggcacggttatggacgtgatctcccgacgcgatcagcgcgggagcggacaggtgggcacgtatggcctgaacaccttcaccaatatggaggcccagctgatacggcaaatggagtccgagggcatcttcagcccctcagaactggagacccccaacctagcagagcgcgccctagactggctcgagaagtatggggtcgagcgcttaaagcgcatggcgatctcaggtgacgactgtgtggtgaagccgatcgacgatcggttcgccacggcgctgacggctctcaacgacatggggaaggtacgaaaggacatcccccagtgggagccctccaaagggtggaacgactggcagcaggtccccttctgcagccatcactttcaccagctgattatgaaagatggccgggaaatcgtggtcccgtgccgaaatcaggacgaactggtggggcgggcgagagtgtcccaaggcgctgggtggtcactccgagagactgcctgcctgggcaagagctacgctcagatgtggcagctaatgtacttccatcgcagagacctgcgtttggcagcgaatgccatctgctccgctgtccccgtagactgggtgcccaccagcagaacgacgtggtctatccacgcccaccaccagtggatgaccactgaggacatgctctcggtctggaaccgtgtgtggatcgaggaaaacccctggatggaggacaaaacgcacatcagcagctgggaggacgtgccgtacctcgggaagagggaagatcagtggtgtgggtccttaatcgggctgaccgcacgggctacatgggccaccaatatccaggtcgcgattaaccaggtgcgacgtctaatcgggaatgaaaactacctggactacatgaccagcatgaagcggttcaagaacgagactgatccagagggagctctgtggtag

SEQ ID NO: 24166 - RNA, 9879 nt, synthetic construct
  misc_feature 1..9879: note = derived and/or modified CDS sequence (opt11) from DENV-1__FJ432735__SS-prME
  source 1..9879: mol_type = other RNA
agcgtgacaatgctgctaatgctgatgcccaccgccctggccttccacctcacgacccgcggcggggaaccccacatgatcgtgtctaagcaggaacggggcaagagcttgctgttcaagaccagcgcgggggtgaacatgtgcaccctcatcgcgatggacctgggggaattctgtgaggacacgatgacctacaagtgcccccgcatcaccgaggccgagccggacgacgtggactgctggtgtaacgccaccgacacgtgggtgacctacggtacctgtagtcaaaccggggagcaccggcgcgacaaacgatccgtggccctggcgccccacgtgggactcgggctggagacgcgcaccgaaacctggatgagctcggagggcgcatggaaacagatccaacgagtggagacctgggccctgcgccaccccgggttcaccgtgatcgccctcttccttgcgcacgcgatcggcactagcatcacccagaaggggatcatcttcatcctgctcatgctggtgaccccctccatggccatgcggtgcgtcggcataggcagccgcgactttgttgaggggctgtccggcgccacgtgggtggacgtcgtgctcgagcacgggagctgcgtaaccaccatggccaaggacaagcccaccctagacatcgagttattgaagacggaggtcaccaacccagcggtgctgaggaagctatgcatagaggccaaaatcagtaacaccaccacggatagccgctgcccgacccagggagaggccaccctcgttgaggagcaggacgccaacttcgtctgccggcgcactttcgtggaccggggctgggggaacggatgcgggctgttcggcaaggggtccttaatcacgtgcgccaagttcaagtgcgtgaccaaactcgagggcaagaccgtccagtacgagaacctgaagtactcggtgatcgtgacggtccacacaggcgaccagcaccaggtagggaacgagtccaccgagcacggcaccactgccaccatcacgccccaggcccccagcaccgagattcagctaaccgactacggggcactcaccctggactgctcgccccggacgggcctggacttcaacgagatggtcctactgaccatgaaggagaaatcttggctggtgcacaagcagtggttcctcgatctgccgctgccctggaccagtggggcatcgaccagccaggagacgtggaaccggaaggacctcctggtgacgtttaagaccgcccacgcgaagaagcaagaggtagtggtgttgggctcccaggagggtgccatgcacaccgccctcacgggggccaccgagatccagacgagcggcactacgaccattttcgccgggcacctgaaatgccgcctgaagatggacaaactcaccctgaaaggtatgtcctacgtcatgtgtaccgggagcttcaagctggagaaggaggttgcggagacgcagcatggcaccgtgttggtccagatcaagtacgagggcacagacgccccctgcaagatccccttctcgacccaagatgagaaaggggtgacacagaacggccgcctgatcaccgccaacccgatcgtgaccgacaaggagaaacccgtaaacatcgaagccgagccgcccttcggagagagctacatcgttatcggcgcgggcgagaaggccctgaagctgtcctggtttaaaaaggggagctccattggcaagatgttcgaggccaccgcccgcggggcccggcgcatggcgatcctcggcgacacggcttgggacttcggcagcatcggcggcgtgttcacctccgtcgggaagctggtgcaccagatcttcggcaccgcctacggggtgttattcagcggcgtcagttggaccatgaagatagggatcggtgtgctcctgacgtggctgggcctcaacagccgctccactagcctgtcaatgacctgtatcgccgtgggactggtcaccctctacctgggcgtgatggtgcaggccgactctgggtgcgtgatcaattggaagggcagagagctgaaatgcggaagcggcatcttcgtaacgaacgaggtacacacctggaccgagcaatacaagttccaggcggactcccctaagcgcttgtcagccgccatcggcaaggcgtgggaggaaggggtctgcggcatccggtccgctacccgcctggaaaacatcatgtggaagcagatcagcaacgagctgaaccacatcctcctggagaacgacatgaagttcaccgtggttgtcggggacgtggcgggtatcctggcccagggtaaaaagatgatccggccccagccaatggagtacaagtacagttggaagtcctggggcaaggccaagatcatcggggccgacgtgcaaaacacgaccttcatcatcgacgggccaaacaccccggagtgtccggacgaccagcgcgcatggaacatctgggaggttgaagactacggcttcgggatcttcaccacgaacatatggcttaagctgcgggattcctatacccaggtgtgcgaccaccgcttgatgagcgccgccatcaaggactccaaagctgtgcacgccgacatgggctactggatcgaaagcgagaagaacgagacctggaaactcgccagagcatccttcatcgaggtcaagacctgcatctggcccaagagccacacgctgtggtccaacggcgtgttagagagcgagatgatcattcccaagatctacggcgggccgatctcccagcacaactaccgccccgggtacttcacacagaccgccggcccgtggcacctcgggaaactggagctggacttcgacttatgcgagggcaccacggtggtcgtggacgagcattgcggcaatcgggggccgagcctgcgcaccaccaccgtgacgggcaaaatcattcacgaatggtgctgccggtcctgcaccctgccgccccttcgcttcaagggggaggatggctgctggtacgggatggaaatccggcccgtcaaggaaaaggaggagaatctggttaagagcatggtgagcgccggctccggcgaggtcgacagcttctccctgggtctactgtgcattagcatcatgatcgaggaagtgatgcgctcccggtggtcccgcaagatgctgatgaccggtaccctcgccgtgttcttcctgctgatcatggggcagctcacgtggaatgacctgatccggctgtgcatcatggtcggcgcgaacgcctccgaccgcatggggatggggaccacctacctcgccctgatggccaccttcaagatgcgcccgatgttcgccgtgggcctcctgttccggcgccttacgagccgggaggtgctgctcctgaccatcgggctgagcctcgtcgcgagcgttgagctgcccaactcgctggaagagctaggcgatggcctggccatgggcatcatgatcctgaagctcctgaccgacttccagagccaccagctgtgggccacactcctgtccctgacgttcatcaagaccacctttagcctccactacgcctggaagacgatggcgatggtcctgtccatcgtgagcctgtttcccctctgcctgtccacgaccagccagaagaccacctggctgcccgtcctcctgggctccctgggctgcaagccgctcaccatgttcctgatcgccgagaacaagatctggggccgcaagagctggccccttaacgaggggataatggccgtcggcatcgtcagcatcctcctttccagcctgctcaagaacgacgtgcccctggccggtcccctgatagccggcggcatgctcatcgcgtgttatgtcatctccggaagctccgccgacctatcgcttgagaaggccgccgaggtgtcctgggaggaggaggccgagcacagcggcgcttcccacaacattctcgtggaggtccaggacgatgggaccatgaagataaaggacgaggagcgggacgataccctgaccatcctgctcaaggccaccctgctcgccgtgagcggtgtgtacccgctctcaatacccgccacgctgttcgtctggtacttctggcagaagaaaaagcagcgtagcggggtgctgtgggacactcccagcccgcccgaagtggagcgcgccgtcctcgacgacggcatctaccgcatcatgcagcggggcctcctgggacgcagccaagtgggcgtcggcgtatttcaggaaaacgtgtttcataccatgtggcacgtgacccggggcgcggtcctgatgtaccagggtaagcgactggagccctcctgggccagcgtgaagaaggacctgatctcctacggcggcgggtggagactgcaaggcagctggaacacgggggaggaggtacaggtcatagcagtggagcccggcaagaaccccaagaacgtgcagaccgcccccggcaccttcaagacctccgagggggaggtcggcgccatcgcgctcgacttcaagcctgggacgagcggctcgcccatagtgaaccgcgaggggaagatcgtgggcctgtacggcaatggggtcgtgaccacctcaggaacctacgtgagcgccatcgcccaagccaaggcgtctcaggagggtcccctgcctgaaattgaggacgaggtcttccggaagcgaaatctcacgatcatggaccttcaccccggcagcggaaagacacgccgctacctgcccgccattgtgcgggaggccataaagcgcaagctccggacgctgatccttgcccccacccgcgtggtcgcctccgagatggcggaggctctcaagggcatgcccatacgctaccagacgaccgccgtcaagtctgagcacaccggcaaggagatcgtggacttgatgtgtcacgccaccttcaccatgcggctgctctcccccgtccgcgtgcccaactacaacatgatcatcatggatgaggcccacttcaccgacccgagctccatcgcggcccgggggtacatcagcacacgggtgggaatgggcgaagccgccgccatcttcatgaccgcgacgccacccggctccgtcgaggccttcccccagtcgaacgccgtgattcaagatgaggagcgggacatcccggagcgctcctggaacagtgggtacgagtggatcaccgacttccccggcaagaccgtgtggtttgtcccctccatcaagagcggaaacgacatcgccaactgcttacggaagaacgggaagcgcgtgatccagctgtcccgcaagaccttcgacacggaataccaaaagacaaagaacaatgactgggactacgtggtcaccaccgatatcagcgagatgggcgcgaacttccgcgccgaccgcgtgattgatcccaggcggtgcttaaaaccggtgatcctgaaagacgggcccgagcgcgttatcctggccggcccgatgcccgtgacggtcgcctccgccgcgcaacggagggggcggatcggcaggaaccacaacaaagagggcgaccagtatatctatatggggcagccgctcaacaacgacgaggaccacgcccactggaccgaggccaagatgctgctggacaacatcaacacgcccgagggcatcatcccggccttattcgagcccgagcgggagaaatccgcggctatcgacggggagtaccgcctgcgcggcgaggctcggaagacctttgtggagctgatgcgccgcggggacttaccggtgtggttgtcttacaaggtcgcatccgagggcttccagtacagcgaccgccggtggtgcttcgatggcgagcgcaacaaccaggtgctagaggagaacatggacgtggagatctggacgaaggagggggagcggaagaagctccgcccccggtggttagatgcccgcacatactccgaccccctggccctccgggagttcaaggagtttgcggccggccgccggagcgtctccggggatctaatactggagatcggcaagctcccccagcacctgacgcagaaggcccagaacgccctggacaacctcgtgatgctgcacaacagcgaacagggagggcgcgcgtatcggcacgccatggaggagctgccggacaccatcgagacgctcatgctgctggccctcatcgccgtgctgacggggggcgtaaccctgttcttcctctccggcagggggctgggcaaaaccagcatcggcctactgtgcgtgatggcctcctcggtgctgctctggatggcgtccgtcgagccacactggatcgccgccagcatcatcctcgagtttttcttgatggtgctgctcattcccgagcccgaccgacagcgcaccccgcaggacaatcagctggcctacgtggtcatcgggctcctcttcatgatcctaacggtggccgcgaacgagatgggcctgctcgagactaccaagaaggacctggggatcggccacgtagccgtcgagaaccaccaccacgcggccatgttggacgttgacctccaccccgcctccgcgtggaccctgtacgccgtggcaacgacgattatcacccccatgatgaggcacaccatcgagaacacgaccgcaaacatcagcctgacagccatcgcgaaccaggccgccatcctcatggggctggacaagggctggccgatttccaagatggacatcggcgtccccctgctcgccctggggtgctacagccaggtgaatcccctgaccctcacggcggcggtgctaatgctggtcgcccactacgctatcatcggccccgggctccaggccaaggcgacccgcgaggcccagaagcggaccgccgctgggatcatgaagaacccgaccgtggacgggatcgtggccattgacctggaccccgtcgtgtacgacgcgaagtttgagaagcagctgggccagatcatgctcctgatcctttgcacgagtcagatcctactgatgcgcaccacctgggcactctgcgagagcatcaccctcgccacgggacccctgaccaccctgtgggaggggtcccccggcaagttctggaacaccactatcgccgtcagcatggccaacatcttcagggggagctacctcgcgggcgccggcctggcattttccctgatgaagtctctcggcggcggtcggcgcggcaccggggcccagggtgagaccctgggagagaagtggaagcggcaactgaaccagctcagtaagagtgagttcaacacctacaagcgctccgggatcatggaggtcgaccggagcgaggcgaaggagggcctgaagcgcggggagacgaccaagcacgcggtatcaaggggcaccgccaagctgcgctggttcgtggagcgaaatctcgtcaagccggaggggaaggtcatcgacctgggctgtggccgcgggggctggagctactactgcgccggactgaagaaggttactgaagtcaagggctatacaaagggcgggccgggtcacgaggagcccatccccatggccacttacgggtggaacctggtgaagctccattccggcaaggacgtgttcttcatcccgcccgaaaagtgcgacaccctgctgtgcgatatcggggaaagctcacccaaccccaccatcgaggagggacggacgctccgcgtgctgaagatggtggagccgtggctgcggggtaaccagttctgcatcaagatcctcaacccttacatgcccagtgtagtcgagaccttggaacagatgcagcgcaagcacggcggcatgctggtgcggaaccccctctcccgcaacagcacccacgaaatgtactgggtgtcctgtggtacgggcaacatcgtatcagcggttaacatgacctcccggatgctactgaaccgcttcacgatggcccatcggaagccgacctacgagcgggacgtggacctcggggccggcacccgccacgtcgccgttgagcccgaggtcgccaacctggacatcatcggacagcggatcgagaacatcaagcacgagcacaagagcacctggcattacgacgaagacaacccctacaagacctgggcgtaccacgggtcctacgaagtcaagcccagcggcagcgcctcctctatggtgaacggagtcgtgaagctgttgacgaagccatgggacgtgatccccatggtaacccagatcgccatgacagacacgacgcccttcggccagcagcgcgtattcaaggaaaaggtggacacccggacccccaaggccaagcgcgggacggcccagatcatggaggtcaccgctaagtggctgtggggcttcctgtcccggaacaagaagcctcgcatctgcacccgggaggaattcacacgtaaagtgcggagcaatgccgcgatcggcgccgtattcgtggacgagaaccagtggaactccgcgaaggaggccgtggaagacgagcgcttctgggacctcgttcaccgggagcgcgagctgcacaagcaggggaagtgcgccacgtgcgtgtacaacatgatgggcaaacgggagaagaagctgggggaattcggcaaggccaagggcagccgcgccatctggtacatgtggctcggcgcgcggttcttggagttcgaggctctgggtttcatgaacgaagaccactggttctcccgcgagaacagcctctctggggtggagggcgaggggctgcacaagctgggatacatcctccgggacatcagcaaaatcccagggggtaacatgtacgccgacgacaccgccggctgggacacccgcatcaccgaggatgacctgcagaacgaggccaagatcacggacataatggagcccgagcacgcgcttctagccaagtcaatcttcaagctgacctaccagaataaggtggtccgagtgcagcgcccggcaaagaacgggaccgtgatggatgtcatcagccggcgcgaccagcgcggctccggccaggtgggcacatatggcctgaacacgttcaccaacatggaggcccagctcatccggcagatggagagcgaagggatattttcgcccagcgaactggagacccctaacctagccggccgcgtgctcgactggctggagaagcacggggtcgagcggctgaagcgcatggcgatcagcggagacgactgtgtggtgaagcccatcgacgaccgtttcgccaccgccctcactgccctgaacgacatggggaaggtcaggaaggacatcccgcagtgggagcccagtaagggctggaacgactggcagcaggtccccttctgctcacaccactttcaccagcttatcatgaaagacggccgcgagatcgtggtcccatgccgcaaccaggacgagctcgtggggcgagccagggtgtcccagggcgcgggctggagcctgcgcgagaccgcctgcctgggcaagtcctacgcccagatgtggcagctcatgtacttccaccgccgggacttacgcctggccgcgaacgccatctgcagcgccgtccccgtggactgggtgcccacctcccggaccacgtggagcatccacgcccaccatcagtggatgaccaccgaggacatgctctccgtctggaaccgcgtgtggattgaggagaacccctggatggaggacaagacacacatctcgtcctggggcgacgtgccatacctaggcaagcgggaggaccagtggtgcggctcgcttattgggctcacggcccgcgcgacgtgggccaccaacatccaggtcgccataaatcaggtgcgccgcctgatcggcaatgagaactacctggactacatgacttccatgaagcgcttcaaaaatgagagcgacccggaaggggccttgtggtga

SEQ ID NO: 24167 - RNA, 9879 nt, synthetic construct
  misc_feature 1..9879: note = derived and/or modified CDS sequence (opt11) from DENV-1__FJ432736__SS-prME
  source 1..9879: mol_type = other RNA
agcgtgaccatgctcctgatgctgatgcccaccgcactagctttccacttgactacccgcggaggggagccgcatatgatcgtaagcaaacaggagcggggcaagagcctgctgttcaagacctccgcaggggtgaacatgtgcacactcatcgccatggacttaggcgaactgtgcgaggacaccatgacctacaagtgcccgcgcataaccgaggccgagccagacgacgttgattgctggtgcaacgcaaccgacacttgggtcacatacgggacctgcagccagaccggcgagcaccggcgcgacaagcggtccgtggcactcgcgccgcacgtgggcttagggctggaaacgcgcaccgagacctggatgtccagtgaaggcgcctggaagcagatccagcgggttgagacctgggccctccgtcaccccgggttcacggtgatcgcactgttcctggcccacgccatcggcaccagcataacccagaaggggatcattttcatcctccttatgcttgtgaccccctcaatggctatgcggtgcgtcggtatcggtagtcgcgacttcgtggaggggctctccggcgccacgtgggtggatgtcgtgctggagcacgggagctgcgtcacaaccatggccaaagacaagcccacactggatatcgagctcctaaagacggaggtcaccaaccccgcggtgttacggaagctctgtatcgaggctaagatcagtaacaccaccacggacagccggtgcccgacccaaggcgaggccaccctggtggaggagcaggacgccaacttcgtctgccgccgtacgttcgtcgacagaggctgggggaacggctgcggactgttcggcaaggggtccctaatcacgtgcgccaaattcaagtgcgtgaccaagctggaaggcaagattgtacaatacgagaaccttaagtacagcgtgatcgtcaccgtccacacgggcgaccagcaccaagtggggaacgagtccacggagcatggcaccaccgcgaccatcactccccaggccccaacgaccgagatccagctcaccgactatggggctctgaccctggactgcagccccagaacgggccttgactttaatgagatggttctgctgaccatgaaggagaagtcctggctggtgcacaagcagtggttcctggaccttccgctcccctggaccagcggggccagcacctctcaggagacgtggaaccggcaagacctgttggttacctttaagaccgcccacgcgaagaagcaggaggtcgtggttctcggcagccaggagggcgccatgcataccgctctgacaggtgccaccgagattcagacctccggcaccacgaccatcttcgccgggcacctaaagtgccgcttaaaaatggacaagcttaccctgaagggcatgagctacgttatgtgtaccgggtccttcaagctcgaaaaggaggtggcggaaacccaacacggcaccgtgctggtccagatcaaatacgaaggcaccgatgccccctgcaagatccccttctccacccaggacgagaagggggtgacgcagaatggccggctgatcaccgctaacccgatcgtgacggacaaggagaagcccgtcaacatcgaggccgaaccgcccttcggggaatcgtatatcgtgatcggcgcgggcgagaaggcactgaagttgagttggttcaagaaggggtccagcatcggcaagatgttcgaagccaccgcccgcggggcgcggcgcatggcgatactgggcgatacagcctgggacttcgggtccatcggcggcgtgttcacgtcggtcggtaagctgatccaccaaatcttcggaacagcatacggggtcctgttcagtggagtgagttggaccatgaagatcgggatcggcgtcctgctgacgtggctcggcctaaacagtcgcagcacgtccctctcaatgacctgcatagccgtggggctcgtgaccctctatctgggcgtgatggtgcaggccgactccggatgcgtgatcaactggaaaggccgggagttgaaatgcgggagcggcatcttcgtcacgaacgaggtgcacacctggaccgagcaatataagttccaagcggacagccctaagcgcctgtcagcggccatcggcaaggcgtgggaggaaggggtgtgcggcatacggagcgccacccgcttggagaacatcatgtggaagcagatctccaacgagctcaaccacatcctgctggagaacgacatgaaactaaccgtcgtggtgggagacgtcgctggcatcctggggcagggcaagaagatgatccgtccccagcctatggagtacaagtatagctggaagtcctggggaaaggccaagatcatcggcgccgatgcccaaaacacgacattcatcatagacggccccaacaccccggagtgccccgacgaccagcgcgcgtggaacatctgggaagtggaagactacgggtttggaatctttacgacgaacatctggctgaagctccgcgacagctacacccaagtgtgcgatcaccgcctgatgtccgccgccatcaaggatagcaaggccgtccacgccgacatgggctactggatcgagtcggagaagaacgagacctggaagctggcgagggcctcgttcatcgaggttaagacctgcatctggcccaagtcccacacgctctggagcaacggggtcctggagagtgagatgatcattcctaagatatacggagggccgatcagccagcacaactatcgtcccggctacctaacccaaaccgccggtccctggcacctcggcaaactggagctggatttcgacctctgcgagggaacgaccgtcgtggtggacgagcactgcgggaacaggggcccatccctgaggaccaccaccgtcacaggaaagatcatccacgagtggtgttgccgctcttgcaccctacccccactgcgcttccggggcgaggacgggtgctggtacggcatggagatccgccccgtgaaggagaaggaggagaacttggtgaaatcgatggtttcagccggccccggggaggttgacagcttttccctaggccttctgtgcatctctatcatgatcgaggaggtgatgcggtcccgttggagccggaagatgctgatgaccggtaccctcgccgtcttcttcctgcttatcatgggccagctcacgtggaacgacttaatccgtctatgcatcatggtgggggcgaacgccttcgaccgcatggggatgggcacaacgtacctcgccctgatggccacctttaagatgcggcccatgttcgccgtgggactcctattccgccggctgacgtcccgcgaggttcttctcctcacgatcggcctgagcctcgtggcaagtgtagagttacccaacagcctggaggaactcggggacggcctggccatgggcatcatgattctgaagctcctgaccgatttccagagtcaccagctgtgggccaccctgctgagcctgacctttatcaagaccaccttctccctccactacgcctggaagaccatggcgatggtgctgagcatcgtctccctgttccccctctgtctgtccacgacctcccagaagaccacttggctccccgtccttctggggagcctgggctgcaagcccctcacgatgttcctgattgccgaaaacaagatctgggggcggaaatcctggcccttaaacgagggcatcatggccgtgggaatagtgtctatcctcctgtcctcgctgctcaagaacgacgttccactggccggcccgctaatcgcaggcggaatgctcatcgcgtgttatgtgatcagcggtagtagcgccgacctttccctggagaaggcggcagaagtgagctgggaggaggaggcagagcactccggggcgtcgcacaacatcctagttgaggtgcaggatgacggcaccatgaagatcaaggatgaggaacgcgacgacacgctgaccattctgcttaaggccacactgctggccgtgagcggcgtataccccctcagcatccccgccacgctattcgtgtggtatttctggcagaagaagaaacagcggtctggcgtgttgtgggacacccccagcccgcccgaggttgagcgggccgtgctggacgacggcatctaccggatcatgcagcgcggcctcctgggccggtcccaggtgggggtcggcgtattccaggagaatgtgtttcacaccatgtggcacgtcacccgcggggcggtgctgatgtaccagggcaagcggctcgaacccagctgggcctccgtgaagaaggacttaatctcatacggcgggggttggcgcttacgggggtcatggaacacaggcgaggaggtccaagtgatcgccgtggagcccgggaagaacccaaagaatgtccagactgcccccggcaccttcaagacccccgagggcgaggtgggtgcaatcgcgctcgacttcaaacccggcacatcggggtccccgattgtgaaccgcgagggtaagatcgtcggcctgtacgggaacggcgtcgtgaccacctctgggatctacgtctccgcaatcgcccaggcgaaggcgagccaggagggccccctccccgaaatcgaggacgaggtgttccggaagcgcaacctcaccatcatggacctgcatccggggagcggtaagacgcggaggtacctgcccgctatcgtgcgggaggccatcaaacgcaagctgcgcaccctgatactggccccaacccgcgtcgtggcttccgagatggccgaagctctcaagggcatgcccattcgctaccagaccacggccgtcaagtcagagcacaccgggaaggagatcgtcgacctgatgtgccacgccaccttcaccatgcggctgctctcgccggtgcgggtgcccaactacaacatgataatcatggacgaggcccattttacggacccctcatccatcgcggcccggggctacataagcacccgcgtcgggatgggcgaggccgctgccatcttcatgaccgcgacgccgcccgggtctgtggaggccttcccccagagcaacgccgtgatccaggatgaggagcgggacattcccgagagatcctggaacagcggtcacgagtggattacggacttccccggcaagaccgtctggttcgtgccctccatcaagagcgggaacgacattgccaactgcctgcgtaagaacggcaagcgcgtgatccagctgagccggaagacctttgacaccgagtaccaaaagacgaagaacaacgattgggactacgttgtcacgaccgatataagcgagatgggcgcgaacttccgcgctgaccgggtgatcgatccccgccggtgccttaagcccgtaatcctgaaggacgggcccgagcgcgtgatcctggccggtcctatgccggtgaccgtcgcctccgccgcgcagcggcgcggccggataggccgcaaccacaacaaggagggggaccagtacatctacatgggccaacccctcaacaacgacgaagaccacgcccactggacggaggccaagatgctgctggacaacatcaacacccccgaggggataatcccagccctcttcgagcccgagagggagaagtccgccgcggtcgatggcgagtatagactgcgaggggaagcgcggaagacctttgtcgaactgatgcgccgcggcgacctccccgtttggttatcctataaggtggcgagcgaggggttccagtacagcgaccgcaggtggtgcttcgatggggagagaaacaatcaggtcctggaggagaacatggacgtggagatatggaccaaggagggcgagcggaaaaagctccgcccacgatggctggacgcgaggacgtacagcgacccgctcgccctacgggagtttaaggagttcgcggccgggcgacggagcgtgtccggcgacctgatactggagatcggcaagctccctcagcacctgacccaacgcgctcagaacgccctggacaacctcgtcatgttgcataactctgagcaaggcgggcgtgcgtacaggcacgccatggaggagctgcccgataccatagagaccttgatgttactggccctgatcgccgtactgaccggcggcgtgactctgttcttcctctccgggcggggcctgggtaagaccagcatcgggctgctctgtgtgatggcctccagcgtgcttctgtggatggcgtccgtggagccccactggatcgcagcgagcatcattctcgagttcttcctgatggtactgctcatcccggaacccgaccgccagcggacgccccaggacaaccagctggcctacgtggtgattgggctcctcttcatgatcctgaccgtcgcagcgaacgaaatggggctgctcgagacgaccaagaaggatttagggatcgggcacgtggccgtggagaaccatcaccacgccgcaatgctggacgtggacctccaccctgcatccgcgtggacactgtacgccgtcgccaccacgatcatcacccccatgatgcgccacaccatcgagaacaccacggccaacatctcactgaccgccatcgcgaaccaggccgccatactcatggggctggacaagggctggcctatctccaagatggacattggggtaccattgctcgccctgggttgctatagccaagtgaacccgctaactctcacagcggccgtgctgatgctggtggcccactacgccataatcgggcccggtctccaggctaaggcgacgcgcgaggcccagaagcggaccgctgccgggatcatgaagaatcctacagtcgatggcatcgtggcaattgacctggaccctgtcgtctacgacgcaaagttcgagaagcaattaggccagatcatgctcttaatcctgtgtaccagccagatcctcctgatgcgcacgacctgggccctctgcgagagcatcaccctcgccaccgggccgctcacgaccttatgggaaggctcgcccggaaagttctggaacaccactatagctgttagcatggccaacatttttcggggctcctacctcgcgggcgccgggctggccttcagcctgatgaagtccctcggcgggggccgccgagggacgggcgcacagggcgagaccctgggagaaaagtggaagcgacaactgaatcagctcagcaagagtgagttcaacacttacaagcggtccggcattatggaggtggaccgctctgaagcgaaggaggggctgaagcggggcgagacaacgaagcacgccgtctcccgcgggaccgctaaactccggtggttcgtggagcgcaaccttgtgaagcccgagggtaaggtcatcgacctcggctgcgggcggggcgggtggagttattattgcgccggcctgaagaaagtgaccgaggtgaagggctacactaagggcggccccgggcacgaggaaccgatacccatggccacatacgggtggaacttggtcaagcttcactccgggaaggacgtgttctttatcccgcccgaaaagtgcgataccttgctgtgcgacatcggcgagagctccccaaaccccacaatcgaggaggggcgcaccctccgggtgctgaagatggtcgaaccgtggctgcgcggcaaccagttctgcatcaagattctcaacccctacatgccaagcgtcgtggagacgctggaacagatgcagcggaaacacggcggaatgctggttcgcaaccctctcagtcggaacagcacgcacgagatgtactgggtgtcctgcgggaccgggaatatcgtgagcgcggtcaacatgacctcccgcatgctgctgaacagattcaccatggcccacagaaagcccacgtacgagcgcgacgtggacctcggcaccggtacccggcacgtggccgtcgagcctgaggtggccaacctggacatcatcgggcaaaggattgagaacatcaagcacgagcacaagagcacctggcattacgacgaggacaacccgtacaagacgtgggcgtaccacggttcctacgaggtgaagccaagcgggtccgcgagctccatggtcaacggcgtggtcaaactgctgactaagccctgggacgttatccccatggtaacacaaatcgcaatgaccgacacgaccccgttcgggcagcagcgggtcttcaaggagaaggtggacacccggaccccaaaggccaaacgtggcacggcccagatcatggaggtaactgcccgctggctgtggggcttcctgagccggaacaagaagccccgcatctgcacccgggaggaatttacccgcaaggtccggagcaatgctgccatcggtgccgtgttcgtggacgagaatcaatggaattccgccaaggaggccgtcgaggacgagcgcttctgggaccttgtgcatcgggagcgcgaactgcacaagcagggcaaatgtgccacgtgtgtgtacaacatgatggggaagcgggagaagaagctgggcgaattcgggaaggccaagggcagccgcgccatctggtacatgtggctcggcgctcgcttcctggagttcgaggcgctggggttcatgaatgaggaccactggttctcccgcgagaacagcttgtctggtgtcgagggggagggcttgcataagctgggctacatcctccgggacatcagcaagatcccgggtggcaacatgtacgccgatgacaccgccgggtgggacactcgcatcaccgaggatgacctgcagaacgaggctaagatcacggacatcatggagcccgagcacgccctgctagccaaagccatctttaagctgacctaccagaataaggtggtgcgcgtccagcggccagctaagaacggaaccgtgatggacgtgatctcccgccgtgaccagcgtggtagcggccaggtaggtacctacgggctgaacacgttcaccaatatggaagcccagctaatccggcagatggagtcagagggaatcttcagcccctccgagcttgagacgccgaatcttgccgagcgcgccctcgactggctggagaagtacggtgtggaacggctgaagcgcatggctatcagcggcgacgactgcgtcgtaaagcccatcgacgaccggttcgccaccgccctcacggccctgaacgacatggggaaggtcagaaaggacattccccagtgggagccctccaagggctggaatgactggcagcaggttccgttttgcagccaccacttccatcaattaatcatgaaggacggccgggagatcgtcgtgccctgccgcaaccaagacgagctcgtggggcgggcacgcgtctcgcagggagccgggtggtctcttcgtgagaccgcgtgcctgggcaagtcctacgcccaaatgtggcagctcatgtactttcaccgccgggacctgcgcctggcagccaacgccatctgcagcgccgtgcccgtggactgggttccaaccagccgaaccacctggagtatacatgcccaccaccagtggatgaccaccgaggacatgctcagcgtatggaaccgcgtgtggatcgaggagaacccgtggatggaggacaagacccacatctccagctgggaggacgtcccttacctggggaagcgcgaggaccagtggtgcggctccctgatcggcctcacggcgcgggccacctgggccacgaacatccaggtggccatcaatcaggtccgcaggctgatcggaaacgaaaactacctagactacatgacaagtatgaagcgctttaagaatgaatccgaccccgagggcgcgctctggtga

SEQ ID NO: 24168 - RNA, 9879 nt, synthetic construct
  misc_feature 1..9879: note = derived and/or modified CDS sequence (opt11) from DENV-1__FJ410198__SS-prME
  source 1..9879: mol_type = other RNA
tcggtgaccatgctgctcatgctgatgccaaccgccctggccttccacctcaccacaagagggggtgagccccacatgatcgtgagcaaacaggagcggggcaagagcctcctgttcaagacctcggccggggtgaacatgtgcaccctcatcgcgatggacctgggcgagctgtgtgaggacaccatgacctacaagtgcccccggatcaccgagaccgagcccgacgacgtggactgttggtgcaacgccaccgacacctgggtcacctacggaacctgcagccagacgggcgagcacaggcgcgacaagcggtccgtggcactcgcgccccacgtcggcttggggctcgaaacccgcaccgagacctggatgagctccgagggcgcgtggaaacaaatccagcgggtggagacgtgggcattaaggcatcccgggttcaccgtgatcgccctgttcctggcccacgcgatcggcacaagcatcacgcagaaagggattattttcatcctcctgatgctggtcacgccctccatggccatgcgttgcgtaggcatcggcagccgggacttcgtggaggggctctcaggcgccacctgggtggacgtcgtgctggagcacgggagctgcgtcacgaccatggccaaggacaagcccacgctggacatcgagttactgaagaccgaggtgaccaaccccgccgtgttacggaagctatgcatcgaggcgaagatctccaacacaacgaccgactccaggtgcccgacccagggggaggcaaccttggtggaggaacaggatgccaacttcgtctgccggcgcacgttcgtcgaccggggctgggggaatgggtgcgggctgttcggcaaggggagcttgatcacgtgcgccaagtttaaatgcgtgaccaagttggagggcaagatcgtccagtacgagaaccttaaatatagcgtgatcgtgaccgtccacacgggggatcagcaccaggtcgggaacgagtccacggagcacggtactaccgccaccatcacgccccaggcgcccaccaccgagattcagctcaccgactacggcgccctcacgctggactgcagcccccgcaccggcctcgacttcaacgagatggtcctgctgacgatgaaggagaaaagttggctcgtgcacaagcagtggtttctggacctgcccctcccctggactagcggggcaagcacaagtcaggagacctggaaccgccaagacctcctggttactttcaagaccgcacacgcaaagaagcaagaggtcgtggtgctcggcagccaggagggcgcaatgcacacggccctgactggcgccaccgagatccagacctccggtacgaccacgatattcgcagggcatcttaagtgccgcctcaagatggacaagctcacgctgaagggcatgtcgtacgtcatgtgcacggggtcgttcaagctcgagaaggaggtggccgagactcagcacggcaccgtgttagtgcagatcaagtacgaagggacggacgcgccctgcaagatcccattcagcacgcaggacgagaagggggttacccagaacggccggctgataaccgccaacccgatcgtgaccgacaaggagaaacccgtaaacattgaggccgaaccgcccttcggggagtcctacatcgtgataggcgccggcgagaaggcgcttaaacttagctggttcaagaaggggtcgagcatcggtaagatgttcgaggctaccgccagaggggcccggcgtatggccatcttaggcgacacggcgtgggatttcgggtccatcggcggcgttttcacctcagtcgggaagctggtacaccagattttcggtaccgcctacggggtcctcttctccggcgtcagctggacaatgaagatcgggatcggcgtgttattgacctggctcggcctgaactcacgcagcacctccctgagcatgacatgcatcgccgtgggcctcgtaacgctgtacctgggcgtaatggtgcaggccgactccgggtgcgtcattaactggaagggccgggagctcaagtgcggctccggcatcttcgtgaccaacgaggtgcacacctggaccgagcagtataagttccaggcggactccccgaagcgactgtcagcggccattggtaaggcctgggaagaaggggtatgcggcatccgtagcgctacccgcctggagaacatcatgtggaagcagatctccaacgaactcaaccacatcctcctggagaacgatatgaaattcacggtggtggtaggggacgtggccggcatcctcgcgcaggggaaaaagatgatccggccccagcccatggagtacaagtacagctggaagtcctggggcaaggctaagataattggggccgacgtgcagaacaccaccttcatcatcgacggaccgaataccccggaatgtcctgatgatcagcgtgcatggaacatctgggaggtcgaggactacggcttcggcattttcacgacgaacatctggctgaagctgcgggacagctacacccaggtgtgtgaccaccgcctaatgtcggcggccatcaaggactctaaggccgtgcacgccgacatgggctactggatcgagtccgagaagaacgaaacctggaagctagcccgggccagctttatcgaggtcaagacgtgcatatggccaaagtcccacaccctgtggagcaacggggtactcgaaagcgagatgatcatccccaagatctacgggggcccgattagccagcacaactaccgccccggatacttcacccagaccgccggcccctggcacctggggaagctggagttggatttcgatctgtgcgaaggcacaacagtcgtcgtcgacgaacactgcggcaaccgggggccgtccctccgcacgaccacggtgaccggcaagatcatccacgagtggtgctgccgaagctgcacactgcctcccctccgcttccgcggagaggacggctgttggtacgggatggagatccgcccagtcaaggagaaggaggagaacctggtcaagtccatggtgagcgctggcagcggagaggtcgactccttcagcctcgggctcctgtgcatttccatcatgatagaggaggtgatgcggagccgctggtcccggaaaatgctcatgaccggcacgctggccgtgttctttctgctcataatggggcaactgacctggaacgacctcatccgcctctgcatcatggtaggcgcgaacgcgagcgaccgaatggggatgggcaccacctaccttgccctgatggccacgtttaagatgcgtccaatgttcgccgtggggttgctgttccgccggctgacttcccgcgaggtgctcctgctgaccatcgggctttcactggtcgcctctgtggagcttcccaatagcctcgaggagctgggagacggcctggcgatgggcatcatgatcctcaagctgctgaccgacttccagtcccaccagctctgggccacgctgctgagcctcaccttcatcaagaccaccttctccttgcactacgcctggaagacgatggccatggtcctgagcatcgtgagcctcttccccctctgcctcagcaccacgtcacagaagaccacgtggctccccgtgctgctgggtagcctcgggtgcaagccactgaccatgtttctcatcgctgagaacaagatatgggggcggcgcagttggcccctcaacgaggggatcatggccgttggaattgtgtcaatcctgctgagctccctactcaagaacgacgtgcccctggccgggcccctaatcgccggcggcatgctgatcgcctgctatgtcatcagcggatcctcggcggacctgtccctcgagaaggccgccgaagtgtcctgggaggaggaagccgagcacagcggcgctagtcacaacatcctggttgaggttcaagacgatgggaccatgaagatcaaggatgaggaacgggacgacaccctgacgatcctactgaaggcgacgttgttagccgtctccggcgtgtacccactcagcatccccgcaacactgttcgtttggtacttctggcaaaagaagaagcagcggtcaggggtgctctgggatacccccagcccgcccgaggttggccgagccgtcctggacgacggaatctatcgaatcatgcagagagggctccttggtcgctctcaggtcggggtgggagtcttccaagagaacgtatttcacaccatgtggcacgttactagaggggccgttctcatgtaccagggcaagcgcctggagcccagctgggcgtccgtgaagaaagacctgatcagctatggcggcggctggcggttacaggggagttggaacaccggagaggaggtgcaggtcatcgctgtggagcccgggaagaacccaaagaatgtgcagacagcccccggcaccttcaagacgcccgagggcgaggtcggggcaatcgccctggacttcaagcccggcaccagcgggtctcccattgttaaccgcgagggcaagatcgtgggcctgtatggaaacggcgtcgtgaccaccagcgggacttacgtgagcgcgatcgcccaggccaaggcctcccaggagggccccctccccgagatagaggacgaggtgttccggaagcgcaatctgaccatcatggacctgcacccaggatctggcaaaacccggcgctacctcccggcgattgtgcgagaggccatcaaacgcaagctgcggaccctgatcctcgcccccacgcgggttgtcgcatcagaaatggccgaggcgttgaagggcatgccaatccgctatcagaccaccgccgtcaagagcgaacacaccgggaaggaaattgtggacttgatgtgccacgccacattcaccatgcggttgctgtcccctgtcagagtgccgaactacaacatgattatcatggacgaagcccattttaccgaccctagctccatcgccgcgcggggctatatcagcacccgcgtggggatgggcgaggccgccgccatcttcatgaccgccacgccgcccgggagtgtcgaggcgtttccacaaagcaacgctgtgattcaagacgaggagcgagacatccccgaacgctcctggaacagcgggtacgagtggatcaccgacttccccggcaagaccgtgtggtttgtcccctccataaagagcgggaacgacatcgccaactgccttcggaagaacggcaaacgcgtgatccaactctcccggaagacgttcgacacggagtaccagaagaccaagaacaacgactgggactacgttgtaacgactgacatcagcgagatgggggcgaatttccgggcggaccgggtgatcgacccgcgccggtgtttaaagcccgtgatcctgaaggacgggcccgagcgcgtcatcttagccgggcccatgccggtaaccgtggcctccgccgcccagcgccgcggccggatcggccgcaaccacaataaggagggcgaccaatatatctacatgggccagcccctgaataacgacgaggatcacgcgcattggaccgaagccaagatgctgctcgacaatatcaacaccccagaggggatcatccccgcccttttcgagccggaacgcgagaagtccgctgccatcgacggcgagtatcgcctgcgcggtgaggcgcggaagactttcgtggagctcatgcgccggggcgacctgcctgtgtggctgtcctacaaggttgctagcgagggcttccagtatagcgaccgccggtggtgttttgacggggagcgcaacaaccaggtgctcgaggagaacatggacgttgaaatctggacgaaggagggagagcggaagaagctgcgcccacggtggctagacgcccgcacctactccgaccccctcgccctacgggagttcaaggagttcgcggcggggcgcagaagcgtctccggcgaccttatcctggagatcggcaagttgccgcagcacctgacccagcgcgcccagaatgctctcgacaacctggtgatgctgcacaactcagagcagggcgggcgggcctacaggcacgcgatggaggagctgcccgacacgatcgagacgcttatgctgcttgccctgatcgccgtactgacgggcggcgttaccctcttcttcctgtccgggcgaggcctgggaaaaaccagcattgggcttctgtgtgtgatggcctccagcgtactgctttggatggcctccgtcgagccccactggatcgcggccagcatcatcctggagttcttcttgatggtgttactgatccccgagccggacaggcagcggacgcctcaggacaatcagctggcttatgtggtgatcggcctccttttcatgatcctaaccgtggccgcgaatgaaatggggctcctggagaccactaagaaggatctgggcattggacacgtcgcggtcgagaaccaccaccacgccactatgctcgacgtcgacctgcatcccgcctccgcgtggaccctgtacgccgtggcgaccacgatcatcaccccgatgatgcgccataccatcgagaacaccaccgccaacatcagcttgacggccatcgccaatcaagctgcgatactcatgggtctcgacaagggctggcccatatcaaagatggacatcggggtccctctcctggccttgggctgctacagccaggtgaatcccctcacgcttaccgccgccgtgctgatgctcgtcgcccactacgctatcattggtccaggtctgcaggccaaggctacacgcgaggcacagaagcggacggcggccggcataatgaagaaccccaccgtggatggcatcgtcgccatagacctggaccccgttgtgtatgacgccaagttcgagaaacagctcggtcaaatcatgctgctgatcctctgcacctcccagatccttctgatgcgcacgacgtgggccttgtgcgagagcatcaccctcgcgaccggccccctgaccacgctctgggaaggctccccgggcaagttctggaacaccaccatcgccgtcagcatggccaacattttccggggctcctacttggccggcgcaggcctcgcgttcagcctcatgaagtcccttggcggaggccgcagagggaccggcgcgcagggcgagaccctgggggagaagtggaagcgacagctcaaccagctgtccaagagcgagttcaacacctacaaacggtcggggatcatggaggtcgatcgcagcgaggccaaggaggggctgaaacggggtgagaccacaaagcacgccgtgtcccgcgggacggcgaagctccggtggttcgtggagcgcaacctggtcaagcccgagggcaaggtgatcgacctgggttgcgggcggggcgggtggagctactactgcgccggcctgaagaaggtgaccgaagtcaaagggtacaccaagggcggccccgggcacgaggagcctatcccgatggccacgtacggatggaatctcgtgaagctgcactctgggaaggacgttttcttcatcccgcccgaaaagtgcgacaccctgctctgcgacatcggcgagagctcccccaacccgaccatcgaggaggggcgtaccctgcgggtcctgaagatggttgagccctggctccgcggcaaccagttctgcataaagatcctcaacccctacatgccgagcgtggtggagaccctggagcagatgcaacggaagcacggcgggatgctggtgagaaacccgctttccaggaacagcacccacgagatgtattgggtgtcctgcggcacgggtaatatcgtcagcgccgtgaacatgacctcccgcatgctgctcaatcgcttcaccatggcccaccggaagcccacctacgagcgggacgtggacctgggtgcgggcacgcggcacgtcgccgtcgagcccgaagtggccaacctggacatcatcggtcaacgcatcgagaacatcaagcacgagcacaagtctacctggcactacgacgaggacaacccctacaagacctgggcatatcatggctcctacgaggtcaagccgagcgggtccgccagcagcatggtgaacggcgtcgtgaagttactgaccaagccctgggacgtgatccccatggtcacgcagatcgctatgaccgacaccaccccctttggtcagcagagagttttcaaggagaaggtggatacgcgtaccccgaaggccaagcggggcaccgcccaaatcatggaggtcaccgccaagtggctgtggggctttctctcccgcaacaagaaaccacggatctgcacgcgcgaggagttcacccggaaggtgcgttctaacgccgccatcggtgccgttttcgtcgacgaaaaccagtggaactcggccaaggaggctgtggaggacgagcgcttctgggacctggtgcaccgcgagcgcgagctgcacaagcagggcaagtgcgcgacctgtgtctacaacatgatgggtaagcgcgagaagaagctcggcgagttcgggaaagccaagggcagccgggccatatggtatatgtggctgggcgcccgcttcctggagtttgaggccctcgggttcatgaacgaggaccactggttctcccgcgaaaactcgctgtccggtgtcgaaggggagggccttcacaagctcggttacatcctgcgcgacatcagcaacatccccggcggcaacatgtacgcagacgacaccgccgggtgggacacccggatcacagaggacgacctgcagaacgaggcccgcataaccgacatcatggagccagagcacgccctcttagccaagtccatcttcaaactgacctaccaaaacaaagtcgtccgcgtgcaacggcccgccaagaatggcacggtcatggatgtcatctcgcgccgggaccagagagggtcaggacaggtgggcacctacggactcaacaccttcaccaacatggaggcacagctcatacggcagatggaaagcgagggcatcttctccccaagcgagctggagacacccaacctcgcggagagggtgctggactggctggagaagtacggggtcgagcggctcaagcgcatggcaatctccggggacgactgcgtggtgaagcccatcgacgacaggttcgccaccgccctgaccgccctgaacgacatgggaaaggtgcgcaaggacataccccagtgggagccttcgaagggctggaacgactggcaacaggttccgttctgctcccaccacttccaccaactcatcatgaaagacggacgggagatcgtggtgccgtgccgaaaccaagacgagctggtggggcgggcccgcgtgagccagggtgccgggtggagcctgcgggagactgcttgcctcggcaagtcctacgcacagatgtggcagctgatgtacttccaccgccgggatctgcgcctcgccgccaacgccatctgctcggcggtccccgtggactggatacccacctccaggaccacctggtccatccacgctcaccaccaatggatgactacggaggatatgctgtccgtgtggaatcgcgtctggatcgaggaaaacccctggatggaggataaaacccacatcagctcctggggcgacgtgccgtacctgggcaagagggaggaccagtggtgcggctcactcatcggcctgactgcacgggccacctgggcaacgaacattcaggtggccataaaccaggtccgccggctgataggcaacgagaactatctagactacatgacgtccatgaagcgcttcaagaacgagagcgaccccgagggcgccttatggtga

SEQ ID NO: 24169 - RNA, 9879 nt, synthetic construct
  misc_feature 1..9879: note = derived and/or modified CDS sequence (opt11) from DENV-1__FJ410199__SS-prME
  source 1..9879: mol_type = other RNA
agcgtcactatgctcctcatgttaatgcccacagcactggcgttccacctgaccacaagaggtggggaaccccacatgatagtcagtaaacaagaaaggggcaaatcactgctattcaaaacctccgctggagtgaatatgtgcacacttatcgctatggaccttggggagttctgcgaagacacaatgacatacaaatgcccccggataactgaagccgaacctgacgacgtcgactgctggtgcaacgcaacagacacatgggtaacatacggaacgtgttcccaaacaggcgaacacagacgagataagcggagcgtcgcacttgcgccccatgtaggtctagggctcgaaacccggacagaaacgtggatgtcaagtgaaggtgcctggaaacaaatacagcgggttgaaacatgggcgcttcgccaccctggattcacagtgatcgctctgttccttgcccacgcaataggcacatcaataacacagaaaggcatcatcttcatattacttatgctagtaacacccagcatggccatgcggtgtgtggggattggtagcagggactttgtggaaggcctgtccggtgctacctgggtcgacgtagtactggaacacggctcatgcgtaacaaccatggccaaagataaaccgacgttagacatcgaactcctaaaaacagaagtcacaaacccagccgtcctacgcaagctatgcatcgaagctaagatctccaacacaaccacagactccagatgcccgactcagggggaagccacattggtggaggaacaggatgcgaactttgtctgtcgtcggacgttcgtagaccgaggatggggaaacggttgtggcctcttcggaaaaggcagcttaatcacgtgcgccaaattcaaatgtgtcacaaaactcgaaggaaaaaccgtccaatacgagaacctcaagtactccgtgatcgtgacagtacacaccggggaccaacaccaggtgggcaacgaatccacagagcacgggaccacggccacaatcacaccgcaagcaccgtctaccgagatacaactaacggattacggcgcgctaaccctagactgtagtccccggacgggcttagacttcaacgaaatggtactgctgacaatgaaggagaaaagttggctagtacacaagcaatggttcctcgatcttccactaccatggacatcaggagcctccactagccaggagacatggaaccgaaaagacctcttagtgacattcaagactgcccatgccaagaaacaagaagtggtcgtgttggggagtcaagaaggagccatgcataccgcattaacaggggcaactgaaatacagacatcaggcacaacgacaatctttgcaggccacctcaagtgtagacttaaaatggataagctaacactgaaaggaatgtcctacgtcatgtgtaccggcagcttcaagctagaaaaggaagtggcagaaacacagcacggtaccgtgctcgttcagatcaagtacgaaggaacagatgcgccctgcaagatcccattcagcacccaagatgagaagggcgtaacacaaaatggccgactcataacggccaacccaatagtcacggacaaagaaaaaccagtgaacatagaagcagaaccgccattcggagaatcttacatagtcataggtgcgggggaaaaggccctcaagctgagctggtttaagaagggctcctcaattggtaagatgtttgaggcgacagcccgcggggcccggcgcatggccatactcggagacaccgcgtgggacttcggctctatcgggggagtattcacatcagtgggaaagctggtccaccaaatatttggcaccgcttacggggtcctctttagtggcgtaagctggaccatgaaaataggcatcggcgtcctactgacctggttaggcctaaactcccgcagcacctccttaagcatgacgtgcatagcagtcgggttagtcacactgtaccttggcgtgatggtccaagccgacagcggctgcgtcatcaattggaaaggaagagaactgaagtgcggttcaggtatattcgtgacaaacgaagtacatacctggacggaacaatacaagttccaagccgatagccctaagaggctatcggctgcaattggcaaagcctgggaggaaggagtatgtgggatacgctcggcaacacgcctggagaacataatgtggaaacaaatcagcaacgaattaaaccatatactcttggaaaatgacatgaagttcacggtggtagtaggcgacgtggcaggaatcctagcgcagggaaagaaaatgatacgcccccagcccatggaatataaatacagctggaaatcctggggaaaagctaaaataatcggagcagacgttcaaaacaccaccttcatcattgacggacccaacacaccggagtgccccgatgatcaaagagcgtggaatatatgggaagtcgaagactacggtttcggtatcttcaccacaaacatatggctgaagctaagggacagctatacccaggtgtgcgatcacaggctaatgtctgcagcgatcaaagatagcaaggcggtgcacgcagacatggggtattggatcgagtccgagaaaaatgaaacctggaagttggcccgtgcatccttcatagaggtgaagacatgcatctggcctaaaagccataccctatggagtaacggggtgctcgagtccgaaatgatcatacccaaaaactatggaggtccaatatcacaacacaattatcggcctgggtactttactcaaactgcggggccttggcatttaggaaaactagaactagatttcgacctatgcgaagggacaactgtcgtcgtggacgaacactgcggaaatcgggggccaagtttgcgcacgacaacagtcacaggtaagataatacacgagtggtgctgccgaagctgcacccttccgccactcaggtttaagggagaagacgggtgctggtatggcatggagattcggcccgtgaaagagaaagaggaaaacctggtcaaatcgatggtgtcagccggctcgggcgaggtcgactccttcagtttaggattgctgtgcatatccattatgatagaggaggtgatgcgcagccgatggtcgagaaaaatgctgatgacaggcacactagcggtcctgttcttgctaataatggggcagttgacatggtccgacctcatcaggctctgcataatggtgggcgcaaacgcaagtgaccggatgggaatgggcacgacctacttggcgctgatggcgaccttcaagatgagaccgatgttcgcagtaggactactcttcagaagactaacctcaagggaagtgctcctcctgaccatcggactatccttagtcgcgagcgtcgaactaccaaactctctcgaagaattgggcgacggcctggcaatgggcataatgattctcaagctcctgaccgactttcagtcacatcaactctgggctaccctcctatccctcactttcataaaaacaaccttttcgctccactacgcctggaaaacaatggcaatggtactaagtattgtcagcttattcccgctatgcttaagcaccacttcgcagaaaactacatggctgccagtgctcctcggctcgctcggatgcaaaccactaactatgttcctgatcgccgaaaacaaaatttggggaaggaagtcctggcctctaaacgagggaataatggcggtggggatagtcagcatccttctgtcgtcattgctaaagaacgacgtaccattagcaggaccacttatcgcgggaggaatgctcatcgcctgctacgtcatatccgggagcagcgcggacctctcactagaaaaagccgcggaagtctcatgggaagaagaagccgaacacagcggtgccagtcacaacatcctcgtagaggtgcaagatgatggtacaatgaagatcaaggacgaggaacgagacgatacactcacgatactacttaaagccactctcctcgcggtatccggggtttacccactgagcatccctgcaacactattcgtatggtacttctggcagaagaagaaacaacgcagcggggtcttatgggacactccatcaccgccagaagtcgaaagggccgtactagacgacggcatctacagaataatgcagcgcggactactcgggcgctcgcaagtaggggtaggcgttttccaagaaaacgtcttccacacaatgtggcacgtgacacgaggtgcggtgcttatgtaccaagggaaaaggttggaaccaagctgggcttcagtaaagaaggacctaatctcttacggtgggggatggcgcctccagggctcctggaataccggtgaagaagttcaagtaatcgctgtagaaccaggcaaaaatcccaagaacgtccaaacggcacccggaacatttaaaaccagcgaaggcgaagtcggcgccattgccttggatttcaaacccggaaccagcgggagccccatcgtcaaccgagaaggaaaaattgtcggcctctacggaaacggggttgtcacgacgtcgggtacatatgtatcggcgatcgcccaagcaaaagcatcacaggaggggccccttccagagatagaagacgaggttttccggaagcgaaacctgacaatcatggaccttcatccaggatcagggaagacgcggaagtacctgcccgccatagtgagagaagcgatcaaaaggaagctgcgaacgcttatcctggccccgacaagggtcgttgcaagcgaaatggccgaggctctgaaagggatgccaatacgataccaaaccacggcggtgaaaagcgagcacaccggaaaagaaatcgtagacctaatgtgtcatgcgaccttcacaatgcggctactatctcccgtgcgcgtcccaaactacaacatgatcatcatggacgaggcacacttcaccgacccgagtagcatagccgctcgaggctatattagcacaagagtcggaatgggagaagccgccgccatcttcatgaccgctacaccacccggctccgtagaggcatttccccagtctaatgccgtcatacaggatgaagaacgcgacataccagaacggagttggaacagcggttatgagtggatcacagactttccaggcaagaccgtgtggttcgtaccttcaatcaagtctggaaacgacatagccaactgcctgcgaaagaatgggaaacgcgtgatccaactctctcgcaaaacatttgatactgagtatcagaaaaccaaaaacaacgactgggactatgtggtgaccaccgacataagcgaaatgggcgccaacttccgtgctgatcgcgtgatcgacccccggcgctgcttgaagccagtaatccttaaggatggtccagaacgagtgatcctcgcaggaccgatgcctgttaccgtggcatcagctgcacaacgacgagggagaatcgggcgaaaccataacaaggaaggagaccaatatatttacatggggcaaccacttaacaacgatgaagaccacgcccactggacagaggcgaagatgctactagacaacatcaatacacctgaaggcataataccagcattgttcgaaccagaacgagaaaaatcagccgcgatcgacggagagtaccgtttgagaggcgaagctcgcaaaaccttcgtagagcttatgagacgaggagacctcccagtctggctttcgtacaaggttgcatctgaggggttccagtactcagatcgccgctggtgcttcgatggagaacgcaacaaccaagtactagaagaaaacatggatgtagaaatatggaccaaggagggggagcgtaagaagctccgtccgagatggctcgatgccagaacttacagtgacccacttgccctcagagagttcaaggagttcgcggccggaagacggagtgtgtcaggggacctaatactggaaatcggcaaactgccacagcacctcacccaacgagcacagaacgccctagacaacctagtcatgctccacaatagcgaacaaggcggtagggcgtacagacacgccatggaggagctcccagacacaattgaaactctcatgctcttggcactaatcgcagtattaacaggaggagtcacactcttcttcctaagcggccgggggctggggaaaaccagcataggattgctttgtgtcatggcgagttcggtcctactctggatggcctccgtcgagccgcattggatcgcggcgagcatcatactagagttcttcctcatggttctactaatacccgaacccgacagacaacggaccccacaggacaaccaactcgcgtacgtcgtcatagggctactcttcatgattctcacagttgcagccaacgagatgggcctactcgaaacgactaaaaaggatctgggaattggccacgttgccgtagaaaaccatcatcacgcagctatgctagacgtagatctgcaccccgcatccgcatggacactctacgcagtcgccacgacaataataacaccaatgatgcgacacaccatcgaaaacacaacagcaaacatcagtctgaccgccatcgccaaccaggcggcaatactgatggggttagacaaaggctggccaataagcaagatggacatcggcgttccactcctagcgcttggatgctactcccaagtaaatccactcacgctaacagcagcagtgctcatgctcgtggcccactatgcaattatcgggcccggtctacaagcgaaagcaaccagagaggcccaaaagcgcacagctgcggggattatgaaaaaccctactgtagacggcattgtcgcgatagaccttgacccagtcgtgtatgacgcaaagttcgagaaacaactgggccaaattatgctattaatcctgtgcacgtctcagatcttactaatgaggaccacatgggcgctatgcgaatcaattacactcgcaacgggacccctcacgaccctgtgggaaggaagccccgggaagttctggaacaccactatagccgtctccatggctaacatcttcagggggtcctacctagccggcgcgggactggctttttcgcttatgaaaagtttaggcggcgggcggcggggcactggagcacaaggagagacactaggcgagaaatggaagcgacaactgaaccagctcagcaagagcgagttcaacacctacaaacgcagcggcataatggaggtggacaggagcgaagcaaaggaagggctcaagcgaggcgagacgacgaaacacgccgtgagccggggtactgctaaattgcgatggttcgtggaacgaaatctcgtcaagcccgaagggaaggtgatcgatctcggctgcggccgcggcggatggagctactattgcgcaggccttaaaaaggtaacggaagtcaagggatacacaaagggcggcccgggacacgaggaacccattccgatggccacgtacggatggaacctcgtcaagttacactccgggaaagacgttttcttcataccacccgagaaatgcgacaccctcctctgcgatatcggtgagtcctcgccaaatccgaccattgaagaaggccgcacacttcgggtcctcaaaatggtcgaaccatggttaagaggcaaccaattctgcatcaagatactaaacccttacatgcctagcgtagtcgaaacgttggaacagatgcaacgaaagcacggcggaatgctcgtccggaaccctctgagtcgaaatagcacgcacgaaatgtactgggtgtcctgcggaactggaaacatcgtgtcggcggtaaacatgacaagtcgaatgcttctaaacagatttacgatggcccaccggaagccaacatacgagcgggacgtggacttgggggccggtaccagacacgtagcagttgagccagaggtggccaatctcgatataattggacaaagaatcgagaacattaaacatgagcacaaaagcacatggcactacgacgaggacaacccatataagacctgggcataccacggctcctatgaggtcaaaccaagcggctcagcgtcctccatggtaaacggcgttgttaaactactcacaaaaccctgggacgtcatcccaatggtcacacagatagcaatgacagacacaacgccattcggacaacaaagggtgttcaaggagaaagtagacaccagaacgccgaaggcaaagcgcgggacagcccaaataatggaggtaacagccaaatggctatgggggttcttatctcgaaacaagaaaccacggatatgtacgcgggaagagttcaccaggaaagtgcggagcaacgcagcgatcggggccgtattcgtggacgagaaccagtggaactcagctaaagaagcagtggaagacgaaaggttctgggatttggtacaccgcgaacgagagctgcacaagcaagggaaatgcgcaacttgcgtatacaatatgatggggaaacgagagaagaaattaggagagttcggtaaagccaaaggatcaagggcaatctggtatatgtggctcggcgcccgattcttagagttcgaggcattaggattcatgaacgaagatcactggttctcccgggagaacagtctgagcggagttgagggtgagggactccacaagctgggctacatactgagggacatatccaaaataccgggcgggaacatgtatgcggacgacaccgcaggctgggatacacgcattactgaagacgacctacagaatgaagccaaaatcacagacattatggagccggaacacgcactactcgcgaagtcaattttcaagctaacctaccaaaacaaagttgtaagggtccagcgacccgcgaaaaatggcacagtcatggacgtaattagccgtcgtgaccaaaggggatccggccaagtgggaacctacgggctaaacaccttcacaaacatggaagcccaactcatacgacaaatggagtcagaaggaatcttcagcccctccgaactagagacccccaacctcgctggacgcgtactggactggctcgaaaaacacggcgtcgaacgccttaagagaatggcgattagcggagatgactgcgtagtcaagccaatcgacgacaggttcgcgacagccctgaccgcactcaacgacatgggaaaagtacggaaagacatcccccaatgggagccctcgaagggctggaatgattggcagcaggtaccattctgtagccaccacttccaccagcttattatgaaggacggaagggaaatagtagttccctgccgaaatcaagacgagctggtcggccgggccagagtcagtcaaggagcgggatggagcctcagagaaacggcctgccttggcaagtcttacgcccaaatgtggcagttaatgtactttcacagacgtgacctccgactggccgccaacgcaatatgctcggcagtccccgtcgactgggtcccaacatcacgcacaacgtggtccatacacgcgcaccaccaatggatgacaaccgaagacatgctcagcgtttggaatagggtttggatagaagagaacccgtggatggaagacaaaacgcacatttccagttggggagacgtgccctacctcggcaagcgcgaggaccagtggtgcggaagcctcatcggactgaccgcacgagccacatgggccactaatatccaagtagcgatcaaccaagtacgacgcctcatagggaacgaaaattacctggactacatgaccagcatgaagagattcaagaatgagtcggacccggaaggcgcactatggtga

SEQ ID NO: 24170 - RNA, 9879 nt, synthetic construct
  misc_feature 1..9879: note = derived and/or modified CDS sequence (opt11) from DENV-1__FJ432739__SS-prME
  source 1..9879: mol_type = other RNA
agcgtgaccatgctgctcatgctaatgcccacggcactcgcttttcaccttaccacgagaggcggggagccccatatgatcgtgtccaagcaggaacgcggtaagtccctgctgtttaagacctccgcaggggtgaacatgtgtaccctcatcgccatggacttaggcgagttctgcgaggacacgatgacctacaaatgcccacgcatcaccgaagctgagcccgacgacgtggactgctggtgcaacgccaccgacacttgggtcacctacgggacctgtagccagaccggcgaacaccggcgagacaagcgctccgtcgccctggcgccccacgtgggcttagggttagagacgcgcaccgagacttggatgtcctcagagggggcctggaagcagatccagcgggtcgagacctgggccctacgccatccggggttcacggtgatcgccctcttcttggcgcatgctatcggcaccagcatcacccagaaggggatcatcttcattctgctcatgctggtgaccccctctatggctatgcggtgcgtaggcataggctcaagagacttcgtggaaggactgtccggcgccacgtgggttgacgtcgtgctcgaacacgggagctgcgtgacgaccatggccaaggataagccaaccctagacatcgaactgctcaagacggaggttactaacccagctgtgttgcgaaaattgtgcatcgaggccaaaatctccaacaccaccacggacagccgctgcccgacccagggcgaggccaccctcgtcgaggaacaggacgccaactttgtctgcagacgcactttcgttgaccggggctggggtaacggctgtgggctgttcggcaaggggagccttatcacttgtgccaagttcaagtgcgtgactaaactcgagggcaagactgtccaatacgagaacctgaaatactcggtcatcgttaccgtccacacgggcgaccagcaccaggttgggaacgagtccacggagcacggcaccacggcgaccatcaccccccaggccccctcgaccgagatacagctgaccgactacggtgccctgaccttggactgttcaccacggacgggcctggacttcaatgagatggtcctcctgacaatgaaggagaaggcctggctggtgcacaagcaatggttcctcgacctgccgctaccgtggacctccggagccagcacctcccaggagacgtggaatcggaaggacctattggtgacgttcaaaaccgcacacgccaagaaacaagaggtagtggtgctgggcagccaggaaggcgccatgcataccgccctcactggcgccaccgagatccagaccagcggcaccacgactatttttgcggggcacctgaagtgtcggctgaagatggacaaactcaccctgaagggcatgagctacgtcatgtgcactggctccttcaagctagagaaggaggttgccgagacgcagcacggtaccgtcctcgtacaaatcaagtacgaggggaccgacgcgccttgcaagatccccttcagcacccaggacgaaaagggtgtgactcagaatggccgcctgataaccgccaacccgatcgttacagataaagagaaaccagtgaacatcgaagcagagccgcccttcggggagagttatatcgtgatcggcgccggtgagaaggccctgaagttaagctggttcaagaaaggctctagtattggcaaaatgttcgaggcaaccgcccgcggagcgcggcggatggccatactcggcgacacagcctgggactttgggtccatcggcggtgtgttcaccagcgtcgggaagctagtgcaccagatcttcggcaccgcatacggggtgctgttctcaggcgtctcctggaccatgaagatcggaataggagtcctccttacgtggctagggctcaactcccgaagcacttccctgagcatgacctgcattgcagtgggcctggtgaccctttacctgggcgttatggtccaggcggactccgggtgcgtcatcaactggaagggtcgggaactgaagtgcgggagcggcatctttgtgaccaacgaggtgcatacctggaccgagcagtacaagtttcaggccgacagcccgaagcgtctctccgccgccataggtaaggcgtgggaagaaggggtctgtggcatccggagtgcgacccgactggagaacatcatgtggaagcagatatccaacgagctgaaccacatcctgctggagaatgacatgaagttcaccgttgtggttggggatgtggccggaattctagcccaagggaaaaagatgatcagacctcagcctatggagtacaagtacagctggaagagttggggcaaggctaagatcatcggcgcggacgttcagaacgccacgttcatcatcgacgggcccaacaccccggaatgccccgacgatcagcgcgcatggaacatctgggaggtcgaggattacggcttcgggatcttcaccaccaacatctggctcaagctgcgcgacagctatacccaggtgtgtgaccaccgccttatgtccgccgccatcaaggacagcaaagcggtgcacgccgacatggggtactggatcgagtcggagaagaacgagacctggaagctcgcccgggcgagctttatcgaggttaagacctgcatatggcccaaatcccacaccctgtggagcaacggcgtgctggagtccgagatgatcattccgaagatctacgggggcccaatcagccagcacaactatcgccccgggtacttcacgcaaaccgccggcccctggcatctagggaagttggaactggacttcgacctctgtgagggcaccaccgtggtggttgacgagcactgcggcaaccgggggccgtccctgcgcacgaccaccgtgaccggcaaaatcatccacgagtggtgctgccgtagctgcacgctgccgcccctgcgcttcaagggggaggacggctgctggtacggtatggagattagacccgtcaaagagaaggaggagaacctggtgaagtccatggtttcagcgggctcaggcgaggtcgactccttcagcttgggattgctgtgtatcagcattatgattgaagaggtgatgcgcagccgatggtcccgtaaaatgctgatgaccggcatacttgccgtgttcttcctgctgataatggggcaactcacctggaatgacctgatccggctctgcataatggtcggcgccaatgccagcgatcgcatggggatgggcacgacgtacctcgccctgatggctaccttcaagatgcgcccgatgttcgccgtgggactcctgttccgccgcctgactagccgggaagttctgctcttgaccatcggtctgagcctcgtcgcctcagtagagctgcccaacagcctggaagagctcggcgacgggctggccatgggcataatgatcctgaaactcctgacggacttccagtctcatcaattatgggcgaccttgctgagcctgacctttatcaagaccacgttcagtctccactatgcctggaagacgatggctatggtcctgagcatcgtgtccctgttccccctctgcctttcaaccacctcccagaagacaacgtggcttcccgtgcttcttggcagcctggggtgcaagcctctaacaatgttcctgatcgcagagaacaaaatctggggccgcaagtcctggcccttaaacgaggggatcatggccgtcggcatagtgagcatattgctgagcagcctgctcaagaatgacgtgcccttggctggtccccttatcgccggcggtatgctcatcgcctgctacgtcatcagcgggtccagcgccgatctgtccttagagaaggccgccgaggtgagctgggaggaggaagccgagcactctggcgcgagccataacatcctcgtggaggtccaggacgatgggaccatgaagataaaggacgaggagcgtgatgacacgcttaccatcctgctaaaggcgacgctgctggccgtatcgggcgtgtacccgcttagcattccagcaaccttgtttgtctggtacttctggcaaaagaagaagcagcgctccggggttctgtgggacaccccctccccgcccgaggtggaacgggctgtcctcgacgacggtatataccgcatcatgcagcggggcctgctagggcgctcccaggtgggcgtgggtgtgtttcaagagaacgtcttccacacgatgtggcacgtgacccgcggcgccgttttgatgtaccaggggaagcgcctcgaaccgagctgggccagtgtgaagaaggacctgatcagctacggcggcggttggcggctgcagggatcctggaacaccggggaggaggtgcaggtaatcgcggtggagccaggcaagaaccctaaaaacgtgcagaccgcgcccgggactttcaaaaccagcgagggcgaggtgggggccatcgccctcgacttcaagcctggcacatccggcagtcccattgtgaaccgcgaggggaagatcgtgggcctgtatggtaacggggtcgtgaccacaagcggcacctatgtgtccgccatcgcccaggctaaagccagccaggagggccctctgccggagatcgaggacgaggtctttagaaagcgcaacctcacaattatggacctgcatcccgggtcaggcaagaccagacgctaccttcccgccatcgtgcgggaggccataaagcgcaagctccggaccttaatcctggctccaacccgcgtggtcgccagcgagatggccgaagccctcaaagggatgcccatccgctaccaaaccaccgccgtgaagtccgaacacaccggcaaggagatcgtggacctgatgtgccacgcgaccttcaccatgcggctgttgagccccgtccgcgtgcccaactataacatgatcatcatggatgaggcccacttcaccgacccgagtagcatcgccgcccgggggtacatctcgacgcgcgtgggcatgggggaggccgcggccatcttcatgaccgccaccccgccaggcagcgtggaggcctttccgcagtccaacgccgtgatccaggacgaggagcgggatatcccggagcgcagctggaactccggttacgagtggatcaccgacttccccggcaagaccgtgtggttcgtgccaagtataaagtcaggcaacgacatcgccaactgcctccggaagaacgggaagcgcgtgatccagctgagccggaagaccttcgataccgagtaccagaagactaagaataatgactgggactacgtagtcacgaccgatatcagtgaaatgggcgcgaacttcagagccgaccgggtgattgatccccgacgttgcttgaaaccggtgatcctgaaggacggtccagagcgcgtcatcctagctggtcccatgcctgtgacggtcgccagcgccgcccagcggcgcgggcgaatcggccgcaatcacaacaaggaaggcgaccagtacatctacatgggacagccgctcaacaacgacgaggaccacgcccactggaccgaggccaagatgctgttggacaatatcaacacgcccgagggcattatacccgcactcttcgagcccgagcgggaaaagtccgccgcgatcgacggggagtaccgcctgcgcggcgaagcccggaagaccttcgtcgagcttatgcgccgcggggacttgccggtgtggctgtcctacaaggtcgcctcggagggcttccagtactccgaccgccggtggtgtttcgacggcgagcgaaacaatcaagtgctggaggaaaacatggacgtggagatctggacaaaggagggggagcggaagaagctacgcccccggtggcttgacgcgagaacatactcggaccctctggccttgcgggagttcaaggagttcgccgcaggccgccgttctgtcagcggagacctgatcctggaaataggcaaactcccccagcacctgacacagcgcgcccagaacgccctggataacctcgtgatgctgcacaactccgagcaaggcggccgggcataccgccacgcgatggaggagctgccggacaccatcgagacgttaatgctactggccctgatcgcagtgctgaccggcggggtcaccctgttcttcctcagcggacgggggctgggcaagacgtccatcgggctgctctgtgtgatggctagctccgtgttgctgtggatggccagcgtcgagcctcactggatcgccgcctccatcatcctcgagttcttcctgatggttctgttaatccccgagcccgacaggcagcggacaccgcaggacaaccagttagcttatgtggtcattgggttgctcttcatgattctgacagtggctgccaacgagatgggcctgcttgagaccacgaagaaagacctggggattggccatgttgccgtcgaaaaccaccaccacgccgccatgttggacgtagatttacaccccgccagcgcctggaccttatatgccgtggcgaccacaatcatcacgcccatgatgcgccacacgatcgagaataccaccgccaacatctccttgacggccatcgccaaccaagccgcgatcctcatgggtctggacaagggatggccgatcagcaaaatggacatcggtgtcccgctgctcgccctggggtgctactcccaggtaaaccccctgactcttaccgccgccgtgctgatgctggtcgcccactacgcaatcatcggcccagggttgcaggctaaggccacccgggaggctcaaaagcgcacggccgcgggcatcatgaagaacccgaccgtggacgggatcgtggcgatagatttagaccccgttgtttacgacaccaagttcgaaaagcagcttggccagatcatgctccttattctgtgcaccagccagatcctacttatgcgcacgacctgggccttgtgcgagagtatcactctcgccactggccccttgacgaccctgtgggagggaagccctggcaagttctggaacaccacaatcgccgtttccatggcgaacatcttccgggggagctacttggctggcgccgggttagccttcagcctgatgaaatcgctcgggggcgggcggcggggcacgggggcgcagggcgaaacgctgggcgagaagtggaagcgccagctgaaccaactcagcaagagcgagttcaacacctacaagcgctctgggatcatggaagtcgaccgaagtgaggccaaggagggcctgaagcgcggggagaccacgaagcacgccgtgagtagaggcaccgccaagctgcggtggttcgtggagcggaacctggtcaagccggagggtaaggtgatcgacctgggctgcggccgcggcgggtggtcctactactgtgcagggctgaagaaggttacagaggtgaaggggtacaccaagggcggcccgggccatgaggaacccatccccatggccacttacggttggaaccttgtgaagctccatagcggcaaggacgtgttcttcataccgcccgaaaaatgcgacaccctcctgtgcgacatcggggagtccagcccgaaccccaccatcgaggagggccgcaccctcagggtcttaaagatggtggaaccctggctgcgcgggaaccagttctgcatcaagatcctcaacccctacatgcccagtgtggtcgagactctggagcaaatgcagcggaagcacggagggatgttagtccgcaaccccttatcgcggaactccacccacgagatgtactgggtgagctgtggaaccggcaatatagtcagcgccgtaaacatgacctcgcgcatgctactgaaccgcttcactatggcccaccgcaagccgacgtacgagcgtgacgtcgatctcggggccggcacccgccacgtcgccgtggagccagaggtggctaacctggatatcattggccagcgcattgagaacattaagcacgagcacaagtctacctggcactacgacgaggataacccctacaagacctgggcctatcacggctcttacgaggtcaagccctccggaagcgccagctccatggtgaacggggtcgtaaagctgctgacgaagccgtgggatgtaatcccaatggttacgcaaattgccatgacggacacaactcccttcggccagcagcgcgtgtttaaagagaaggtggatacccggacacccaaggccaagcgggggacggcgcagatcatggaagttacagccaagtggttgtggggcttcctgagccgcaataaaaagcctcgcatctgcacccgcgaagagttcacccgcaaggtgcgctcaaacgccgccataggtgctgtgttcgtcgacgagaaccagtggaacagcgccaaggaggccgtggaggacgagcggttctgggatctcgtgcaccgcgaacgggagctgcataaacaggggaagtgcgcgacctgcgtctacaacatgatgggaaaacgcgagaaaaagctgggcgaattcggcaaggccaagggctcccgggctatctggtacatgtggctcggtgctcgcttcttagagttcgaggcactggggttcatgaacgaggaccactggtttagccgggagaacagtctcagcggcgtggagggcgaggggctgcataagctgggctacatcctccgtgacatctccaagatcccagggggaaatatgtacgccgacgacacggccggctgggacacccggattaccgaagacgatctgcagaacgaagcgaagattaccgacattatggagcccgagcatgccctgctcgccaaatccatctttaagctgacgtaccagaataaagtagtgcgcgtgcagcgaccggccaagaacgggaccgttatggacgtcatatcccgccgcgaccagcggggaagcggccaagtgggcacttacggcctgaataccttcacaaatatggaggcccaactcattcgccaaatggagtccgaggggatcttcagcccctccgaacttgagacgcccaaccttgcggggcgggtcctcgactggctggagaagcacggggtcgagcgacttaagcggatggccatctcaggagacgattgcgtggtgaagcccattgacgatcgcttcgccacagccctcaccgccttgaacgacatggggaaggtgcggaaggacataccgcagtgggagccctccaaggggtggaacgactggcagcaggtgccattctgctcgcaccattttcaccaactgatcatgaaagacggtcgcgaaattgtggtgccctgccggaaccaggatgagctcgtaggccgcgctagagtgagccagggtgccgggtggtccttaagggagacggcctgcctgggcaagagctacgcccagatgtggcagttgatgtatttccaccggcgcgacctgagattagccgcgaacgcaatttgctccgccgtcccggtggactgggtgcccaccagccgcaccacctggtcaatccacgctcaccaccagtggatgacgacggaggatatgctctcagtctggaaccgtgtgtggatagaggagaacccctggatggaggataagactcatatctctagctggggcgacgttccctacctggggaaacgggaggaccaatggtgtggctccttaattgggctcaccgcacgggcaacgtgggccaccaatatccaggtcgccatcaaccaagtccgccgattgatcggcaacgagaactatctggactacatgaccagcatgaagcggttcaagaatgagatcgacccggagggggccctctggtga

SEQ ID NO: 24171 - RNA, 9879 nt, synthetic construct
  misc_feature 1..9879: note = derived and/or modified CDS sequence (opt11) from DENV-1__FJ410201__SS-prME
  source 1..9879: mol_type = other RNA
agcgtgaccatgttactcatgctgatgccgaccgctctggcttttcacctcaccacccgcggtggagagccgcacatgattgtgagcaagcaggagagaggaaaaagccttttgttcaagaccagcgccggggtgaacatgtgtaccctcatcgctatggacctgggcgagctttgcgaggacacgatgacttacaagtgccctcgcatcaccgaggccgaacccgacgatgtcgactgctggtgcaacgccaccgatacgtgggttacctacgggacttgctctcagaccggtgagcataggcgcgacaagcggtccgtagccttagcaccccacgtcgggctgggcctggaaacaaggactgagacctggatgtcttccgagggcgcctggaaacagatccaacgggtcgagacatgggctctccgccatcccgggttcacagtgatagcactgttcctggcgcacgcaataggaaccagcatcacccagaagggcattatctttatccttctgatgctggtcaccccctccatggccatgcggtgcgtcggcatcggaagcagggactttgtcgaggggcttagcggcgccacctgggtggacgtcgtgctcgagcacgggagctgtgtgaccactatggccaaagacaagcccaccttagacatcgagctgctgaagacagaggtcaccaatcctgcggtgctccggaagctctgcatcgaggccaagatatcgaacaccaccacggatagccgctgcccgactcaaggagaggccactctggtggaggagcaagacgccaacttcgtctgccggcgtaccttcgtggaccggggctgggggaacggctgtgggctgttcgggaagggatctctcatcacgtgcgccaagttcaagtgcgtgactaaactagagggaaagattgttcagtatgagaacttaaagtacagcgtgatcgtgactgtccataccggcgaccaacatcaggtggggaacgaatccacagagcatggcaccactgcgaccattactccccaggcccccacgacggagatccaactaaccgattacggggctttgacgctggattgcagcccccgtactggcctggacttcaatgaaatggtcctgttaacaatgaaggagaagtcctggctagtccacaagcagtggttccttgacctacccctcccctggacgtcgggggcttcgacctcccaggagacgtggaatagacaggacctgctggtgacctttaaaaccgcccacgcgaagaagcaggaagtcgtggtcctcggcagccaggagggtgccatgcataccgccctgactggggcaaccgaaatccagaccagtggcaccacaactatctttgccggccacctgaagtgccgtctcaaaatggacaagctgacactgaagggcatgagctacgtcatgtgcaccgggagctttaagcttgagaaggaggttgcggaaacgcagcacggcaccgtcctggtccagatcaagtatgagggcaccgacgccccatgcaaaataccatttagcacccaagacgagaaaggggtgacgcagaacggccgcctgatcaccgcgaatcccatagtgacggacaaggagaaaccagtgaatattgaggccgagccccccttcggggagagctacatcgtgattggggcgggcgaaaaggccctgaagctcagctggttcaaaaaggggtcaagcatcggaaagatgtttgaggccaccgcccggggggctcggcggatggcaatcctgggggacacggcgtgggacttcgggtcgatcggcggcgttttcacctcggtagggaagctggtgcatcaaatcttcggcaccgcatatggagtcctcttctccggggtctcctggactatgaagatcggaatcggggttctcttgacgtggcttggtctgaacagtcgttcaacctccctgtcaatgacctgcatcgccgtggggctcgtgacgctatacttgggcgtgatggtgcaggccgactccgggtgcgtgatcaattggaagggtcgggagctgaagtgcggtagcggcatcttcgtgactaatgaggtgcacacatggaccgaacagtacaagtttcaggctgatagcccgaagcgcctgtccgccgcgatcgggaaggcctgggaggagggggtctgcggcatacggagtgccacacgcttggagaacatcatgtggaaacagatttccaacgagctcaatcacatcttactggaaaacgatatgaaactcactgtggtggtcggggatgtcgcgggcattctgggtcagggcaagaagatgatccggccccagcccatggagtacaagtattcctggaagtcctggggcaaagccaagatcatcggagccgacgcccagaacaccacctttatcatcgacggcccgaacacaccggagtgccccgacgaccagcgcgcgtggaacatctgggaagtggaggactacggattcggcatctttaccactaacatctggctgaagctccgtgacagctacacacaggtctgcgaccaccgcctgatgagcgccgccatcaaggactccaaggccgtccatgccgacatgggctactggattgagtccgaaaagaatgagacctggaagcttgcgcgggcctcatttattgaggttaagacctgcatatggcccaagtcccacacgttgtggtcgaacggtgttctggagagcgagatgatcatccccaagatatacggcgggccgatctcacagcacaactaccgaccagggtacttcacccagacagcaggtccgtggcaccttggcaagctcgaactagacttcgacctgtgtgaggggaccaccgtagtggttgacgagcactgtgggaaccgggggccgtctctacgcaccaccaccgtgaccgggaagatcattcacgagtggtgctgcagatcatgtaccctgcccccactgcgcttcagaggcgaagacgggtgctggtacggcatggagatccgccccgttaaggagaaggaggaaaacctcgtaaaaagcatggtgtcggccggcagcggagaagtcgattccttcagcctaggcctgctctgcatcagcatcatgatcgaggaggtgatgcgctctagatggtcccgcaaaatgcttatgaccggaacccttgccgttttcttcctcctaattatgggccagctgacgtggaatgacctcatccgcctgtgcatcatggtgggagcaaacgccagcgaccgcatgggcatgggcaccacctatctagcgttgatggctacgttcaaaatgcggccgatgttcgccgtcgggctactgttccgtcggctcacgtccagagaagtgctactcctcaccatagggcttagcctggtggcgtcggtcgagttgccaaactccttagaggagttgggcgacggcctcgccatgggtatcatgatcctgaagctgctcaccgatttccagtcgcaccagctgtgggccaccctgctaagcctgacgttcatcaagaccaccttcagtctgcactacgcctggaagaccatggcaatggtactcagcatcgtctccctcttcccgctgtgccttagtactacctcgcagaagaccacctggctgcccgtgttactcgggagcctgggctgcaagcctctgacgatgttcctcatcgccgagaacaagatctgggggcggaagtcctggcccctgaacgaaggaatcatggccgtaggcattgttagcatcctgctctcttccttgttgaagaacgacgtgcccttggccggccccctaatagccggcggcatgttaatcgcgtgctacgtgatcagtggcagtagcgcggacctcagcctggaaaaggcggccgaggtcagctgggaagaagaggctgaacacagcggggcctcacacaacatactggtagaggtgcaggacgacggcacgatgaagatcaaggacgaggagcgcgacgacaccctcacaattctcctgaaagccaccctcctggcggtgtcaggggtgtatccgctgtctatccccgccaccctcttcgtgtggtacttctggcagaaaaagaaacagcggtccggcgtcctgtgggacaccccatccccgcctgaggtggagcgcgccgtactggacgacggcatctaccgtatcatgcaaagggggctgctcggccgaagccaggttggggtgggcgtgttccaggaaaacgtcttccatactatgtggcacgttactcgtggggcggtgctgatgtatcagggcaagcggcttgagccctcctgggcctccgtcaagaaggatttgatcagctacggcggaggctggcggcttagagggagttggaacacgggcgaggaggtccaggtgatcgccgtcgagccaggaaagaatcccaagaatgtgcaaacagcccccggtaccttcaagaccccagagggagaggtgggggcgatcgccttagatttcaagcccggcacatctgggtcacccatcgtcaaccgcgagggcaagatagttggcctctacgggaacggcgtggtaacaaccagcggcacttacgtaagcgccatcgcccaggccaaagcttcccaggagggccctttgccggaaatagaggacgaggtcttccggaagcgcaacctgacgatcatggacctccacccagggagcggaaagacacgccgctacttacccgccatcgtccgagaggccatcaagcgtaagctgcgcaccctcatcctggcccccacccgggtggtggcctccgagatggcagaggcactaaagggcatgcccatccgataccaaacgaccgcagtcaagtctgagcacactgggaaggagatcgtggacctcatgtgccacgccacgttcactatgcggctgctctcacccgtgcgcgttccgaactacaacatgatcattatggacgaagcccacttcaccgaccccagctcgatcgcggcccggggctacatcagcaccagagtggggatgggtgaggcagcggccatcttcatgaccgcgacgccgccagggtcagtcgaggccttcccccagagcaatgccgtgatccaagacgaagagcgcgatatccccgagaggagttggaacagcggttacgagtggattaccgatttccccgggaaaacagtgtggttcgtaccttcaataaagagcggtaacgatatcgccaattgcctcagaaagaatggcaaacgcgtgatccagctgtcccggaagacctttgatacggaataccagaagaccaagaacaacgattgggactacgtagtgaccaccgacatctctgagatgggagccaatttccgcgccgaccgagtcatcgacccgcgccggtgcctgaagcccgtgatcctcaaggatggaccagagcgcgtgatcctggccggccccatgccagtcacagtggcctccgctgcgcagcggcgcggccggatagggcgcaaccacaacaaagagggggatcagtatatctatatggggcagccccttaataatgacgaggaccacgcgcactggaccgaggccaagatgctcctggacaatatcaacacccccgaggggatcatccccgcgctattcgagccggaacgggagaagtccgccgccgtagacggcgagtaccggctccggggggaggcccggaagacatttgtagagctgatgcgccggggcgacctccccgtgtggctgtcttacaaggtggccagcgagggcttccagtacagcgatcgccggtggtgcttcgacggggagcgcaacaatcaggtgctggaggagaacatggacgttgaaatctggacgaaagagggtgagagaaagaagctgcgcccccgctggctcgacgcccgcacctactccgaccccctggcgctgagggagtttaaggaattcgcggccgggagacggagcgtttccggggacctcatcttggagatcggtaagctgccccagcacctcacccagcgggcgcagaacgccttagataatctagtcatgttacacaacagcgagcagggcggacgggcgtaccgccatgccatggaggagctgcctgataccatcgaaactcttatgctcctggcgctgatcgctgtattgacggggggcgtgaccctcttcttcctgtccgggcggggcctcggcaagactagcatcgggctgctatgcgtgatggcctcctctgtgctcctgtggatggcgtccgtcgagccccattggatcgcagcctccatcatcttggagttcttccttatggtgctactgatccctgaaccggaccgccagagaacgccccaggataatcagctcgcctacgtggtcataggcctgctgttcatgatcctcacggtggccgcgaacgagatggggctcctggagaccactaaaaaagacctgggcatcgggcatgtggccgtcgagaaccaccaccacgccgccatgctggacgtggacctgcaccctgcctcggcgtggaccctctacgcggtcgctacaacgatcatcaccccaatgatgcgccacaccatcgagaatacgaccgccaacatcagcttgaccgctattgcaaatcaagccgccattctgatgggtctcgacaagggctggcccatcagtaagatggacattggggtccccctactggctctcggctgctacagccaggtgaatcccctgaccctgacagcggccgttctcatgctggtggcccactacgccattatcgggcccggcctacaagctaaagcaacccgcgaggcgcaaaagcggaccgccgccggtatcatgaaaaaccccaccgtggacggcatcgttgccatcgacctcgaccccgttgtgtacgacgcgaagttcgaaaagcagctgggccagatcatgctcctcatcctatgtacgagccagatcctgctaatgcggaccacctgggcgctgtgtgagtccatcaccttggccaccgggcctctcactaccctgtgggagggctccccggggaagttctggaacaccacaatcgccgtgagcatggccaacatctttcgtggatcctatctagcgggagccggtttagctttcagcctgatgaagtccctgggcgggggccgcagaggaaccggcgcccagggcgagaccctcggggaaaagtggaagcgccagttaaaccagctgtccaagagcgagttcaacacctacaagcgttccggcattatggaagtagatcgttcagaggcgaaggaagggctcaagcggggcgaaaccaccaaacacgccgtgtcccgcgggaccgccaaactgcggtggtttgtggaacggaacctggtcaagcccgaaggcaaggtaatcgatctgggctgtgggcggggtgggtggtcctattactgcgccgggctcaaaaaagtgacagaggttaaggggtacacgaagggcggcccggggcatgaggaacccattccgatggcaacctatggctggaacctggtgaagctacactccgggaaagacgtgttcttcatcccgcccgagaagtgcgataccctcttgtgtgacataggcgagagctcccctaacccgaccatcgaggaggggcgcacgctgagggtcctcaagatggtggagccctggctgcggggtaaccaattctgcatcaagatcctgaacccctatatgcccagcgtcgtcgagacactcgagcagatgcagcggaagcacggcggtatgctggtgcgaaacccgctgtcccggaacagtacccacgagatgtactgggtgtcctgcgggaccgggaatatcgtcagcgcggttaatatgacctcccgcatgctcctgaaccgcttcactatggcccacaggaagcccacctacgagagggacgtcgacctgggcaccggcacgcggcacgttgccgtggagcccgaggtagctaacttggatatcataggccaacgcatcgagaacatcaagcacgagcacaagtccacatggcactacgatgaggacaacccgtacaagacctgggcctaccacggctcctacgaagtgaaaccatctggttccgcaagctccatggttaacggcgttgtcaagctgctcaccaagccctgggacgtcatccccatggtcacccaaatcgccatgacggacacaacgcccttcgggcagcaaagggtgttcaaggaaaaggtagacacccgcacgccgaaagccaagcggggcacggctcagatcatggaggtcaccgcgcgctggctctggggcttcttgtcgcggaacaagaagccccgcatctgcactcgagaggagtttacgaggaaggtacgtagcaacgctgccatcggagccgttttcgtcgacgaaaaccaatggaactccgcaaaggaggcggtggaggacgaacgcttctgggacctggtgcaccgggaacgcgagctgcataagcaaggcaagtgcgcgacctgcgtctacaacatgatggggaagcgggagaagaaactgggtgagttcggtaaggccaagggctcgcgcgcaatctggtacatgtggctgggtgctcggttcctcgaatttgaggcactggggttcatgaatgaagaccattggttctccagggagaatagcctgtccggagtggagggagagggcctccacaaacttggctacatcctgcgggacataagcaagatcccgggcggaaacatgtacgccgatgacaccgcagggtgggacacccgcattacggaagacgatcttcaaaacgaggccaagatcaccgacatcatggagccagaacacgccttattagcaaaggctattttcaagttaacctatcaaaacaaggttgtccgtgtgcagcggccagcgaaaaatggaaccgtgatggacgttatcagtcgccgggaccagcgtggcagcggccaggtgggaacgtatgggctgaacacgttcacaaatatggaggcccagctaatcagacagatggagtccgagggcatcttctccccctctgagcttgagacccccaacctcgccgaacgcgcgctggactggctcgagaagtatggggtggaacgactgaaacgcatggcgatcagcggcgacgactgcgtagtgaagccgatcgacgaccggtttgccaccgctctgaccgccttgaacgacatggggaaggttcgcaaagacatcccccagtgggagccctccaagggatggaatgactggcagcaggtccccttttgctctcaccacttccaccagctgatcatgaaggacggacgggaaattgtcgtgccgtgccgcaaccaggatgaattagtggggcgagcgcgcgtcagccagggcgccgggtggtcactccgggagaccgcctgcctggggaagagctatgcccagatgtggcagctgatgtacttccaccgccgggacctgagactggccgccaatgccatctgttctgcggtacccgtcgattgggtgcccaccagccggacgacctggtccatccacgcgcaccaccagtggatgaccaccgaggacatgctgagcgtgtggaatcgcgtatggatcgaggagaatccctggatggaggacaaaacgcacatctctagctgggaggacgtgccgtacctcgggaagcgcgaagaccaatggtgcggatccctgattggactgaccgcgagggccacctgggccaccaacatccaggtggccattaaccaggtgcgccggctcatcgggaatgaaaactacctgaattacatgaccagcatgaagcgcttcaagaacgagtccgaccctgaaggcgctctttggtaa

SEQ ID NO: 24172 - RNA, 9879 nt, synthetic construct
  misc_feature 1..9879: note = derived and/or modified CDS sequence (opt11) from DENV-1__FJ410203__SS-prME
  source 1..9879: mol_type = other RNA
tctgtgaccatgctgctcatgctgatgcccaccgccctggctttccacctcaccacccgcggcggtgagccacacatgatagtgtccaagcaggaacggggcaagagcctgttattcaagacctccgccggggtgaacatgtgcaccctcattgccatggacctgggcgagctgtgcgaggacacgatgacatacaaatgccccaggatcaccgaggccgagcccgacgacgtggactgttggtgcaacgccacggacacgtgggtgacctacgggacgtgctctcagacaggcgagcaccggagagacaaacggtccgtggcactggcgccccacgtgggccttgggctggagacgcgcaccgagacctggatgtcaagcgagggcgcctggaaacaaatccagcgggtcgagacttgggccctccgccaccccgggtttacggtgatcgccctgttcttggcccacgccatcggcaccagcatcacccagaaggggatcatcttcatcctccttatgctggtcacccctagcatggcgatgcggtgcgtcggcatcggcagccgcgacttcgtggaggggctctcaggcgccacgtgggtggacgttgtgctggagcacgggagctgcgtgaccaccatggccaaggacaagcccaccctggacatcgaactcctaaagacggaggtcaccaaccccgcggtgctgcggaagctctgtatagaggccaagatctccaacactaccacggacagccgctgcccgacccagggcgaagccaccctggtcgaggagcaggacgccaatttcgtttgccggcgcaccttcgtggaccggggctgggggaacgggtgcgggctgttcggcaagggttccctaatcacgtgtgccaagttcaaatgcgtgaccaagttggagggcaagatcgtccaatacgagaacctgaagtacagcgtcatcgttaccgtccataccggagatcagcaccaagtgggtaacgagtccactgagcacggcaccaccgcgaccatcaccccccaggcccccacaaccgaaatacagctcaccgactacggggccctgaccctggactgctcgccccgcacgggcctcgacttcaacgagatggttctgctaaccatgaaggagaagtcatggctagtccacaaacaatggttcctggacctgccccttccatggacgagcggggcctcaacctcccaggagacgtggaaccggcaggacctgctggtgaccttcaagaccgcccacgcgaaaaagcaggaggtcgtggtgctcggcagccaggagggcgccatgcacaccgccctgacgggggcgaccgagatccagacctccggcaccacgactatcttcgccgggcacctgaagtgccgcctcaagatggacaagctgaccctgaagggcatgagttacgtcatgtgcaccgggtccttcaagctcgagaaagaggtggcggagacgcagcacggcaccgtgctggtccagatcaagtacgagggcaccgacgccccctgcaaaattcccttcagcacgcaggacgaaaagggggtgacgcagaacggccgtcttatcaccgcaaacccgatcgtgaccgacaaggagaaacccgttaacatcgaggccgaaccgccctttggggagtcctacatcgtgatcggggcgggcgagaaggcactgaagctctcttggttcaagaaggggtcctcgattggcaagatgttcgaggccaccgcccgtggggcccggcgcatggcgatcctgggcgacacggcttgggatttcgggtccatcggcggtgtgtttacctccgtcgggaagctgatccaccagatctttggcaccgcctatggagtcctcttctccggcgtgagctggaccatgaagatcggtatcggggtcctgctgacctggctcggcctgaactcccgcagcacctccctgagcatgacctgtatcgccgtggggctcgtcaccctgtacctgggcgtcatggtgcaagccgactccgggtgcgtaatcaactggaagggtagggagctcaagtgtgggagcggcatcttcgtcacgaacgaggtgcacacctggaccgaacagtacaagtttcaggcggacagcccgaagcgcctatcagccgccattggcaaggcctgggaggaaggggtgtgcggcatccggagcgccacacgcctggaaaacatcatgtggaagcagatctcaaacgagctgaaccacatcctgctggagaacgacatgaagctcaccgtcgtggtaggggacgtcgctggcatcctggggcagggcaagaagatgatcagaccccagcccatggagtacaaatacagctggaagtcctggggcaaggccaagataatcggagccgacgcgcagaacacgaccttcatcatcgacggccccaacactccggagtgccccgatgaccagcgcgcgtggaacatctgggaggtagaggattacgggttcggaatctttaccacaaacatctggctgaagctccgggacagctacacccaggtgtgcgaccaccgcctaatgtccgctgctatcaaggactccaaggccgtccatgccgacatgggctactggatcgagagcgagaagaacgagacctggaagctagcgcgggccagcttcatcgaggtgaaaacttgcatatggcccaaatcccacacgctctggagcaacggggtgctggagtctgagatgatcatccccaagatctacggtgggccgatcagccaacacaactaccgccccgggtacttcacccaaacggcgggtccctggcacctgggaaaactcgagctggacttcgacctgtgcgagggcactacggtcgtggtggacgagcactgcggcaaccgggggccgtccctccgcaccaccaccgtcacggggaagatcatccacgagtggtgctgccggagctgcaccctgccgcccttacgcttccgtggcgaggacgggtgctggtacggcatggagatccgccccgtgaaggaaaaggaggaaaacctcgttaagtcgatggtcagcgccggcagcggggaggtggacagcttcagcttaggcctgctctgcatctccataatgatcgaagaggtgatgcgatctagatggagtcgaaagatgctgatgaccgggaccctggccgtcttctttttattgattatgggccagctcacgtggaacgacctcatccgcctgtgtatcatggtgggagccaacgcctttgaccgcatgggcatgggcaccacttacctggccctcatggccaccttcaagatgcggccgatgttcgctgttgggctcctgttccgccggctcacgagccgcgaggtactgctactcactatcggcctgtccctggttgcgtccgtggagctccctaactcgctggaggagctgggggatggcctcgccatgggcatcatgatcctgaagctgctcaccgatttccagagccaccagctgtgggccactctgctctccctgacgttcatcaagaccacctttagcctgcactacgcctggaaaacaatggcgatggtcctcagcatcgtgtcgctgttccccctctgtctctccacgaccagccagaagaccacctggctgcccgtcctgctcgggtccctggggtgcaagccgctgacgatgttcctcatcgccgagaataagatatggggacggaaatcctggccgctgaacgagggcatcatggctgtggggatcgtgtccatcctgctcagtagtctgctgaagaacgacgtccccctcgcgggccccctgatcgccggcgggatgctgatcgcgtgctacgtgatctccggcagctcggcggacttgagcctggagaaagccgcagaggtatcctgggaggaggaggccgagcacagcggggcgtcccacaacattctggtcgaggtacaggatgacggcaccatgaagatcaaggacgaggagcgagacgacaccttgaccatcctgctgaaagccaccctcctggctgtgagcggggtctatccgctgtccattcccgccacgctcttcgtctggtacttctggcaaaagaagaagcagcggagcggagtgttatgggatacccccagcccgcccgaggtcgaacgcgccgtgctggacgacggcatctaccggatcatgcagcgcgggctgctcggccggagtcaggtgggggtgggcgtgttccaggagaacgtgtttcacaccatgtggcacgtcacacgcggtgcggtgttgatgtaccagggcaaacggctggagccctcctgggcctcggtgaagaaggacctcatcagctacggcggcggctggcgccttcgggggagctggaatacgggcgaggaggtccaggtgatcgccgtggagcccgggaagaaccccaagaacgtccagaccgcccccggcaccttcaagacacccgagggcgaggtgggggccatagcgctggatttcaagccgggcacgtccggcagccccatcgtgaaccgggagggcaagatcgtaggcctctacgggaatggagtggttaccacctctgggacttacgttagcgccatcgcccaggccaaggcgagccaggagggtccactgcccgaaatagaggacgaggtctttcggaaaagaaatctgacaattatggacctccaccccgggtccggcaagacccggcgctacctgccggccatcgtgcgggaggccatcaagcgcaagctgaggaccctcatcctcgcccccaccagggtcgtagccagcgagatggccgaagccctgaaaggcatgcccatccgataccagacgaccgccgtgaagtccgagcacaccgggaaggagatcgtcgatctcatgtgccacgccacattcacgatgaggctgctgagccccgtgcgcgtgcctaattacaacatgatcatcatggacgaggcccacttcactgacccctccagcatcgccgcccgaggctacatctccacccgcgtcgggatgggcgaggccgccgccatctttatgaccgctacgccgcccgggagcgtagaggccttcccgcagtctaacgccgtaatccaggacgaggagcgggacatccccgagcgcagctggaactccggccacgagtggatcaccgacttccccggcaaaaccgtttggttcgtaccctctatcaagtccgggaacgacatcgccaactgcctccggaagaacgggaagcgggtaatacagctgagccgtaagacctttgatacggaataccagaagaccaagaacaacgactgggactacgtcgtgaccacggacataagtgaaatgggggcgaatttccgcgcagaccgggtgatcgacccgcgccgatgcctgaagcccgtcatcctcaaggacggccccgagcgcgttatcctggccgggccgatgccggtgactgtcgccagcgccgcgcagcggaggggccgcattggcaggaaccacaacaaggagggggaccagtacatctatatgggccagcccctgaacaacgacgaggaccacgcccactggaccgaggcaaagatgctcctggacaatattaacacccccgagggaatcatccccgccctgttcgagccggagcgcgagaagtccgccgcggtggacggcgagtatcggctccgcggggaggcccggaagaccttcgtcgagctgatgcgccggggcgacctgccagtgtggctctcatacaaggtggcctccgagggcttccagtacagcgaccggcggtggtgctttgacggtgagcgcaacaatcaagtcctggaagaaaatatggacgtggagatctggaccaaggaaggagagcggaagaagttacgtccccggtggctcgacgccagaacctatagcgaccccctggccctgcgggaattcaaggagttcgcggccgggcgccggtccgtgagtggcgacctcatcctggaaatcggcaagctgccccagcacctcacacagcgcgcccagaacgccctggacaacctagtgatgctccacaactccgagcagggcgggcgggcgtaccgccacgccatggaggagctgcccgacaccatcgagacattaatgctcctggcactcatcgccgtactcaccgggggcgtgaccctcttcttcctgagcggacggggcctgggcaagacctccatcgggctgctgtgcgtcatggccagctccgtgctcttatggatggcaagtgtggaaccacactggatcgccgcatccatcatcctggagttcttcctcatggtcctgctgatccccgagccggaccgccagcggacgccccaggacaaccagctcgcctacgtggtgatcggcctgctgttcatgatcctcacggtcgccgcgaacgagatggggctgctggagaccacgaagaaggacttaggcatcgggcacgttgccgtagagaaccaccaccacgccgctatgctggacgtcgacctgcaccccgccagcgcgtggaccctctacgccgtggccacgaccatcatcacccccatgatgcgccacaccattgagaacacgaccgctaatatctccctgaccgccatcgcgaaccaagccgccatcctgatgggcctggacaagggctggcccataagcaagatggacatcggtgtgcccctgctggctctcggctgttactcccaggtcaaccccctgaccctgacggctgccgtgctaatgctggtggcccattatgccataatcgggcccggcctccaggccaaagcgacccgcgaggcccaaaagcggaccgccgccgggatcatgaagaatcccaccgttgacggcattgtggccatagatctcgacccagtggtctacgacgcgaagttcgagaagcagctgggccagatcatgcttctcatactgtgcacgagccagatcctgctcatgcggaccacctgggccctgtgcgaatccataacgctggccacggggcccctcaccaccctttgggagggcagcccggggaagttctggaacaccacgatcgccgtgtccatggccaatatcttccggggcagctacctggcgggggccggtctcgccttctccctgatgaagtccctaggcgggggccgccgggggaccggcgcccagggcgagaccctcggggagaagtggaagcgccaactgaatcaactttcgaagtccgagttcaacacctacaagcggagcggcatcatggaggtggatcgctccgaggcgaaggaggggctcaagcggggtgagaccaccaaacacgccgtctcccgcgggacagccaaactgaggtggttcgtggaaaggaacttagttaagcccgaaggcaaggtcattgacctgggctgcgggcgtggtgggtggtcctactattgcgccggcctcaagaaggtgaccgaggtgaaggggtatacgaagggcggccccgggcacgaggagcccatcccgatggccacgtacggctggaacctggtcaaattgcacagcgggaaggatgtgttcttcatcccgcccgagaagtgcgacaccctcctgtgcgacataggcgagtccagccccaacccgaccatcgaggaggggcgcacgctgcgggtgctcaagatggtcgaaccctggctgcgcggcaaccaattctgcattaagatcctcaacccctacatgccctccgtggtggagaccctggagcagatgcagagaaagcacggcgggatgctggtcagaaacccattgagccggaactccactcacgagatgtactgggtcagctgcggcaccgggaacatcgtgtccgcagtcaacatgaccagccgcatgctgctgaaccgcttcacgatggcgcaccggaagcccacctacgagcgcgacgtggacctgggcaccggcacgcggcacgtagccgtcgagcccgaagtggccaacctcgacattatcgggcaacgaatcgagaacatcaagcacgagcacaagtccacgtggcactacgacgaggataacccctacaaaacctgggcctaccacggcagctacgaggtgaagccgtccgggagcgcgtcctctatggttaatggcgtggtgaagctcttaaccaagccctgggatgtgatccccatggtgacccagatcgcaatgacggacacgacccccttcgggcagcagcgggtcttcaaggagaaggttgacacccgcacgcctaaggccaagcggggcaccgcccagatcatggaggtgacagcgcgctggctctggggcttcctgtcgcggaacaagaagccccgcatatgcacacgggaggagttcacgcggaaggtccggtccaacgcggccatcggggccgtgttcgtggatgagaaccagtggaatagcgccaaggaggcggtcgaggacgagcgcttctgggacctcgtccaccgggagcgcgaactccacaaacagggcaagtgcgcgacctgcgtgtacaacatgatggggaagcgcgagaagaagctgggtgagttcgggaaggcgaagggctcccgcgcaatctggtacatgtggctgggcgctcggtttctcgaattcgaggcgctcgggttcatgaacgaggaccactggttcagccgcgagaacagcctcagcggcgtcgagggggagggtctccacaagctggggtatatcctgcgggatatctccaagatcccgggaggcaacatgtacgccgacgacaccgctgggtgggacacccgcatcacggaggacgacctccagaatgaggccaagatcaccgacatcatggagccggaacacgccctgctggccaaggccatcttcaagctcacctaccagaacaaggtggtgcgcgtccagcgtcccgcaaagaacggcaccgtgatggacgtgatcagccgccgagatcagcgcgggtccggccaggtcggcacgtacgggctgaacaccttcaccaacatggaggcccagctgatccgccagatggagagcgaaggcatcttctcccctagcgagctcgagacccccaacctagccgagagggcgttagactggcttgagaagtacggggtggagaggctgaaacgcatggccatctccggcgacgactgcgtggtaaagcccatcgatgaccgattcgccactgccctgaccgccctaaatgacatggggaaggtgcgcaaggacatcccccagtgggagcccagcaaaggctggaacgactggcagcaggtccccttctgctctcaccacttccaccagcttatcatgaaggacggccgggagatcgtcgtgccctgccgcaaccaagacgagctggtggggcgggcgcgcgtctcgcagggggcggggtggtccctccgggagaccgcctgcctgggtaagagctatgcccagatgtggcagctgatgtatttccaccgcagggacctccgcttggcggccaacgccatttgcagcgccgtgccggtggattgggtccccaccagccggacgacctggagcatccacgcccaccaccagtggatgacaaccgaggacatgctgtccgtctggaaccgcgtgtggattgaggagaacccctggatggaggacaagacgcacatcagctcctgggaggacgtcccgtacctcggtaagcgcgaggaccagtggtgcggcagcctgatcggcctgaccgcgcgggccacctgggccaccaacatccaagtggcaataaaccaggtgcgccgactcatcggcaacgagaattacctggactacatgacctccatgaagcgattcaagaacgagagcgaccccgagggcgccctttggtga

SEQ ID NO: 24173 - RNA, 9879 nt, synthetic construct
  misc_feature 1..9879: note = derived and/or modified CDS sequence (opt11) from DENV-1__FJ410204__SS-prME
  source 1..9879: mol_type = other RNA
agcgttaccatgctgttgatgctgatgccgaccgccctggcgttccatcttacgacccgcggcggggagccccacatgatcgtgagcaagcaggagcgtggcaagagcctcctcttcaagacctcagctggggtgaatatgtgcaccctcattgccatggaccttggggagctgtgcgaggacaccatgacctataagtgcccacgcatcaccgaggccgagcccgacgatgtggactgttggtgcaacgccaccgacacatgggtcacctacgggacatgtagccagaccggcgagcaccggcgcgacaaacggagtgtggccctcgcgccccacgtgggcctggggctggaaacccgcaccgagacctggatgagctccgagggcgcctggaaacagatccaacgggtcgaaacctgggcgctcaggcacccaggattcacggttatcgccctgttcttagcacacgccatcggaacgagcatcacacagaaggggatcatctttatactcctcatgctggtgaccccctccatggccatgagatgcgtcggcatcgggagcagagacttcgtggaaggactctccggcgccacgtgggtggacgtggtactggagcacgggagctgcgtgaccaccatggccaaggacaagccgaccctggatatcgagctcctgaagactgaggttaccaatcccgctgtgctgaggaagctttgcatcgaggccaagatctccaacaccaccacagacagccgctgcccgacccagggcgaggccacactggttgaggagcaggacgccaacttcgtctgccggagaacgtttgtggaccggggctggggaaacggctgcgggctctttggcaagggatccctcatcacgtgcgcaaagttcaagtgcgtgaccaagctggagggcaagatcgtccagtacgagaaccttaagtactctgtcattgtgacagtccacaccggggaccagcaccaggtgggtaacgagtcaacggagcacggcaccaccgccaccattacgccccaggcccccacgaccgagattcagctcaccgactatggagccctgaccttagactgcagccctcgtacgggcctcgacttcaacgagatggtcttactgaccatgaaggagaagtcatggctcgtgcacaagcagtggttcttggacctgcccctcccatggaccagcggagcctccacgtcacaggagacgtggaaccgtcaggacctgcttgtgactttcaagaccgcccacgccaagaaacaggaggtcgtggtgcttggcagccaagagggcgcaatgcacacggccctgacgggggccaccgaaattcagacctcgggcaccacgaccatattcgccgggcacttaaagtgcagactgaaaatggacaaactgacgttaaagggaatgagctacgtaatgtgcaccgggtctttcaaactcgagaaagaggtggcggagacgcagcacggaaccgtgctggtccagatcaaatacgagggcaccgatgccccctgcaagatccccttttctacccaggatgagaagggggtgacgcaaaatggacggctgatcaccgcgaacccgatcgtgaccgacaaggagaagcctgttaacattgaggccgagccaccgttcggtgagtcctacatcgtaataggcgcgggcgaaaaggcactgaagctaagctggttcaagaaggggtcctcaatcggcaagatgttcgaggcaaccgcccgcggcgcacggcgcatggcgatcttaggcgacacggcctgggacttcggttctatcggcggtgtgttcaccagcgtcgggaaactgatccaccagatcttcggtacagcctacggggtgctgttcagcggcgtcagctggacgatgaagatcgggatcggagtcctgctgacgtggctcggcctgaactcccgcagcacctccctaagcatgacatgcatcgccgtggggttagtaaccctgtatctgggcgtcatggtgcaagccgactccggctgcgtgattaactggaagggccgtgagctcaagtgcggcagcggcatctttgtcacaaacgaagtttacacctggaccgagcagtataagttccaggctgactccccgaagcgactgtccgctgccattggcaaggcctgggaggaaggggtatgcggcatccggagcgccacccgcctggagaacatcatgtggaagcagatctccaacgaattaaaccacatcctgctggaaaacgacatgaagctcacggtcgtagtgggggacgtcgcgggcatcctggggcaaggcaagaagatgatcagaccccagcccatggaatataagtacagctggaagagctggggcaaagccaagatcataggagcagatgctcagaacacgacgttcatcatcgacggccctaataccccggaatgccccgacgatcagcgcgcatggaacatctgggaagtggaagactacgggttcggcatttttaccaccaatatctggctgaagctcagggacagctacacccaggtttgcgaccaccgactgatgtccgccgccatcaaagacagcaaggctgtccacgcggacatgggctactggatcgagtcggagaagaacgagacctggaaactcgcgcgggccagtttcatcgaggtgaagacttgcatttggccaaagtcccacacgctctggagtaatggggtgctggagtccgagatgataatccccaagatatacggcgggccgatcagccaacacaactaccgccccgggtatttcacccaaaccgctggaccttggcacctaggcaagctcgagctggacttcgacctttgcgagggcaccacggtcgtggttgacgagcactgcggaaatcgggggccgagtctccgcaccaccaccgtcacgggtaagattatacacgagtggtgctgccggtcttgcaccctgccccccctgcgcttccggggcgaggatgggtgttggtacggcatggagatacgccccgtcaaggagaaagaggagaatctcgtaaagtccatggtcagtgccgggtcaggggaggttgactcattcagcctggggctgttgtgcatctctatcatgattgaggaggtgatgcggagccgatggtcccggaaaatgctcatgactgggactctggccgtcttcttcctcctgataatgggccagctgacgtggaacgatctcataaggctctgcattatggtgggtgcaaatgccttcgaccgcatgggtatggggaccacctacctcgccctcatggccaccttcaagatgcggccgatgttcgcggtggggctcctgttccgaaggctcacttcacgcgaggtcctcctgctcaccatcggcctatcccttgtggcgtctgtcgagttaccgaactctctggaggagctcggggacggtctcgccatgggcatcatgatcctcaaactgctcaccgacttccagagccaccagctatgggccaccctgctctccctgacgttcatcaagactaccttcagcctccactatgcctggaagaccatggcgatggtcttatccatcgtgtcgcttttccccctgtgcctttccactactagtcagaagaccacatggctgcccgtcctgctcgggtccctgggctgcaagcctctgacgatgttcttgatcgccgagaataagatctggggcaggaagtcctggcccctgaacgagggaataatggccgtcggcatcgtatccattctgctcagcagcctcttaaagaatgatgtacccctcgccggccccctgatcgccggcgggatgttaatcgcatgctacgtcatctctggaagctccgccgacttgagcctggagaaggccgcagaggtgtcctgggaggaagaggcagagcactccggggcatcccacaacatcctggtagaggtgcaggacgacggtactatgaaaatcaaggacgaggagcgcgacgatacactcaccattctgctcaaggccaccctcttggctgtgtcaggagtctaccccctgagtatccccgccacactctttgtgtggtacttctggcagaagaagaagcagaggagcggcgttctctgggacaccccaagcccgccagaggtcgagcgagccgtgctggacgacggcatctacaggatcatgcagcgcgggctgctcggccggagccaggtgggggtcggcgtgttccaggagaacgtgttccatacaatgtggcatgtcacacgcggggccgttctgatgtatcagggcaagcggctggagccctcctgggccagcgtgaagaaggacctgatctcctatggcggaggctggcgtttgcggggatcatggaatacgggtgaggaggtccaagtgatcgccgtagaacctgggaagaatcccaagaacgtccagaccgccccgggaacgttcaagacccccgagggagaggtcggggccatcgctctggacttcaagcccggtacgagcggcagtcccatcgtcaaccgggagggtaagatagtcggactatatgggaacggcgtggttaccacgtccggcacctacgtatccgccatagcccaggccaaggcgagccaggagggcccgctgcccgagattgaggacgaggttttccggaagagaaacctgacgatcatggatcttcacccggggtcaggtaagacccggcgttacttacctgccatcgtgcgggaagccatcaagagaaaattacgcacgctcatcctggcgcccacccgggtcgttgcgagcgagatggcggaggccctcaagggcatgccgattaggtaccagacgaccgcggtgaagtccgagcacaccgggaaggagatcgtagaccttatgtgccacgctactttcacgatgcggctgctgagcccagtgagagtgcccaactacaatatgatcatcatggatgaggctcacttcaccgatccctcctcaatcgcggcacgtggctatatctcaacgagagtaggtatgggcgaggccgccgcaatcttcatgaccgcaaccccgcccggctcagtggaggcctttcctcagagcaatgccgttatccaggacgaggagcgggacatcccggagcgcagctggaattccggccacgagtggatcacagacttccccggcaagaccgtctggttcgtgcctagcatcaaatccgggaacgacattgcgaactgcctccggaagaacggcaaacgcgtaatccagctgtcacgcaagacttttgacacagagtaccagaagaccaagaataacgactgggattacgtcgtgaccaccgacatctccgaaatgggcgcgaacttccgggccgaccgggtgatagaccctcgccgctgcttgaaacctgtcatcctcaaggatggccccgaacgcgtaatcctggccggccccatgccggtgacggtcgcctccgcggcgcagcgccgcggccggatcggccgcaaccacaacaaggaaggggaccaatacatctacatggggcagcccctgaacaacgacgaggatcacgcgcactggaccgaggccaagatgcttctggacaacatcaacaccccggagggaatcatccccgccctgttcgagcccgagcgcgagaagtccgccgctgtggatggtgaataccggctgcgcggggaggcccggaaaacgtttgtcgagctgatgcgtcggggcgacctgcccgtgtggctcagctacaaagtagcatcggagggcttccagtatagcgaccgccgttggtgcttcgatggggagcggaacaaccaggtcctcgaggagaacatggacgtggagatttggacgaaggaaggggagaccaagaagttacggcaccgctggcccgatgcccggcagtatagcgacccactcggcctgcgagagttcaaggaattcgccgcgggccggcgctccgtgagcggcgacctgatccttgagattgggaagctgccgcaacatctgacacagcgggcccagaacgccctcgacaacctggttatgctgcacaactccgagcaaggcggccgcgcctaccggcacgctatggaggagctgcctgacactatcgaaacgctgatgctgctcgccttaatcgccgtgcttaccggcggggtgaccctcttcttcctgagcgggcgcggcctggggaagacgtccatcggcctcttatgcgtaatggcctcgtccgtactgttgtggatggcctcagtggagccccactggatcgctgcctccataatcctggaattcttcctgatggtcctcttgatccccgagccggaccggcagcgcacgccccaggacaaccaactcgcctacgtagtgatcggactcctcttcatgatcctgactgtcgccgcgaacgagatgggccttctggagaccaccaagaaggacctaggcatcggccatgtggccgtggagaaccatcaccacgccgccatgctcgatgtggacctgcaccccgcctcggcctggaccctgtacgcggtggccacaaccatcatcaccccgatgatgcggcacactatcgagaacacgaccgccaacatcagcctcaccgcgatcgccaaccaggcggccatcctaatgggcttggataagggctggcccatcagtaagatggacatcggcgtgcctctcctggccctgggatgctactcccaagtcaaccccctcaccttgacggccgcggtcttgatgcttgtagcccactacgccatcatcggcccggggttacaagccaaggccacacgcgaggcgcagaagcggaccgccgccggcatcatgaagaaccccaccgtcgacgggatagtggccatcgaccttgaccccgtggtctacgatgccaaattcgagaagcagctcggtcaaatcatgctgcttatcctctgcacgtcccagatcctactgatgagaaccacctgggcgctgtgcgagtccataaccctggccacgggccccttaaccaccctctgggaggggtctccgggcaagttctggaacaccactatcgccgtgtccatggccaacattttccgcggcagttacttggcaggggctggtttagccttctccttgatgaaatccctcggcggcgggagacgagggaccggcgcccagggggagacgctaggcgaaaagtggaaacggcagctcaaccaactgagcaaatccgagttcaacacctacaagcgaagcgggataatggaggtggatcggtccgaggccaaggagggcctgaagcgtggagagacgaccaagcacgcggtaagcagaggcaccgccaagctccgttggtttgtggagagaaacctcgtgaagcccgagggcaaggtcattgacctgggatgcggccgggggggatggtcctactattgcgccgggctgaaaaaagtgaccgaggtgaagggctacacgaaaggcgggcccggccacgaggagccgatccctatggccacctacggttggaaccttgtcaaacttcacagcggtaaggatgtgttttttattccgccggagaagtgcgacacactgctctgcgacatcggcgaaagcagcccaaacccgaccattgaggagggccgcacgctgcgcgtgcttaagatggtagagccctggctccgggggaaccagttctgcatcaagatcctgaacccttatatgccgagcgtggtggaaacccttgagcagatgcaacgtaagcacgggggcatgctcgtccggaacccgttgtcacgaaactcaacgcacgagatgtattgggtaagctgtgggaccggcaacatcgtgtccgccgtcaacatgacgagccggatgttgctcaatcgcttcacgatggcacaccggaaacctacctacgagcgggacgtggatctgggcaccgggaccaggcacgtggccgtagagcccgaggtggccaacctggacatcatcggccagcggatagagaacatcaagcacgagcacaagtccacctggcactacgacgaggacaacccctacaagacctgggcctaccacgggagctacgaggtgaagccatcgggctccgcctccagcatggtcaatggcgtggtcaagctcctgaccaagccctgggacgtgatacccatggtgacacagattgcgatgacggacaccaccccgttcggccagcagcgcgtattcaaagagaaggtggacacccggacgccgaaggccaagcgcggcaccgctcagatcatggaggtgactgcccggtggctgtgggggttcctcagccgcaacaagaagcccagaatctgcactcgcgaggagttcacgcgcaaggtccgctccaacgccgcgatcggcgccgtgttcgtcgacgagaaccaatggaactccgccaaggaggctgtcgaggacgagcggttctgggaccttgtgcatcgggagcgggagctgcacaagcaggggaagtgcgcgacttgcgtgtataacatgatgggcaagcgcgagaagaagctcggagagtttggcaaggccaaaggctcccgggccatctggtatatgtggctcggggcccgcttcctggagttcgaggccttgggattcatgaacgaggaccactggtttagccgtgagaactccctgagcggggtcgaaggcgagggtctgcacaagctcggctacatcctgcgcgacatatcgaagatccccggtgggaacatgtacgcggacgacaccgctggctgggacacgcgcatcacggaggacgacctgcagaacgaggccaaaatcaccgacatcatggaaccggaacatgccctcctcgccaaagcaatcttcaagctaacgtaccagaacaaggtggtgcgggtccagcgccccgccaagaacgggactgtgatggacgtgatctcacggcgagaccagcgaggctcaggccaggtcgggacatacggcttgaacacttttaccaatatggaggcacagttgatccgccaaatggagagcgaagggatcttctcccctagcgagctggagaccccgaatctcgcagaacgggccctggactggctggagaagtacggcgtggaacgcctcaaacggatggccatctccggggacgactgcgttgtcaagccgatcgacgacagattcgccacggccctgaccgctctgaacgatatgggcaaggtgagaaaggatatcccccagtgggagccctccaagggttggaacgattggcagcaggtccccttctgctcccaccacttccaccagctcattatgaaggacggtagagaaatcgtagtgccgtgccggaaccaggacgagctggtgggccgcgcccgggtcagccaaggagcgggctggagcctgcgcgagacagcctgtctcgggaaaagctatgcacagatgtggcaactgatgtattttcaccggcgcgacttacgcctcgccgcgaacgccatctgctctgccgttcccgttgactgggttcccaccagccgcacgacctggagcatccacgcccaccaccagtggatgactaccgaggacatgttatccgtttggaaccgtgtttggatcgaggagaacccctggatggaggacaagacgcacatttcgtcctgggaggacgtaccgtacttaggcaagcgcgaagaccagtggtgcggctctctgatcggactgaccgcccgcgcaacatgggccaccaatatccaggtggccatcaaccaggtgcggaggctgataggcaacgagaactacctcgactacatgacctccatgaagcggttcaaaaacgagagcgaccccgagggggccctgtggtga

SEQ ID NO: 24174 - RNA, 9879 nt, synthetic construct
  misc_feature 1..9879: note = derived and/or modified CDS sequence (opt11) from DENV-1__FJ432742__SS-prME
  source 1..9879: mol_type = other RNA
agcgtgaccatgctgcttatgctgatgcccacggccctggcgtttcacctcaccacccggggtggggaacctcacatgatcgtgaccaagcaagaacgaggcaaaagcctgctgttcaaaaccagcgccggagtgaacatgtgcaccctgatcgccatggacctcggagagttatgcgaggacaccatgacctacaagtgccccaggatcaccgaggccgagcccgatgacgtggactgctggtgcaacgcaacagacacgtgggtgacctacgggacatgcagccagacgggcgagcaccggcgcgataagagatcagtggccctagcaccccacgtgggcctagggctggagacccgcaccgagacctggatgtccagcgagggcgcatggaagcagatccagcgggttgagacgtgggccctccgccacccagggttcaccgttatcgccctgttcctggcgcacgccatcggcacctccataacccagaaagggattatctttatcctcctaatgttagttacgcccagcatggccatgcgatgcgtcggcatcggctcccgcgacttcgtggaggggctctctggtgccacatgggtggacgtcgtgctggaacatgggtcctgcgtgaccactatggccaaggacaagcccacgttggacatcgagctcctgaagaccgaggtaaccaaccccgctgtgctgcgtaaattatgcatcgaggccaagatatccaacaccaccacggactccagatgcccaacccagggagaagccaccctgatggaggagcaggacgcgaactttgtgtgccggcgcacgttcgtcgaccggggctggggtaacggctgtgggctgttcggcaaaggctcactcatcacgtgtgccaagttcaaatgcgtaaccaagctggaggggaagatcgtgcagtacgagaacctgaagtactccgtcatcgtgaccgtgcatacgggtgaccagcatcaggtcgggaacgagagcaccgagcacggcaccacggcgacgattacaccccaggcccccacctccgagatccagctcaccgactatggggccctgacactggactgcagcccccgcacgggattagacttcaacgaaatggtgctgctgaccatgaaggagaagtcctggctcgtccacaagcagtggttcttagacctgccactcccctggaccagcggtgccagcacctcccaggaaacgtggaaccggcaagacctgctggtgactttcaaaaccgcccacgcgaaaaaacaggaggtggtcgtgttagggagccaggagggcgcaatgcacaccgccctgacgggggccaccgagatccaaacctccggcaccacgacgattttcgccgggcatttgaagtgccgcctcaagatggataagctgacattaaagggcatgtcctacgtcatgtgcacgggctccttcaagcttgagaaggaggtcgcggagacgcagcacggcaccgtgttagtgcaaattaaatatgaaggcacagacgccccctgcaagatccccttctctacacaggacgaaaagggggtcacgcagaacggccgcctgataacagccaatcccatcgtcaccgacaaggagaagcccgtgaacattgaagccgaaccgccttttggtgagtcctacatcgtcatcggcgcgggcgagaaggccctgaagctctcgtggttcaaaaagggatcaagcatcggcaagatgttcgaggccactgcccgcggggcccggcgcatggctatcttgggagacacggcctgggacttcgggtcggtgggcggcgtgttcaccagcgtcgggaaactggtacaccagatattcggcaccgcctacggggtcctgttctccggcgtcagctggacgatgaagatcgggatcggcgtgctgttaacgtggctcggcttaaactcacgcagcacctcgttaagcatgacttgtatcgcagtggggctcgttaccctgtacctgggagtgatggtgcaggccgactccgggtgcgtcattaattggaagggccgggagttaaaatgcggctctggtatcttcgtgactaacgaggtgcacacctggaccgagcagtacaaattccaggctgacagcccgaagaggttgtcggccgcgatcggcaaggcctgggaggagggggtctgcggcatccgttctgccacccgccttgagaatatcatgtggaagcaaatctccaacgagctcaaccacatcctcctcgagaacgatatgaagttcaccgttgtggtcggggacgtggtgggcatcctggcgcagggtaagaagatgattcggccccagcccatggagcacaaatacagctggaagtcctggggaaaggcaaagatcatcggcgcagacgttcagaacacgaccttcatcatcgacgggcccaacaccccggagtgtcccgatgaccagcgcgcctggaacatctgggaggtggaggactacggcttcggtatatttaccacgaacatctggctgaaacttcgggattcttacacccaggtgtgcgaccaccgcctcatgtccgcggccataaaagactccaaggccgtccacgccgacatgggctattggattgagtccgagaagaacgagacctggaagctggcccgggcgagcttcattgaggtgaaaacttgcatctggcccaagagtcacacgctgtggagcaacggcgtgctcgagtccgaaatgatcatccctaagatctacggtggcccgataagccagcacaattatcgccccgggtacttcacccagaccgctggcccctggcacctggggaagctggagctcgacttcgatctgtgcgaaggcaccacggtcgtggtggatgagcactgtggcaaccgagggccgtccctacgcaccaccacggtaacgggcaagattatccacgagtggtgctgtcggtcgtgcacgttgccacccctccgctttaaaggggaggacggctgctggtacgggatggagatccggcccgtgaaggagaaggaagagaacctggtgaagtccatggtctcggccggctcaggcgaagttgactccttcagcctcgggctgctgtgcatctccattatgatcgaggaggtgatgcgcagcagatggtctcgcaagatgctcatgaccggcaccctggccgtcttcctgctcctgataatggggcagctgacatggaacgacctcatccggctgtgcatcatggttggcgccaatgctagcgaccgcatggggatgggcaccacctacctggcactcatggccaccttcaagatgcgcccaatgttcgccgtggggctgctgttccggcgcctcacgtcccgggaggtactgctgctcacgataggcctgtcactggtggcctccgtcgaactccccaacagcctggaggagctgggcgacgggctcgcgatggggatcatgatcctgaagttgctcacggacttccagtcccaccaactgtgggccactctgctgagcctgacgttcatcaagaccaccctctccctccactatgcctggaagactatggctatggtgctgtcgatcgtgagtttgttcccactctgcctgagcacgacctcccagaagaccacctggctgccggtgctcctaggcagcctggggtgcaaaccgttaacgatgttcctaatcactgagaacaagatatggggccgcaaatcctggccccttaacgaggggatcatggcggtgggcgtcgtcagcatcttattatcctccctgctcaagaatgacgtccccttggccggtcccctgatcgccggcgggatgctcatcgcctgctacgtgatcagcggttcaagcgccgacttatccctggagaaggccgccgaggtcagctgggaggaagaagccgagcactccggcgcctcacacaacatcctcgtggaggtacaggacgacgggaccatgaagatcaaggacgaggagcgggacgacactttaacgatcctgctcaaggccacgcttctggcggtgtcgggcgtgtacccgctctccatacccgccaccctgttcgtgtggtatttctggcagaaaaagaagcagcgctcgggggtcctgtgggacacccccagcccgcccgaggtggagcgggccgtgctcgacgacggcatctaccgcatcatgcagcggggcctcctggggcgctcccaggtaggggtgggggtgttccaggagaacgtcttccataccatgtggcacgtgacgcggggcgccgtgctgatgtatcaggggaagaggctcgagcccagctgggcctccgtcaagaaggacctgatcagctatggcggcgggtggcggttgcagggttcgtggaacaccggggaggaggtccaggtgattgcggtcgagccgggcaagaaccctaaaaacgtacagaccgcccccggcaccttcaaaacgcccgagggcgaggtgggcgccatcgccctagatttcaagcccggaaccagcggctcccccatcgtcaaccgcgagggcaagatcgtagggctgtacggcaacggcgtagtcaccaccagcggcacatacgtgagcgccatagcgcaggccaaggcatctcaggagggtccgctgcccgagatcgaggacgaggtgttcaggaagagaaacctcacgatcatggacctccaccccggaagcgggaagacccggagatacttaccggcaatcgtccgggaggcgatcaagcgcaagctccggaccctgatactggcccctacgcgcgttgtggcttccgagatggccgaggccctcaaaggcatgcccatccgctatcaaaccaccgcggtcaagagcgaacacaccggcaaggagatcgtggacctgatgtgccacgccacgtttaccatgagactgctctcccccgtgagggtcccgaactataacatgatcatcatggacgaggcccactttaccgacccatcttccatcgccgcgagggggtacatcagcacccgggtgggcatgggggaagcggccgccatcttcatgacggccacgccgcccggttccgtcgaagccttcccgcagagcaatgcggtcatccaggacgaggagcgggacatccccgagcgctcctggaactctgggtacgagtggatcaccgacttccccggaaagaccgtgtggtttgtgccctccatcaagagtgggaacgacatcgctaactgtctgcggaagaacggaaagcgtgtcatccagctgtcccgaaagacgttcgacaccgagtaccaaaaaaccaagaacaacgattgggactacgtggtgaccacggacatcagcgagatgggcgccaacttccgcgcagaccgggtcatcgacccgcgccgatgcctaaagcccgtgatactgaaggacgggcccgagcgtgtaatactggcgggccccatgccagtgaccgtggcctcggcggcccagcggcgcggaagaatcgggcgcaatcacaacaaggagggtgaccaatacatctatatggggcaacctctcaataacgacgaggaccacgcccactggacggaagccaagatgctgttggacaacatcaacacgcctgagggcataattcccgcccttttcgaaccggaacgggagaaatcagcagccatcgacggggagtaccgcttacgcggcgaggctcgcaagacgttcgtcgagctgatgcgcaggggggacctccccgtttggctatcttacaaggtcgctagcgagggtttccagtatagcgaccgccggtggtgcttcgatggcgagcgcaacaaccaggtcctggaggagaacatggacgttgagatatggaccaaggagggggagcggaaaaagctcagaccccggtggctggacgcccgtacttactccgacccactggcactacgggagtttaaagagttcgccgctggcaggcggtccgtgtccggggacctcatcttagagatcggcaaactcccccagcacctcacccagcgcgcgcagaacgccctcgacaacctcgtcatgctgcacaactccgagcagggcgggagagcctaccgccacgccatggaggagctgccagacacgatcgagaccctaatgctgttggcgttaatagcagtgctgaccggcggggtgaccctgtttttcctttccggccgggggctgggcaagaccagtatcggcctgctgtgtgtaatggcctctagcgtgctgctttggatggcctccgtggaaccccactggatcgccgcgagcatcattctagagttcttcctgatggtcctgctgatccccgagccagaccggcagcggacgccccaggacaaccagctggcctacgtggtaatcgggctcttgttcatgatcctgaccgtcgcggctaacgagatgggcttgctggagaccaccaagaaggacctagggatcggccacgtggccgtggagaatcaccaccacgcgacgatgctggacgtcgacctccaccccgcatccgcctggaccctgtatgccgtggccaccacaattatcacgccgatgatgcgccataccatcgagaacaccaccgcaaatatcagcctgacggcgatcgccaaccaggccgccattctcatggggctggacaagggctggcccatctcgaagatggacatcggcgtgcccctgctcgcgctgggttgctacagccaggtaaaccccctgaccctcacggccgccgtactgatgctggtggcccactacgcgatcatcggtccggggctccaggctaaagccactcgggaggcccagaaacgcacggcggcgggcatcatgaagaaccccactgtcgatgggattgtggccatcgacctggaccccgtggtgtatgacgctaagttcgagaagcaactgggccagataatgctcctgatcctgtgcacgtcgcagatcctcctgatgcggaccacttgggccctgtgcgagagcatcacgctcgccactggcccgctcaccacgttatgggaggggtccccgggcaaattctggaatactacgatcgcagtgagcatggccaatatcttccgggggtcctaccttgcgggcgccggtctcgccttcagtctcatgaaatcactcgggggcgggcgccggggcacgggagctcagggagagacgctgggcgagaagtggaagcgccagctgaaccagttgtccaagagcgaattcaatatctacaagcggtccgggatcatggaggtggaccgcagcgaggccaaagagggcttgaaacgcggggaaactaccaggcatgcagtttcgcgaggcacagctaagctgcgctggttcgtggagcggaatctggtgaagccagagggcaaagtcatcgacctcggctgcggccgggggggctggagctattactgcgctggtctgaagaaagtgaccgaggtcaagggctacaccaaggggggccccggccacgaagagcctatcccgatggctacttacgggtggaatctggtcaagctccactccggcaaagacgtgttctttacgccacccgagaagtgcgacacgctgctgtgcgacatcggcgaaagttcccccaacccgaccatagaggaggggcgtaccctccgcgtgctgaagatggtcgagccgtggctgcgggggaatcagttctgcataaagatcctcaatccatatatgcccagcgtggtggaaaccctggagcagatgcagcgcaagcacggtgggatgctcgtccgcaacccgctatcccgcaacagcacccatgagatgtactgggtgtcctgtgggacgggcaatatcgtcagcgccgtgaacatgacctcccggatgctgctgaatcgattcaccatggcccaccgcaagccaacctacgaacgggatgtggacctcggggccgggacgcgccacgtggcagtcgagcccgaagtggccaacctggatataatcggccagaggatcgagaacatcaagcacgaacacaagagtacctggcactacgacgaggacaacccatataaaacctgggcctatcacggatcctacgaggtcaaaccgagcggttccgccagcagcatggtgaacggggtggtcaagctgctcaccaagccgtgggacgtgatacccatggtgacgcagatcgccatgaccgacaccaccccctttggccagcagagagtcttcaaggagaaagtcgacacccggaccccgaaggcgaaaagagggaccgctcagatcatggaggtgactgcacggtggctatggggcttcctctcacgcaacaagaagccgcggatctgtacgcgggaggagtttaccagaaaagtccgcagcaacgccgccatcggcgccgtgttcgtggacgagaaccaatggaactccgcaaaagaggccgtcgaggacgagcgtttttgggacctcgtgcagaaggagagagagctgcacaaacaggggaagtgcgcgacatgcgtgtacaacatgatgggcaagcgggaaaagaagttgggggaattcggaaaggcgaaggggtcgcgcgccatatggtacatgtggcttggggccaggttcctggagttcgaggccctgggcttcatgaacgaggatcactggttctcccgcgagaacagcctctccggggtcgagggcgaaggcctccacaagctgggctatatcctccgcgacatcagcaagatccccgggggtaacatgtacgcggatgacaccgcgggctgggacacccgcatcaccgaggatgacctgcagaacgaggccaaaatcaccgacatcatggagccggagcacgcccttctcgccacaagcattttcaagctgacgtaccagaataaggtggtgcgcgtccagcgcccggccaagaacgggaccgtgatggatgtcatcagccgaagagaccaacgcggctccggccaggtcggcacctacggtctgaacaccttcaccaacatggaggcgcagctcatacggcaaatggagagcgaggggatctttttaccctccgagctggagacaccaaatctcgcggagagggtgctggactggctggagaagtacggcgtggagcggctcaagcgcatggcaatcagcggggatgactgcgttgtgaagccgatcgacgaccggttcgccaccgctctgaccgcgcttaacgacatgggcaaggtgaggaaagacattccccagtgggagccctccaaggggtggaacgactggcagcaggtccccttctgcagtcaccacttccatcagctcattatgaaagacggccgggagatcgtggtgccgtgccgcaaccaggatgagctggtcggccgagccagagtgtcccagggggccggatggtcgctgcgggagacggcctgcttaggaaagagctatgcccagatgtggcaactgatgtatttccaccgccgggatctgcgcctcgcggccaacgccatttgctctgccgtcccggtcgattgggtgcccaccagtcggaccacctggagcatacacgcgcaccaccagtggatgacaaccgaggacatgctgagcgtgtggaaccgcgtctggatcgaggagaacccctggatggaggacaagacccacgtgagtagctggggcgacgtgccgtacctggggaagcgggaggaccagtggtgtggctccctcatcgggctgaccgcccgcgctacgtgggccagcaatatccaggtcgcgatcaaccaggtgcgccggttaatagggaacgagaattatctcgactacatgacgtccatgaagcgctttaagaacgagggcgacccggaaggggcgctgtggtaa

SEQ ID NO: 24175 - RNA, 9879 nt, synthetic construct
  misc_feature 1..9879: note = derived and/or modified CDS sequence (opt11) from DENV-1__FJ410205__SS-prME
  source 1..9879: mol_type = other RNA
tcggtgacaatgctgctgatgctgatgcccaccgctttagcgttccacctcacaacccgtggtggggagcctcatatgatcgtgagcaagcaagagcgtggtaagagcctgctgttcaagacctctgctggggtgaatatgtgcaccctcattgccatggacctgggcgagctgtgcgaggacaccatgacatacaagtgcccccggatcaccgaaaccgagccggacgacgtggactgttggtgcaacgccacggatacctgggtcacctacgggacctgcagccagacgggggagcaccggcgggacaagcggtccgtggccctcgcgccccacgtgggcctggggctggagacccgcaccgagacgtggatgagctccgagggcgcctggaagcaaatacagcgggtcgagacgtgggccctccggcatccggggttcaccgtgatcgccctgttcctggcccacgcgatcgggacaagcatcacacagaaggggatcatcttcatcctcctgatgttggtgacgccctcaatggccatgcggtgcgtcggcatcggcagccgggacttcgtggagggtttgtccggcgccacctgggtggacgtcgtactggagcatgggagctgcgtcacgacaatggccaaggataagcccacgctggacatcgagctcctgaagaccgaggtcaccaaccccgccgtgctgcgaaaactctgcatcgaggcgaaaatctccaacaccacgacagacagccgctgcccgacccagggcgaggccaccctggttgaggagcaggacgcgaacttcgtctgccggcgtacgttcgtggaccggggctgggggaacggctgcgggctgttcggcaaggggtccctcatcacgtgcgccaagttcaagtgtgtgaccaagctggagggcaaaattgtccagtacgagaacctgaagtacagtgtgattgtaacagtccacacgggcgaccagcaccaggtcgggaacgagtcgaccgagcacggcaccaccgccaccattacgcctcaggcgccgaccaccgagatccagttgaccgactacggggccctgaccctggactgtagccccaggacaggcctcgacttcaacgagatggtcttactgaccatgaaagagaagtcgtggctcgtgcacaagcagtggttcctggacctgccgttaccctggacaagcggggcctctacatcccaggagacttggaaccgccaagacctgctagtcaccttcaagaccgcccacgccaagaaacaagaggtcgtcgtgctcggcagtcaggagggtgcgatgcacacggccctgaccggcgccaccgaaattcagacctcgggcacaaccacgatcttcgcggggcacctgaagtgccgcctcaagatggataaactgaccctgaagggcatgagctatgtcatgtgcacgggcagcttcaaacttgagaaggaactggccgagacacagcatggcaccgtgctggtgcagatcaagtacgagggcaccgatgcgccctgtaagatccccttcagcacgcaggacgagaagggggtcacccaaaacggccggctaatcaccgccaacccgatcgtgaccgacaaggaaaagcccgtgaacatcgaggccgagccgccgttcggagagtcctatatagtcatcggcgcaggggaaaaagcgctcaagctgagctggttcaaaaagggcagtagcatcggcaagatgttcgaagccacggcacgcggggcccggcgcatggctatcctgggggataccgcgtgggattttgggtccatcggcggagtgtttacgagcgccgggaagctcgtgcaccaaatcttcggcaccgcctacggagtcctgttctccggcgtgagctggacgatgaagatcgggatcggcgtcctgcttacatggctgggcctgaactcccgcagcaccagtttaagcatgacctgcatcgccgtcgggctcgtgactctgtacctgggcgtgatggtccaagccgactcaggttgcgtcatcaattggaagggccgggagcttaagtgcgggagcggcatcttcgtgactaacgaggttcatacgtggaccgagcagtacaagttccaagcggacagcccgaagcgcctgtcggctgccatcggcaaggcctgggaggagggggtgtgcgggatccggagcgcgacccgactcgagaacattatgtggaagcagatctccaacgaactgaaccatatcctgctcgaaaacgacatgaagttcacagtggtcgtgggggacgtggcgggcatcctcgcgcaagggaagaagatgatccgcccccagccaatggagtacaagtactcttggaagtcctgggggaaggcaaagatcattggggcggacgtccagaacacaaccttcatcattgatgggcccaataccccggaatgcccggatgaccagagggcctggaacatttgggaggttgaggactatggcttcgggatcttcactaccaacatatggctgaagctccgtgactcctacacccaagtgtgcgaccatcgcctgatgtccgccgccatcaaagactcaaaggccgtccacgccgacatgggctactggatcgagtccgagaagaacgagacttggaagctggcacgggccagctttatagaggtgaagacgtgcatctggcccaagtcccacaccctctggagcaacggcgtgctggaatccgaaatgatcatccccaagatctacggagggccgatcagccaacataactaccgccccgggtacttcacccaaaccgccggcccctggcacctggggaaattagagctggacttcgacctgtgcgagggcactaccgtcgtggtggacgagcactgcggcaaccgggggccgtccctccgcacaaccaccgtcaccggcaagattatccacgaatggtgctgccggagctgcaccctgccgcccctgagatttagaggggaggacggctgctggtacgggatggagattcgccctgtgaaggagaaggaggagaatctagtgaagtccatggtcagtgccggatcgggagaggtggactccttcagcctggggctgctgtgtatctccatcatgatcgaggaggtgatgcggagccgctggagccggaagatgttaatgacgggcacgctggccgtcttcttcctcctgatcatgggtcagctgacctggaatgacctcatccgcctgtgcattatggtgggcgcgaacgcctccgatcgcatgggaatgggcaccacctacctggcgctcatggctactttcaagatgcggccgatgttcgcggtgggcctgctgtttcgccggctcacctcccgcgaggtcctgctcctcaccatcgggctgagcctggtggcatccgtggagttacctaacagcctggaggaactgggcgacgggttggccatgggcatcatgatccttaaactgttaactgacttccagtcacatcagctgtgggccacgctgctcagcctaaccttcatcaagacgaccttctccctgcactacgcgtggaagacgatggcgatggttcttagcatcgtgagcctgttccccctgtgcctcagcaccacctcccagaagacgacgtggctgcccgtcctgctgggcagcctggggtgcaagccgcttaccatgttccttatcgccgagaataaaatatggggccggaggtcctggcccttaaacgaggggatcatggccgtgggcatcgtgtcaatcctgctcagctcgctgctgaagaacgacgttcccctggccgggcccctgatcgccggcggcatgctgatcgcgtgctatgtcatcagcggttccagcgccgatctctccctggagaaggccgcggaggtgagctgggaggaggaggcggagcactccggcgctagccacaacatcctggtcgaggtgcaggacgatggaacaatgaagatcaaagacgaggagcgggacgacaccctgaccattctgctgaaggccaccctcctagccgtgtctggcgtctacccgctgagcatcccggccacactcttcgtctggtacttctggcagaagaagaagcagaggagcggggttctgtgggacacccccagcccgcccgaggtagagcgggctgtgctggacgacggcatctaccgcatcatgcagagaggcttgctcgggcggagccaggtgggcgtcggggtgttccaagagaacgtgttccacaccatgtggcacgttacgcggggcgctgtgctgatgtatcaggggaagcgcctagagcccagttgggccagtgtgaagaaggacctcatcagctatggcggaggttggcggctgcaaggctcctggaacaccggggaagaagtccaggtgatcgccgtggagcctggcaagaaccccaaaaacgtacagaccgcgcccgggaccttcaagacgcccgagggcgaagtgggcgccatcgcgctggacttcaagcccggaaccagcggctcccccatcgtgaaccgcgaggggaagatcgttggcctctacggcaatggggtggtgaccacaagcggaacgtacgtcagcgcaatcgcccaggccaaggcctcccaagaggggccgctaccggagatcgaagacgaggtgttccggaagcgcaatctgacgatcatggatctccatcccggcagcggtaagacccgacgctatctgccggccatagtccgggaggcaatcaaacgtaagctgcgcaccctcatccttgcccccacgcgggtagtggcctccgagatggcggaggccctgaaggggatgcccatccgctaccagaccaccgccgttaagagcgagcacaccggcaaggaaatcgtcgacttgatgtgccacgccacgttcaccatgcggctgctgtcccctgtgcgcgttccgaactacaacatgatcatcatggatgaagcacacttcaccgaccccagctccatcgcggcgcgggggtacattagcacccgcgtcggcatgggtgaggccgccgccatcttcatgacggcgacgccacccggctccgtggaggccttcccgcagtctaacgccgtgatccaagacgaggaaagggacatccccgagagatcatggaacagcgggtacgaatggatcaccgacttccccggcaagaccgtctggttcgtgccgtccatcaagagcggcaacgacatcgcgaactgcctccggaagaatggtaagcgcgtcattcagctgtcgcgaaaaacgttcgacaccgagtaccagaagaccaagaacaacgactgggactacgttgtgaccacggatatcagcgaaatgggcgctaactttcgcgccgaccgcgtgatcgacccgcgccgatgcctgaaaccagtcatcctcaaggacgggccggagcgcgtgatcctggccggtcccatgccggtgacggtcgcatccgccgcccagcgccgcgggcggatcggccgtaaccacaacaaagagggagaccaatatatctacatggggcagcccctaaataacgacgaggatcacgcccactggaccgaggccaaaatgttattagacaatatcaacacccccgagggcatcatcccagccctgttcgagcctgagcgcgagaagtccgccgctatcgacggggagtaccggttgcgcggcgaggcccggaagacgttcgtggaactgatgcgccgcggggacctgcccgtatggctcagttataaggtggcaagcgaaggcttccagtacagcgaccgtcggtggtgcttcgacggcgagcgaaataaccaggtgctggaagagaacatggacgtcgaaatctggacgaaggagggggagcggaagaaactccgcccccggtggttagacgcccgcacctactccgacccactggccttacgggagttcaaggagttcgcggccggccgccggagcgtgtccggggacctcattctagagataggcaagctgcctcagcatctcacccagcgcgcccagaacgccctggacaacctggtgatgctccacaatagcgagcagggcgggcgggcttaccgacacgccatggaggagctgcccgacacgatcgagacgctgatgctcttagctctgatcgcagtccttaccggtggagtaaccctgtttttcttatccggccggggcctcgggaagacctcaatcgggctcctgtgcgtgatggcgtccagcgtcttactgtggatggcttcagtggagccccactggatcgccgcctctatcatcctggaatttttcctcatggtgctactgatccccgagccggaccgccagcggacaccccaggacaaccagctcgcctatgtcgtgatcgggctgctgttcatgatcttaaccgtggccgcgaacgaaatgggtctgcttgagaccaccaaaaaggatctcgggatcggccacgtcgccgtggagaaccaccaccacgccgccatgctggacgtcgacctccaccccgcatccgcgtggacgctctacgccgtggcaaccaccatcataacgccgatgatgaggcacacgatcgaaaacaccaccgccaacatcagcctgacggccatagccaaccaagccgctatcctgatgggactggacaagggctggcccatctccaagatggacatcggtgtgcccctgctggccctcgggtgctacagccaggtgaaccccctgacccttacagcggccgtactcatgctggtagcccactacgccataatcggcccggggctgcaggccaaggcgacacgcgaggcccagaagaggaccgccgccggcatcatgaagaaccccacggtggacgggatcgtcgccatcgatctcgaccctgtcgtatacgacgcgaagttcgagaaacaactgggccagatcatgctgctcatcctatgcacctcccagatccttctcatgcgcaccacctgggccttgtgcgaaagcatcactctggccaccggccccctgacgacattatgggaagggtctccaggcaagttctggaacacgaccatcgccgtcagcatggctaacatcttccgggggtcttacttggcgggcgccggactcgcctttagcctgatgaagtccctcggaggagggcgccgggggaccggcgcccagggcgagaccttgggcgagaagtggaagcgtcagttgaaccagctatccaagagcgagtttaacacgtacaaacggtcggggatcatggaggttgaccgctcggaggcgaaagagggcctcaagcgcggggagaccacaaagcacgccgtgtcccgcgggactgccaagctgcggtggttcgtcgagcgcaacctggtgaagcccgaggggaaagttatcgacctgggctgtggtcgcgggggctggtcatactactgcgccgggctcaagaaggtcacggaggtaaagggctataccaaaggcggccccggccacgaggagcccatccccatggccacctatgggtggaaccttgttaagctgcactccggcaaggacgtcttcttcatcccgcccgagaagtgcgacaccctcctgtgcgacataggggagagctcccccaacccaacgatcgaggaggggcggaccctgcgggtgctcaaaatggtggagccctggctgcgtggaaatcagttctgcatcaagatcctgaacccctacatgcccagcgtcgtggagaccctagagcagatgcagcggaagcacggaggcatgctggtgcgcaacccgctgtcccggaatagcacacacgagatgtattgggtctcctgcgggaccggcaacatcgtgagcgccgtgaacatgacgtcccgaatgctcctgaaccgcttcactatggcccatcggaagcccacatacgagagggatgtcgacctgggggccggtacccggcacgtggccgtggagcctgaggtcgccaacctcgacatcatcggccagcgcatcgagaacatcaagcacgagcacaagagcacgtggcactacgacgaggacaacccctacaagacctgggcgtaccacgggtcctacgaggtgaagccgagcggctcagccagcagcatggtgaacggggtcgtgaaactgctgaccaagccgtgggatgtcatcccaatggtgacccagatcgccatgacggatactaccccgttcggccagcagcgagtgttcaaggagaaagtcgatacgcgcactccgaaggccaagcgggggaccgcccaaatcatggaagtgacagcaaagtggctctggggtttcctgtcccgcaacaagaaaccccggatctgcacgcgcgaggagttcacgcggaaggtacgcagcaacgccgccatcggcgccgtcttcgtggacgaaaaccaatggaactccgcgaaggaggcagtagaggacgagaggttctgggacctggtccaccgcgagagagagctccacaagcaggggaagtgcgcgacgtgtgtttacaacatgatggggaagcgcgagaagaaactgggggagttcggcaaggccaaggggagccgggccatatggtacatgtggctgggcgcgagatttctcgagttcgaggctctgggcttcatgaacgaggaccactggttctccagggagaacagcctttcaggggtggagggcgaagggttgcacaagctgggctacatcctgcgcgacatcagcaagatcccagggggcaacatgtacgccgatgacaccgcaggctgggatacccggatcacggaggatgacctccagaacgaggcccgcatcacggacatcatggagcccgaacatgcgctactggccaagagcatcttcaaactaacctaccagaacaaggtcgtgcgcgtgcaacggcccgccaagaacgggaccgtaatggacgtgatctcgcgccgcgaccagcgcggatccggtcaggtcgggacgtacggcctgaacacattcaccaatatggaggcgcagctgatccggcagatggagagcgaggggattttctccccgagcgagctcgagaccccgaacctggccgagcgcgtcctggactggcttgagaagtacggcgtggagcggctgaaacgcatggcgatttcgggggacgattgcgttgtcaagccgatcgacgaccggttcgccactgccctgaccgccctcaacgacatgggcaaggtgcgcaaggacataccccaatgggagccatctaaggggtggaatgactggcagcaggtccccttctgctcccaccatttccaccagctgattatgaaggatggccgggaaattgtcgtgccctgtcgcaaccaggatgagctggtgggccgcgcccgcgtcagccagggcgcaggctggagcctccgggagacagcctgcctgggtaagtcgtatgcccagatgtggcagctgatgtacttccatcgccgggacctccgcctggcagcgaacgccatctgcagcgccgtgcccgtggactggatccccacatcccgtactacctggagcatccacgcccaccaccaatggatgacgacggaggacatgctgagcgtttggaaccgcgtgtggattgaggagaatccctggatggaggacaagactcacatctcctcctggggcgacgtgccgtacctcgggaaacgcgaggaccaatggtgcggctccctgattggcttaaccgcccgggcgacctgggcaaccaacatccaggtcgcgatcaaccaggtgcgccggctcatcgggaacgagaactacctggactacatgacctccatgaaacgattcaaaaatgagtcagaccctgagggcgccctgtggtga

SEQ ID NO: 24176 - RNA, 9879 nt, synthetic construct
  misc_feature 1..9879: note = derived and/or modified CDS sequence (opt11) from DENV-1__FJ410207__SS-prME
  source 1..9879: mol_type = other RNA
tctgtgaccatgctactcatgctgatgccaaccgccctggccttccacctgaccacccgcggcggggagccgcacatgatcgtgagcaagcaggagcgtggcaagtccctgctgttcaagaccagcgcgggggtgaacatgtgtaccctcatcgccatggaccttggtgagttctgtgaggataccatgacttataagtgccctcgcatcactgaggcagaacccgacgacgtagactgctggtgcaacgccaccgacacctgggtgacctacggtacctgcagccagaccggcgagcaccggcgggataagagatcggtggcgctggcgccccacgtgggcctagggctggagacacgaaccgagacctggatgagctccgagggcgcatggaagcagatccagcgggtcgagacctgggccctgcgccacccggggttcatggtgatcgccctcttcctggcgcacgctataggcacgagcataacccaaaagggaatcatcttcatactgcttatgctggtgaccccctcaatggccatgcgttgcgtcggcatcgggagccgcgatttcgtcgagggcctgtccggcgccacctgggtggacgtcgtgctcgagcatgggagctgcgtgacgaccatggcgaaggacaagcccaccctggatattgagctgctgaagacagaggtcacgaaccccgcggtgctgcggaaattatgtatcgaggccaagatctccaacaccaccaccgacagccgctgcccgacgcagggcgaggccaccttagtggaggagcaggacgccaacttcgtgtgccggcgcaccttcgtggaccgcggctgggggaacgggtgcgggctgttcggcaaggggtccctgataacgtgcgccaagttcaagtgcgtgacgaaactggagggcaagaccgtccagtatgagaacctgaagtacagcgtgatcgtaaccgtgcacacaggcgaccagcaccaggtggggaatgagtccacggagcacggcactactgcgaccatcacaccccaggcgcccagcacggagatccagctgactgactacggagctctcaccctggactgtagcccacggaccggcctggacttcaacgagatggtcctgctcacgatgaaggagaagtcttggctggtgcacaaacagtggttcttggacctgcccctgccatggaccagcggggccagtacaagccaggagacctggaatcgaaaggacctcctggtgacgttcaaaaccgcccatgcgaaaaagcaggaggtcgtcgtactgggctcccaggagggcgccatgcacaccgccctcaccggagccactgagattcagaccagcggcacgaccacgatcttcgctggtcacctgaagtgccgcctgaagatggacaagctcaccttaaagggcatgtcctacgtcatgtgcacggggagcttcaagctggagaaggaagtggcggagacccagcacggcacggtgcttgtacagatcaagtacgagggcaccgacgccccctgcaagatccctttctccacccaggacgagaagggggtgacccaaaacgggcggctgatcacggccaacccaatcgtgactgacaaggagaaactggtcaatatcgaggccgagcccccctttggggagagctacatcgtgatcggcgcaggcgagaaggccctgaagctctcatggttcaaaaaggggagtagcatcggcaaaatgttcgaggccacagcccgcggagcccggcggatggcgatactgggcgacacggcctgggactttgggagtatcggcggcgtattcacgtcggtcgggaagctagtgcaccagatcttcggtacagcctacggggtgctgttcagtggagtctcctggaccatgaagatagggatcggagtgctgctgacatggctcggcctgaacagccgctctacgtccctatccatgacttgcatcgccgtggggctcgtcaccctctatctgggtgtaatggtgcaggctgacagcgggtgtgtcatcaactggaagggccgcgagttgaagtgcggttccggcatcttcgtgaccaacgaggttcacacgtggaccgagcagtataagttccaggctgactcccccaagcgccttagcgccgccatcgggaaggcatgggaggagggggtctgcggcatccggtccgccacccgcctggagaacatcatgtggaaacaaatcagcaacgagctcaatcacatcctgctagagaacgacatgaagttcaccgtggtcgtaggggacgtcgcgggcatcctcgcccaggggaagaagatgatccggccgcagccgatggagtacaagtactcctggaagtcctggggcaaggccaaaatcattggcgccgacgtgcaaaacacgacgttcattatcgacgggcccaacacccccgagtgtccggacgaccagcgcgcgtggaatatctgggaagtggaggactacggattcgggatcttcacgaccaacatctggttgaagctgagagacagctacacccaggtgtgcgaccatcgcctcatgagcgccgccatcaaagactccaaggcagtacacgccgatatgggctactggatcgagagcgagaagaacgagacctggaaactggcacgggcctccttcatcgaggtcaagacctgcatttggcccaagtctcacacactgtggtccaacggagtgctcgagagtgagatgattatcccgaagatctacgggggccccatctcccaacacaactaccgcccgggttacttcacccagaccgccggcccctggcacctcgggaagctggagctcgacttcgacctatgcgagggcaccacggtggtcgtagacgagcactgcgggaatcgggggcccagcttgcgcactaccaccgtgactggcaagatcattcacgagtggtgctgtcggtcctgtacgttaccgcccctgcgcttcaaaggggaggacggatgctggtacgggatggaaatccggcccgtcaaggagaaggaggagaatctggtgaagtccatggtgagcgccggctccggcgaggtcgacagcttttctctcggtctgttatgcatctccatcatgatcgaggaggtgatgcgctcccggtggagccgcaagatgctcatgacaggcaccctggccgtattcttcctgctcatcatggggcaactgacctggaacgacctaatacggctctgcatcatggtcggcgccaacgcctccgaccgcatggggatgggcaccacctacttagcccttatggccaccttcaagatgcgccccatgtttgccgtgggcctcctgttccggcgcctgacaagccgggaggtgcttctgctgacgatagggctctccctggtcgcgagcgtggagctgccgaattccttagaggagctgggggacgggctggccatgggcatcatgatcctaaagctgctgaccgacttccaaagccaccagctttgggccaccctgctgtcgctcacctttatcaaaacgactttcagcctgcactacgcctggaagactatggcaatggtactgtcgatcgtcagcctcttccccttgtgcctgtcaaccacgagccagaagaccacctggttgcccgtgctgctgggatccctcgggtgcaagcccctgaccatgttcctgatcgccgagaaccgtatttggggtcgaaagagctggccgctcaacgaggggatcatggccgtcggcattgtgagcatcctactgtccagcctcctgaagaacgacgtgcccctcgccgggcccctcatcgccggtggcatgttaatcgcgtgttacgtcatcagcggaagctctgccgacctgtctctcgagaaagccgccgaggtgtcctgggaagaggaagcagagcactctggcgcctcccataacatcttggtggaggtccaagacgacggaacgatgaagataaaggacgaggagcgcgacgacaccctgaccatactcctgaaagcaaccttgttagccgtgagcggcgtgtaccccctgtccatcccggccaccttattcgtctggtacttctggcagaagaagaagcagcggagcggtgtgctctgggacacgccctcaccgccagaggtggaacgagccgtactggacgacggaatctaccggatcatgcagcgtggcttactggggcgcagccaggtcggcgtgggagtcttccaggagaacgtgttccacaccatgtggcacgtgacccgtggcgcggtcctcatgtaccaggggaagcggctggagccgtcctgggccagcgttaagaaggatcttatttcctacggcggcgggtggcgcctccagggttcctggaacaccggggaggaggtgcaggtcatcgccgtggaacctggcaagaaccccaagaacgtgcagaccgcccccggaacctttaagacctccgagggcgaggttggcgccatcgcgctggacttcaaacccgggacctctgggagcccaatcgttaaccgggagggaaagatcgtgggcctgtacggtaacggcgtcgtgactacctccggcacttacgtgagcgccattgcccaggcgaaggcgtcccaggagggccccctacccgagatagaagacgaggtcttccgcaagcggaatctgaccatcatggacctgcatccgggcagcgggaagacgcgccggtacctccccgccatcgtgcgcgaggcaatcaagcgcaagctgcgcacactgatcctagccccgacccgcgtggtcgccagtgagatggcagaggccctgaagggcatgccaatccggtaccagacgacggccgtcaagagcgagcacaccggcaaggaaattgtagacttgatgtgtcatgccaccttcactatgcgcctcctgtcccccgtccgggtgcctaactacaatatgatcatcatggacgaggcccacttcacggaccccagctccatcgctgcacgcgggtacatcagcactcgggtgggcatgggggaggccgccgcaatcttcatgacggcgaccccaccaggctcggtcgaggcgttcccccagagcaacgccgtgatccaggacgaggagcgcgacatccctgaacgaagttggaatagcgggtatgagtggatcacggatttcccgggcaagaccgtgtggttcgtgccctccatcaagagcggcaacgatatcgccaattgtctgcgcaagaacggtaagcgggtaatccagctctcccgcaagaccttcgacaccgagtaccagaagacgaaaaataacgattgggactacgtggtcacaaccgacataagcgagatgggagctaactttcgggctgaccgggttatcgatcccagacgctgtctgaagcccgtgatccttaaggatgggccggagcgggtcattctcgccgggccaatgccggtgaccgtcgcctcggccgcgcaacgcagagggcgtatcggccggaaccacaacaaggagggcgatcagtacatttacatggggcagcccctgaacaacgacgaggaccacgcgcactggacggaggccaaaatgctgctcgacaacatcaacacgcccgagggcatcatccccgccctgttcgaacccgagagagaaaagtcagccgcgatcgacggagagtacagactgcgcggcgaggcccgcaagaccttcgtcgagctcatgagacgcggggacctgccagtgtggctgagctacaaggtcgcctccgagggtttccagtacagcgatcggcgctggtgtttcgacggcgagagaaacaaccaggtattagaagagaatatggacgtggagatctggaccaaggagggggagcgcaaaaagctgcggccgcgctggctggacgcgaggacgtactccgaccccctcgccttaagggagtttaaggagttcgcggccggccggcgcagcgtctccggggaccttatcttggaaatcggcaagctgccacagcacctgacccagcgggcccagaatgcactcgacaacctggtgatgctgcacaacagcgagcagggcgggcgcgcgtatcggcacgccatggaggagctcccagacaccatcgagaccctaatgctgctcgcgcttattgcagtgttgacgggcggggtcacccttttcttcctatccggccgcgggctgggcaagaccagcatcggcctcctctgcgtaatggcctcctcggtcctgctctggatggcgtccgtcgagccgcactggatcgccgccagcatcatccttgagtttttcctgatggtgctactgatccccgagcccgaccggcagcgcacgccccaagacaatcagctggcctacgtggtcatcgggctcttgttcatgatcctgacagtggccgcgaacgaaatgggcctcctagagacgaccaagaaggacctgggaattggccacgtggccgtcgagaaccaccaccacgccgccatgctcgacgtggacctgcacccggcctcagcgtggaccctgtacgccgtggccaccacgattatcacacccatgatgcggcacacgatcgagaacaccacggccaacatcagcctcaccgccatcgcgaaccaggcagcgatcctgatgggactggacaaggggtggcccatttccaagatggacatcggcgtcccgctcctggccctggggtgctacagccaggtgaacccactcaccttgacggcggcagtcctgatgctcgtcgctcactatgccatcatcggcccgggactgcaggcaaaggcgacccgcgaggcccagaagaggaccgccgccggcatcatgaagaatcccaccgtggacgggatcgtggccatcgacctggatccggtcgtttacgacgcgaagttcgagaaacagttaggccagataatgctcctgatcctctgcacctcccagatcctgctaatgcggacgacctgggctctctgcgagagcatcactctggccaccggccccctgacgacgctctgggaaggatcccccggcaaattctggaacaccaccatagcggtgagcatggcgaacatattccgcgggagctacctggcgggcgctggcttggccttctccctcatgaagtccctcgggggtgggaggcgcgggacaggggcccagggcgagacccttggggagaagtggaagcgccagctcaaccaactgtccaagtcagaattcaacacctacaagcgcagtggaatcatggaggtcgaccggtcggaggctaaggagggcctaaagcgcggggagactacaaagcacgcagtgagccggggcaccgccaagctccgctggttcgtcgagcggaacctggtcaagcccgaggggaaagtgattgacctgggctgcggccgcgggggctggagctattattgcgccgggctaaagaaggtgaccgaggtcaagggctacaccaagggtgggccgggccacgaggagcccatccctatggccacgtacgggtggaacctcgtgaagctgcactccggcaaggacgtgttcttcacaccgccagagaagtgcgacaccctgttgtgcgacatcggggagtcatcccccaatccaaccattgaggaaggcaggacgctgcgcgtcctgaagatggttgagccctggctccgcggcaaccagttctgcatcaaaatactgaacccctacatgccaagcgtggtcgaaactctggagcaaatgcagcgtaagcacggcggcatgctcgtgcgtaaccccctttcccgcaacagcacccacgagatgtactgggtgtcctgcgggactggcaacatcgtaagcgctgtgaacatgacctcccggatgctgctcaacaggtttaccatggcccaccgcaagcccacgtacgagcgggacgtggacctgggggccggcacccgccacgtggccgtggagcccgaggtggccaatctggacatcatcggccagcggatagagaacatcaagcacgaacataaaagcacctggcactacgacgaggacaacccctacaagacgtgggcctaccacgggtcctacgaggtcaagcccagcggcagcgcctccagcatggtaaacggggtagtgaagctactgaccaagccctgggacgtgatcccgatggtcacccaaatcgccatgaccgatacgactccgttcggccagcagcgcgtgtttaaggaaaaggtcgacacacggacgcccaaggctaagcgcgggacggcacagatcatggaggtcaccgcgaagtggctgtggggatttctcagccggaacaagaagccacgcatctgcacaagggaggagttcacccgcaaggttcggagcaacgccgcgatcggcgccgttttcgtcgacgaaaaccagtggaactccgctaaggaggccgtggaggacgagcgcttctgggatctggtgcatcgggagcgggaactgcacaagcaggggaagtgcgcaacgtgtgtctacaacatgatgggcaagcgggagaagaagctcggggaattcggcaaggctaaggggagccgagccatatggtacatgtggctgggcgcgcgattcctggagttcgaggcgctcggcttcatgaatgaggaccactggttctcccgcgagaacagcctgtccggggtggagggcgaggggctgcataagctcggctacatcttgcgggacatcagcaagatccccggcgggaacatgtacgcggacgacaccgccgggtgggacaccaggatcacggaggacgacctgcagaacgaggcgaaaataacggacatcatggagccggagcacgcgctcctggccaaatccatcttcaaactgacctatcaaaacaaggttgttagggtgcagcgccccgctaaaaacgggaccgtgatggacgtcattagccgccgcgatcaacgcggctcaggacaagtgggcacctacgggcttaatacgttcaccaacatggaggcccagctgatccggcagatggagagcgaggggattttttccccgtctgagctggagactccaaacctcgccgggcgagtgctggactggctggagaagcacggggtcgagcggctcaaacggatggcgatcagtggggacgactgcgtggtgaagcctatcgacgaccgtttcgccaccgccctgacggccctgaatgacatggggaaggtccgcaaggacatcccccagtgggaaccgagcaagggctggaacgattggcagcaggtccccttctgcagccaccatttccatcagctcatcatgaaggacggccgggagatcgtggtcccctgtcgcaatcaagacgagctggtgggacgggcgcgcgtgtcccagggcgcggggtggagcctgagggagaccgcctgtctcggcaagtcctacgcccaaatgtggcagttgatgtatttccaccgccgggacctgcgcctcgccgcgaacgccatctgtagcgccgtaccggtggactgggtgccgacctctagaaccacgtggagcatccatgcccaccaccagtggatgaccacagaggacatgctgtccgtctggaaccgggtgtggatcgaggagaacccttggatggaggataaaacgcacatctcttcctggggtgatgtgccctacctggggaagagagaggaccagtggtgtggcagccttatcgggctgactgcgcgcgcgacatgggcaaccaacatccaagtcgcgatcaaccaggtgagacggctgatcgggaacgagaattacctcgactacatgacctccatgaagcgctttaagaacgagagcgaccccgaaggggccctgtggtga

SEQ ID NO: 24177 - RNA, 9879 nt, synthetic construct
  misc_feature 1..9879: note = derived and/or modified CDS sequence (opt11) from DENV-1__FJ432744__SS-prME
  source 1..9879: mol_type = other RNA
agcgtaacgatgctgctcatgctgatgcccaccgccctggcgttccacctcaccacccgcggcggggagccacacatgattgtttccaagcaggagcggggcaagtctctcttgttcaagacctccgcgggggtgaacatgtgcactctcatcgccatggacctgggggagttctgcgaggacacgatgacgtacaagtgtccccggatcaccgaggccgagccagacgacgtggattgctggtgcaacgccacagatacgtgggtcacctacgggacctgcagccaaacgggagagcatcggcgcgacaagcgcagtgtggctctggcgccccacgtgggcctcgggctggaaactcgcaccgaaacctggatgagcagcgagggcgcctggaagcagatccagcgggtcgaaacctgggccttacgtcaccctgggtttacggtgatcgccctgttcttagcgcatgccatcggcaccagcatcacccagaaggggatcatcttcatcctgctcatgctggtgacgccctccatggccatgcgttgcgtgggcatcggttcacgcgacttcgtggaaggactgtccggcgcgacgtgggtggacgtcgtgctcgagcacgggagctgtgtgaccaccatggccaaagacaagcctaccctggatatcgagctgctcaagacggaggtcaccaaccccgcggtcttgcggaagctttgcatcgaggcaaagatctcaaacaccaccacggacagccgctgcccgacccagggcgaggccacccttgtggaggagcaggacgccaacttcgtctgtcggagaaccttcgtggaccggggctgggggaacggctgcggtctgtttggcaaaggttccctcatcacgtgcgcaaagttcaaatgcgtgactaaactggagggcaaaacagtccagtacgagaatctgaagtacagcgtgatcgtgaccgtccacacgggcgaccagcaccaggtggggaacgagtccaccgagcacggcaccacagcgactatcaccccccaggcccccagcaccgagatacaactgaccgactacggggccctcaccttagactgcagcccccgcacgggcctggactttaacgaaatggtcctcctgaccatgaaagagaaggcttggctggtgcacaagcagtggttcctcgacctgccgctgccctggacgagcggggccagcacctctcaggagacgtggaaccggaaggatttactggtgaccttcaaaaccgcgcacgccaagaagcaggaggtagtggtgctgggctctcaggagggcgctatgcacaccgccctcactggggccaccgagatccagacgtccgggaccacgaccatcttcgccgggcatctgaaatgtcgcctgaagatggacaagctaaccttgaagggcatgagctacgtaatgtgcaccgggtcgttcaagttagagaaggaggtggccgagacgcagcatggcaccgtgctcgtccagatcaaatacgaggggaccgatgccccctgcaaaatcccgttctctacccaggacgagaagggggttacgcagaacggccggctgatcaccgccaatccgatagtgaccgacaaggagaagcctgtcaatatcgaagcggagccgcccttcggggaatcctacattgtgattggcgccggcgagaaggctcttaagctgagctggttcaagaaagggtccagcataggcaagatgtttgaagctactgccagaggggcgcgtcgcatggccatcctcggtgacactgcctgggactttgggtccatcggcggcgtgttcacgagcgtcgggaagctggtgcaccagatcttcggcacagcctacggagtgctgttctcaggcgtctcctggaccatgaagatcggaatcggcgtgctcctgacctggctgggcttaaattcccgcagcacctctctgagcatgacctgcatcgcggttgggctggtcaccctctacctgggtgtaatggttcaggcagactccgggtgcgtcatcaactggaagggccgggagctgaagtgcgggagcggcatattcgtgacaaacgaggtgcacacctggactgagcagtacaagttccaggctgacagcccgaaacgcctcagtgccgccatcggcaaggcctgggaggagggggtctgcggcatccgaagcgcgaccaggctagagaacatcatgtggaaacagatctccaacgagcttaaccacatcctcttggagaacgacatgaagtttactgtggtggtaggggacgtggccggcatcctggcgcagggaaaaaagatgatacgaccccagcccatggagtacaagtacagctggaagtcctggggcaaggccaaaatcatcggcgcagacgtacaaaacgccacgttcatcatagacgggcccaacaccccggaatgtcccgatgaccagcgcgcatggaacatctgggaggttgaggactacggcttcgggatattcaccaccaatatctggctgaagctgcgggactcttatacccaggtgtgcgatcaccgcctgatgagtgccgccatcaaggacagcaaggcggtgcacgccgacatgggctactggatcgagagcgaaaagaacgagacgtggaagctcgcacgggccagctttattgaggtcaagacctgtatctggcccaagtcccacaccctgtggtctaacggtgtgctggagtccgagatgatcatccccaagatatacgggggcccgatcagccaacacaattaccgccctgggtatttcactcagacggccggaccctggcatctcgggaagcttgagctggatttcgacctctgtgagggcaccacagtggtcgtggacgagcattgcggcaaccgggggcccagtctgcgcacgacgaccgttaccggcaagattatccacgagtggtgctgccggtcatgcacgctgccgcccctgaggttcaagggagaggacggctgctggtacgggatggagattcgacccgtaaaggagaaggaagagaacctagttaagagtatggtaagcgcgggcagcggcgaagtcgactccttcagcctggggctcctgtgcatctccatcatgattgaggaggtgatgcgtagccggtggtcgcgcaagatgctaatgaccggcatcctcgccgtgttcttcctgctgatcatggggcaactcacctggaacgatttgattcggctgtgcatcatggttggcgctaacgccagcgaccgcatgggtatgggcaccacttacctcgcactgatggctacatttaagatgcgcccgatgttcgccgtgggcctcctattccggcgactcacctcccgagaggtgctgcttctcaccatcggattgagcctcgtcgcctccgtggagctcccaaacagcctggaggaactcggcgacggtctggccatgggcatcatgatactgaagctactgacagactttcagtcccaccaactgtgggcgaccctcctgagcctgaccttcattaagaccacgtttagtctccactacgcctggaagaccatggccatggtgctgagcatagtgtccctgttccccctctgcctgagcaccacttcccagaaaaccacctggctgcccgtgctcctggggagcctcgggtgcaagccgttaaccatgtttctgatcgccgagaacaagatctggggccgcaaatcctggccgctgaacgaggggattatggccgtcggcatcgtgagcatcctactgagcagtctactcaagaacgacgtgcctctggcggggcccctgatcgccggcggcatgcttattgcctgttacgtcatctccggttccagcgccgacctctccctggagaaggccgcggaggttagctgggaagaggaagccgagcactccggcgcgagtcacaatatcctcgtggaggtacaggacgacgggaccatgaagatcaaggacgaggagagggatgacacgcttaccatcctgctcaaggcgacgctgttagccgtgtccggtgtatacccgctcagcatccccgcgaccctctttgtctggtacttctggcagaagaaaaagcgccggtccggggtgctgtgggacacgccatccccccccgaagtggagcgcgccgtgttggacgacggcatctatagaatcatgcagcgcggcctgttagggcggtcccaggtgggcgtcggggtattccaggaaaacgttttccacacaatgtggcacgttacccgaggcgccgtgctgatgtaccaggggaagcggctcgagcccagctgggcatccgtgaagaaggacctgatatcctacggcggcgggtggcgacttcagggctcctggaacaccggggaggaggtgcaagtcatcgcagtggagcccggcaagaatcccaagaacgtacagaccgcgcccgggacattcaaaaccagcgagggtgaggtcggcgccatcgccctcgacttcaagccagggacctcgggctcccccatcgtgaaccgagaggggaagatcgtaggcctgtacggcaacggggtcgtaaccacgtctggcacctacgtctccgctatcgcgcaggccaaggcctcacaggaggggcccctgcctgagattgaggatgaggttttccgcaagcggaacctgaccataatggacctgcacccaggcagtgggaagacccgccggtacctgccggccatcgtacgcgaggccatcaagcggaagctccggacgctgatcctggcgccgaccagggtggttgccagcgagatggcggaagccttaaagggcatgccgatccgctaccagaccaccgcagtgaagtccgagcacacgggcaaggagatcgtggacctgatgtgccacgctaccttcaccatgcgactcctcagccccgtccgggtgcccaactataacatgatcatcatggacgaggcccactttaccgacccgtccagcatcgccgcccgggggtacatatcgacgcgagtgggcatgggagaggccgcagccatcttcatgaccgccacgcctccgggctcggtcgaggccttcccccagtccaacgcggtgatccaggatgaggagcgcgacatcccggagcggagctggaactccgggtatgaatggatcaccgactttcccggaaaaacggtctggttcgtcccctctatcaagtccggtaacgacatcgccaactgcctgcgcaagaacgggaagagggtgatccaactgagccgcaagaccttcgacactgaataccagaagaccaagaataacgactgggattatgtggtcacgacagacatctccgagatgggagccaacttccgtgctgatcgcgtaatcgacccccggcgctgcctcaagccggtgatcctgaaggacgggcccgagcgtgtcatccttgccggccccatgcccgtgacagttgcgagcgcggcccagcgccgggggcgcatcgggcggaaccacaacaaagagggcgatcagtacatctacatgggtcagccgctgaacaacgacgaggaccacgcccactggaccgaagccaaaatgctgctagacaacatcaacacgcccgaaggcatcatccccgccctcttcgagcctgaacgcgagaagtccgccgccattgatggggaataccgcctgcggggcgaggcccggaagaccttcgtggagctgatgcggcgcggggacctcccggtttggctgagctacaaggtcgccagcgagggcttccagtattccgatcggcgttggtgcttcgatggcgagagaaacaaccaagttctggaggagaacatggacgtggagatctggaccaaagagggggaacgcaagaagctcagaccccgctggttagacgcgaggacttatagcgaccccctggccctccgggagttcaaggagttcgccgccggccggcgctcggtcagcggggacctgatactcgaaattggcaaactgccgcaacaccttacgcaacgggcacagaacgccttagacaacctcgtgatgctgcacaactccgagcaaggagggcgcgcctaccggcacgcgatggaggagctgccggacacaatcgagaccctcatgctcctggccctcatcgcggttctgaccggcggggtcaccctgttcttcctcagcggtcgcgggttgggcaagacctccatcggcctgctctgcgtgatggccagctccgtcctgctgtggatggcaagcgtcgagcctcactggatcgccgcttctatcattcttgagttcttcctgatggtgttacttatccccgagcccgaccggcagcgcaccccgcaggacaaccagctggcgtacgtagtcatcgggctcctcttcatgatcctaaccgtggccgccaacgagatgggactactcgagaccacgaagaaagatctggggatcggccacgtcgccgtggagaaccaccaccacgccgcgatgctggacgtggacctccacccggccagcgcctggaccctgtacgccgtggcaacaaccatcatcacacccatgatgcggcacaccatcgagaacaccaccgctaacatatcactcacggcaattgctaatcaagctgcgatcctcatgggtttagacaagggttggccgataagcaaaatggatatcggagtcccactgctcgccttagggtgctactcccaggtgaaccccctgacactcacagccgctgtgctgatgttggtcgcccactatgcgatcatcggccccgggctgcaggcgaaggccacccgcgaggcccaaaaacgcaccgcggcgggcattatgaagaacccgacggtggacggtatcgtcgccatagacttggaccccgtggtctacgacacaaagtttgagaagcagctggggcagatcatgttgttaatcctgtgcacctcacagatactcctgatgcggacgacctgggcgctgtgcgagagcatcaccctcgcaaccggccccctgactaccctgtgggaagggagccccggaaaattctggaacaccacgatcgccgtgtccatggcgaacatattccgaggtagctacctcgccggcgccggcttagctttctctctgatgaagtccctggggggggggcgacgcggcacaggtgcgcagggcgagaccctcggcgagaagtggaagcggcagctgaaccagctctccaagtccgaatttaacacctataagcgcagcgggatcatggaagtcgaccggtccgaggctaaggagggcctgaagcgtggagagaccacgaagcacgccgtgtcacggggcaccgccaagctgcgatggttcgtggaacggaaccttgtgaagcctgagggaaaggttatcgatctgggatgcggacgcgggggctggtcgtattactgcgcagggctgaagaaagtgaccgaggtcaagggctacaccaagggcgggccgggccacgaagagcccatccctatggcgacgtacgggtggaacctggtgaagctccacagcggcaaggacgtgttcttcatcccacccgagaagtgcgacacgctgctgtgcgacatcggggagtcatcacccaaccccaccatcgaggagggcaggaccctacgagtgctgaagatggtagaaccgtggctgcgcgggaatcagttttgcatcaaaatattgaacccctatatgccctctgtggtcgagacgctggaacaaatgcagcgcaagcacggcggcatgctggtacgcaacccactcagccgaaactccacgcacgaaatgtactgggtgagctgcgggaccggcaacattgtctccgcagtgaacatgacaagccggatgctgctgaaccgcttcacgatggcccacaggaagccgacgtacgaacgggatgtggaccttggtgccggcacgcgacacgtcgccgtggagccagaggtggcgaatctggacatcattgggcagcgaattgagaacataaagcacgagcacaagtccacatggcactacgacgaggacaacccgtacaaaacttgggcctaccacgggagctacgaggttaagccgtccggtagcgcaagcagcatggttaacggggtcgtgaagctgctcacgaagccgtgggacgtgataccaatggtcacccagatcgcgatgaccgacaccacgccctttggccaacagcgggtgttcaaggagaaggttgacacccggacccccaaggctaaacgcgggacggcgcagatcatggaggtcactgccaagtggctgtggggcttcctgtcacggaacaagaagccgcgcatctgcacccgcgaggagttcacccgcaaagtacggtccaatgccgccataggcgcggtgttcgtcgacgagaatcagtggaacagcgccaaggaggccgtggaggacgagcgcttctgggacctcgtgcaccgggagagggagctgcacaagcaggggaaatgcgcgacatgcgtctacaacatgatgggcaagcgggagaagaagctcggggagttcggcaaggccaaggggtcccgcgccatctggtacatgtggcttggcgcccggttccttgagttcgaggccctgggattcatgaacgaggaccactggttcagtcgcgagaactctctcagcggcgttgaaggcgaagggctgcataagcttgggtacatcctccgagacatctccaagatccccggaggcaacatgtacgccgatgacacggcgggatgggacacccgcatcaccgaagacgacctccagaacgaagcgaagatcaccgatatcatggagccagagcacgccctgcttgccaagagcatcttcaaactgacgtaccagaacaaggtggtccgggtgcaacgccctgccaagaacgggactgtgatggacgtcatctccagacgggaccagcgcggcagcggccaggtgggcacctacggcctaaacacctttacgaacatggaagcacagctcatccggcagatggaatcggaggggatattcagcccctccgaactggagacacccaacttggcgggccgcgtgcttgattggctggagaagcacggggtagagcggctgaagcgcatggccatcagcggcgacgactgcgtggtgaagcccatcgacgaccggtttgccactgccctcaccgcactcaacgacatggggaaagttcgtaaggacattccacagtgggagccctccaagggctggaatgattggcagcaggtccccttctgcagccatcatttccaccagttaatcatgaaagacgggcgggagattgtcgtcccctgccgcaatcaggacgagctcgtgggccgtgcgcgcgtgagccagggagccgggtggtccctgcgggagacggcctgcctgggcaagtcctatgcgcagatgtggcagctcatgtacttccatcgccgcgacctgcgcctggcggccaacgccatctgctccgcagtcccggttgattgggtgcccactagccggaccacctggtccatccacgctcaccaccagtggatgacgacagaggacatgcttagcgtgtggaaccgcgtgtggatcgaggagaacccctggatggaagacaagacccacatttccagctggggcgacgtgccctatctgggcaagcgggaggaccagtggtgcggctccctgatcgggctaaccgcgcgcgcgacgtgggccaccaacatacaggtcgccatcaaccaggtgcgccggcttatcggcaacgagaactacctggactacatgacctcgatgaaacgcttcaagaacgagatagatccggagggggccttatggtga

SEQ ID NO: 24178 - RNA, 9879 nt, synthetic construct
  misc_feature 1..9879: note = derived and/or modified CDS sequence (opt11) from DENV-1__FJ547060__SS-prME
  source 1..9879: mol_type = other RNA
agcgtgaccatgctgctaatgctgatgcccaccgccctggccttccatctcaccacccggggcggggaaccccacatgattgtgaccaagcaggaacggggcaagagcctgctgttcaagaccagcgccggggtgaacatgtgtaccctcatcgccatggacctcggggagctgtgcgaggacactatgacctataagtgcccacggatcaccgaagccgagcccgacgacgtggactgctggtgcaacgccaccgacacctgggtgacctatgggacctgctcccagacgggggagcacaggcgcgacaagcggagtgtggccctcgcgccccacgtgggtctggggctggaaacccgcaccgagacctggatgtcaagcgagggtgcctggaagcagatccagcgggtggagacgtgggcactccgccaccccgggttcaccgtgatcgccctgttcctggcgcacgccatcggcacgtccatcacccagaagggtattatcttcatcctcctgatgctggtcactcccagcatggccatgcgctgcgtcggcatcggctcccgagacttcgtggaagggcttagcggcgccacctgggtggacgttgtgttagagcacgggtcctgcgtgaccaccatggctaaagacaagccaacgctggacatcgagctcttgaagaccgaggtcaccaacccagcggtcctgagaaaactctgcatcgaagccaagatcagcaacacgacgacggactcacgctgccccacccagggcgaggccacccttatggaggagcaggacgccaacttcgtgtgccggcgcactttcgtcgaccgggggtgggggaacggatgcgggctgttcggcaagggtagcctaatcacgtgcgccaagttcaagtgcgtgaccaagctggagggcaagatagttcagtacgagaacctgaagtattccgtcatcgtaaccgtgcacacgggcgaccagcaccaggtcgggaacgagagcacggagcatggcaccaccgcgaccatcacgccgcaggcccccacctccgaaatccagctcaccgactacggagccctgaccctggactgcagcccacgtacaggcctcgatttcaacgagatggtgctcctgaccatgaaggagaaaagctggctcgtacacaagcagtggttcctggacctaccgctcccctggaccagcggggccagcacctcgcaggagacctggaaccgccaggacctgctggtgaccttcaaaaccgcccacgcgaagaagcaggaggtggtcgtgctcgggtcccaggagggcgccatgcacaccgccctgacgggggctaccgagatccagacctccggaaccactaccatcttcgccgggcacctgaagtgccgcctcaagatggacaagctgaccctcaagggtatgagctacgttatgtgcaccgggtccttcaagctcgagaaggaggtcgccgagacacagcatggcaccgtgctggtgcagatcaagtatgagggcaccgacgccccctgtaagatccccttcagcacccaggatgagaagggggtcacgcagaacggccggctgatcacggccaatccgatagtgaccgacaaggagaaaccagtcaacatcgaggccgagccgcccttcggggagagctacatcgttataggggcgggtgagaaggccctcaagctcagctggttcaagaaggggtccagcatcggcaagatgttcgaagccaccgcccgcggggcccggcgcatggcgatcctgggcgatacggcctgggacttcgggtccatcggcggagtgttcaccagtgtggggaagctagtccaccagatcttcggcaccgcttacggcgtcttattctccggggtgtcttggaccatgaagatcggcatcggcgtcctcctgacgtggctcggactgaatagtcgcagcacatccctgagcatgacctgcattgccgtggggctcgtgaccctgtacctgggcgtcatggtacaagctgactccggttgcgtgatcaactggaagggccgggagctcaagtgcgggagcggcatcttcgtcacgaacgaggtgcacacctggaccgagcagtacaaattccaggcggacagcccaaaacgactgagtgcagccataggcaaggcctgggaggagggggtgtgcggcatccggagcgccacccgcctggaaaacattatgtggaagcaaatctccaacgagttaaaccacatactgctggagaacgacatgaagttcaccgtcgtggtaggggacgtcgtgggcatcctcgcccaggggaagaaaatgatccggccccagcccatggagcacaagtacagctggaagtcctggggcaaggccaagataatcggcgccgacgtccagaacacgaccttcatcatcgacggacccaacactcctgagtgccccgatgatcagagggcctggaacatctgggaagtcgaggactacggtttcgggatctttacgacgaatatctggctgaagctgcgggacagctacacccaggtatgcgaccaccgcctcatgtccgcggccataaaagacagcaaagccgtgcacgccgacatggggtactggatagagtccgagaagaacgagacctggaagctggcccgggcgagcttcatcgaggtcaaaacctgcatctggccgaagtcccacacattgtggagcaacggagtgctcgagtccgagatgatcatccccaagatctacgggggcccgatcagtcagcacaactaccgccccgggtacttcacccagaccgccggcccttggcatctggggaagctggagctcgacttcgatctgtgcgagggcacaacggtggtcgtggacgagcactgcggcaaccgggggccgtccctgcgcaccacgaccgtgacgggcaagatcatccacgagtggtgctgccggtcatgcaccctgccgcccttgcgcttcaaaggggaggacggctgctggtacgggatggagatacggcccgtcaaggagaaagaggaaaacctggtgaagtccatggtgagcgccggcagcggcgaggtcgactccttcagcctcggcctgctgtgcatctccatcatgatcgaggaggtgatgcgctcccgttggtcccgcaagatgttgatgaccggcaccctggccgtgttcctgctcctgatcatggggcagcttacgtggaacgatctcatccgtctgtgcatcatggtcggcgcaaacgcgagcgaccgcatggggatgggcaccacctacctggcgctcatggccacctttaagatgcgcccgatgttcgccgtgggcctgctgttccggcgactcacgtcccgggaggtgctgctgctcaccatcgggttgagcctggtcgcctccgtagagctccccaacagtctggaggagctcggcgacggactcgcgatgggcataatgatcctgaagctactcaccgactttcagtcccaccagttgtgggccactctcctctcactgacgttcatcaagaccaccctgtccctccattatgcctggaagaccatggccatggttctgagcatcgtttccctgttccctctctgcttatcgacgacctcccagaagaccacttggctgcccgtgctcctgggtagtctggggtgcaagccactcacgatgttcctgatcgctgagaacaaaatctggggccgcaagtcctggcccctaaacgaggggataatggcggtcggcgtggtaagcatcctcctgtcatcccttctcaagaacgacgtccccctggccgggcctctgatcgccggcggcatgctcatcgcttgctacgtgatcagcgggagcagcgcggacctatccctggagaaggccgcggaggtgagctgggaggaggaggccgagcactcaggcgccagccacaacatcctggtcgaggtgcaggacgacgggaccatgaagatcaaggacgaggagagggacgacacgcttaccatcctgctgaaggcgaccctgctggccgtgtctggcgtctacccgctcagcatccccgccacactcttcgtgtggtacttctggcagaagaagaaacagaggtccggggtgctatgggacacccccagcccgccagaggtggagcgtgccgtgctcgacgatggcatttaccgcatcatgcagcgggggctcctggggcgctcccaggtgggcgtcggggtgttccaggagaacgtattccacaccatgtggcacgtaacccggggcgccgtgttgatgtaccaagggaagcgcctggagcccagctgggcgtccgtgaagaaggatcttataagctacggcggcgggtggcggctgcagggctcctggaacactggggaggaggtccaggtgatcgccgtggagcccggcaaaaatcccaagaacgtccagaccgcccccgggaccttcaagacccccgagggcgaagttggagccatcgccctcgacttcaagcccggcacgagcggatcgcctatcgtgaacagggaggggaagatcgtcggcctctacggcaacggggtagtcaccaccagcggcacctacgtcagcgcgatcgcccagacaaaggcctcccaggaggggccgctgcccgagatcgaggacgaggtgttccggaagcgcaacctgacgatcatggacctgcaccccggcagcgggaagacgcggcgatacctgcccgccatcgtgcgggaggcgatcaagcgcaagctccggaccctgatcttagccccgacgcgcgtagtggcctccgagatggccgaagccctcaaaggcatgcccatccgctatcagaccaccgcggtcaagagcgaacacaccgggaaggagatcgtcgacctgatgtgccacgccacgttcaccatgcggctgctctcccccgtcagggttccaaactacaacatgatcattatggacgaggcccacttcaccgaccccagctccatcgccgcccgggggtacatcagcacccgcgtcggcatgggggaagccgccgccatcttcatgacggccacgccgccaggctcggtggaagccttcccacagagcaacgcggtgatccaggacgaggagcgggacatccccgagcgcagctggaacagcgggtacgagtggatcaccgacttccctggcaagaccgtctggttcgtgccctcaatcaaaagcgggaacgatatagcgaactgcctgcggaagaacgggaagcgagtcatccagctgtcccggaagacgttcgataccgagtaccagaagaccaagaacaacgactgggactacgtcgtgaccacggacatcagtgagatgggtgccaactttcgagccgaccgcgtgatcgacccgcgccggtgcctcaagccagtcatcctgaaagatgggcccgagcgcgtgatcctggcgggccccatgccggttaccgtggcctccgccgctcagcggcgcgggcggataggacgcaatcataacaaggagggcgaccagtacatctacatgggccagcctcttaacaatgacgaggaccatgcccactggaccgaagcgaagatgctgctggacaacatcaacacaccagagggcatcatccccgccctctttgagccggaacgggagaagtccgccgccattgacggggagtatcgcctgcggggcgaagcccggaagaccttcgtggagctgatgcgccgcggggacctccccgtatggctgtcctacaaggtggcgagcgagggcttccagtatagcgaccgccggtggtgcttcgacggcgaacgcaacaaccaggtgctcgaggagaacatggacgtcgaaatctggaccaaggagggggaaaggaagaagctgcgcccccggtggctggatgctcgtacctactccgaccccttagccctccgggagttcaaggagttcgccgccggccgccgaagcgtatccggcgacctgatcctggagatcggaaagctcccgcagcacctgacccaacgcgcacagaacgccctagacaacctcgtgatgctgcacaacagcgagcaaggcgggcgggcttatcgccacgccatggaggagctacccgatacaatcgagacccttatgctgctggcgctcatcgccgttctgacgggcggggtgaccctgttcttcctctccggccggggtctgggcaagacgagcatcggcctgctgtgcgtgatggcctccagcgtcctattgtggatggcctcagtggagccgcattggatcgccgctagcattatcctcgagttctttctgatggtgcttctcattcccgagccggaccgtcagcggacgccccaggacaaccagctggcctacgtcgtgattgggctcctcttcatgatcctgaccgtggctgccaacgagatgggcctgctcgagaccaccaagaaggacctggggatcggccacgtcgccgtggagaaccaccaccacgcgacgatgctggacgtggacctccaccctgcctccgcctggaccctgtacgccgtcgccacaaccatcattacgccgatgatgcgccacaccatcgagaacaccaccgcgaacatcagcttaacggccatcgccaaccaggccgcaatcctgatggggctggacaagggctggccgatctccaagatggatattggcgtgcccctgctcgccttggggtgctactcacaggtgaacccgctgaccctcacagccgccgtcctgatgctggttgcccattacgcgatcatcggccccgggctccaagcgaaagccacacgggaagcccagaagcgcacagccgcgggtattatgaagaaccccaccgtggacggcatcgtcgccatcgacctggaccccgtggtgtacgacgccaagttcgagaagcaactgggccagataatgctcctgatcctgtgcacctcccagatactcttaatgcgcaccacatgggcactgtgcgagagcatcaccctagccaccggccccctgaccacgctgtgggaggggtccccgggcaagttctggaacaccacaatcgcggtcagcatggccaacatcttccgggggtcgtacctcgccggtgctggcctggctttcagcctgatgaaatctttaggagggggacgccgggggaccggggcgcagggcgagacgctgggcgagaagtggaagcgccaactgaaccaactcagcaagagcgagttcaacatctacaagcggtctgggatcatggaagttgaccgctctgaggcaaaagagggcctgaagcgcggggagaccacccgccatgcggtttcccgcggaaccgccaagctgcgttggttcgtggagcgcaacctggtgaagcccgaggggaaggtgatcgatcttggctgcgggagagggggctggagctactactgcgccgggttaaagaaagtcacggaagtgaagggatataccaagggcgggcccggccatgaggagcccatcccgatggccacctacgggtggaatctggtgaagctccactcgggcaaggacgtcttcttcacgccgcccgagaagtgcgacaccctgctgtgcgacatcggggagagctcccccaacccgaccattgaggagggtcggaccctccgcgtgctgaaaatggttgagccctggctgcgggggaaccagttctgcatcaagatcctaaacccctacatgccctcggtggtggaaacccttgagcagatgcagcgcaagcacggcggcatgctggtacggaacccgctctctcgcaacagcacccacgaaatgtactgggtctcctgcgggacgggcaacatcgtgagcgccgtgaatatgaccagccggatgttactgaaccgcttcaccatggcccaccgcaagcccacctacgagcgtgatgtcgacctcggggccggaacgcggcacgtggcggtggagcccgaggtcgccaacctggacatcatcggccaacgcatcgagaatatcaagcacgagcacaagtctacctggcactatgacgaggacaatccctacaagacctgggcctaccacgggagctacgaggtgaagccgagcgggtccgccagcagcatggtcaacggggtggtgaagctgttaaccaagccttgggacgtgatccccatggtgacgcaaatcgccatgaccgacaccacccccttcggccagcagcgcgtgttcaaggagaaagtcgacacgcggaccccgaaggcgaagcgcgggaccgcccagatcatggaggtgaccgcacggtggctatggggcttcctgtcccgcaacaagaagcccaggatatgcacgcgcgaggagttcacccgcaaagtgcgcagcaatgccgccatcggggcggtattcgtggacgaaaaccagtggaactccgccaaggaggccgtggaggacgagcgattctgggacctcgtccagaaggaacgtgagctgcacaagcagggcaagtgtgcgacctgcgtgtacaacatgatgggcaaacgtgagaaaaagctgggagagttcggtaaggcgaaggggagccgcgccatctggtacatgtggcttggcgcacgattcctggagttcgaggccttgggcttcatgaacgaagaccattggttttcccgcgagaacagcctctccggggtggagggcgaagggctgcacaaattgggctatatcctccgggacatcagcaaaatccccggcggcaatatgtacgccgacgacaccgcgggatgggatacgcgcataactgaagacgacctgcagaatgaggccaagatcaccgacatcatggagccggaacacgccctgctcgccacgtccatcttcaagctgacgtaccagaacaaggtcgtgcgggtgcagcgccccgccaagaacgggaccgtcatggacgtgatcagccgcagagaccagcgcggctccggccaggtgggcacctacggcctgaacacctttactaacatggaggcccagctcgtccgacagatggagagcgaggggatcttctccccctgcgagctcgagatccccaacctggccgaacgggtgctcgactggctggagaagtacggcgtggagcggctgaaacgcatggcgatcagcggggatgactgcgttgtgaaaccgatcgacgatcggttcgccaccgccctcaccgcgctgaacgacatgggaaaggtgcgcaaggacgtcccccagtgggagccctccaaggggtggaacgactggcagcaggtccccttctgcagccaccacttccaccaactgatcatgaaggacggccgggagatcgtggtcccgtgccggaaccaggatgagctcgtgggccgggcccgggtgtcccagggggccggttggagcctgcgggagaccgcctgcctgggcaagtcatacgctcagatgtggcagctcatgtacttccaccgacgggacctccgcctggcggccaacgctatctgctccgccgtccccgtggactgggtgcccacgagccggaccacctggtccatccacgcgcaccaccagtggatgacgacggaggacatgctcagcgtctggaaccgcgtgtggatcgaggagaacccctggatggaggacaagacccatgtgtcatcttggggcgacgtcccgtacctggggaaacgcgaagaccagtggtgcggctcactgatcggcctcaccgccagggccacctgggcctccaacatacaggtggccatcaaccaggtgcgccggctgataggcaacgagaactatctggactacatgacctccatgaagcgcttcaagaacgaaggcgaccccgagggggcgctctggtga

SEQ ID NO: 24179 - RNA, 9879 nt, synthetic construct
  misc_feature 1..9879: note = derived and/or modified CDS sequence (opt11) from DENV-1__FJ432745__SS-prME
  source 1..9879: mol_type = other RNA
tctgtcactatgctgctcatgctgatgccgaccgcactggccttccacctcaccaccagaggaggggaaccccacatggtggtgagcaagcaggaacggggcaagagcctgttattcaagacctcagcgggggtgaacatgtgcaccctcatcgcgatggacctgggcgagctgtgcgaggacactatgacctacaagtgcccccgaataaccgaggccgagccagacgacgtggactgctggtgcaacgcaacggacacctgggtgacttacgggacctgcagccagaccggggaacaccgccgcgacaagcgatctgtggccctcgcgcctcatgtcggcctgggtcttgagacgcggaccgagacctggatgagctccgagggcgcgtggaaacagatccagcgtgtggagacctgggcccttcgccacccgggcttcacggtgatagccctgttcctggcgcatgctatcgggactagcatcacccaaaagggtatcatattcattctcctgatgctggtcacacccagcatggccatgcggtgcgtgggcatcggtagccgcgattttgttgaagggctctcaggtgccacgtgggtcgacgtggtgctggagcacgggtcgtgcgtcacgactatggccaaggacaagccaaccctggacatcgagctcctcaagactgaggtaaccaaccctgccattttgcggaagctctgcatcgaggccaagatctccaataccaccacggacagccgctgcccaacccagggcgaggctaccttggtggaggagcaggacgccaactttgtgtgccggcgcacgttcgtcgacagggggtgggggaacggctgcgggctgttcggcaaggggtccttaatcacgtgcgccaagttcaagtgcgtcaccaagctggagggcaagatcgtccagtacgagaacctcaagtacagcgtgatcgtgaccgtgcacaccggtgatcagcaccaagtggggaacgagtccacggagcacggcacaaccgcgaccattacgccccaggccccaacgaccgagatccagctcaccgactacggggcgctgaccttggactgcagcccgagaacgggcttagatttcaacgagatggtcctgctgaccatgaaagagaaatcctggctcgtgcataagcagtggttccttgacttacctctcccctggacgagcggggccagcacctcacaggaaacgtggaatcgccaggacctgctggtgaccttcaagaccgcccacgcgaagaagcaggaggtcgtcgttctgggctcccaggagggggccatgcacaccgcgctgacgggggccactgaaatccaaacctccggcaccactaccattttcgcggggcacctgaaatgtcgtctcaagatggacaaacttaccctaaagggcatgtcatacgtcatgtgtaccgggtccttcaagctcgagaaggaggttgcggaaacgcagcacggcacggtcctcgtacagattaagtatgagggcaccgacgcgccctgcaagatacccttctcaacacaggacgagaagggggtaacccaaaacggccgactgatcaccgccaacccgatcgtgaccgacaaggaaaagccggtaaacatcgaagcggagccgccgttcggggagtcatacatcgtgattggcgcaggcgagaaggcgctgaaactcagctggttcaagaaggggtcatcgatcgggaagatgttcgaggccaccgcacgcggggcccggcgtatggccatattgggcgacacggcctgggacttcgggtcaatcggcggcgtgttcactagcgtcgggaagctagttcaccagatcttcggaaccgcctacggggtcctgttctcgggcgtcagctggaccatgaagatcggcctgggcgtgctgctcacgtggctaggcctgaacagtcgttccacctcactctcaatgacctgcattgccgtgggactggtcaccctgtatctcggcgtcatggtgcaagcagactccgggtgcgtcatcaattggaaggggcgggagttaaagtgcggcagcggcattttcgtgacgaacgaggtgcatacgtggaccgagcagtataaatttcaggcggatagcccgaagcgcctgtccgccgccataggcaaggcctgggaagagggagtctgcggcatacgctctgccacccggctagagaacgtgatgtggaagcagatcagtaatgaattgaaccacatcctgctagagaacgatatgaagttcaccgttgtggtgggggacgtggcgggaatattggcccaggggaaaaagatgatccggccccagcccatggaatacaagtacagctggaagtcctggggaaaggcaaagatcatcggcgccgacgtacagaacacgaccttcattatcgacggccccaacaccccggagtgtcccgatgaccagagggcgtggaacatctgggaggttgaggactacggattcgggattttcaccacgaacatctggctcaaacttcgagacagctacacccaagtgtgtgatcaccgcctgatgtccgccgcaatcaaggacagtaaggccgtccacgccgatatgggctattggatcgagtccgagaagaacgagacctggaagctggcgcgggcttccttcatcgaggtgaagacctgtatttggcccaagtcccacacactctggagcaacggcgttctggaatccgagatgatcatccccaagatttacggaggcccaatcagccagcacaattaccggcccggatatttcacccagaccgccggcccctggcaccttgggaaactggagcttgacttcgacctgtgcgagggcaccactgtcgtggtggacgagcactgcggcaaccggggaccgtccctccgcaccaccacagtcacgggtaagattatacacgagtggtgttgccgcagctgcacattaccgccccttcgcttccggggcgaggacggctgctggtatgggatggaaatcaggccggtgaaggagaaggaggagaaccttgtaaagagcatggtcagcgccggcagcggtgaggtggactccttcagcctggggctgctctgtatatccatcatgatagaagaagtaatgcggtcccgctggtcgcggaagatgttaatgaccggaacgctggcggtcttcctgctgctgatcatggggcagctcacgtggaacgacctgatccgcctgtgtatcatggtcggcgcgaacgccagcgatcgaatggggatgggcacgacctacctcgccctgatggccaccttcaagatgcggccgatgttcgccgttgggctcctgtttcgtcggcttacgtcaagggaagtactgttgctaaccatcgggttgagcctcgtggcgagcgtcgagctgccaaacagcttagaagaactcggcgatgggttggccatgggcatcatgatcctgaagctcctgacagactttcaatcgcaccaactgtgggccaccctcctgtctctgacattcatcaagaccaccttttcgctccactacgcctggaagacgatggcgatggttctgagcatcgtgtccctattcccgctctgccttagcacgacatcccagaagaccacatggctgcccgtcctcctgggcagcttagggtgcaagccgctcacgatgtttttaatcgcagagaacaaaatatggggcagacgctcctggcccctgaacgagggtatcatggcggtgggtatagtgagcatcctcctcagctccctgctcaagaacgacgtccccctggccgggcccctgatcgccggcggcatgttaatagcgtgctacgtgatcagcgggtccagtgcggacttatctctggagaaagccgcagaggtgtcgtgggaagaagaggccgaacattccggcgcgagtcacaacatcctcgtcgaggtgcaggacgacgggactatgaagatcaaggacgaggagcgtgacgacaccctgaccatcctgctcaaggccacgctgctggccgtgtcaggcgtttacccgctctcgatcccagccacgctgttcgtgtggtacttctggcagaaaaagaagcagcgttccggggtactatgggacacccccagcccgcctgaggtcgaacgggccgtgttagatgacggcatttaccgcattatgcagcggggcctcctcggaaggtcccaggtgggcgttggggttttccaggagaatgtgtttcacactatgtggcacgtcacacggggcgcggtgctgatgtaccaggggaagaggctcgagcccagctgggcatctgtgaagaaggacctgataagctatggaggcggatggcggctgcagggctcctggaacacgggggaagaggtccaggttatcgccgtggagcccggcaagaaccccaagaacgttcagacggctccggggaccttcaagacgccggagggcgaggtgggcgccatagcgctcgacttcaagcccgggacgagcggctctcccatcgtgaaccgagaggggaagatagtgggcctgtacggcaacggggtggtgaccaccagcggcacctacgtcagcgccatcgcccaggccaaagcgtcccaggaggggccgctgcccgaaattgaggacgaagtgttccggaagcgcaatctcacgattatggacctgcatcccggctccgggaagacccggcgctatctgcctgccatcgtgcgggaggccattaagcgcaagctgagaacactgatactcgccccgacccgagtcgtggccagtgaaatggcggaggccctcaagggtatgccaatccgctatcagacgacggccgtcaagtctgagcacaccggcaaggagatcgtcgacctgatgtgccacgccacgtttacaatgcgattactgtcccctgtgcgcgtgccgaactataacatgatcatcatggatgaggctcacttcaccgacccctcgtccatcgcggcccgggggtacatcagcacaagggtaggcatgggggaagccgccgccatcttcatgaccgcaacgccgcccggctcagtagaggcctttccgcagtcaaacgccgtgatccaggacgaggagagggacattcccgaacggtcctggaacagcgggtatgagtggatcacggatttccccggcaagaccgtctggttcgtgccctctatcaagtctggcaacgacatagccaattgtctgcggaagaacgggaagcgcgtgatacagctctcgcggaagaccttcgacacggagtatcagaagaccaagaacaacgactgggactatgtcgtaaccacagacattagtgagatgggggcgaacttccgagccgaccgagttatcgatccgaggcggtgcttaaagcccgtcatactgaaggacgggcccgagcgcgtgatcctggccggccccatgccggtcactgttgcctccgccgcgcagcggcgcgggagaatcggccgcaaccacaacaaagagggcgaccagtacatttacatggggcagcccttgaataacgatgaggatcacgcccactggacagaggccaagatgcttctggacaacatcaataccccggaagggataatccccgccttattcgagccagagcgcgagaaatccgccgcgattgacggggagtaccggctgcgcggcgaggcccggaagaccttcgttgagctgatgcgccgcggggacttacccgtctggctgagctacaaagtcgccagcgagggcttccagtacagcgacagaagatggtgcttcgacggagagcgcaacaaccaggtcctggaggagaacatggacgtcgagatctggacgaaggagggggagagaaagaagctccgcccccgttggctggacgcaagaacgtattctgacccgctcgcccttcgggagttcaaggagttcgcggctggccgccggagcgtctccggagatctgattctggagatcggcaaattaccccagcatttgacccagcgcgcgcagaatgccctcgataatctagtcatgctgcataacagcgaacaaggcgggcgggcgtacaggcacgccatggaggagttgccagacaccatcgagaccctgatgctactggctctcatcgccgtcctgacaggaggggttactctatttttcctctccggccggggactaggcaagacaagcataggcttactctgtgtgatggcttcctcagttctgctatggatggcgtcggtggaaccccactggatagccgccagcatcatcctcgagttcttcctgatggtgctgctaattcccgagccggaccggcagcggactccccaggacaaccagctggcttatgtcgtgatcggcctgctgttcatgatcctgaccgtagcagcaaacgaaatgggcctcctcgaaaccaccaagaaggaccttggcatcggccacgccgcggtgggaaaccaccaccacgcagccatgctggacgtggacctccaccccgcgtccgcttggacgttgtacgccgtggcaacaaccatcatcaccccgatgatgcgccacaccatagagaacacgacggcaaacatcagcctgaccgcgatcgccaaccaggccgccatcctcatgggcctggacaaaggctggcccatttccaaaatggacatcggagtccccctactcgcgctagggtgttacagccaggtaaatccactgacgctcacggcggcggtactgatgctggtcgcccactacgccatcattgggccgggcctacaggcgaaggccaccagagaggcccagaaacggaccgccgccggcatcatgaagaaccccaccgtggacggcatcgtggcgatcgatctggaccccgtcgtctacgacgccaagttcgagaaacagctgggccagataatgctcctgatcctttgcacgagtcaaatcctcctgatgcgcaccacctgggccctgtgcgagagcatcaccctagccacggggccccttaccacactgtgggagggctccccggggaagttctggaacaccacaatagccgtatcaatggccaacatcttccggggatcctacctagcgggcgccgggctggcattcagcctgatgaaatccttgggcggcggccgtcgggggaccggcgcccagggcgagaccctgggggagaagtggaagcgccagctgaaccagctgtccaagtcagagttcaacacctacaagcggagtggcatcatggaggttgatcgcagcgaagccaaggaggggctgaagcggggcgaaacgaccaagcacgccgtctcccgcgggaccgccaagctgcggtggttcgtggagcgcaatttagtcaagcccgagggcaaggtcatagacctcggttgcggtcggggcggctggagttactactgcgccggcctgaagaaggtgaccgaggtaaaggggtacacgaagggcggccccggccacgaggagcccataccgatggctacttacgggtggaacctggtgaagctccactccgggaaggacgtgttcttcatccctcccgaaaagtgcgacaccctcctgtgcgacatcggcgagtccagccccaatccgaccatcgaggaggggcgcaccctccgggtcctcaagatggtcgagccctggctgcggggcaaccaattttgtatcaaaattctcaacccatacatgcccagcgtggttgagaccctggagcagatgcagcggaaacacggagggatgctggtccgcaacccgctttcccggaactcaacccacgagatgtactgggtgtcctgcggcaccgggaatatcgtgagcgcagtgaacatgacgtcacgcatgctgctcaatcgcttcacgatggcccacaggaagcccacatatgagcgcgatgtcgatctcggtgccggcaccagacacgtcgccgtggagccggaggtggccaacctggacatcatcgggcagcgcatcgaaaacatcaagcacgagcataagagcacttggcactacgacgaagacaatccctacaagacgtgggcctaccacggctcctacgaagtaaagccgagcgggtccgctagtagcatggttaatggcgtcgttaagctgctcaccaaaccatgggacgtcattcccatggtaacccagatcgccatgaccgatacgacccccttcgggcagcagcgggttttcaaggagaaggtggacacccgcacgcctaaggccaagcggggcacggcacagattatggaggttaccgccaagtggctatggggcttcctctcccgcaataagaagccccggatctgcacccgcgaggagttcacccgcaaggtacgcagcaacgccgccatcggggcggtgtttgtcgacgagaaccagtggaactccgctaaggaggccgtggaggacgagagattctgggaccttgtgcaccgcgagcgggagttacacaagcaaggcaagtgcgcgacgtgcgtctacaacatgatggggaagcgcgagaagaaacttggcgagtttgggaaggccaagggctctcgggcgatctggtacatgtggctaggtgccaggtttctcgagtttgaggccctggggttcatgaacgaagatcactggttctcccgggagaacagcttgtcaggagtggagggggaagggctgcacaaacttggctacatcctccgcgacatcagcaaaatcccagggggcaacatgtatgccgacgacacagccgggtgggacacccgcattaccgaggatgatctgcagaatgaagcgcgcattacggacatcatggaaccggagcatgcccttttggccaagtccatcttcaagctgacttaccaaaacaaggtggttcgcgtgcagcggcccgccaagaatggcaccgtgatggacgtcatcagccgccgggatcaacgcgggtccggtcaggtgggcacgtacggactgaacacgttcactaacatggaagcccaactcatccggcagatggagagcgagggaatattctcccccagcgaattggagacccccaacctggcggagcgcgtcctcgactggctcgaaaaatacggggtcgagcgactgaagcgcatggccatctccggcgatgactgcgtggtgaagccgattgacgaccggttcgccaccgctctcacggctctgaacgatatggggaaagtccgcaaggacataccccagtgggagccctcgaagggctggaacgactggcagcaggtccctttctgctcacaccacttccaccagctgatcatgaaggacggtcgggagatcgtggtcccttgccgtaaccaggacgaactcgtggggcgggcgcgcgtgagtcagggcgcagggtggtcactgcgggagaccgcctgcctgggaaagagctatgcccagatgtggcaactcatgtatttccaccgccgggacctgcgcctggcggccaacgccatctgctccgccgttcccgtagactggatcccgaccagccgcaccacatggagcatccacgctcatcaccagtggatgaccaccgaagatatgctctccgtgtggaaccgcgtttggatcgaagagaatccctggatggaggacaagacccacatctcatcctggggcgacgtgccctacctggggaagcgagaggaccagtggtgcggcagcctgattggtctaacggcgcgggccacatgggccaccaacatccaggtggcaatcaaccaggtccgccggctgataggcaatgagaactacctggactacatgacatccatgaaaaggttcaagaatgagagcgatccggagggtgccctctggtaa

SEQ ID NO: 24180 - RNA, 9879 nt, synthetic construct
  misc_feature 1..9879: note = derived and/or modified CDS sequence (opt11) from DENV-1__FJ432746__SS-prME
  source 1..9879: mol_type = other RNA
agcgttaccatgctgctgatgctcatgcccaccgcgctagcattccatctcacgacccgcggcggggaaccccacatgatagtgagcaaacaggagcggggcaaatccttactgttcaagacctcagcgggggtgaacatgtgcacccttatcgccatggacctgggcgagttctgcgaggacacgatgacgtacaagtgcccgcgcatcactgaagctgagccggacgacgtggactgctggtgcaatgcaaccgacacctgggtgacctatggtacctgtagccagaccggggagcaccggcgcgacaaacgctccgtggccttggcaccccacgtgggcctcgggctggagacgcgtacagagacttggatgagctccgagggggcctggaagcagatccagcgcgttgagacctgggccctccgccaccccggtttcacggtgatagcactcttcctggcgcacgccattggcaccagcatcactcaaaaggggattatattcattcttctcatgctagtgaccccctccatggccatgcggtgcgtcggtatcgggtcacgagacttcgtggagggtctgtccggcgccacctgggtcgatgtcgtcctcgagcacggtagctgcgtgactaccatggccaaggacaagcccacgctggacattgaactgctgaagaccgaggtcaccaaccccgcggtgctgagaaagctgtgcattgaggcaaagatctccaacactaccaccgacagccgctgcccgacccagggggaggccaccctcgtagaggagcaggacgccaacttcgtctgccggcgcaccttcgtggaccggggctggggtaacggctgcgggctgttcggcaaggggtcattgatcacgtgcgccaagttcaaatgtgtgaccaagttggagggcaagatcgttcagtatgagaacctgaagtacagcgtgatcgttaccgtccacacgggcgatcagcaccaggtgggaaacgagtccacggagcacggcactaccgcgacaattacgccccaagccccctccaccgagattcaactgacggactacggggctttaaccctggactgctctccccgcaccggcctagacttcaacgagatggtgctcctgacgatgaaggaaaagtcctggctggtgcacaagcagtggttcttggacctgccgctgccgtggacctcaggggcctccaccagccaggagacctggaacagacaggacctccttgtgacgttcaagactgcccacgcgaagaaacaggaggtggtggtcctaggctcccaggagggggccatgcacacggccttgaccggggccacggagatccagacaagcgggactaccacgatcttcgctgggcacctgaagtgccgcttaaaaatggataaactgaccttaaagggaatgtcctacgtcatgtgcaccgggagcttcaaactggagaaggaggtggccgagacacagcacggaaccgttctcgtccagatcaagtacgagggcaccgacgcaccctgtaagatccccttctccacccaggacgaaaagggggtgacccagaatgggcggttgatcacggccaacccgattgttacggataaagaaaagccggtcaacatcgaggccgagccgccctttggggagagctacatcgtgataggcgccggcgaaaaggcactgaagctgtcctggttcaagaagggatcttccataggaaaaatgttcgaggcaactgccaggggcgcccggcgcatggcgatcctcggggacacggcctgggacttcgggagcatcggcggcgtattcacttccgtcggtaagctggtgcaccagatattcggcaccgcttacggggtactgttcagcggcgtgtcgtggaccatgaagatcggaattggcgtactcctcacctggctgggcctcaacagccgctccacctcactatccatgacgtgcatcgccgtggggctagtcaccctctatctgggcgtgatggtgcaggcagatagcggatgcgtcatcaactggaagggtcgggagctgaagtgcgggagcggcatcttcgtgaccaacgaggtccacacgtggaccgagcagtacaaatttcaggcggactctccgaagcgcctcagtgccgccataggcaaggcctgggaggagggggtctgcgggatccggtccgccacccgcctagaaaacatcatgtggaaacagatcagcaacgagcttaattacatcctgctggagaacgacatgaagctgaccgttgtcgtgggggacgtggcgggcatcctcgcacaggggaagaaaatgatccggccccaacccatggagtacaagtacagttggaagtcatggggcaaggccaagatcatcggagccgacgttcagaacacgacgttcataatcgacgggcctaatacaccggagtgtccagacgaccagcgcgcgtggaacatttgggaagtggaggactacggcttcggaatcttcaccacgaacatatggctgaaactgcgggactcctatacccaggtgtgcgaccatcgccttatgagcgccgccatcaaagacaccaaggccgtgcatgcagacatgggctactggatcgaaagcgaaaagaatgagacttggaagctggcacgggccagctttatcgaggtcaagacctgcatctggcccaagtcacacacgctgtggtctaacggggtgctcgagtcagaaatgatcatccccaagatctacgggggacctattagccagcacaactatagaccagggtacttcacccaaactgccggcccttggcatttagggaagctcgaactcgatttcgacctgtgcgagggcaccacggtggtagtagacgagcactgcggcaaccgggggcccagcctgcgcaccaccaccgtgacgggcaaaatcatccatgagtggtgttgccggagctgtaccttgccgcctctccgtttcaagggggaggacggctgttggtacgggatggagattcggcccgtgaaggagaaggaggaaaatttagtgaagtccatggtctcagccggcagcggcgaggtcgactccttcagcctcggcctgctgtgcatctccatcatgatagaggaggttatgcgctcccgttggtccagaaagatgctcatgaccggtactctggccgtgttcttcctgctcataatgggtcaactcacgtggaacgacctgatccggctctgcataatggtcggcgcgaacgcgagcgatcgcatggggatgggtaccacctacctggctctgatggccaccttcaagatgcgaccaatgttcgccgtgggccttctgttccgccgcttaacgtcccgggaggtattgctactgaccatcgggttgagcttggtcgcaagcgtcgagctgcccaactctctggaagaactgggcgacgggctggccatgggcatcatgatactaaagctgctgaccgacttccagtcccaccagctctgggccacgctgctctcactcaccttcgtccgcaccaccttcagtctgcattacgcctggaagaccatggccatggtgttgagcattgtgtcattattccccctgtgcctctccactacctctcagaagacaacctggttacccgtcttactgggcagcctcgggtgcaaaccgctgacgatgttcctgatcgccgaaaacaagatttggggcagaaagtcctggcccctaaacgaggggatcatggccgtggggatcgtgagcatcctgctgagctcgctcctgaaaaacgacgttcccttggcgggtcccctcattgctggcggtatgctcatcgcgtgctacgtgattagcgggtccagcgcggacctgtcactcgagaaagccgccgttgtcagctgggaggaagaagccgaacacagcggcgcgagccacaacatcctggttgaagtgcaggacgacgggactatgaagatcaaggacgaggagcgcgatgacacactgaccatcctccttaaggccaccctgctcgccgtatccggcgtgtacccgctgtctatccctgcgaccctgtttgtttggtacttctggcagaagaagaagcagcggtcaggcgtcctctgggacaccccctcaccgccggaggtagagcgcgccgtgttagacgacggcatataccggatcatgcaacgcggactgctggggaggtcccaggtcggcgtgggggtgttccaggaaaatgtcttccacaccatgtggcatgtgacccgcggcgcggttctcatgtaccaggggaagaggctggagcccagctgggcctccgtgaaaaaggacctgatcagctatggcggcgggtggcgcctccagggctcatggaacacaggcgaggaggtccaggtcattgcggtggagccgggcaaaaaccccaagaacgttcagaccgcccccgggaccttcaagaccagcgaaggcgaggtgggcgcaatcgcacttgacttcaagcctgggacgtccggcagccccatcgtcaaccgggaaggaaagatcgtgggcctctacggcaacggggtggtcactacctcgggcacctacgtctccgccatagcacaggcgaaggcgtcgcaggagggacccctccctgaaatagaggacgaggtgttccgcaagcggaacctgacgatcatggatctacatcccggctcagggaaaacgagacgctacctcccagccattgtccgtgaggcaatcaagcgcaaacttcgcacactgatccttgcccccaccagggtggtggccagcgaaatggcggaggcgttgaagggcatgcctatccgataccagactaccgcggtcaagtccgagcacaccggcaaagagatcgtggacctgatgtgccatgccacctttacgatgcgcttactcagcccagtgcgggtgcccaactacaatatgatcataatggacgaggcccactttaccgacccctccagcatagcggcccgcgggtacataagcacccgggtgggcatgggggaggctgccgccatatttatgacagctacgccgccaggctctgtggaggccttcccccaatccaacgccgtcatccaggatgaggaacgcgacataccggagcgtagctggaactccggttacgagtggattactgatttccccggcaaaaccgtatggttcgtgcccagtatcaagtccggcaacgacatcgccaattgcctgaggaagaacgggaagcgtgtcattcaactcagcagaaagaccttcgacacggagtaccagaaaaccaagaataatgattgggactacgttgtaactactgacatctccgaaatgggagcgaacttccgggccgaccgcgtaatcgacccccggcgctgcctgaagccggtgatcctgaaggacgggcccgagcgggtcatcctcgcaggccccatgcccgtgaccgtggcgagcgccgcgcagcgcagggggaggatcggtcggaaccacaataaggagggcgaccagtatatctacatggggcagccgctgaataacgacgaagatcacgcccactggaccgaggccaaaatgctgctcgataacatcaatacccccgaaggcatcatccccgccctgttcgagcccgagcgcgagaagtccgccgcgatcgacggggagtatcgcctgcggggcgaggcccgcaagaccttcgtcgagctcatgcggcgcggagacctgccggtgtggctgagctacaaggtggccagcgagggcttccagtactccgaccggcgctggtgcttcgacggtgagcggaacaatcaggtactcgaggaaaacatggacgtggagatctggacgaaggaaggggagcgcaagaaactacggccccgctggctcgacgcccggacctacagcgatcccctagcgcttcgcgagttcaaggagttcgcggccggccggcggtccgtaagcggagacctgatcctcgaaatcggcaagctcccccagcacctaacccagcgcgcccagaatgccctcgacaacctcgtgatgctgcacaactccgaacaaggcgggagggcgtaccggcatgccatggaagaactcccggacaccatcgaaaccctgatgctgttagccctaatcgccgttctgaccggcggggtgaccctcttcttcttgagcggccgcggcctggggaagacatctatcggcttattgtgcgtaatggccagctcagtgctgctatggatggcaagcgtggagccccattggatcgccgcctccatcatcctagagtttttcctgatggtcctcctgatccccgagcctgaccgccagagaaccccgcaggacaaccagcttgcctatgtggtcatcgggctcctgttcatgatcctgacggtggccgcgaacgagatgggcctcttagagaccactaaaaaggacctggggatcgggcatgtggccgtggagaatcatcatcacgccgccatgctagacgtcgacctgcaccccgccagcgcatggaccctgtacgccgtggccacgaccatcattacccccatgatgcggcacaccatagagaatacgaccgctaatatctccctcaccgcaatagcgaaccaagccgccatcctgatggggttggacaaaggatggccgatcagcaagatggacataggcgtgcccctcctggccctggggtgctactcccaggtcaatccgctaacccttacggcggcagtgctgatgctcgtggcccactacgctattatcggacccgggctgcaggccaaggcgactcgtgaggcgcaaaaacgcaccgccgccggcatcatgaaaaatccgacggtagacgggatagtggcgatcgacctggatcccgtggtctacgacgcgaagtttgagaagcaactcggccagatcatgctgctgatcctctgtaccagccaaatcctattaatgcggacgacctgggcattgtgcgagtccataaccctggccacgggccccttgaccaccctatgggaggggagcccgggcaagttctggaacacaacgatcgccgtgtccatggccaacatctttcgcgggtcctacctggcgggcgcgggcctggccttcagcctcatgaagtcactcgggggcgggcggcgcgggaccggggcgcaaggcgagactctgggcgagaagtggaaacggcagctcaaccagcttagcaagtccgagtttaacacctataagcgcagcgggatcatggaggtcgaccggtccgaggcgaaggagggcctgaaacgcggggagacaaccaagcacgccgtcagccgaggcaccgccaagctccgttggttcgtggagagaaacctggtgaagccggaggggaaggtaatcgacctgggctgcgggcgcggcggctggtcttactactgtgccgggctgaagaaggtgaccgaggtgaaggggtatacgaaaggagggcccggtcacgaggagcccatccccatggccacatacgggtggaatctcgtaaagctgcactcgggcaaggacgtgttcttcatcccgcccgagaagtgcgacactctgctctgcgacatcggtgagtccagcccaaaccccaccatcgaggagggccgcacgctgcgcgtcctcaagatggttgaaccgtggctccggggcaatcagttctgcataaagatcctgaatccctacatgccctccgtggtggagaccctggaacagatgcagcgtaagcacggaggcatgctcgtacgtaaccccctgtctcgcaattccacccacgagatgtactgggtgagctgcgggaccggcaatatcgtatccgcggttaacatgaccagccggatgctgttgaaccgcttcacgatggcccaccggaagccgacgtacgaacgtgatgtggacctgggggccgggacacgccacgtggccgtcgagccagaggtagctaacttggacatcattggccaacggatcgagaacatcaaacacgagcacaagtccacctggcactatgatgaggacaacccttacaagacatgggcgtaccacggcagctacgaggtcaagccctccggtagtgcctcttccatggtgaacggcgttgtcaagctcctgacgaaaccatgggacgtgatccccatggtgactcaaatcgccatgacggataccacccccttcggccaacagcgcgtcttcaaggagaaggttgatacacggacccccaaagccaagaggggaacggcccagatcatggaggtgacggccaagtggctgtggggcttcctctcccggaacaaaaagccacgcatctgcactagggaggagttcacccgcaaggtccgttccaatgctgccatcggcgccgtcttcgtggatgaaaaccagtggaacagcgcgaaagaggccgttgaggacgagcgcttctgggacctagtgcaccgggagagagagctacacaagcagggaaagtgcgccacgtgcgtgtataacatgatgggtaaacgggagaaaaagctcggcgagttcggcaaagccaaggggtcccgcgccatctggtacatgtggctgggcgcgcggtttttagagtttgaggccctcggcttcatgaacgaggaccactggttcagccgggaaaactccctgagcggcgtcgaaggagaggggcttcacaagttgggctacatcctgcgggacatctcaaaaatccccgggggcaacatgtacgccgacgataccgccggatgggacacccgcatcaccgaggacgacttacagaacgaggccaaaatcacagatatcatggagcccgaacacgcgttactagcaaagagcatcttcaagctgacctaccagaacaaggtagtccgggtccagcgcccagcgaagaacggcaccgtgatggacgtgatctcccgcagagaccaaaggggaagcggacaggtcggtacctacggcttgaacacgttcacaaatatggaggcacagctgatacgtcaaatggagtccgaagggatattcagcccgtccgagttagagacccccaacctcgccggccgcgttctggactggctggagaagcacggggtcgagcggctcaagcgcatggcgatctcaggcgacgactgtgtcgtaaagccgatcgacgaccggttcgccaccgccctgacggcgctgaatgacatgggaaaggtgaggaaggacatcccgcaatgggagccttccaagggctggaacgactggcaacaagtcccgttctgttcacaccacttccaccagctcatcatgaaggacggtcgggaaatcgtcgtgccctgccggaatcaggacgagctggtcgggcgggcccgcgtgagccaaggcgcgggctggtccctgcgggagaccgcctgcctgggtaagagctatgcccagatgtggcagctgatgtacttccaccgccgggacttacgcctcgccgcgaacgccatctgttccgccgtgccggtcgactgggtgcccaccagccggaccacgtggtccatacacgcccaccaccagtggatgaccaccgaggacatgctgagcgtgtggaatagggtctggatcgaggagaacccctggatggaagacaagacccacatctccagctggggcgacgtgccctacctgggcaagcgggaggaccagtggtgtggcagcctcatcgggctgacggctcgcgccacgtgggccaccaacatccaagtcgccatcaaccaggtccggcgactcctcggcaacgagaactacctggactacatgaccagcatgaagcgcttcaagaacgaaagtgacccggagggggccctgtggtaa

SEQ ID NO: 24181 - RNA, 9879 nt, synthetic construct
  misc_feature 1..9879: note = derived and/or modified CDS sequence (opt11) from DENV-1__FJ432748__SS-prME
  source 1..9879: mol_type = other RNA
agtgtgaccatgctccttatgcttatgcccacggccctcgcattccacctcaccactcggggcggagaaccccacatgattgtgagcaagcaagaacgaggcaagagcctgttattcaagacaagtgccggggtgaatatgtgcactctgatagccatggacctcggggagctgtgcgaagacactatgacctataagtgccccaggatcaccgaaaccgagcccgacgacgtagactgctggtgcaacgccacggacacatgggtgacctacggaacctgcagccagacgggagagcaccggcgcgacaagcggtctgtggcactcgcaccccatgtgggcctgggtctggagacccggaccgagacatggatgtcgtccgagggcgcgtggaaacaaatccagcgggtcgagacgtgggccctccgccaccccgggttcaccgtgatcgccctgtttcttgcccacgcaataggaacatcgatcacccaaaaggggatcattttcattctcctgatgttggttactccctccatggccatgcggtgcgtcggcatcggctctcgtgactttgtggaagggctctccggcgccacttgggtcgatgtcgtactggagcacggaagctgtgtgactaccatggccaaggataagccgacgttggacattgaattgctgaagaccgaggtcaccaaccccgcagtgctacgtaagctatgtatcgaggcgaagatatccaacaccacgactgacagccgctgtccgactcagggcgaggcgacgctggtggaggagcaggatgcgaattttgtctgccggcgcacgtttgtggaccggggctgggggaacggatgcggtctgttcggcaaagggtccctaatcacgtgcgccaagttcaagtgtgtgaccaaactggagggcaagatcgtgcagtatgaaaacctgaaatacagcgtcatcgtcaccgtgcacacgggcgaccaacaccaggtggggaatgaatccaccgagcacggtacgacagccaccatcacgccccaggcgcccaccaccgaaatacagcttaccgactacggtgctctgacgcttgactgctcgccccgcaccgggctcgacttcaacgagatggtcctacttacgatgaaggaaaagtcgtggctcgtccacaagcaatggttcctggacctgccgctcccctggaccagcggcgcctccaccagccaagaaacgtggaaccgccaggacctgctggtgacgttcaagaccgctcacgccaagaagcaggaggtcgtagtgttgggcagccaagagggggcgatgcatacggccctgaccggggctacagagatacagacgtccggaacgaccacaatcttcgctgggcacctgaagtgccgcttaaagatggacaagctgaccctgaagggcatgtcctacgtcatgtgcacgggctccttcaagctcgaaaaggaggttgctgagacccagcacggtacagtgctggtacagatcaagtacgaaggcaccgacgcgccctgcaaggtgccattcagcacgcaggacgagaagggggtgacgcagaacggccgcctaattactgccaaccccattgtcacggacaaggaaaagcccgttaacatcgaagcggagccgcccttcggggagtcctacatcgtgatcggtgccggtgagaaggcgctgaaactcagctggtttaagaaggggtcaagcattggcaagatgttcgaggccacggcccgcggggctcgacgcatggccatcctgggcgacaccgcctgggactttgggtccatcggcggcgtcttcacgagcgtggggaagttggtgcatcagatcttcggcacagcctacggggtcctcttttccggagtcagctggacgatgaagatcgggatcggcgtactgctcacctggctcggcctgaactctcgaagcacctccttaagcatgacctgcatcgccgtcgggttagtcacgctgtacctcggcgtgatggttcaagccgactccgggtgcgtgatcaattggaaagggcgtgagctcaagtgcgggagcggcatcttcgtgaccaacgaggtccacacctggactgagcagtataagttccaagccgacagcccgaagcgcctgtccgcggccatcggaaaggcgtgggaggagggggtgtgcgggatccggagcgccacccgactggagaatatcatgtggaagcagatatccaacgaactcaatcatatcttactggagaacgacatgaagtttacagtagtcgttggcgacgtggccggcatcctcgcgcaggggaagaaaatgatcaggccacagcccatggagtacaagtacagctggaagtcctgggggaaagccaaaataatcggcgcggacgtccagaataccaccttcatcatcgacgggcccaacacgccggagtgccccgacgaccagcgcgcctggaacatctgggaagtggaggattatggcttcgggattttcaccaccaacatctggctgaagctgcgcgattcttacacccaagtctgcgaccacaggctcatgtccgcggccatcaaagacagcaaagccgtccatgccgacatggggtactggatcgagtccgagaagaatgaaacctggaagctggcgagagccagcttcatcgaagtgaagacgtgcatctggcccaagtcccacaccttgtggagcaacggcgtgctggagagtgagatgatcattcccaagatctacgggggcccgattagtcaacacaactacagacccgggtactttacccaggcagccggcccgtggcacctggggaagctggagctcgacttcgacttatgtgagggtaccaccgtcgtggtagatgagcactgcggcaaccgggggccgtcactgaggaccaccacagtcacgggcaagataatccacgagtggtgctgccgcagctgcaccctgccccctctccgattcaagggcgaggatggatgctggtacggaatggaaattcggcctgtaaaggagaaggaagagaatcttgtgaagtccatggtcagcgctggcagcggtgaggtggattccttctcactcgggctcctgtgcatctccatcatgatcgaagaggtgatgcgctcaaggtggtccaggcgcatgctcatgaccggcaccctcgccgtattctttctgttaatcatgggccagctaacttggaatgacctgattcgactctgcatcatggtgggcgcaaatgccagcgaccgcatggggatgggcacgacctacctggccctgatggcaaccttcaagatgcggccaatgttcgcggtaggactgctgttccgccgactgacgtcccgcgaggtactcctgctgaccatcgggctcagcctggtggcgtccgtcgagctgccaaacagtctcgaagaactgggcgacggcctggccatgggtatcatgatcttaaagctgctgaccgacttccagtcccaccagctatgggccaccctgctgagcctcacctttataaagacgaccttctcgctgcactatgcttggaaaaccatggcgatggtgctatctatcgtgagtctgtttccgctgtgcctgagcacgacctctcagaagacgacttggcttcccgtcctgctgggaagcctcggatgtaaacccctgacaatgtttctcatagccgaaaacaagatttggggccggcgctcctggcccctcaacgaggggattatggcggtgggcatcgtgagcatcctgctgagctccctcctgaagaacgacgtccccctggctggtcccctcatagctggtggcatgctaatcgcgtgctacgtgatcagcgggtcctccgccgacctgtccctcgagaaagccgccgaggtgtcttgggaggaagaggcagagcacagtggggcatcgcataacatactggtggaagtgcaggacgacgggaccatgaagataaaagacgaagaacgagacgacaccctgaccatcctattgaaggccacccttctcgccgtatccggcgtctacccgctgagcattcccgccacgctgttcgtgtggtacttctggcagaaaaagaagcagcgctcaggggtcctctgggacacccccagcccgcccgaggtggagcgtgcagtgctggacgacggtatctaccgcatcatgcagcggggcctactggggcgctcgcaagtgggcgtcggggtgttccaggagaacgttttccacaccatgtggcatgtcacccgcggggcagttctcatgtaccaggggaagcgcctggagcccagctgggccagcgtgaagaaagaccttatcagctacggcggcggttggcggttgcagggctcgtggaacacgggggaggaggtccaggtcatcgctgtggaacctggcaagaaccctaagaacgtccagaccgccccggggaccttcaagaccccagaaggagaggtgggtgccattgccctcgatttcaagccgggaacgtcgggctcccccatcgtgaatcgggaaggcaagatcgtcggcctgtacggcaacggggttgtgactaccagcggcacatacgtcagcgccattgcccaggctaaggcgtcccaagagggaccgctccccgagatcgaggacgaggtcttccgcaaacgcaacctgacgatcatggatctgcaccccggttccgggaagacccggcgctacctcccggcgattgtgcgggaggcgatcaagcgcaagctgcgaaccctaatactggcccctacacgggtcgtcgcctccgagatggcggaggccctgaagggcatgcccatcagatatcaaacaaccgccgtcaagagtgagcatacgggcaaggagattgtcgacctgatgtgccatgcgacctttacgatgcggctcctgtcccctgtgcgcgtgccgaactacaacatgatcatcatggacgaggcccatttcaccgaccctagctccatcgcggcaagggggtacatctcaacccgcgtcggcatgggggaagccgctgcaatcttcatgaccgctaccccgcccggctcagtggaggcctttccgcagtcgaacgccgtgatccaggacgaggaacgggacattcccgaaaggtcctggaactctgggtatgagtggatcaccgacttccccggcaaaaccgtctggttcgtgccctccatcaagagcggcaacgacatcgccaactgccttcgaaagaatgggaagcgcgtcatccagctctcccggaagaccttcgatacggagtaccagaagaccaagaacaacgactgggactacgtggtgaccaccgacatctctgaaatgggcgccaacttccgcgccgaccgggtgatcgacccacggcgctgcctaaagcccgtcatcctaaaggatggacctgagcgcgtaatcctggcgggcccgatgcccgtcacggtggcctcagccgcgcaacggcgcgggcggatcggccggaatcacaataaagagggcgatcagtacatctatatgggacagcctctcaataacgacgaggatcatgcccattggactgaggctaagatgttactcgacaacatcaacacccccgaaggcatcatccccgccttattcgaaccggagcgcgaaaaatctgcggcgatcgacggagagtaccggttgcgcggcgaggccaggaagaccttcgttgaactcatgaggagaggggatttacccgtctggctatcctacaaagttgcctcagaaggcttccaatacagcgacaggcggtggtgtttcgacggcgagcggaacaaccaggtactcgaggaaaatatggacgtcgaaatttggacgaaggagggcgagcggaagaagctccgcccccggtggctagacgccaggacatacagtgaccccctcgccctgcgtgagttcaaggagttcgcggccggccgccggagcgtgtccggggacctgatcctcgagatcggcaaactaccgcagcacctaacccagcgggcccagaacgccctcgacaacctggtgatgctgcacaacagcgagcaaggcggacgggcgtaccgccatgccatggaggaactccccgacaccattgagacgctaatgctcctcgcactgatcgcggtgctgacgggcggcgtgacgttattctttctgtccggcagagggctgggtaagacctccataggcctcctttgcgtgatggcgtccagcgtgttactctggatggcgtccgtggagccccactggattgctgcgagcatcattttggagttcttcctgatggtgctcctgatccccgagcccgaccgccaaaggacgccccaggacaaccagctggcctacgtcgtaataggcctactcttcatgatcttgacggtggcagcgaacgagatggggctcctggagaccaccaagaaggatttagggatcggccatgtagcagtagagaaccaccaccacgccgctatgctcgacgtagatttacatcctgcctccgcgtggaccctgtacgcagtcgcgacgaccatcatcacccccatgatgagacacaccatagagaatacgaccgccaacatctcactaaccgcgatagcgaaccaggccgccatcttgatggggcttgacaagggttggcccatttcaaagatggacatcggcgtgcccctcttggccctgggctgctacagccaagtcaaccctctaaccttaacggcggcggtgcttatgctagtggcccattatgcgattatcggcccgggtctgcaagcaaaggccacccgcgaggctcagaagcggaccgccgctggcattatgaagaaccccaccgttgacgggatcgtggcaatcgacctggatcccgtggtgtacgacgcgaagttcgagaagcagctcggacagatcatgttactgatactctgcacgagtcagatccttctgatgcgcaccacttgggccttgtgcgaaagcataaccttggctacgggccccctgacaaccctctgggaagggtccccaggcaaattctggaacaccactatcgccgtcagcatggcgaacatctttcggggatcctatctcgcgggcgccggcctggcatttagcctcatgaagtccctcgggggcgggagacgggggacgggggcccaaggcgagactctgggcgagaagtggaagcgccagctcaaccagcttagtaagagcgagtttaacacctacaagcggtccgggattatggaggtggatcgcagtgaggcgaaggagggactgaagcgcggggagacgaccaaacatgccgtgtcgcgcggaaccgcgaagctcaggtggttcgttgagcgtaacctggtgaagcccgaggggaaggtgattgatctgggctgcggcaggggcgggtggagctactactgtgctggactgaagaaggtaacggaggttaaagggtatacgaagggcggccccggccatgaggagccaatcccgatggccacctacgggtggaaccttgtgaagttacactccggcaaagatgtcttcttcataccgcccgagaagtgcgatacactgctctgcgacatcggtgagagttccccgaatcccactatcgaagagggccgcacgctgcgtgtgctgaagatggtggagccatggctccgagggaaccaattctgcatcaagatcctaaacccctacatgcccagcgtcgtggaaaccctggagcagatgcaacggaagcacggaggcatgctcgtgcgcaacccgctgtcaagaaattcgacccacgagatgtattgggtctcctgtggaacgggcaacattgtgagcgcggtgaatatgacgagtcgcatgctactcaatcgcttcaccatggcccatcggaagccgacatacgagcgcgacgttgacttgggagccggcacccgacatgtggccgtggagcccgaggtcgcgaacctggacattatcggccaacgaatagagaacattaaacatgagcacaagagcacttggcactacgatgaggacaacccctacaagacgtgggcgtatcacgggtcttacgaggtgaaaccctctggctccgccagctctatggtgaacggggtggtgaagctactgactaagccctgggacgtgatccccatggtgacccagattgcaatgacggacacgacccccttcggccaacagcgggtgttcaaggagaaggtcgataccagaaccccaaaggccaagagggggacggcccagatcatggaagtaacagcaaagtggctgtggggcttcctctcacggaacaagaagccccggatctgcaccagagaggagttcacccggaaggtgcgctcaaacgccgcaattggagccgtcttcgtggacgagaaccagtggaactccgctaaagaggccgtagaggacgagcggttctgggacctcgtccacagggagcgggagctgcacaaacaggggaagtgcgccacgtgcgtgtacaatatgatgggtaagcgcgagaaaaagctcggggagttcggcaaggcgaaggggagccgggcaatctggtatatgtggctgggggcgcgcttcctggagttcgaggccctaggctttatgaacgaggatcactggttctctcgggagaatagcctgtccggggtggaaggcgaggggctgcataagctcggctatatcctacgcgacatcagcaagatccccgggggaaacatgtatgccgacgacaccgcgggctgggacaccagaattacagaggatgacctccagaacgaagcgcgcattacggatataatggagccggagcatgcgctcctcgccaagagtattttcaagctgacctaccagaataaggtggttcgcgtgcagcggcccgccaagaatgggaccgtcatggacgtgatcagccgcagggaccagagaggctccggccaggtgggcacctacggcctcaacacattcaccaacatggaggctcagctgattcggcagatggagagcgaggggatcttctcacccagcgagctagaaacccccaacctggcggagcgggtcttagactggttagagaaatacggcgtggagagactcaagcggatggccatctccggggacgactgcgtggtgaagccgattgacgaccggtttgccacggccttaacagcactgaacgacatgggtaaggtgcgcaaagacatcccccagtgggagccgagcaagggatggaacgactggcagcaggtacccttctgttcccatcatttccatcagctcatcatgaaggatggccgggagatcgtcgtaccttgtcgcaaccaagatgagttagtgggccgggcccgcgtaagccagggggcgggctggagcctgcgtgagacagcgtgcctcggcaagtcctatgcccagatgtggcagttaatgtacttccaccggcgcgacttaaggctcgcagcgaacgccatctgcagcgctgtgcctgtggactggatccccacttcccggaccacgtggagcatccacgcccatcaccagtggatgactaccgaggacatgctgtcggtgtggaaccgcgtatggatcgaggagaacccctggatggaggacaagacacatatatcttcctggggcgacgtgccatatctgggaaagcgcgaggatcagtggtgcgggtcactcattggtctgacggcccgagccacttgggctacgaacatccaagtcgccataaaccaagtgcgccggctgatcgggaacgaaaactacctcgactacatgacatccatgaagcgcttcaagaacgagagcgacccagagggggccctctggtga

SEQ ID NO: 24182 - RNA, 9879 nt, synthetic construct
  misc_feature 1..9879: note = derived and/or modified CDS sequence (opt11) from DENV-1__FJ432749__SS-prME
  source 1..9879: mol_type = other RNA
agcgtgaccatgctgctgatgctgatgccgaccgccctggccttccacttgaccacacgcggtggggagccccacatgatcgtaaccaaacaagaacgggggaagagccttctgttcaaaaccagtgcgggggtgaacatgtgcaccctaatcgcgatggaccttggcgagctgtgcgaggacaccatgacttacaaatgcccccgaatcaccgaggcagaacccgacgatgtggattgctggtgcaacgccaccgatacctgggtcacctacgggacatgttcccagaccggcgagcaccggagggacaagcggagcgtcgccctcgcgccccacgtgggccttgggctggagacgcgcaccgaaacctggatgtcgagcgagggcgcttggaagcaaatccagcgagtcgagacgtgggcactcaggcaccccggcttcaccgtcatcgccctattcctggctcacgccatcggcacttccatcacccaaaaaggcatcatcttcatactgctgatgctggtaacgccctcaatggccatgcggtgtgtcggcatcggctcccgcgatttcgtggaggggctctctggcgccacctgggtggacgtcgtgctggagcatggctcctgtgttaccaccatggccaaggacaagcccacgctggacatcgaactactgaagactgaggtcaccaaccccgcggtgctgaggaagttgtgcatcgaggcaaagatcagtaacaccaccaccgactcccgctgccccacacagggagaagccacccttatggaggagcaggacgccaatttcgtgtgccggcgcacattcgtcgacaggggctggggtaacggctgcgggctgttcggtaaggggtcgctcatcacgtgcgccaagttcaagtgtgtgaccaagctggaagggaaaatcgtgcagtacgagaaccttaagtactccgtcatcgtgacggtgcacacgggggaccagcaccaggtcgggaatgagagcaccgagcacggcaccaccgcgaccatcactccgcaagctcccacctccgagatccagctcacagactacggggccttgacccttgactgcagccctcgcaccggcctcgatttcaacgagatggtgctgctgacgatgaaggagaagtcctggctcgtgcacaaacagtggttcctggacctgccattgccctggacaagcggggctagcacctcccaggagacgtggaatcggcaggacctgctggtcacattcaaaaccgcccacgcgaagaagcaggaggttgtcgtgctgggcagccaggagggcgccatgcatactgccttaacgggggcaactgagatacagacctctggtacaacgacgatcttcgccggccatctgaagtgccgcttaaagatggacaagctgaccctgaagggcatgagctacgtgatgtgcaccgggagtttcaagctcgagaaggaggtcgccgagacgcaacacggaaccgtcctggtgcagattaagtacgagggcaccgacgccccctgcaagatccccttcctgacccaggacgagaagggggtcacgcagaacggtagactgataactgcaaatccgattgtgacggacaaggaaaagcccgtgaacatcgaagccgagccacccttcggggaaagctatatcgtcatcggcgcaggcgagaaggcactcaagttatcctggttcaaaaaaggcagctcaataggcaagatgttcgaagccaccgccagaggggctcggcgcatggcgatcttgggcgacacggcctgggacttcgggagcatcgggggcgttttcaccagtgtggggaagcttgtccaccagatcttcggcaccgcctacggggtcctgttcagcggggtttcctggacaatgaagataggaatcggcgtcctgctcacgtggctgggcctaaacagccgctccacgagcctctcgatgacctgcatcgccgtagggctggtgacactctatctcggcgtcatggtgcaggccgatagcgggtgtgttatcaactggaagggtcgggaactaaagtgtgggtccggcatattcgttacgaacgaggtacatacatggaccgaacagtacaaattccaagcggactctccgaagcgcctgtcagcggccatcggtaaggcctgggaggagggggtgtgcggcatccggtccgccacccgcttagagaatatcatgtggaagcagataagcaatgagctcaatcacattctactcgagaacgacatgaaattcaccgtcgtggtgggagatgtcgtgggcatactggcgcaagggaagaagatgatccggcctcagccgatggagcataagtactcctggaagtcctggggcaaggcaaaaattataggcgccgacgtgcagaacacgaccttcatcatcgacgggcccaacaccccggagtgtcctgatgaccagcgcgcctggaacatctgggaggtggaggactacggctttggtattttcactacgaacatatggctgaagctccgggactcctacacccaggtgtgcgaccaccgcctgatgagcgcggccatcaaagactccaaggccgtccacgccgacatgggctattggattgaaagcgagaagaacgagacctggaagctggcccgggcgtccttcatagaagtcaagacatgcatctggccgaaaagccatacgctctggtcaaacggagtgcttgaaagcgagatgatcatccctaaaatctacggaggccccattagtcagcacaactatcgccccgggtacttcacccagaccgccggcccctggcacctggggaagctagagctcgacttcgacctgtgcgaggggacgacggtggtcgttgacgagcactgcggcaacaggggtccgagccttcgcaccactaccgttacgggtaagatcatccatgaatggtgctgccgatcctgcaccctgccgccactgaggttcaagggggaggacggctgctggtacgggatggagatccggcctgtcaaagagaaggaggagaacctggtcaagtcgatggtgtccgcaggctccggcgaagtagatagcttctccctggggctgctctgcataagcataatgatcgaagaggttatgcgcagccgttggtcccgcaagatgctaatgactggcacacttgccgtgttcctactgctaatcatggggcagctcacgtggaatgacctgatacggctttgcatcatggtgggcgccaacgcgtctgaccgcatggggatgggcaccacctatcttgccctcatggccacatttaagatgcgtccgatgttcgccgtgggcctccttttccgaagattaacgagccgagaggtcctgctgctcaccattgggctatccttggtcgctagcgttgaactgcccaactccctggaggagctcggcgacggactggcgatggggatcatgatcctgaagctgctgaccgatttccagtcccatcagctatgggccaccctgctttcgctgaccttcatcaagacgaccctctcattgcactacgcctggaagaccatggccatggtcctgagtatcgtgagcctcttccccttgtgtctgtccacaactagccaaaagaccacctggcttcccgtgctgctgggatctcttgggtgcaagccgttaacgatgtttctgatcgccgagaacaagatctggggccgcaagtcctggccactcaacgaggggatcatggccgtcggcgtggtgtccattttactaagcagcctcctgaagaacgacgtacctctggcagggcctctcatcgccggtggcatgctgatcgcatgctacgtgatctccgggagctccgcagacctgagcctcgaaaaggccgccgaggtgtcgtgggaggaggaggccgagcactccggggcctcccacaacatactggtcgaggtgcaggacgacgggaccatgaagatcaaggacgaggagcgggacgacaccctgaccatcctcctgaaggcgaccctgctcgccgttagcggggtctacccgctgtccatccccgctacgctgttcgtatggtatttctggcagaagaaaaagcagcgcagcggcgtgctgtgggacacccccagcccgcccgaagttgaaaaggccgttctcgatgacggaatttaccggatcatgcagcgcggcttactcggacggagccaggtgggcgtcggggtgtttcaggaaaacgtattccacacgatgtggcacgtcacccgcggcgccgtattgatgtaccaggggaagcgtctcgagccttcctgggcgagcgtgaagaaagacttgatctcctacggcggcggttggcgccttcaaggctcatggaacactggggaggaggtccaagtgatcgccgtggaacctgggaagaaccccaaaaacgtgcaaaccgcacctggaactttcaaaacccccgagggtgaggtgggcgcgatcgcactggatttcaagcccggtacgtccggcagcccgattgtcaaccgcgaggggaagatcgtcggcctgtatgggaacggggtggtgaccaccagtgggacctacgtcagcgcgatcgcccaggccaaggccagccaggaggggccgctgcctgagatcgaagatgaagtgttcagaaaacggaacctcacgataatggacttacaccccggctccgggaagacccgccgatacctccccgcgatcgtgcgagaggccatcaagcggaagctgcgcaccctgatcctcgcccccacacgggtcgtggccagcgagatggccgaggcgctgaagggtatgcccatccgctaccagacgaccgccgtaaagtctgagcacaccggaaaggagatcgtcgacctgatgtgtcacgccaccttcacgatgcgcttgctgagccccgtgcgggtcccgaactacaatatgatcatcatggacgaagcccactttaccgacccctccagcatcgcagcgcgcgggtacatcagtacacgggtcggaatgggagaggccgccgcgatttttatgaccgccacgcctcccggcagcgtcgaggcgttccctcagtccaacgccgtgatccaggacgaggagcgcgacatccctgagcgcagctggaactccgggtacgagtggatcacggatttccccggcaagaccgtctggttcgttcccagtataaagtccggcaatgacatcgccaactgcctgcgcaaaaacgggaagcgtgtgatccagctctcccgcaagacgttcgacacagaatatcagaagaccaagaacaacgactgggactacgtcgtaaccaccgacatatccgagatgggcgccaattttcgggcagatcgcgtgatcgacccacggcgctgcctgaagcccgtcatcctgaaggatgggccagagcgggtgatcttggccggcccaatgccagtcacggtggccagcgccgcccaacgcagggggcgaatcggccggaaccacaacaaggagggcgaccaatacatctacatggggcagcccctgaacaacgacgaggaccatgcgcactggaccgaggcgaagatgctgctggacaacatcaacacgcccgagggtattatacccgccctgttcgagccggagcgcgaaaagtccgccgccatcgacggtgagtatcgattgcgcggtgaggcgcgcaagaccttcgtggagttgatgcggcgcggagacttgcccgtatggctgagctacaaggttgcatctgaggggttccagtacagcgaccggcgctggtgtttcgacggcgagcgtaataatcaggtgcttgaggagaacatggacgtcgagatctggacaaaggagggagagcgcaaaaagctgaggccccgctggttggatgcccgaacatacagcgaccccctcgctctgcgcgagtttaaggagttcgccgcgggccgccgctcagtgagcggggacctaatcctcgagatagggaagttaccgcagcacctgacacagcgggcccagaacgccctcgacaacttagtcatgctgcacaacagtgagcaaggcgggcgtgcctaccgccatgccatggaagaacttcccgacaccatcgagacgttgatgctgctcgccctaattgccgtcctgacaggcggggtaacgctcttcttcctcagcggccgcgggctgggcaagacctccataggcgtgctctgtgtcatggcctcaagtgtgctcctgtggatggcctcagtggaaccacactggatagcggcctcgatcatactcgagttcttcttgatggtcctgcttatcccagaaccggatcggcaacgaacgccccaggacaaccagctcgcctacgtcgtgatcgggctcctgttcatgatactgacggtagccgccaacgagatgggcctgctcgaaaccacaaagaaggacctggggatcggccacgtggcagtggaaaatcaccaccacgcgaccatgttagacgtcgatctccaccccgcctcagcctggacgctttatgccgtggccaccaccatcatcaccccgatgatgcggcacacgatcgagaacaccaccgccaacatttccctgaccgccatcgccaatcaagctgcgatcttgatgggactggataagggctggcccatcagcaaaatggacataggcgtgcccctgctcgccctgggatgctactcccaggtcaaccctctaacgctaaccgccgccgtgctcatgctggttgcgcactacgccattatcggaccgggcctccaggccaaagcaacgcgcgaggcgcagaagcggaccgctgcaggcatcatgaagaaccccaccgtcgacggtatcgttgctattgacctggaccccgtggtctacgacgctaaattcgagaagcagctgggccagataatgctgctgatcttgtgcaccagccagattctccttatgcgcactacctgggctctgtgcgagtcaatcacgctcgcgacgggacctttaaccaccctgtgggaagggagcccgggcaagttctggaacacgactatcgccgtgagcatggctaacatcttccgcgggagctacctcgccggcgccggcctagctttctccctgatgaagtccctaggaggcgggcggcgcggcaccggggcccagggcgagaccctgggcgagaagtggaaacggcagctgaaccaactcagcaagtctgagttcaacatctacaagcgaagtgggattatggaggtggaccgctccgaggcaaaggagggcctaaagcgaggggagaccacccgtcatgccgtcagccgcgggacggcgaagctgcgctggtttgtggagcgcaacctggtgaagcccgaagggaaagtaatcgacctcggttgcggccgcggggggtggtcgtactactgcgcagggctaaagaaggtgaccgaggtcaaggggtacacgaagggcgggccgggacacgaagagcccatcccgatggccacctacgggtggaacctggtcaagctccactcgggcaaggacgtattcttcacgccgcccgagaagtgcgacaccttactgtgtgacatcggggagtccagcccaaacccgacgatcgaagaaggtcgaaccctccgagttcttaagatggtcgagccctggctgcgcggcaatcagttctgtatcaagatactcaacccctatatgccctccgtggtagagaccctagagcagatgcaacgaaagcacggcggcatgctggtccgcaacccgttaagccggaactccacccacgagatgtactgggtgagttgcgggaccggtaacatcgtgtccgctgtcaacatgacgagccgcatgctgctgaaccgatttacaatggcccaccgcaagcccacgtacgagcgagacgtggacctcggggcgggtacgcgacatgtagccgtcgaacccgaggtagccaacctggatatcatcgggcaaaggattgagaacataaagcatgagcacaaaagcacgtggcactacgacgaggacaacccctacaagacctgggcctaccatgggagctacgaggtcaagccctccggcagcgccagcagcatggtgaacggggtggtgaaactgcttaccaagccctgggatgtcatccccatggtcacgcaaatagcaatgacagacaccacccccttcggtcaacagcgggtctttaaggaaaaggtcgacacccgcacgccgaaggccaagcgggggacagcgcaaatcatggaggtgaccgcacggtggctgtggggcttcttgagtcgtaataagaagccacggatctgcacccgggaggagttcacgcgcaaggttcggtcgaacgcggcgattggcgccgtgttcgtggatgagaatcaatggaacagcgccaaggaggctgtcgaggacgagagattctgggacctcgtgcaaaaagaacgtgagctgcacaagcaggggaaatgcgccacctgcgtgtataacatgatgggaaagcgcgagaaaaaactgggggagttcggaaaggccaaagggtcgcgggcgatctggtatatgtggctcggcgcccgcttccttgagttcgaagcgctgggctttatgaacgaggaccactggttcagccgagaaaactccctctctggagtcgagggtgaagggctgcacaagctgggctacatcttacgcgatatctccaagataccgggcggcaacatgtacgcggacgacaccgccggctgggacacccgcatcacggaggacgatctgcagaacgaggctaagatcaccgacataatggagccggagcacgccctcctcgccacgtcaatcttcaagctgacctaccagaacaaggtggttcgcgtccagcggccagccaagaacgggacagtgatggacgtgatatcccgtcgcgaccagcggggcagcgggcaggtcggcacctacggcctgaacacattcactaacatggaggcacagttgatacgccagatggagtctgaaggaatcttcctgcccagcgagctcgagacgccaaacctggcggagcgcgtgctagactggctcgagaagtatggcgtggaaaggcttaagcgcatggccatatccggggacgactgcgtggtgaagccgatcgacgataggttcgccaccgcgctgacggccctgaatgatatgggcaaggtgcggaaggacataccacagtgggagcccagcaaggggtggaacgactggcagcaagtccccttctgctcccaccacttccatcagctcattatgaaagacggccgggagatcgtggttccgtgccggaaccaggacgagctggttgggcgcgcgcgggtaagccagggggccggctggagcctccgcgagaccgcctgccttggcaagagctacgcgcagatgtggcagctgatgtactttcaccggcgcgacttgcggctggccgccaacgcgatctgcagcgcggttcccgtcgactgggtccccacgtcccgcaccacctggtccatacatgcccaccaccaatggatgaccactgaggacatgctctccgtgtggaaccgggtatggatcgaggagaacccctggatggaggacaagacccatgtaagcagttggggcgacgtcccatacctgggaaagcgcgaggaccagtggtgtggcagcctcattggcctgaccgcgcgggccacctgggcatccaacatccaggtcgcgatcaatcaggtgcgccgcctgattggtaacgagaactatctcgactacatgacaagcatgaagagattcaagaacgaaggcgaccccgagggggccttctggtga

SEQ ID NO: 24183 - RNA, 9879 nt, synthetic construct
  misc_feature 1..9879: note = derived and/or modified CDS sequence (opt11) from DENV-1__FJ410212__SS-prME
  source 1..9879: mol_type = other RNA
agcgtgaccatgttactgatgctgatgccaactgccctggccttccacctcacaactcgtggcggggagccccacatgattgtttcaaagcaagagcggggcaagagcctcctgtttaagactagcgccggtgttaacatgtgcacgctcatcgcaatggacctgggcgagctgtgcgaggatacgatgacttacaagtgtccccggatcacggaggccgagcccgacgacgtagactgctggtgcaacgcgacggacacgtgggtcacttacgggacctgcagccagaccggcgagcatcggcgggagaagcggtccgtggccctcgctccccacgtgggcctgggacttgagacacggaccgaaacctggatgtcctccgagggggcctggaagcagatccaacgggtcgagacctgggccctacgccatcccgggttcacggtgatcgcactgttcctggcgcacgccatcgggacatccatcactcaaaagggaatcatcttcattttacttatgctggtgaccccctccatggccatgcgatgcgtaggcatcggctcgcgcgacttcgtggagggcctctcgggcgcgacgtgggtggacgttgtgctggaacacgggtcgtgcgtgaccaccatggccaaggacaaacccaccctggatatcgagctcctgaagacggaggtcaccaaccccgcggtgctgcggaaactctgtatcgaggccaagatctcgaacaccacgacggacagccgctgcccgacccagggcgaagcaactctggttgaagaacaggacgccaacttcgtctgtcggcgcacctttgtggaccggggctgggggaacggctgcggtctgtttggcaaggggtccctgctgacttgcgccaaattcaagtgcgtaaccaagctcgagggcaaaatcgtacagtacgagaacctcaagtactcggtgatcgttaccgtccacacgggcgaccagcaccaggttgggaacgagtccacagagcatggcaccaccgctacaattacgcctcaggctcccacgaccgagatccagctgacggactatggggccctgaccctcgactgtagcccccgcacggggctggacttcaacgagatggttctcctcaccatgaaagagaagtcctggctggtgcacaagcaatggttcctggacctccccctgccctggaccagcggggccagcacctcccaggagacgtggaaccggcaagacctgctcgtgacctttaagaccgcccacgcgaaaaagcaggaggtcgtggtgctgggcagccaggaaggcgccatgcacacggccctgactggggccacggagatccagacgtccgggacaacgaccatcttcgccggacacctgaagtgccgactaaaaatggacaagctgaccctcaagggtatgtcatacgtcatgtgtaccgggtctttcaagctcgagaaggaggtcgcggagacacagcacggcaccgtgctggtccagatcaagtatgagggcactgacgccccatgcaagatcccgttcagcactcaagacgagaagggggtgacgcagaacggccggctgatcaccgccaacccgatagtgaccgacaaagaaaagcccgtgaacatcgaggccgagccgcccttcggggaatcctatatcgtgatcggcgctggcgaaaaggccttgaaacttagctggttcaagaaaggatccagcatcggcaagatgtttgaggccactgccagaggggcacgtcgcatggcgatcctgggagatacggcctgggacttcggatccatcggcggcgttttcacaagcgttgggaaactcgtgcatcaaattttcggcaccgcctacggggtgctattttccggggtctcctggaccatgaagatagggatcggcgcgctgcttacttggctgggactgaactctcgctctactagcctaagcatgacctgcatcgcagtggggctggtgaccctctacctcggcgtcatggtacaggcggactccggatgcgtgatcaactggaagggcagagaactgaagtgcgggtcaggcatattcgtcactaatgaggtgcacacctggaccgagcagtacaagttccaagcggacagcccgaagcgcctgagcgcggccatcggcaaggcctgggaggaaggggtgtgcgggatccggtccgcgacccgactcgagaacatcatgtggaaacagatctccaacgaactgaaccacatccttctcgagaatgacatgaagttcaccgtcgtggtgggggacgtggccggcatcctggtgcaggggaagaagatgatccggcctcagccgatggagtacaagtacagctggaagtcctggggcaaggctaagatcatcggcgcagacgtgcagaacagcacgttcataattgacggacccaacaccccggagtgccccgacgaccagcgcgcgtggaatatatgggaggtcgaggactacgggttcggtattttcaccaccaacatctggctgaaactcagagattcctacacccaggtgtgcgaccataggctgatgagcgctgccataaaagactccaaagccgtccacgccgacatgggctactggatagaaagcgagaagaatgagacctggaagctggcgcgcgcctccttcatcgaggtcaagacctgcatctggcccaagtctcacaccctctggtccaacggcgtgctggagagcgaaatgataatccccaagatccatgggggcccgatctcccagcacaactaccgccccgggtactttacgcagaccgcggggccatggcacctggggaaactggagctggatttcgacttgtgcgagggcacgacagtggttgtagacgagcactgtggcaatcgggggcctagcctccgcacaaccaccgtgaccggcaagataatccacgaatggtgttgtcggtcctgtacgcttccgcccctgcggttccgtggggaagatggttgctggtacgggatggagatacgccccgtcaaggaaaaggaggaaaacctggtgaaaagtatggtttccgccggcagtggcgaggtagatagcttcagtctggggctgctctgcatatcgatcatgatagaggaggtgatgcggtcccgctggagccggaaaatgctgatgaccggcaccctggccgtgttcttcctcttaatcatggggcagctgacctggaatgacctcattcgcctgtgcatcatggtcggcgcgaacgcctccgatcgcatggggatgggcacgacttacctggccctcatggccaccttcaaaatgcggccgatgttcgccgtgggcctcctgttcagacggctcaccagccgcgaggttctgctgctgacaatagggttgtccctggtcgcgtccgtggagctccccaacagcctggaggagctcggcgacgggctcgcgatgggcatcatgatcctgaaactactcaccgacttccagagctaccaactgtgggccaccctgctcagcctgaccttcatcaagacgactttcagtctgcactacgcgtggaagaccatggcgatggtcctcagcatcgtgtctctgttccccctgtgcttatccaccacgagccagaagaccacatggctgcccgtgctgttgggatccctggggtgcaagccgcttaccatgttcctaatcgcggagaacaagatctggggccgcaaaagctggcccctgaacgaggggatcatggccgtcggcatcgtgagcatactgctatccagcctgcttaagaatgacgtccccttagcggggcccctcatcgccggaggcatgctaattgcgtgctacgtgatctccgggtcctccgccgacctcagcttagagaaagccgcagaggtctcctgggaggaggaggccgagcatagtggcgcgtcccataacattttggtggaggtccaggacgacgggacgatgaagattaaggacgaggaacgcgacgacactctgacaattctcctgaaagccaccctactggccgtgtcgggcgtgtatccgctgtcgatccccgccacactgtttgtctggcacttctggcagaaaaagaagcaacggagcggggtgctatgggacacgcccagcccgcccgaagttgagcgcgcggtactggatgacggcatctatcggattatgcagcgcgggctgctcgggcggtctcaggtgggtgtgggcgtgttccaggagaacgtgttccacaccatgtggcatgtgacgcgcggcgcggtcctgatgtaccaggggaagaggctggagccctcctgggctagcgtgaagaaggacctcatatcatatggcggcgggtggcgattccaagggagctggaacacaggggaggaggtgcaggttatcgccgtggagcccggcaagaaccccaagaatgttcagacggccccagggactttcaagacccccgagggcgaggtcggagcaatcgcgctggacttcaagcccgggacgtccggctcgccgatcgtgaatcgggaaggaaagatcgtggggttgtatggcaacggggtcgtgaccaccagcggcacgtacgtctccgccatcgcccaggcaaaggcgagccaggaggggccgctccctgagatcgaggacgaagtcttccgcaagcggaacctgacaatcatggacttgcatcccggctccggtaaaaccagacgatacctcccggcgatcgttcgcgaggccataaagcggaaacttagaaccctgatcctagcccccacgcgagtggtcgccagcgagatggcagaggccctgaagggcatgcctatccggtaccaaaccacggccgtgaagtccgagcataccgggaaggagatcgtggacctaatgtgccacgccaccttcaccatgcgcctcctgagccctgtgcgggtaccgaactacaacatgatcatcatggacgaagcccacttcacggacccctccagcatcgcggcccgcgggtacatatccacccgggtgggcatgggggaggctgcagccatcttcatgaccgcgacgccgccggggtcaatggaagcattcccgcagtctaacgcggtcatccaggacgaagaacgcgacattcccgaacgcagctggaactccgggtatgagtggatcacggacttccccggcaagaccgtgtggttcgtgcccagcatcaaggctgggaacgacatagcgaactgcctgcgcaaaaacggcaagcgggtcatccagttatcccggaagactttcgataccgagtatcagaaaacgaagaacaacgactgggactacgtggtgaccaccgacatcagcgagatgggagccaacttccgggcagaccgcgtcattgacccacgccgctgcctgaagcccgttatcttgaaggacggtcccgaacgcgtcatcttagcaggacccatgccggttaccgtcgcctccgcggcccagaggagggggcgcatcggccgaaaccacaacaaggaaggcgaccagtacatctacatggggcagcccctgaacaacgatgaggaccacgcccactggacggaggccaagatgctactcgacaacatcaacacccccgagggcatcatccccgccttatttgagcctgaaagagagaagtccgcggccatcgacggggagtacagactgcgcggggaggcccggaagacctttgtcgagttaatgcggagaggggacctgcctgtgtggctctcctacaaagtggccagtgagggcttccaatacagtgaccggcgttggtgcttcgacggcgagcggaacaaccaggtcctcgaggagaacatggacgtggagatatggaccaaagagggggagcgcaagaaacttcggccccgctggctcgatgcccggacgtactcagaccctctcgcgctacgcgagtttaaagagtttgctgccggccggcgcagcgtgtccggggacctgatcctcgagatcgggaaactgccgcaacacctgacccagcgggcccagaacgcgctcgataacctagtcatgctgcataactcagagcagggtgggagagcctatcgacatgcgatggaggagctccccgacactatcgaaaccttgatgctgttggccctgatcgctgtcttgacgggcggggttaccctgttctttctgtccggcaaggggttgggcaagaccagcatcggactcctgtgcgtcatggcatccagcgtgctgctctggatggcttccgtggaaccccactggatcgccgcaagcatcatactggagttcttcctgatggtcctccttattcccgagccggacaggcaaaggacgccccaggacaaccagctggcctacgtggtcataggtctcctgttcatgatcctgaccgtggccgcaaacgaaatgggtctattagagacgaccaagaaggacctggggatcggccacgtggcggtggagaaccaccaccacgcggccatgctcgatgtcgaccttcaccccgcgtccgcttggaccctgtacgccgtcgcaaccacgatcgtcaccccaatgatgcggcataccattgagaataccactgcgaatatctctctcacagcgatcgcaaatcaggctgccatcctgatggggctggacaagggctggcccatctccaagatggacatcggagtccccctcctagcgctggggtgttatagccaggtgaaccccctcaccctgaccgccgccgtgctgatgctcgttgcccactacgccatcataggcccggggctgcaggccaaggccacgcgggaggcccagaagcgcaccgcagccggcattatgaagaatcccaccatagatgggattgtggcgatcgacctggaccccgtggtctacgacgctaagttcgagaagcaactcggccagatcatgctacttatcctctgtacgtcccagatcctgctgatgcgcaccacctgggccctctgcgagagcatcaccctggccaccggacccctgactaccctctgggaggggagtcccggcaaattctggaataccaccatcgctgtgagcatggcgaacatcttccgggggtcctacctggcaggcgccggactggcctttagcctcatgaaaagcctcgggggcgggcgccgggggaccggggcacagggcgaaacactgggagagaagtggaagcgccagttaaaccaactgtccaagagcgagttcaatacctacaagcggtccgggatcatggaggtggaccggagcgaagccaaggaggggctgaaacgcggggagactacgaagcacgctgtctcccgcggtactgccaagctccggtggttcgtggagcgcaatttagtcaagcctgaggggaaggttatcgatctaggttgcggccgagggggctggagctactactgcgccggtttgaagaaggtgacagaggtaaagggttacaccaaaggcggaccgggtcatgaggaaccgatccccatggccacttacggatggaacttagtgaagctccattccggcaaggacgtgtttttcataccgcccgagaagtgcgacaccctcctctgcgacataggggagtcatcccccaatccgaccatcgaagaaggcagaaccctgcgggtgttaaaaatggtcgagccctggctccgagggaaccagttctgtattaagatcctcaacccttacatgccatctgtggtggagacgctggagcagatgcagcggaagcacggcggcatgctcgtccgtaacccgctgagtcggaacagcacccacgagatgtactgggtgagttgcgggaccgggaacatagtgagcgcagtcaacatgacctcccgaatgctgctaaacagattcaccatggcccatagaaagcccacgtacgagcgcgacgtggatcttggggccggcacccggcatgtcgccgtggagccggaggtggcgaacctggacataatcggccagcgcattgagaatatcaaacacgagcacaagtcgacctggcactatgatgaggacaacccttacaagacctgggcataccatggctcgtacgaagtgaagccgagcggctccgcctctagcatggtcaatggggtggtcaagctgttgacgaaaccctgggacgtcatccccatggtgacccagatcgccatgaccgacacaacacccttcggccagcaacgggtattcaaggagaaggtggacacacgcaccccgaaggccaagcggggtaccgcccagatcatggaagtaacggctcgctggctgtgggggttcctctccaggaacaagaagccccgcatctgcacccgggaggagttcactcgaaaggtccggagcaatgccgccatcggcgcggtgtttgtcgatgaaaaccagtggaactccgccaaagaggccgtcgaggacgaccgcttttgggacctggtgcaccgggaacgcgagctacacaaacaggggaagtgcgcgacctgcgtatacaacatgatgggcaagagagagaagaagctcggggagttcggcaaggccaaggggagccgtgcgatctggtatatgtggctgggcgcccgcttcctggagttcgaggcacttggcttcatgaacgaggaccactggttctcccgagagaacagcctgtccggggtcgaaggcgaggggctgcacaaactggggtacatcctgcgggatatcagcaagatccccgggggaaacatgtacgccgacgacacggccggctgggatacacgcatcaccgaggacgacctgcagaacgaggcgaagatcaccgacatcatggagcctgaacacgcccttctggcaaagtctatctttaagctgacgtaccagaacaaggtggtgcgagtgcagcgccctgctaagaacggtaccgttatggacgtgatcagtcgccgggaccagcgcggctccggccaggtcggcacctacggcctaaacaccttcacgaacatggaggctcaactgatccggcaaatggagtcagaggggatattcctgcccaacgaactcgagacgcccaacctggcgggtcgcgtgctggactggctcgaaaaatacggggtggagcggctgaaacgcatggccatctcgggcgacgactgcgtcgtgaaaccgatcgacgaccggttcgccaccgccttgacagccctcaacgacatggggaaagtgcgcaaagatatcccccagtgggagccctccaagggctggaacgactggcagcaggtccccttctgctcccatcactttcaccaactgatcatgaaggacggccgggagattgtggtgccctgccgcaaccaggacgagctggtggggcgtgcgagggttagccagggcgccgggtggtccctccgcgagaccgcctgccttggtaagagctacgcccaaatgtggcagctgatgtacttccacaggcgggacttgcgactggcggccaacgccatatgcagcgccgtccctgtcgactgggtgcccacttcccggaccacctggagcatccacgcccatcaccagtggatgacgactgaagacatgctatccgtgtggaacagggtctggatcgaggagaacccctggatggaggacaagacccgcatcagctcctgggaggacgtgccgtacctcgggaagcgcgaggaccagtggtgcggcagcctaataggcctgacggcgcgcgccacgtgggctaccaacatccaggtagccattaaccaggtccgtcgcctcatcggcaacgagaactactcggattacatgacgtcaatgaagcggttcaagaacgaatccgagcccgagggtgcgttgtggtga

SEQ ID NO: 24184 - RNA, 9879 nt, synthetic construct
  misc_feature 1..9879: note = derived and/or modified CDS sequence (opt11) from DENV-1__FJ461307__SS-prME
  source 1..9879: mol_type = other RNA
agcgtgacaatgctgctgatgcttatgcccaccgccctggccttccacctcaccacccggggtggggaaccccacatgatagtgagcaagcaagagcgtggcaagagcctgcttttcaagacctcggccggcgtgaacatgtgcacgcttatagcgatggacctgggagagctgtgcgaggacaccatgacctacaagtgcccccggatcaccgaggctgagcccgacgacgtggactgctggtgcaacgctaccgacacatgggtcacctacgggacctgcagccaaaccggcgaacacaggcgggagaagcggtccgtggccctggctccccacgtgggtctgggtctggagacgcggaccgagacgtggatgagctccgagggcgcctggaagcagatccagcgggttgagacctgggcgctacgccaccccggctttacggtcatcgccttgtttctggcgcacgcaatcggcacgagcatcacccaaaaggggatcatcttcatcctcttgatgcttgtgaccccctccatggccatgcgctgcgtcggcataggcagtcgcgatttcgttgagggtctctccggcgccacctgggttgatgtagtgttagagcacggtagctgcgtgaccaccatggccaaggacaagccaaccctggacatcgagctcctaaaaacggaagttacgaaccccgctgtgttacgaaagctctgcatcgaggctaagatctcaaacaccacgacggactctcgctgcccaacacagggcgaggccaccctggtcgaagaacaggacgccaatttcgtctgtcggcgtaccttcgtggatcgggggtgggggaacggttgcggtctctttggcaagggttccctcctcacgtgcgccaagttcaaatgcgtgaccaagttagagggcaaaatcgtccaatacgagaacctcaagtacagtgtgatcgtaaccgttcatactggagaccaacaccaggtggggaatgaatccacagagcacggcaccacagcgaccatcacgccccaggcccccacgacagagatccagctaaccgactacggggcacttaccctcgactgtagcccgcgcacgggcctagactttaacgagatggttctgctcaccatgaaggagaagtcgtggcttgtgcacaaacagtggttcctggacctaccgctgccctggacgtctggagccagcacctcgcaggagacgtggaaccggcaggatctgctcgtgaccttcaagacggcccacgcgaagaaacaggaagtcgttgtgctgggcagccaggagggggccatgcacacagcccttaccggggcaacggagatccagacctccggcacaacgaccatcttcgccggccacctcaagtgtaggctgaagatggacaagctgaccctaaagggaatgagctacgtaatgtgcaccgggtcctttaagctggagaaagaagtggcggaaactcaacacggcaccgtgctggttcagatcaagtacgagggcaccgacgccccctgcaagatcccattcagcacccaagatgagaaaggagtgacgcaaaatgggcgtcttatcacagcgaacccgatcgtgaccgataaagagaaaccagtaaatatcgaggcagagccccccttcggcgagtcctatattgtgattggcgcgggcgagaaggccctcaagctgagctggttcaagaaggggtccagtatcggaaagatgttcgaggctaccgcccgaggtgcacgtcgcatggcgatcctgggtgacaccgcctgggatttcggttccatagggggggtattcacctcggttgggaagctcgtacaccagatcttcggcaccgcttacggggtgctgttcagtggggtaagctggaccatgaaaatcgggattggtgtactgctcacgtggctgggcttaaactccaggagcacctccctcagcatgacctgcatcgccgttgggctggtcaccctgtacttgggggttatggtgcaggccgatagtgggtgcgtaattaactggaagggcagagagctgaagtgcggaagcggcatcttcgtcacgaacgaagtgcatacctggaccgaacagtacaagtttcaggcggacagcccgaagcgactgagtgccgcgatcggcaaggcctgggaggagggggtctgcggcatccgtagtgccacccgcctcgagaacatcatgtggaagcagatttccaatgagctcaaccacatactgctcgagaacgacatgaagttcaccgtggtggttggcgacgtggccggcatcctggtacaggggaagaagatgatacggccacaacccatggaatacaagtacagctggaagagttggggcaaggcaaaaatcatcggggccgacgtccagaacagcacattcatcatcgacgggccaaacacaccggaatgccccgacgaccagcgcgcctggaacatttgggaggtggaggactacggattcggtatcttcacgaccaacatatggctcaagctcagagactcctacacacaggtgtgcgaccatcgcctgatgagcgctgccatcaaggactccaaggccgtccacgccgacatgggatactggatcgagtcggagaaaaacgaaacctggaaattggcccgggcgtcgttcattgaagttaaaacctgcatctggcccaaaagccacaccctctggtccaacggggtgcttgagagtgaaatgatcatcccaaagatccacggaggccctatatcccaacataactaccgccccgggtacttcacgcagacggccggcccctggcacctagggaagctcgagctggatttcgacctttgtgagggcaccaccgtcgtggtggacgagcactgcggcaaccgagggccgtcgttacgcacgaccaccgtcacaggcaagattatacacgagtggtgttgccggtcctgtacgctgccgcccctgcgctttcgcggggaggacgggtgctggtatggaatggagattcgacccgtgaaggagaaggaagagaaccttgtgaaatcgatggtcagtgcgggcagcggcgaggtggacagcttctcactgggactgctctgcatcagcatcatgatcgaggaggtgatgcggtctcgctggagccgaaaaatgttgatgaccggcaccctggcggttttcttcctacttatcatggggcaactgacctggaacgacctcattcgtctgtgcataatggtcggcgctaatgcgagtgatcgcatgggtatgggcacgacctatctggcactcatggccacctttaagatgaggccgatgtttgccgtgggcctcctcttccgccggctcacgtctcgcgaggtcctgctgctaaccatcgggctgtcgctggtggccagcgtcgagctccccaattccctagaggaactaggcgatgggctcgcaatgggaatcatgattctgaaactattgactgacttccagagctatcagctgtgggctaccctgttatccctcacattcatcaagacgaccttcagcctgcactacgcctggaagaccatggccatggtgctatccatagtgagccttttcccactatgcctctccaccacaagccagaagaccacctggctccccgtcctgctcggctctctggggtgcaagccgctgacgatgtttctcatcgcggagaataagatctggggtcgcaaatcctggcctttgaatgaggggatcatggccgtgggtatcgtatctatactgctttctagcctgctgaagaacgatgtccccctcgcggggcccctgattgcgggcggtatgctgattgcctgctacgtgatctccgggagcagtgctgatctgagcctggagaaggccgccgaggtatcctgggaggaagaagccgagcacagcggcgcctcccacaacatcctggtcgaggttcaggatgacgggacaatgaaaattaaggacgaagaacgcgacgataccctcaccatcctgctgaaggcgaccctgctggccgtgagcggggtgtacccgctttcgattcccgccaccctcttcgtgtggcacttttggcagaagaaaaaacagcggtccggggtcctatgggataccccgtcaccgcctgaagtcgagcgtgccgtcctggacgatggcatctatcggatcatgcagcgcggcctgctcgggcggagccaggttggcgtcggggttttccaggagaacgtgttccacaccatgtggcacgtcacaaggggcgccgtgctcatgtaccagggcaaacgcctggagccctcctgggcgagtgtgaagaaggacctaatttcctacggcggcggatggcgctttcagggtagttggaacacaggggaagaggtccaggtaatcgccgtggaacctggcaagaatcctaagaacgtccagacggcccccggcaccttcaagacgccagagggcgaggtgggcgcaattgccctggacttcaagccagggacgtcaggcagcccaatcgtgaatcgggagggaaagatagtcggcctttacggaaacggggttgtgactaccagcggcacttacgtctcagctattgcccaggcgaaggccagccaagaggggccgcttccagagatagaggacgaagtgttccgtaagcggaacctgactatcatggacctacaccccggaagtgggaagacgcgccggtatctccctgcaatagttcgcgaggccattaagcggaagctgcgcaccctgatcttggccccgacccgggtggtggcttcagagatggctgaggcgctgaagggaatgcccatcagataccaaaccacagccgtgaaatccgagcatactggcaaagaaatcgtggatttgatgtgtcacgcaaccttcaccatgcgtctcctgagccccgtgcgggtgccgaattacaatatgatcatcatggacgaagctcacttcaccgacccatcgagcatcgccgcgcgcgggtacatttccacccgggtcgggatgggggaggccgccgcgatattcatgaccgccacgccgccgggcagcatggaagcgttccctcagtccaacgccgtgatccaagacgaggagcgggacattcccgagcggagctggaattccgggtacgagtggatcacggacttccccggtaagactgtctggttcgtcccctctatcaaggccggcaacgacattgccaactgtctacgcaagaacgggaaacgcgtgatccagctgtctcggaaaaccttcgacaccgagtaccagaagacgaagaataatgactgggactacgtggtgaccacagacatcagcgagatgggcgccaacttccgagctgaccgcgtgatagacccgcgtcgctgcttaaagcccgtaatattgaaggacgggcccgagagagtgatcctagccggccccatgcccgtgactgtcgcctccgcagcgcaacgccgtgggcggatcggtaggaaccacaacaaggagggcgaccagtatatctacatggggcaacctcttaacaatgacgaggatcacgcccattggacggaagccaaaatgcttctagacaacatcaacaccccagagggaatcatccccgccctgttcgagccggagcgcgagaagtccgccgcgattgacggggagtaccgcttacggggcgaagcccgcaagaccttcgtggagctcatgcggcgcggggacctcccagtgtggctgagttacaaggtcgccagcgagggcttccaatacagcgacaggcggtggtgcttcgacggagagcgtaacaatcaagtgctcgaggaaaacatggacgtggagatttggaccaaggaaggggagcgcaagaaattacggccccggtggctcgacgcgcggacgtattccgaccccttagccctgcgcgaattcaaggagttcgcggccggccggagatcagtctcgggcgacctgatattagagatcggcaagctgccacaacacctgacccagagggcccagaatgctctcgacaacttggttatgctgcacaatagcgagcaaggcggtagggcctatcgccatgccatggaagaactcccagataccattgagaccctgatgctactcgccctgattgccgttctaacgggcggggtcacactcttctttctgtcgggcaaagggctgggcaagaccagcatcggcctcctgtgcgtgatggcctccagcgtcttgctatggatggcgagtgtcgagccacactggatagccgctagcatcatcctggagttcttcctgatggtgctcctgatcccagagccggaccgccagcggacgccccaggacaaccagctggcctacgtggtgatcgggctgctgttcatgatcctgaccgtggctgctaacgagatgggcctcctagagactaccaagaaggatctggggatcggccacgtggccgtggagaaccaccaccacgccgcgatgctcgacgtcgatttgcaccccgcctccgcgtggacactgtatgccgtggccaccacgataataaccccgatgatgcgccacaccatcgagaatactacggctaacatctcgctcaccgccatcgcgaatcaggccgccatcctgatggggctggacaagggttggccaatctccaaaatggacatcggagtccccttgctggccctggggtgctacagccaggtgaatccgctaaccttgacagccgcagtgctcatgctcgtcgcccactacgcgatcatcggtccggggttacaagcaaaagcgacacgggaggcccagaaacgaaccgcggctggcatcatgaagaacccgaccatcgatgggatcgtggccattgacttggaccccgtcgtctacgacgcgaagttcgagaagcagctaggccagatcatgctgctgatactctgcacctcacagatccttctgatgcgcacgacctgggccctttgcgagagcatcaccctggccaccggtccactgacaacactttgggaaggctccccgggcaagttctggaacaccacgattgccgtgagtatggccaacatcttccgggggtcctacctggcgggagccggcctggcattttccctcatgaagtccctcgggggcgggcgcagagggacgggggctcagggtgaaactctcggcgagaagtggaagcgccaactcaatcagttatccaagagcgagtttaacacctacaagcggtccggaatcatggaggtagacagatcagaggcaaaggagggcctgaagcgcggcgagacaacgaagcacgcagtcagtcgcgggaccgccaagcttcggtggttcgtggagcggaacctggtgaaacccgaggggaaggtcatagacctgggctgcgggcgggggggctggagctattactgcgccgggttaaagaaggtgaccgaggtcaagggctacaccaaggggggcccaggccatgaggagcccataccgatggccacgtacgggtggaacctcgtcaaactccactcaggcaaggacgtgttcttcatcccgcccgagaaatgcgacactttactctgtgacatcggggagagctccccgaacccgaccatagaagagggacgcacactgcgtgttttaaagatggtcgagccctggttgcgcgggaaccaattctgcatcaagattctgaatccctacatgcctagcgtggtggaaacgctggagcaaatgcagagaaagcacggcggtatgcttgtgcgcaacccgctgtcccgcaactccacccacgagatgtattgggtatcctgtgggaccggcaacatcgtgagcgccgtcaacatgacctcccgcatgctactcaaccgtttcacaatggcgcaccgcaagcccacgtacgagcgcgatgtagacctgggtgccggcacccggcacgtggccgtcgagcccgaggtggccaacctggacattatcggccagcgcatcgaaaacattaagcacgagcacaagagcacctggcactacgacgaggacaacccttacaagacctgggcttatcacggaagttacgaggtgaagccgagcgggtccgccagcagtatggtcaacggagtggtcaagttgcttacgaagccgtgggacgtgatccccatggtgacccagatcgccatgaccgacaccacgcccttcggccagcaacgggtcttcaaggaaaaagtggatacccgcacccctaaagccaagcgcgggaccgcgcagataatggaggtgacggcacgctggctttggggcttcctttccaggaacaaaaagccccgcatctgcacccgggaggagttcacccgcaaggttcggagcaacgcagccatcggcgccgttttcgtggacgaaaatcagtggaactccgcgaaggaagctgtggaggacgatcgcttctgggatctagtgcaccgagagcgcgaactgcacaagcagggcaaatgtgctacctgtgtttacaacatgatgggcaagcgtgagaagaagctcggcgagtttggcaaagcgaaggggtcccgcgctatctggtacatgtggttaggcgcgcggttcttggagttcgaagccctcggcttcatgaacgaggatcactggttttcccgcgagaattcactgtctggagtcgagggtgaggggttgcacaaactcggctacatcctgcgggacatctcgaaaatccccgggggcaatatgtacgccgacgatacggcaggctgggacaccagaatcaccgaggacgatctgcagaacgaggccaagatcaccgacattatggagccagaacatgcgttactggccaagtccattttcaagttaacgtaccagaataaggtggtgcgggtacagcgccccgcgaagaacggtaccgtaatggacgtgatttcccgcagagaccaaagaggttcggggcaagtcgggacctacggattaaacaccttcacgaatatggaggcccagctgatccggcagatggagtctgaggggatctttctgccaaacgagttagagacacccaatctagccggccgcgttctggactggctcgagaagtacggggtagagcgactgaagcgcatggctatctccggcgatgactgcgtggtgaagccgatcgacgaccggttcgccaccgcactgaccgcccttaacgacatggggaaggtgcgcaaggacatcccgcaatgggagccgagcaagggctggaacgattggcaacaggtccctttctgcagccaccactttcaccagctgataatgaaggatggccgggagatcgtggtgccttgccgtaaccaggatgaactcgtcgggcgagctcgggtctctcagggagcggggtggtccctccgcgagacggcctgcctgggcaagtcgtacgcacagatgtggcaactaatgtacttccaccgccgtgacctccgcctggccgcgaacgcaatatgcagcgccgtgcccgtcgattgggtgcccacttcccggaccacctggagcatccacgcccatcatcagtggatgacgaccgaggatatgctgtccgtgtggaaccgcgtctggatagaggagaacccctggatggaggacaagaccagaataagctcctgggaggacgtgccgtacctggggaaacgcgaggaccagtggtgcggcagcctgatcggcttgactgcccgcgccacgtgggccacaaatatccaggtggcaatcaaccaggtccggcgcctgatcgggaacgagaactactccgattacatgataagcatgaagagattcaaaaacgaatccgagcccgagggcgccctgtggtga

SEQ ID NO: 24185 - RNA, 9879 nt, synthetic construct
  misc_feature 1..9879: note = derived and/or modified CDS sequence (opt11) from DENV-1__FJ410213__SS-prME
  source 1..9879: mol_type = other RNA
agcgtcaccatgttgctaatgctgatgccaaccgccctcgcctttcacttgacaactagaggcggggagccccacatgattgtgaccaagcaggaacggggtaagagtctgctgttcaagaccagcgccggggtgaatatgtgcaccctcatagccatggatttaggcgaactgtgcgaggacacgatgacgtacaagtgcccccgtattaccgaagcggagccggacgatgtggattgctggtgcaacgccacggacacttgggtcacatacgggacctgcagccaaacgggcgagcaccggcgcgacaagcggagcgtggctctcgcgcctcacgtgggcctggggttggagacccgcaccgagacctggatgtcttccgaaggagcctggaagcagatacagcgggttgagacgtgggccctcaggcaccctggcttcaccgtgatcgcactgttcctggcccatgccatcggaacctccatcacgcagaaggggataatattcatcctcctaatgctggtgacgccaagtatggccatgcggtgcgtcggcatcggttcccgcgatttcgtcgaggggttaagcggagccacctgggtggatgtggtgctggaacatggaagttgcgtgaccaccatggccaaggacaaacccacgctggatatcgaactgttgaagaccgaagtgaccaatcccgctgtgctgcggaagttgtgcatcgaagccaagatatctaacacaacgaccgattcccgctgtcctacccaaggcgaagccactctgatggaggagcaggatgccaacttcgtgtgccggcgaacgtttgtcgaccgcggctgggggaacggctgcgggctctttggcaagggcagcctcatcacgtgcgccaaatttaagtgcgttaccaaattggagggcaagatcgtgcagtacgagaatctgaagtactccgtcatcgtgaccgtgcatacgggcgaccagcaccaagtcgggaacgagagcacggagcacggcacaactgcgactatcactccccaggccccaacatccgagatacagctcaccgactacggcgccctgacgctggactgtagcccccgcacgggcttggatttcaacgagatggtgcttttaacaatgaaagaaaagagctggctcgtgcacaagcagtggttcctggatctaccgctcccctggaccagcggggcctccacttcccaggaaacgtggaatcggcaggatctgctggtgacgtttaagacagcccacgcgaagaagcaagaagtggtcgtgctaggatcacaggagggcgccatgcacacggcgctgacgggggctactgagatccaaacatccggcacgacgacaatctttgctggtcacctgaagtgtaggctaaagatggataaacttacgttgaagggcatgtcttatgtgatgtgcaccgggtctttcaagctcgagaaggaggtggcggaaacccagcatggcaccgtgctagttcaaattaagtacgagggtacagacgctccctgtaaaatccctttcagcactcaggacgaaaagggggttacccagaacggcagactgatcaccgccaacccgatcgtgacggataaggagaaaccggtcaatattgaggcggaaccacccttcggtgaatcctacatcgtcatcggcgcgggcgagaaggccctgaagctctcttggttcaagaaggggtcttccatcggtaagatgttcgaggcgactgcacgtggggcccggcgcatggcgatcctcggggacacggcctgggacttcgggagtgtgggcggtgtgttcacctcggtagggaaacttgtgcatcaaatattcggtactgcgtacggagtcctgttttcgggcgtctcctggaccatgaagatcgggatcggcgtgctgctcacgtggctcggcctgaactcgcgcagcacctccctgagcatgacatgtattgccgttgggctcgtgaccctgtacctgggcgtaatggtgcaggccgactccgggtgcgtcatcaactggaagggcagggagctgaagtgcgggagcggaatcttcgtaacgaatgaggtgcatacctggaccgagcagtacaagtttcaggcggacagccctaaacgcctgtccgcggcaataggcaaggcgtgggaggagggggtttgcggcatccggagtgccactcgcctggagaacatcatgtggaagcagatctccaacgagctcaaccatatcctacttgagaatgacatgaaattcacagtagtggtcggggacgtggtgggaatcctcgcgcaggggaagaagatgatccggccccagccgatggagcacaagtatagctggaagtcctggggaaaggccaaaatcatcggcgccgatgtacaaaatacaaccttcatcatagatggccccaacacaccagagtgccccgacgaccaacgggcctggaacatttgggaagtcgaagactacgggttcgggatatttacaacgaacatctggttaaagttacgagacagctatacccaggtgtgtgaccatagactcatgtccgcggccatcaaggatagcaaagccgtccacgcggacatggggtactggatcgagtccgagaaaaacgagacttggaagctggctcgggcctccttcattgaagtgaagacctgcatttggccaaagtcccatacgctgtggagcaacggggttttagagtcagaaatgatcattcctaagatctacgggggaccgataagccagcacaattaccgcccggggtattttacccaaaccgccggcccgtggcacctcgggaagctggagctcgacttcgacctatgcgagggaaccacggtcgtggttgacgaacattgcggcaaccgggggccgtccctgcgcacgaccactgtgacgggcaagatcatccacgagtggtgctgccggagctgcactctgccgcccctccgcttcaaaggggaggatgggtgctggtacgggatggagatccgtcccgtgaaggagaaggaagagaacctagtcaagtccatggtatctgccggcagcggtgaggtagactccttctccttaggtctgctgtgcatctccatcatgatcgaggaggttatgcgctcacggtggtcccgcaagatgctcatgaccggtacgctggccgttttcttgttactgataatgggccagcttacgtggaacgacctcatccggctgtgcatcatggtgggcgccaacgccagcgatcgcatggggatgggtactacctatctggccctgatggccacgtttaagatgcggcctatgttcgctgtgggccttctgtttcggcgcctcacgtcccgggaggtcctgctgctcaccatcggcctgagcctggtggcctccgtcgagttaccgaacagcctggaggagctgggcgatgggctcgcgatgggcatcatgatcctgaagctgctgacggacttccagagtcatcagttatgggccacccttctcagcctgaccttcatcaagacgaccctgagtttacattacgcctggaagacgatggcgatggtcctgagcatcgtttccctgtttcccctctgcctatcaacgacctcgcagaaaacgacttggctgcccgtcttgctgggctctctggggtgcaagccacttacgatgtttctgatcaccgagaacaagatctggggacgcaagtcctggcccctgaatgaagggatcatggcggtgggagtggtcagcatactcctgagctcccttctcaaagacgacgtgcccctggcagggcctcttatagccggcggcatgctcatagcatgctacgtcattagcgggtccagcgccgacctaagtctagaaaaggccgcggaagtcagctgggaagaggaggccgagcactccggcgccagccataacatcctcgtggaggtgcaggacgacgggactatgaagatcaaggacgaggaaagagacgacacattaaccatcctgctcaaggctaccctgctggcggtgtccggcgtgtacccgctcagcatccccgccaccctgtttgtttggtacttctggcaaaagaagaagcagcgaagcggtgtcctgtgggacacccccagcccacccgaggtagaacgggccgttctggatgacggcatttaccgcatcatgcagcgaggcctcctgggccgttcccaggtcggcgtgggtgtgttccaagagaacgtcttccacaccatgtggcatgtgacacgtggtgccgtgctgatgtaccaagggaagcgcttggaaccatcttgggcctccgtcaagaaagacctgatcagctatgggggcgggtggcgattgcaggggtcctggaacactggcgaggaagtacaggtgatagcggtcgagccgggcaagaacccgaagaatgtacagaccgcccctggaaccttcaaaacgcccgaaggcgaagtgggcgccatcgccctcgattttaaaccagggaccagtggctcccccattgtcaaccgcgaggggaagatcgttggattatacgggaatggggtggtgaccaccagcggaacgtacgtgagcgccatcgcgcaggccaaggcctcccaggaggggcccctccccgaaatcgaggacgaggtgttcaggaagcgcaacctcaccatcatggatctgcatccaggctcggggaaaacgcggcgctacctgccggccatcgttcgggaagcaatcaagcgcaagctccggaccctgatcttagcgccgacgcgcgtagtagcatccgagatggctgaggctctcaagggcatgcccatcaggtatcagaccacagcagtaaagagcgagcacaccggcaaagagatagtggacctgatgtgccatgccacgtttaccatgaggctgctcagtcctgttcgtgttccgaactacaatatgataatcatggacgaggcccacttcaccgaccccagcagtatcgccgcccgggggtacatcagcacccgcgttggtatgggagaggctgccgccatcttcatgacagcgactccgcccggctcggtggaggccttcccgcagagcaacgctgtcatccaggacgaagagagggacatcccggagcgatcctggaacagcgggtacgaatggataaccgacttccctggtaagaccgtgtggttcgtgccctccatcaagtctggcaatgatatagccaactgcctgcggaaaaatgggaagcgcgttatccaactgtcccggaaaacgtttgacactgaataccaaaagaccaaaaacaacgactgggactacgtggtgaccacggacattagcgagatgggcgcgaacttccgagccgaccgagtcattgacccgcgccgttgcctaaagcccgtgatcctcaaggacgggcccgaacgggtaatcctggcggggcctatgccggtgaccgtcgcctccgccgctcaacggcgcgggcggattggccgcaaccacaacaaagagggtgaccagtatatctacatggggcagcccctaaataacgacgaggaccatgcccattggacagaagcgaagatgctgttggataacatcaatacccctgaaggaatcatccccgccctcttcgagccggagcgggagaagtccgcagccatcgatggggagtatagactacgcggcgaggccaggaaaacatttgtagagttgatgcgcagaggggacctccctgtgtggctgagctacaaggtggccagtgagggcttccaatatagcgaccgtagatggtgtttcgacggcgaacgtaacaatcaggtactggaagagaatatggacgtggaaatctggaccaaggagggtgagcggaagaaattgcgcccacgttggctggatgccaggacctacagcgaccccctggccttacgggaatttaaggagttcgccgccggccgccggagcgttagcggggacctcatcctggagataggaaagctgccgcagcacctgacccaacgcgcgcaaaatgccctggataaccttgtcatgttgcacaacagcgagcagggcggccgggcgtaccgccacgccatggaggaactgcccgacaccatcgagacactgatgctgctggcgctcatcgccgtgctgactgggggagtaacgttgtttttcctctccggccgggggttaggaaagaccagcataggcctcttatgtgtcatggcctccagcgttctgttgtggatggcctccgtggagcctcattggatagcagcaagcatcatcctcgagttctttctgatggtcctactcatcccagaaccggatcgccagagaacaccccaagataaccaattagcatacgtggtcatcgggttgttattcatgatattaaccgtcgctgccaacgagatgggcctgctcgaaacgaccaagaaggacctgggcatcggccacgtcgccgtcgagaaccaccatcacgcgactatgctggacgtcgatctccaccccgcctccgcatggaccctgtacgccgtggcgactaccataataacaccgatgatgcgacacacaatcgagaacaccacggcgaacatcagcttaaccgccatcgccaaccaggccgcgatcctcatggggctggacaagggctggcccatctccaaaatggatatcggcgtgccgctgctcgcgctggggtgttactcacaggtgaatcccctgaccctcaccgccgccgtgttgatgttagtggcccactacgcgattatcggcccggggctccaggctaaggccacccgagaagctcaaaagcgcacggccgcagggatcatgaaaaaccccaccgtagacgggattgtggctatcgacctcgaccccgttgtgtacgacgccaagttcgagaagcagctgggccagattatgctcctgatcctgtgtacctcccagatcctcctgatgcgtactacatgggctttgtgtgaaagcatcacccttgcgaccggccccctgaccacgctgtgggaggggtccccgggcaagttctggaacaccaccatcgcggtcagcatggctaatatcttccgtgggtcataccttgccggcgcaggcctggctttcagcctgatgaaatcactagggggcggccgcagaggcaccggcgctcagggcgagacgcttggcgagaagtggaagcgtcagttaaaccagctctctaagtccgagtttaacatctacaagcggtctgggatcatggaggtggaccgtagcgaagcaaaggaggggctgaagcgcggggagaccactaggcacgccgtttcccggggaaccgcaaaactgagatggttcgtggagcggaacctggttaaaccagagggtaaggtcatcgatctcggctgcggccgcgggggttggtcatactactgcgcggggctgaagaaggttactgaggtgaagggctataccaagggaggacccggccacgaggagccgatcccgatggccacgtacgggtggaacttggtcaagctgcactccggcaaggacgtattcttcacaccacccgagaaatgcgacacgctactgtgcgacattggggagagctcgccaaatccgaccatcgaggaaggccgcaccctccgggttctaaagatggtcgagccgtggctgcggggaaatcagttctgtatcaagatcctcaacccctacatgccgtctgttgtggagaccctggagcagatgcaacgcaagcacggcggcatgttggtgagaaacccgctgagtcgcaacagcacccatgaaatgtactgggtgagctgcgggactggcaacatcgtgagcgccgtaaacatgacctcacggatgctgttaaatcgcttcaccatggcccaccgcaagcccacctatgagcgggacgtggatctcggtgccggcacgcgtcacgtggcagttgagcccgaggtggccaacctggacataatcggacagagaatcgaaaacataaagcacgaacacaagagcacgtggcattacgatgaggataacccctacaaaacctgggcataccatgggtcctacgaagtgaagcccagcgggagcgccagctctatggtgaacggggtggtcaaactgctcaccaaaccgtgggacgttatccccatggtgacgcagatcgccatgacggacaccactccgttcggacagcaacgcgtcttcaaggagaaggttgacacgcggacccccaaagcgaagcgcggaaccgcccagatcatggaggtgacagcccgctggctctggggatttttgtcccgcaacaagaagccccgaatctgcacgagagaggaatttactcggaaagttcgcagcaacgccgctatcggcgctgtgtttgttgacgaaaaccagtggaactccgccaaggaggccgttgaggacgagcgtttctgggacctcgtgcagaaggagcgggagctgcacaaacaggggaagtgcgcgacctgcgtgtacaacatgatgggcaagagagagaaaaagctgggggagttcggtaaggcgaagggatcgcgggcaatttggtacatgtggttaggcgcccggttcctggagttcgaagccttaggctttatgaacgaggaccactggttctcccgcgagaacagcctctccggggtcgaaggagaaggcctgcacaagctggggtatatcttgcgggacatcagcaagatcccaggtggcaacatgtacgccgacgacacagcgggatgggacacgcgtatcaccgaggatgacttacaaaacgaggcaaagatcaccgatatcatggagccggagcacgccctgcttgccacctccatcttcaagctaacgtaccagaacaaggtggtgcgggtccagcggcccgcaaagaatggaactgtgatggacgtgatctcccggcgggaccaaaggggctccgggcaggttggaacctacggcctgaacacctttacgaacatggaggcgcaactcatccggcagatggaatcggaggggatcttcttgccctccgagctcgagactcccaacttggctgagcgcgttctggactggcttgagaagtacggcgtggagcggttaaagcgcatggcgattagcggggatgactgcgttgtgaaacccatagacgaccgttttgccaccgccctgactgcattgaacgacatgggcaaggtgaggaaggacatcccccagtgggagccctccaagggctggaatgactggcagcaggtccctttttgctcccaccacttccaccaattaatcatgaaagacggccgggagatcgtcgtgccgtgccgtaaccaggacgagctggtcgggagggcacgagtgtcccagggtgccggctggagcctgcgggaaacggcctgcctcggcaagagttacgcccaaatgtggcagctgatgtatttccacaggcgggacctgagactcgcagccaacgcgatctgctccgccgtgcccgtcgactgggtaccgaccagcagaaccacctggtccatacacgcgcaccaccagtggatgacgacggaggacatgctgagcgtgtggaaccgtgtctggatcgaggaaaacccctggatggaggataagacccacgtgtcctcatggggcgacgtgccgtacctcgggaaacgggaggaccagtggtgtggctcgctcatcgggctgaccgcccgcgccacctgggccagcaacattcaagtcgccatcaaccaggtgaggcggctgatcgggaacgaaaactacctcgactacatgaccagcatgaagcgcttcaagaacgagggagaccccgagggtgcgctgtggtga

SEQ ID NO: 24186 - RNA, 9879 nt, synthetic construct
  misc_feature 1..9879: note = derived and/or modified CDS sequence (opt11) from DENV-1__FJ461308__SS-prME
  source 1..9879: mol_type = other RNA
agcgtgaccatgctgctcatgctgatgcccaccgccttggcattccacctaaccaccaggggcggggagccccacatgatcgttagcaagcaggaacgggggaagtctctgttgtttaaaactagcgcgggggttaacatgtgcaccctcatcgccatggacctgggcgagttctgtgaggacaccatgacctacaagtgcccgcgcataaccgaggccgaacccgacgacgtcgactgctggtgcaacgcgaccgacacatgggtgacctacgggacctgctctcagacgggcgaacatcggcgggacaagcgaagcgtagccctggctcctcacgtgggcctcgggctggagactcgcgccgagacgtggatgtcttccgagggcgcctggaagcagatccagcgggtggagacctgggcgttgcgccacccgggttttaccgtgattgccctgttcctggctcacgcgatcggtacgagcataacacagaagggcatcatcttcatcctactcatgctggtgaccccctccatggccatgcgctgtgtcgggatcggcagcagggacttcgttgaggggttatccggtgccacctgggtggacgtcgtcctcgaacacgggagctgcgtaacgaccatggcgaaagacaagcccaccttagatatcgagctgctcaagaccgaggtaactaacccagccgtgctccggaagctgtgcattgaggccaagatatccaacacgaccaccgacagccgatgcccaacgcagggcgaggcaaccttggtcgaggaacaagacgccaacttcgtgtgccggaggactttcgtcgaccgggggtggggcaacggatgcggtttgttcggcaaggggtctctcataacttgcgcgaagttcaagtgcgtgacgaaattagaaggcaagactgtccagtacgagaacctgaagtacagtgtgatcgtgacagtccacaccggcgaccagcaccaggttgggaacgaatctacggaacacggcaccaccgccactataacgccccaggcccccagcaccgagattcagctgaccgattacggcgccctcaccctggactgcagcccccgcaccggtctagatttcaacgagatggtcctcctaacgatgaaggaaaagtcatggctggtgcacaagcagtggttcctcgacctcccgctgccctggacaagcggagcctcgacctctcaggagacctggaatcggaaggacctcttggtgacgtttaaaaccgcgcacgctaagaagcaagaggtcgtggtcctcggctcccaggagggtgccatgcacaccgccttaacaggggccacggagattcagactagcggcacgaccacgatctttgcggggcacctgaaatgccgcctgaagatggacaaactcaccctgaagggaatgagttacgtcatgtgcaccgggtccttcaaactggagaaggaggtggccgagacccagcacggcacggtgctcgtccagatcaagtacgagggcaccgacgccccctgcaagattcccttctccacccaagacgagaagggcgtgacccagaacggacgactgatcacggccaaccctatcgtgaccgataaggagaagccagtcaatattgaggcagagccgccgttcggggaaagctgcatcgtgatcggcgccggcgagaaagcgctgaagctgtcctggtttaagaagggatcttccatcggcaagatgttcgaggcgaccgcccgcggggcgcggcgcatggcgatcctcggcgacaccgcatgggacttcgggagcatcggcggtgtgttcacgtccgtcggcaagctggttcaccagatctttggcaccgcctacggagtactgttctcgggggtctcctggaccatgaagatcgggatcggcgtgctcctgacctggttaggcctcaacagtcgctccacgagcctgtccatgacctgtatcgccgtggggctcgttaccctttacctaggcgttatggtgcaggctgacagtgggtgcgtcattaactggaaaggccgggagctgaagtgcgggtcaggcatcttcgttaccaatgaagtgcatacgtggacggagcaatacaagttccaggccgactcccctaagagactctccgccgcaatcggcaaggcgtgggaggaaggtgtgtgcggcatccgtagcgcgacaagactggagaatatcatgtggaagcagattagcaatgagctaaaccacatcctcttggagaacgacatgaagttcactgtggtggtcggggacgtggccggcattttggcccaagggaagaagatgatccggccccagcccatggagcataagtactcctggaaatcctggggtaaggcgaagatcatcggcgccgacgtgcagaacacgacgtttatcatagacggccccaacaccccggagtgcccagacgaccagcgcgcttggaatatctgggaggtggaggactacggcttcgggatcttcacaacgaacatctggctcaagctgcgcgactcctacacacaggtgtgtgaccaccgactcatgagcgccgccatcaaggactccaaggccgtgcacgcggacatgggctactggatcgagtctgagaaaaacgagacttggaagctcgcccgggcctcctttatcgaggtcaagacctgcatctggcccaagagccacaccttgtggagcaacggcgtgctagagagcgagatgatcatcccaaagatctacgggggcccaatctcgcaacataactaccgtcccggttactttacgcagactgccggaccctggcacctcgggaagctggagctggatttcgacctctgcgagggcaccaccgtggtcgtggacgagcactgcggcaaccgggggccgagcctacgaacaaccaccgtgaccggcaagatcatccacgagtggtgctgcagatcctgcacgctgccgccattacgcttcaagggagaggacggctgctggtatggaatggagatccggcccgtaaaggagaaggaggagaacctggttaagagcatggtgagcgccggtagtggggaggtggactccttctccctgggtctcctgtgcattagcatcatgatagaggaggtgatgcgcagtcggtggagccgcaaaatgctgatgaccggcacactcgcggtgttctttctattgatcatggggcagctcacctggaacgatttaatccggctgtgcatcatggtcggcgccaacgcctccgacagaatggggatgggcactacttacctcgcgctgatggccacctttaaaatgcgccccatgttcgcagtgggtttactattccggcgcctgacgagccgggaagtactgctcctgacgatcgggctctccctcgtcgcatcagtggagctccccaatagcctggaggagctcggagacgggttagccatgggtatcatgatcctaaagctcctcacagatttccagtcccatcagctatgggccaccttactgtcccttactttcatcaagacgaccttcagcctccattacgcgtggaagacgatggccatggtcctttccattgtgagcttgtttccgctctgcctgagcaccacgagccagaaaacaacctggctgcccgtcctcctggggtccctggggtgcaagccgctcaccatgttcctgatcgccgagaataagatctggggccgcaagagctggcccctgaatgaggggattatggccgtcggaatcgtgtctatcctcctgtccagcctgctcaagaatgacgtacccttggccgggccccttattgccgggggcatgctcatcgcctgctacgtcatctctgggtcctccgccgatctgagcctggagaaagcggccgaggtgtcctgggaggaggaggcggagcacagcggcgccagtcacaacatccttgtggaggtccaggacgacggtacgatgaagatcaaggacgaggagcgtgacgatacgctgaccatcctattgaaagccaccctgcttgcagtaagcggagtgtacccgctcagtatccctgcaactctgttcgtctggtatttctggcaaaagaagaaacagcgcagcggggttctttgggatacgccaagcccgcccgaggttgagcgtgcggtcttagacgacggtatttaccgcatcatgcagcgtggcttgttagggcgcagccaggtcggtgtaggggtattccaggagaacgtattccataccatgtggcacgtgactcggggcgccgtcctgatgtaccaaggaaagcgcttagagccctcctgggcctccgtgaagaaggatctgatatcatacggcggcggctggcgtctgcaggggtcatggaacaccggtgaagaggtacaggtgatcgccgtggagcctggtaagaaccccaagaacgtgcagacggccccgggtacctttaagacctccgagggggaggtcggcgcaatcgccctcgactttaagcccgggacgagcggcagtcccatcgtgaaccgcgaggggaagattgttggcctgtacggcaacggggtggtgaccacgtctgggacctacgtgagcgcgatcgctcaggcgaaggcctcccaagaagggcccctcccagagatcgaggatgaggtcttccggaagcgcaatctaaccatcatggatctgcaccccggctccgggaagactcggcgctacctgccagccatcgtgcgggaggccatcaagcgcaaattacggaccctcatcctggccccgacccgcgtggtcgcctccgagatggccgaggccctcaagggcatgcctatccgctaccagaccacagccgtcaagagcgagcacaccggtaaagagatcgtggacctgatgtgtcacgccaccttcaccatgcggctgctctcgcccgtccgcgtgcccaactacaacatgatcatcatggacgaggctcactttacggacccgagcagcatcgcagcccggggatacatcagcaccagagtgggcatgggggaagcagccgcgatcttcatgacggccacgccgcccggctccgtcgaggcgttcccgcaaagcaacgccgtcatccaggacgaggagcgagacatcccggagagatcctggaacagcgggtacgagtggatcacagacttccccggcaagaccgtgtggttcgtcccctcaatcaaaagcggaaacgacatcgcgaactgcctgcgcaaaaacgggaagagagttatccagctgtcccggaagacgttcgacaccgagtaccaaaagacgaagaataacgattgggactacgtggttacaaccgacatctcggagatgggagccaacttccgcgccgaccgggtcattgacccgagacggtgcctcaaaccggtcatcctgaaggacgggcccgagcgcgtcatcctggccggcccaatgcccgtgacagtggccagtgccgcccaacggcgcggacggatcggacgcaatcacaacaaggagggcgatcagtatatctacatgggccaaccgcttaacaacgacgaagaccacgcccactggacggaagctaagatgctgctggacaacatcaacacccccgagggaatcatccccgccctcttcgagcccgaacgggagaagtccgctgccatcgacggtgagtaccgccttagaggcgaggcccggaagacgttcgtggaattaatgcggcgcggggacctcccggtgtggctctcgtacaaggtcgcctccgagggcttccagtacagcgaccgccggtggtgcttcgacggggagcgcaataaccaagtgttggaggagaacatggatgtggaaatatggaccaaagagggggagcggaaaaagctgcgcccccggtggttagacgcccgcacgtactccgaccctctggcactccgcgagttcaaggagtttgccgcaggccgccgaagtgtctccggagatctgatcctggagattggcaaactcccccaacatctgacccagcgcgctcagaacgcgctggacaatctagtgatgttgcacaacagtgaacaaggcgggcgggcttaccgccacgccatggaggaactgccggacaccatcgagaccctcatgctgctagccctcattgctgtcctgacaggcggggtcactctgttcttcctatccggccgagggctgggcaaaacctccataggccttttatgcgtgatggcctctagcgtcctgctgtggatggcatctgtcgagccgcactggatagccgccagcataatcctcgagttcttcctgatggtgctgttgatccccgagcccgatcgtcaacggaccccacaggacaaccagctggcctatgttgtcatcgggctactcttcatgatcttgaccgtagccgcaaacgaaatgggtctgctcgagacgaccaagaaggacctggggatcggccacgtggccgtggagaaccatcaccacgccgcaatgctggacgtggacctccaccccgcgtccgcgtggactctgtatgccgttgcaaccactatcatcacccccatgatgcgccacaccatcgagaatacgacggccaacatcagcctgaccgcaatcgctaaccaggcagcaatcctcatggggctggacaaggggtggccgatcagtaagatggacatcggggtccccctcctcgcgcttgggtgctacagccaagtgaacccactgaccctcaccgccgccgtcctcatgctggttgcccactacgccatcattggccccgggctccaggcgaaggcgacccgagaggcccagaagcgcaccgccgccggcattatgaagaaccccaccgtggacgggatcgtggcgatcgacttagatccagtagtatatgatgccaagttcgagaagcagctgggccagatcatgctgctgatcctgtgcacgtcccagatccttctgatgcgcacgacgtgggccctgtgtgagagcatcaccctggccacagggccccttacgaccctgtgggaagggtcacccggcaaattctggaacaccacaatagcagtctcgatggcgaacatcttccgggggagctacctggcgggtgccggactggccttctcactgatgaagtccctcgggggtggtcgccgtggcacgggggcgcaaggcgagaccctgggcgagaagtggaagcgccaactgaaccaattatccaagtccgagttcaacacatacaagcggtccgggatcatggaggtggatcggagcgaagccaaggagggtctgaaacgaggggagactactaagcacgccgtgagccgcggcaccgccaaattgcggtggtttgtggagagaaacctcgtcaagcctgaggggaaggtcatcgacctgggctgcggaaggggcgggtggagctactactgcgccggactgaagaaggtgaccgaggtcaaggggtacaccaagggcgggcccggccacgaggagcccatccccatggcgacctatggatggaatctggtgaagctgcacagtggcaaggacgttttctttatcccacccgagaagtgcgataccctgctgtgcgacatcggggagagctcccccaatcccaccatcgaggaggggcggaccctgcgggtcctgaagatggtggagccgtggctccgcggaaaccagttctgcatcaagatcctcaacccctacatgccaagcgtggtcgagacgctggagcagatgcaacggaaacacggaggaatgctggtcaggaatccactctccagaaactcgacccacgaaatgtactgggtgtcctgcgggaccggcaacattgtcagcgccgtcaatatgacctcccgcatgctcctgaaccggttcacgatggcccacagaaagccgacgtacgagagggatgtagacctcggggccggcacccggcacgtcgccgtcgaacccgaggtggctaacctggatatcatcggccaaagaatcgagaacataaagcacgagcacaagagcacctggcactatgacgaagataacccctacaagacctgggcgtaccacgggtcctacgaagtgaagcccagcggcagcgcctcctcaatggtgaacggcgtggtgaagctgctcacgaagccgtgggacgttatccccatggtcacccagatcgctatgacagacacaacgcccttcgggcaacaacgtgtgttcaaggagaaggtggatacacgcacccccaaggccaagcgggggaccgcgcagatcatggaggtcaccgccaagtggctatggggtttcctatctaggaacaagaagccgcgaatctgcacccgcgaggaatttacccgaaaagtacgcagcaatgcggctatcggtgcggtgtttgtcgacgaaaaccagtggaactcggccaaggaggcagtggaggacgagcggttttgggatcttgttcaccgcgaacgggagcttcataaacaggggaagtgcgcgacctgcgtctacaacatgatgggcaagcgcgagaagaagttaggagagttcggcaaggccaagggcagccgggcgatatggtacatgtggctgggcgcccgctttctggagttcgaggctctgggctttatgaacgaagaccactggttttcccgggagaacagcctctccggggtggagggcgaggggctgcacaaactgggctatatcctccgggacatcagcaagatccccgggggtaacatgtacgccgacgacacagccggatgggacacccggatcaccgaggacgacctgcagaacgaggcgaagataacggacattatggagcccgaacacgctctgctcgcaaagagcattttcaagttgacgtaccagaacaaggtggtccgcgtgcagcggccggccaagaacggaaccgttatggacgtcatcagccgccgcgaccagcggggctccggacaggtgggcacatacggtctcaacacgttcacgaacatggaggcccagctcatccgtcagatggagagcgagggtatcttctctcccagcgagttggagacccccaaccttgcgggccgagtgttggactggttagagaaacatggggttgagcgcctgaagaggatggccatctccggcgacgactgtgtggtgaagcccatagacgaccgcttcgccaccgcactcaccgccttaaatgatatggggaaggtgcggaaggacataccgcagtgggagcccagcaagggttggaacgattggcagcaagtccccttctgcagccaccacttccaccagctgatcatgaaggatggccgcgaaatcgtggtcccctgccggaaccaggacgagctcgttgggcgcgcgcgggtctctcaaggcgccgggtggagcctgcgcgagacggcctgcctgggcaagtcttatgcccagatgtggcaacttatgtactttcaccgcagagatctgaggctggcggccaacgccatctgcagcgctgtccccgtggactgggtgcccacctcccgcaccacgtggagcattcacgcccaccatcaatggatgacgaccgaggacatgctctccgtctggaaccgtgtgtggatagaagaaaacccctggatggaggacaagacccacatcagctcctggggcgacgttccctacctgggcaagcgcgaggaccaatggtgcggctcgctgatcgggctcaccgcgcgggcgacatgggccactaacatccaggtcgccatcaaccaggtgcgcagactcatcggcaatgagaactacttggactacatgacctccatgaaacggttcaagaacgagagcgatccggagggagcgctctggtga

SEQ ID NO: 24187 - RNA, 9879 nt, synthetic construct
  misc_feature 1..9879: note = derived and/or modified CDS sequence (opt11) from DENV-1__FJ461310__SS-prME
  source 1..9879: mol_type = other RNA
agcgtgaccatgctgctcatgctgatgcccacggcactggccttccacctcactaccagaggaggggaacctcatatgattgtgtcgaagcaggaacggggcaagagcctgctgtttaagaccagcgccggggtgaacatgtgcaccctgatcgccatggacctgggcgagctgtgtgaggacacaatgacctacaagtgcccccggatcacggaggccgagcccgacgacgtcgactgctggtgcaacgccacagatacctgggtaacctacgggacctgtagccagaccggggagcaccggcgggacaagagatcagttgccctcgcgccccacgtgggtctgggtctggagacgcgcacagagacctggatgagctcagagggggcctggaagcagatccagcgggtcgagacgtgggccctacgtcaccccgggtttactgtgatcgccctttttctggcacatgccatcggcacctctattacccaaaaggggatcatcttcatcctcctgatgctggttaccccctcgatggccatgcggtgtgtcggcattggtagccgcgacttcgtggaggggctctccggtgccacgtgggtcgatgtcgtgctggagcacgggagctgcgtgacaacgatggccaaggataagcccactttggacatcgagctcctgaagacggaggtcaccaaccctgcggtgttgcggaaactgtgcattgaggccaagatctccaataccacgacggacagccggtgcccgacgcagggagaggcgaccttggttgaggaacaggacgcgaacttcgtctgccgtcgcaccttcgtggaccggggctgggggaatggctgtggactgttcggtaagggatccctaataacctgcgccaagttcaagtgcgtgaccaagctggaaggcaagattgtccaatacgagaatcttaagtacagcgtgatcgtgaccgtccacaccggcgaccagcaccaggtggggaatgagtccactgaacacggaaccaccgccaccatcacgccccaggcccccacgaccgagatccagctcacggactacggggccctaaccttggactgcagcccgcgcactggcctcgacttcaacgagatggtcctgctgacaatgaaggagaagtcctggctcgtgcacaaacaatggttcctggacctgcccctcccttggacatcaggtgcatcaaccagccaggagacgtggaaccggcaggacctgctggtcaccttcaagaccgcccacgcgaagaagcaggaggttgtcgtgttaggcagccaagagggcgccatgcacaccgcattgacgggggcaacggagatccagacctccggcaccacgaccatcttcgccgggcacctgaagtgtcgactcaagatggacaaattaaccctgaagggaatgagctacgtcatgtgtaccggctccttcaagctcgagaaagaagtggccgagacgcagcacggcaccgttctcgtccagatcaaatatgagggcaccgatgccccttgcaagatccccttctcgacgcaggacgagaagggagtgacgcagaacggccggctaatcactgctaaccctatcgtcaccgacaaggagaagcccgtcaatatcgaggcagaacctccgttcggtgagtcctacatcgtgattggtgcgggcgagaaggcactgaagctgagctggtttaagaaggggtcgagcatcggcaagatgttcgaggcaactgcccgaggagcccgaagaatggcgattctgggtgacacggcctgggactttgggtccatcggcggagtcttcaccagcgtcggcaagctggtgcaccagatcttcgggaccgcttacggggtgcttttctccggtgtaagctggacgatgaaaatcggcatcggagtgctgctgacgtggctcggcctgaactccagatccacctccctgagcatgacctgcatcgcagtggggctcatcaccttatacctaggcgtcatggtgcaggcagactccgggtgcgtgatcaactggaagggccgggagctcaagtgcgggagcgggatcttcgtaacgaacgaggtccacacatggacagagcaatataagttccaggctgacagccccaagcgcctgagcgccgccatcggcaaagcctgggaggagggggtgtgcggcatacggagcgccacccgccttgagaacataatgtggaagcaaatctccaacgagctcaaccatatcctgttagagaatgacatgaagtttaccgtagttgtcggggatgtcgccggcatcctcgcccaggggaagaaaatgatacggccccaacccatggaatacaagtactcgtggaagtcctggggtaaagcaaaaatcattggggcagacgttcagaacactaccttcatcatcgacggaccgaacaccccggagtgccccgacgaccagcgggcatggaacatatgggaagtggaggactacggattcgggatcttcaccacgaacatctggttaaagctgcgggacagctatacccaggtctgcgatcaccgactcatgtccgctgcaatcaaagacagcaaggccgtgcacgccgacatgggctactggatcgaatccgagaaaaacgaaacctggaagttggcgcgggccagcttcatcgaagtgaagacctgcatctggcccaaatcccacacactctggagtaatggcgtcctcgagtccgaaatgatcatacccaagatctacggtggccctatcagccagcacaactaccgccccgggtatttcactcaggcggcggggccgtggcaccttggtaaactggagttagattttgacctgtgcgagggaacgaccgtggtggtcgatgagcactgcggcaaccgggggccgtccttgcggacgaccaccgtgaccggcaagatcatccacgagtggtgctgccgcagctgcacgctgccacccttacggttccgcggggaggacggatgctggtacggaatggagatccgccccgtgaaggagaaggaggagaaccttgtcaagtccatggtgtcggccggcagcggagaggtggactcgttttctcttggcctgctttgtatttccatcatgatcgaggaggtcatgcgatcgcgttggtcccggcgcatgttaatgaccggcactctggcggtatttttccttctcataatggggcagctgacctggaatgacttaatccgcctctgtatcatggtgggcgccaatgcctccgaccggatgggaatggggactacctacctggcgctgatggcgaccttcaagatgcggccgatgtttgcggttggactcctgttccgccgcctgaccagtcgggaggtcctgttactgacgatagggctcagtctggtagcctccgtcgagctgcccaacagcctcgaagaactgggcgacgggctggccatgggaatcatgatcctgaagttgctgactgatttccaatcccatcagctctgggccacgctcctcagcttaaccttcatcaagacgacctttagcctgcactatgcgtggaagacaatggcgatggtcctgtcgattgtctccctctttcccctgtgcctgtcaacaacgtcacagaaaactacctggttgcctgtgctgctgggcagcctaggttgtaagccgcttaccatgtttctgatcgcagagaataagatctggggccgccggagttggcccctaaacgaggggatcatggcggtcggtatagtcagcatcctgctatcatcgttactgaagaacgacgttcccctggccgggcccctgatagcgggcggcatgctaatcgcctgctatgtgatctcagggtccagcgcagatctatccctcgaaaaagcggccgaggtaagctgggaagaagaggcggagcactccggagcctcccataacatactggtggaggtgcaagacgacggtaccatgaaaatcaaggacgaggagagggatgacaccctgaccatcctcttaaaggccaccctgctggccgtctcgggggtgtacccgctgtcaatacccgccaccctgttcgtgtggtatttttggcagcgtaagaagcagcgctccggggtactatgggacacgccgagccctccggaggtggagcgagcggttctcgacgacggtatctaccgcatcatgcagagaggcctcttagggcgttcccaggtcggcgtgggggtgtttcaggagaacgtttttcataccatgtggcatgtgacccggggtgctgtgctcatgtatcaggggaaacggctggagcccagctgggccagcgtaaagaaggacctgatctcatacgggggcgggtggagattgcagggctcgtggaacaccggggaagaagtccaagtgatcgccgtcgaacccgggaagaaccccaaaaatgtgcagactgctcccgggacatttaaaacacccgagggagaagtaggcgcgatcgccttagatttcaagcccggaacctcgggctcccccatcgtcaaccgcgagggaaagatcgtggggctgtacgggaatggtgtggtcaccaccagtggcacatacgttagcgccatcgcccaggcgaaggcttcccaagagggaccactacccgagatcgaggacgaggtcttcaggaagcgcaatctgaccatcatggacttgcaccctggcagcgggaaaacgcggcgctatctcccggctatcgtccgcgaggccatcaaacggaagctacggacattaatcttagcccccacgcgggtggtagcgtccgagatggccgaggccctgaagggcatgcccattagatatcagaccacggccgtgaagtcagagcacaccggtaaggagatcgtggacctgatgtgtcacgccaccttcaccatgcggctgctgtcgcccgtgcgcgtccctaactacaacatgataatcatggacgaggcgcactttacggatcccagctctattgccgcacgcgggtacatcagcacccgcgtgggtatgggcgaagcagccgcgatcttcatgacagccacgccacccgggtctgtggaggccttcccgcaaagcaacgccgtcatccaagacgaggagcgcgacatcccagagcgctcctggaacagcgggtacgagtggattaccgacttccccggcaagacggtctggttcgtgcccagtatcaaaagtggcaacgatatcgccaactgtctgcggaaaaacggaaagcgcgtcatccaactctcccgtaagacctttgacacggagtaccagaagacgaagaacaatgactgggactacgtcgtgaccactgacattagcgaaatgggcgccaattttagggctgaccgagtcatagacccccgccggtgcttgaagcccgttatcctgaaggacggacccgagagggtgatcctcgccggacctatgcccgtaacagtggcctccgcggcccagcggcgcgggaggataggccggaatcacaacaaggaaggagaccagtacatatatatggggcagcccctgaacaacgatgaggaccacgcccactggacggaggctaagatgctgcttgacaatattaatacccccgaagggatcatccctgccctcttcgagccagaacgcgagaagtcagcggccatcgacggtgagtaccggttacgcggcgaggcccggaagacctttgttgagctgatgcgccgcggggacctgcccgtctggctgtcctacaaggtcgctagcgagggattccaatacagcgatcgccggtggtgctttgacggcgaacgcaacaaccaagtcctcgaagagaacatggacgtggaaatctggaccaaggagggggagcgcaagaagttacggccccggtggctcgacgccaggacatacagcgaccctctcgcgctgagggagtttaaagagttcgccgctggccgccggtcagtatccggtgaccttatcctcgagatcggcaagctgcctcaacacctgacccagcgcgcgcaaaacgcgctcgataatctggtgatgctgcacaattccgagcaagggggcagagcctataggcacgccatagaggagctgcccgacaccatcgagaccctaatgttgctcgcattaatcgccgtcttgacgggcggggtaaccctcttcttcctgtccgggcgggggctgggcaagacgagcattggcttactctgtgtcatggcgtcctctgtgcttctatggatggcctcagtagagccccactggatcgcggccagcatcatcctggagttctttctaatggttctgctgattcctgagccggaccgacagagaacgccccaagacaatcagctggcttacgtcgttatcggcctcctgttcatgatcctgaccgtggccgccaacgagatgggactcttagagactaccaagaaggacttggggatcggtcacgtagcggtagagaaccatcatcacgcagccatgctcgatgtcgacctgcacccggcttccgcatggaccctctacgccgtggccacaacgataattacccccatgatgcggcacaccatcgagaacaccacggccaacatctccctcaccgcaatagctaaccaggccgccatattaatgggactggataaaggctggcccatctcgaagatggacatcggggtccccctcttggcgcttgggtgctatagccaggtcaaccccttaaccttaaccgcagccgtactgatgctagttgcacactacgcgatcatcgggccgggactgcaggcgaaggccacgcgcgaggcccaaaagcgaactgccgcgggcatcatgaaaaaccccacagtcgatgggattgtggcgatcgatctggaccccgtcgtctacgacgccaaattcgaaaagcagttaggccaaatcatgctgctgatcctatgcactagccagatcctgctgatgcgcacgacatgggcattatgtgagtctatcaccctggcgacggggcccctgacaaccctctgggaggggtccccaggcaagttctggaataccaccatagcagtatcaatggcgaatatattccgggggtcctatctggccggggccggactggccttctcgctcatgaaatccctcggcggtgggaggcgagggacgggggcgcaaggggagaccctgggcgagaagtggaagcgccagctcaaccagcttagtaagagcgagtttaacacgtacaaacggtctggtatcatggaagtggacaggagcgaggcaaaggaaggcctgaagcgcggagagaccactaaacacgccgtgtcccgcggtaccgccaagctccggtggttcgtagagcgcaacttagtgaagcctgaagggaaggtcatcgacctgggctgcggcagagggggctggagctactactgcgccgggctaaagaaagtgactgaagtgaaaggctacactaagggcggccccggtcacgaggagcccattcctatggctacgtacggctggaaccttgtcaaattgcactccggcaaggacgtgttctttataccacccgaaaagtgcgacaccctgctgtgcgatataggagagagctccccgaacccgaccatcgaggagggaagaactctccgtgtgctgaagatggtcgagccgtggctccggggcaaccagttctgcatcaagatcctgaacccctacatgcccagtgtagtcgagacgttagagcaaatgcagcggaagcacggagggatgcttgtccggaaccctctgtcccgcaacagcacacacgagatgtactgggtgtcctgcgggaccggcaacatcgtgagcgccgtcaacatgacctcccggatgctgctcaaccgcttcaccatggcacaccgcaagcccacgtatgagcgcgatgttgacctgggcgccggcactcgacatgtggccgtcgagcccgaggtggcgaatctcgacatcatcgggcagcgcatcgagaacatcaaacacgagcacaagtctacatggcactacgacgaggacaacccctacaagacctgggcctaccacgggtcctacgaggtgaagccgagcggctccgccagcagcatggtgaacggcgtggtcaagttgcttaccaaaccctgggacgtgatacccatggtgactcagatcgccatgaccgatactacgcccttcggacagcagagagtcttcaaggagaaggtggacacccgcactccaaaggccaaacggggaaccgcgcagatcatggaagtgacggcaaagtggctctggggcttcctctcccgcaacaaaaagcccagaatctgcacccgcgaggagtttacacgtaaggtccgctccaatgccgccatcggggcggtcttcgtggacgagaatcagtggaactccgccaaggaggccgtggaggacgagcggttctgggacctggtacaccgcgaacgggaactgcataagcaggggaagtgcgcgacatgcgtctataatatgatgggcaagcgagagaagaagctaggtgagttcggcaaggctaagggcagccgggcgatatggtatatgtggttgggcgcccgcttcttggagttcgaggccctaggcttcatgaacgaggaccattggttctcccgagagaacagcctgtccggcgtcgaaggcgaaggactccacaagctcggctacatcctgcgcgacatcagcaaaatccccggcggaaatatgtatgcagacgacacggctggctgggacacccgcatcaccgaggacgacctgcagaacgaggctaggataaccgacatcatggagcccgagcacgccctcctcgccaagagcatcttcaaactcacttatcagaacaaggtggtgcgcgtccagcggcccgccaagaacggcaccgtgatggacgtgattagtcgccgggaccaaagaggctcggggcaagtcggcacatacggtctcaacacattcacgaacatggaagcgcaattgatccggcagatggagagcgaggggatcttctccccctcggagctggagaccccgaacctcgcggaacgcgttttggactggttagagaagtacggcgtcgaacggctcaagcggatggccatatctggggacgactgcgtagtgaagccaatcgatgacagattcgcaacagccctgaccgccctgaacgacatgggtaaggtgcgcaaggacatccctcagtgggaaccgagcaaggggtggaacgactggcagcaggtccccttctgttcccaccacttccaccagctcataatgaaggatggccgggagatcgtggtgccgtgtcgcaaccaggacgagctagtgggccgagcgcgcgtgagccaaggggccggttggagcctgcgggagacggcctgccttgggaagtcctatgcccagatgtggcagctgatgtacttccaccgcagagaccttcgcctcgccgctaatgccatctgctccgccgttcccgtcgactggatccccacatctcgtaccacgtggagcatccacgcccatcaccagtggatgacgaccgaggacatgctgtcagtgtggaatcgggtgtggattgaagagaacccctggatggaggacaagacccatatcagctcctggggagacgtcccatatctggggaagcgcgaagaccaatggtgtggcagcctcatcggactgactgcgcgtgccacgtgggccaccaacattcaggtggcaatcaaccaggtgcgccggctgatagggaacgagaactacctcgactacatgacaagtatgaagcggttcaaaaatgagagcgaccccgagggtgccctgtggtga

SEQ ID NO: 24188 - RNA, 9879 nt, synthetic construct
  misc_feature 1..9879: note = derived and/or modified CDS sequence (opt11) from DENV-1__FJ906728__SS-prME
  source 1..9879: mol_type = other RNA
tcagtgaccatgttactcatgcttatgcccaccgctttagcattccacctcacaacccgaggcggtgagccgcatatgatagtttccaaacaggagcgggggaaaagcctgttgttcaagaccagtgcgggggtgaacatgtgtactctcattgccatggacttaggtgaattatgcgaggacaccatgacctacaaatgcccccgaatcaccgaggcagaacctgacgacgtcgattgctggtgcaatgcaacggacacgtgggtgacttacgggacttgctcccaaaccggtgagcaccggcgagacaagcgctctgtggcactcgcgccccacgtgggcctgggtctggagacgcgaaccgagacctggatgagcagtgagggggcctggaagcagattcagcgggtcgagacctgggcactccgccatcctggcttcacggtgatcgcactgttcctggcgcacgccatcggcacctcgattacccagaaagggatcatcttcatactccttatgctcgttacccccagcatggccatgaggtgcgtcggcatcggcagccgcgacttcgtagaggggctgtccggggccacctgggtggacgtcgtgctggagcatggaagctgtgtgaccaccatggccaaggacaaaccgacactagatatcgagctgctgaaaacggaagtcactaacccggctgtgttacggaaactctgtatcgaggcaaagatcagtaacacgaccacggacagcagatgccccactcaaggcgaggctaccctggttgaggaacaggacgccaatttcgtatgccggcgaaccttcgtggaccgcggctggggaaacggctgcggactcttcggcaaggggtccctcatcacttgtgccaagttcaagtgcgtcacaaaattggaaggcaagatcgtccagtacgaaaacctgaagtatagcgtgatcgtgaccgtacacaccggcgaccagcaccaggtagggaacgagtccacggagcacggaacaaccgcgacgatcacaccccaggcccccacgacggagatccagctcaccgactacggggccttaatcctggattgttccccgcgcaccggtctcgacttcaacgagatggtcctattgacgatgaaggagaagtcctggctcgtccataagcaatggttcctcgacctgcctctcccatggaccagcggggccagcacaagtcaggagacctggaaccggcaggacctgctggtgacgttcaagaccgcccatgcgaagaagcaggaggtggtagtccttggcagccaggaaggcgccatgcacacagccctaaccggcgccacagagatacagacatccggcaccaccaccatcttcgcggggcacctgaagtgccgcttaaaaatggacaaacttaccttgaagggcatgtcctacgtgatgtgcaccggacccttcaagctcgagaaggaggtggccgagacccaacacggcacggtactcgttcaaattaagtacgagggaaccgacgccccctgcaagatcccgttcagtactcaggacgagaaaggagtgacgcagaatggccggctgataacggccaacccgatcgtcaccgacaaggaaaaacccgtcaacatagaagctgagcctccattcggggagtcgtacatcgtgatcggcgcgggggagaaggctcttaaactctcctggttcaagaaggggagctctatcggaaagatgttcgaggccaccgcccgcggcgcccgccgcatggccatccttggggacaccgcatgggattttgggagcatcggaggagttttcacgtccgtagggaagctggtgcaccagatattcggcaccgcgtacggggtgctcttttccggagtaagctggacaatgaaaatcgggattggcgtactgttaacctggctcggactaaacagccgctccacgagcttgtcgatgacgtgcatcgccgtgggacttgtgaccctgtatttgggagtgatggtgcaggccgattcgggatgtgtcatcaactggaagggtcgagagttaaagtgcgggtccggcatcttcgtgactaacgaggtgcacacgtggaccgaacagtataagtttcaggctgacagcccgaagcggctgagcgccgccatagggaaggcttgggaggagggggtgtgcggaatacgatccgcgactcgccttgagaatatcatgtggaaacagatctctaacgaactcaaccacatccttttagaaaacgacatgaagctaaccgtggttgtgggggacgtggcgggcatcctggggcaggggaagaagatgataaggccccagcccatggagtacaagtactcctggaaaagctggggaaaggctaagattattggggcggacgcccagaacaccacttttatcatcgacggacctaacactccggagtgtcccgacgaccagcgcgcgtggaatatttgggaggtggaggactacggattcggtatcttcaccacaaacatttggctgaaacttcgggactcttacacacaggtctgcgaccaccgcctgatgagcgccgcgatcaaggactccaaggctgtgcacgcagacatgggctactggatcgagagcgagaagaacgagacctggaagctagcgcgagcctctttcatcgaagtgaagacctgcatctggccaaaatcgcacaccttatggtctaacggggtactagaaagcgagatgataatcccgaaaatatacggcgggcccatttcccagcataactatcggcccgggtactttacgcagaccgccggcccgtggcacctggggaagctcgagctggacttcgacttatgcgagggtaccacggttgtggtcgacgaacactgtggaaaccgcggtccgagcttaaggacgaccaccgtgaccgggaaaattatacatgagtggtgctgcaggtcctgtaccctgcctcccctacgcttccggggcgaagacgggtgttggtacggcatggagatccgaccggttaaggagaaggaggagaacttggtaaagtcaatggtatccgccggcagcggggaggtagactctttctccctgggcctgctctgcatcagcatcatgatcgaggaagtcatgcggtctcgctggtcacggaaaatgctgatgaccgggactctggccgtattcttcctcctgatcatgggccagctgacctggaacgacctcatccgcctgtgcatcatggtgggggcgaacgcttccgaccgcatgggcatgggaactacctacctagcgctgatggccaccttcaagatgcggcctatgttcgccgtagggctgctgctacgcaggttgacttcgcgagaggtgttactcctgacgatcggcctgtccctcgtagcgagtgttgagcttccaaactccttggaggaactcggggacggtctggccatgggcataatgatcctcaagctcctgaccgattttcagtcacaccagctatgggccaccctcctgtctctgacattcattaagacgaccttcagcctacactacgcctggaagacaatggcaatggtcctgtccatcgttagcctgttcccgctctgcctgtccacgacgtcgcagaaaaccacctggctccctgtgctcttggggtccctgggctgcaagcctctcaccatgttcctgattgcggaaaacaagatctgggggcgaaagagctggcccctgaacgagggcataatggccgtggggatcgtttccatcctccttagcagcctccttaagaacgacgtccctctggccggcccgctgatcgccggcgggatgctcatcgcgtgctacgtgatctccggctcctccgcggacctgtctctggagaaggccgctgaggtttcctgggaagaggaggcggaacatagcggcgcaagccataatatcctcgtggaggtgcaggacgacggcacgatgaagattaaggacgaggagcgcgatgatactctgaccatacttcttaaggctactctactggcggtcagcggggtgtaccccttgagtattcccgcaaccctgttcgtgtggtacttctggcagaagaaaaagcagcggagcggggtcctctgggacacaccctccccgcccgaggtggaacgcgccgtgctggacgacggcatctaccggatcatgcagagagggctcttaggccggagccaggtcggagtgggagttttccaggagaacgtctttcacaccatgtggcatgttaccagaggagcggtccttatgtaccaaggcaagcggttagagccgagttgggccagcgtaaagaaggacctgatatcctacggcggagggtggaggctccggggctcttggaacaccggcgaggaggtgcaggtaatcgccgtggaacccggtaagaacccgaagaacgtgcagacggccccgggtaccttcaaaacccccgagggggaggtgggtgcaatcgccttggacttcaagcccggcacctccgggagcccgatcgtcaaccgcgagggcaagatcgttggtctgtatgggaatggcgtggtcactacttccgggacctacgtaagcgccattgcccaggccaaggcaagccaggaagggcccctgcccgagattgaggatgaggtgttcaggaaacgaaatctcactatcatggacctgcatccggggtccggcaagacgcggagatacttgcccgccatcgtccgggaggcgataaaacggaagctccgcacccttatcctggcccctacccgggtggtggccagcgagatggcggaggcgctaaagggtatgccaatacgctatcagactacggccgttaagtccgaacacaccggtaaagagatcgtggacttgatgtgtcacgccactttcaccatgcggctcttgagccccgtacgcgtgcccaactacaacatgatcataatggacgaggctcacttcactgacccctcgtccatcgcggctcggggctacatctctacacgcgtgggtatgggcgaggccgcagctatttttatgacggcaacacccccggggagtgttgaagccttccctcagtccaacgccgtgatccaggacgaggaacgggacatccccgagcgcagctggaatacaggttacgaatggattaccgactttccagggaagaccgtctggttcgtgccctcaatcaagagcgggaacgatatcgccaactgcctacgaaagaacggcaagcgcgtcattcagctgtcccggaaaaccttcgacacggagtaccagaagaccaagaacaatgactgggactacgtggtgactaccgacatcagcgaaatgggggcgaacttccgcgccgatagagtgatcgaccccagacggtgcctaaaaccagtcatcttaaaagacggacccgagcgcgtgatcctggccgggccgatgccagtcactgtggcgtctgccgctcagcggagaggccggatcggccgcaaccataacaaagagggggaccagtacatctatatgggccaaccgctcaataatgacgaggaccacgctcactggaccgaggctaaaatgctgctggacaacatcaacacacccgaaggtattataccagcccttttcgaaccagaacgggaaaagagcgcagcggtagacggcgagtaccgtttgcgcggggaggcccggaagacctttgtagagcttatgcgacgcggcgacctccccgtgtggcttagctacaaagtcgccagcgagggatttcagtattcggaccgccgatggtgcttcgatggggaacgaaacaaccaggtgctggaggagaacatggacgtcgaaatctggactaaggagggcgagcgcaagaagctccgcccccggtggctggacgcccgcacttattccgacccattggccctccgggagttcaaggagttcgctgccggacgacggtccgtctccggcgacctgatcctggagatcggcaagctgccccagcacctgacccagcgagcccagaacgccctggacaacctagtcatgttacataactccgaacaaggagggcgggcttatcgccacgcaatggaggagctccccgataccatcgagacgttaatgctgctagccctaatcgccgtgctgaccggaggtgtcacactgttctttctctccggtcgcggcctaggcaagaccagcattgggctgctctgtgtgatggctagctctgttttactttggatggcgtcggtcgaaccacactggattgccgccagtatcattctcgagtttttcctaatggttctcctaataccagagcccgatcggcagcgcaccccacaggacaatcaattagcctacgtagttatcggactactcttcatgatcctggccgtggcggccaacgaaatgggcctgctcgaaacgaccaagaaggacctgggtatcgggcacgtcgccgtcgaaaaccaccaccacgccgctatgctagacgtcgacctccaccccgcgtccgcctggacgttgtatgcggtggccaccactatcatcacccctatgatgagacatacgatcgagaacaccacggctaacatcagcctgaccgcgattgccaaccaggccgccattttaatgggcctggataagggttggcccatatccaagatggatattggtgtccctctgctcgctctgggctgctactcacaggtgaatcctctaacactcaccgccgccgtgttaatgctggtcgcccactacgcaatcatcgggccaggcctccaggcaaaggccacacgggaggcccagaagagaacagccgcagggatcatgaagaatcccacagtggacggcattgtagctattgacctagaccccgtcgtgtacgacgccaagttcgaaaagcagcttggccagattatgctcctgatcctgtgcacctcccagatcctcctgatgcgcaccacctgggccctgtgcgaatcaatcaccctcgcaactgggccgttgacaaccctgtgggagggaagtcctgggaagttctggaacaccaccattgccgtgagcatggcgaacatcttccggggatcgtacctcgccggcgcggggctagccttcagcctgatgaagtcccttggcgggggccgccgggggacaggcgctcagggcgagacattaggggaaaaatggaagcgccagctgaaccagttgagcaagagcgagttcaacacctacaaacgcagcggcatcatggaggtcgatcgaagcgaagccaaggagggcttgaagcgtggcgagaccactaaacacgccgtctcccgggggaccgccaaattgcgttggttcgtcgagcgcaacctggtgaagcccgagggcaaggtcatagatttgggttgcgggaggggcgggtggagctactactgcgccggcctaaagaaagtaaccgaggtcaaagggtataccaagggcggccccgggcacgaggaaccgatccccatggcgacttacggatggaatctagtaaaattacactctggaaaggacgtgttcttcataccgcccgagaagtgcgacaccttactgtgtgatataggtgagtcctcccccaaccccactatcgaggagggacgtacccttcgggtactgaagatggtggagccctggcttcggggcaaccagttctgcataaagatcctcaatccctacatgccgagcgtggtggagacgttagaacagatgcaacgcaagcacggcgggatgctggtgcgcaaccctctaagccgaaactccacgcatgagatgtattgggtatcctgtggtacagggaatatcgttagcgctgtgaacatgacatcccgcatgctgctgaaccgcttcaccatggcccatcgcaagcccacgtatgaacgcgacgtggacttgggcaccggcacccggcacgtcgccgtggagccagaggtggccaatctggatataattggacagcggatcgagaacatcaagcatgagcacaagagcacctggcactatgatgaggacaacccttacaaaacttgggcctaccatggctcgtacgaagtaaagcccagcgggtcagcgagctccatggtgaacggagtggtaaagctcctcactaagccctgggatgtgatccccatggtcacgcagattgctatgacagacacgacccctttcgggcagcagcgggtcttcaaggaaaaagtcgacactcggacccccaaggccaagcggggcaccgcccaaatcatggaagtcacagcgcgttggctgtggggcttcctgagccggaacaagaaaccccgcatctgcacccgggaggagttcacgcgcaaggtgcgcagcaacgccgccatcggggccgtgttcgtcgacgagaaccagtggaactccgcgaaggaagccgtggaagacgagcgcttctgggatctcgttcatagagagcgcgagctgcacaaacagggaaagtgcgccacgtgcgtgtacaacatgatgggtaaacgggagaagaaattgggcgagttcgggaaggctaagggctcgcgcgccatatggtatatgtggctcggtgcaaggttcctggagttcgaggcacttgggttcatgaacgaagaccattggttcagccgcgaaaactcactcagcggcgtggagggggagggccttcacaagctggggtatattttacgggatataagtaagatcccgggaggcaacatgtacgcagacgacactgccgggtgggacacccgcattactgaggatgacctgcagaacgaggccaagatcacggatataatggagcccgagcatgcgctgcttgctaaggcgatctttaagctgacgtatcagaacaaggtggtcagggtgcagcgacccgccaagaacggcaccgtcatggacgtcatttcccgcagggaccagcgcggcagtggccaggtgggtacctacggactgaacacgttcacgaatatggaagcgcagctcatacggcaaatggagtccgagggtattttcagcccctccgagcttgagaccccgaacttggcggagcgcgctctcgattggctggagaaatacggggtagaaaggctgaagcgcatggccataagtggcgacgactgcgttgtaaagcccatcgatgaccggttcgccacggccttgacggccctgaacgatatggggaaagttagaaaggacattccccagtgggagccctccaagggctggaacgattggcagcaggtaccgttttgctcgcatcacttccatcaattgataatgaaggacgggcgggagatcgttgtgccctgccgcaaccaggacgagctcgtcgggcgagcccgagtgtctcagggcgcggggtggagcctgcgagaaaccgcttgcctgggcaagtcctacgcgcagatgtggcagctcatgtacttccaccgccgggacctgaggctagccgcgaatgccatctgtagcgccgtacccgtcgactgggtgcccactagccggacaacgtggtctatccatgcgcaccaccagtggatgaccacagaggacatgctctcggtgtggaaccgcgtctggatagaggaaaacccgtggatggaggataaaacccacatctcctcctgggaggatgtgccctaccttgggaagcgcgaggaccagtggtgtggctccctgatcggcctcacggcccgggccacctgggccaccaacatccaggtagccataaaccaagttcgccggctcatcgggaacgaaaactaccttgactatatgaccagcatgaagcgcttcaagaacgagtccgacccagagggcgcattatggtag

SEQ ID NO: 24189 - RNA, 9879 nt, synthetic construct
  misc_feature 1..9879: note = derived and/or modified CDS sequence (opt11) from DENV-1__FJ461313__SS-prME
  source 1..9879: mol_type = other RNA
agcgtcacaatgctgcttatgttaatgcctaccgccctggctttccatctcaccacgcgtggcggagagccgcacatgatcgtcagcaagcaggagcggggcaaaagcttacttttcaagacctcagccggggtgaatatgtgcactctcatcgccatggacctgggagagctgtgcgaggatacgatgacgtataagtgccccaggatcacagaggcggagcccgatgatgtggactgttggtgcaacgccacggatacctgggtgacctacgggacctgctcacagaccggagagcaccggcgggacaagcgttccgtggccctcgcgccccatgtgggcctggggctggagacacgcactgagacctggatgagctccgagggcgcgtggaagcagatccagcgggttgagacgtgggccctccgccaccccgggttcacagtgatcgccctgttcttagctcacgccatcgggaccagcattacccagaaagggataatctttatccttctgatgctggtcaccccctccatggcaatgaggtgtgtcggaataggttcccgcgacttcgtggagggcctatccggggcaacgtgggttgatgtcgtgctggagcacgggagctgtgtgaccacgatggccaaggacaagcccaccctagacatcgaactcttgaagacagaggtgacaaaccccgctgttctgcggaagttgtgtatcgaggccaaaatttccaacaccaccactgacagccgctgccctactcagggcgaggccaccctagttgaggagcaggacgccaacttcgtctgccggcgcaccttcgtcgatagaggctgggggaacggttgcgggctattcggcaaggggtccttaataacgtgtgctaagtttaagtgtgtgacgaagctggaaggaaagatcgttcagtatgaaaacctgaaatatagcgtcatcgtgaccgtccacaccggagaccaacatcaggtcgggaacgagtccacggaacacggcacgaccgcgaccatcacccctcaggcacccacgaccgagatccagctcaccgattatggcgcgttgaccctggactgtagcccccgcacgggcctggacttcaatgagatggtcctgctgaccatgaaggagaagtcctggctcgtacacaagcagtggtttctcgaccttcccctcccctggaccagcggtgcaagcacctcccaggagacttggaaccggcaggacctgctggtgacattcaagaccgcgcatgccaagaagcaggaggtcgtggtcctcggatcacaggagggcgccatgcacacagccctgacgggggccactgagatccagacctccggcacgacaaccatcttcgccggccacttaaagtgccgcctcaagatggacaagctaaccctgaagggcatgagctacgtcatgtgcactgggtcgtttaagctcgaaaaggaggtggcggagacgcaacacggcacggtgttggtccagatcaagtatgaaggcaccgacgccccctgtaagatccccttctcaacccaagacgagaagggagtgacgcagaatggccggctgataaccgccaatcccatcgtgacagacaaggagaagcccgtcaacattgaagccgagccccccttcggcgagtcctacatcgtgatcggcgcgggggagaaggccctgaagctgtcctggttcaaaaagggctctagcatcggtaagatgttcgaggcaaccgctcgcggggcccggcggatggcaatccttggcgacacggcctgggactttgggtcaatcggcggcgtgttcaccagcgtcgggaaactcgtccaccagatcttcggcaccgcctacggggttttgttttccggagtcagctggaccatgaagatcggaatcggtgtgttactgacctggctcggtctgaactcccgctcaacctcgctgagcatgacgtgtatcgcagtggggctagtcactttgtacctgggggccatggttcaagcggactccgggtgcgtgatcaattggaagggccgggagctcaagtgcgggtccggcattttcgtcaccaacgaggtgcacacctggactgagcagtataagtttcaggccgatagcccgaagcgcctgtccgccgccatcggcaaggcctgggaggaaggggtgtgcggtatccggagtgcgacccgactcgagaacattatgtggaagcagatctccaacgagctgaaccacatcctgctggaaaacgacatgaagctcacagtcgtggtgggcgacgtcgccggtatcttgggtcagggaaaaaaaatgatccggccccaacccatggagtataaatattcttggaaatcctggggcaaggcaaagataatcggggccgacgcgcagaacactaccttcatcattgacggacccaacacccctgagtgccctgacgaccagcgcgcctggaatatctgggaggtggaagactatgggttcggcatcttcaccactaacatttggttgaagctgcgggacagctatacccaggtgtgcgaccacaggctgatgtcagcagccatcaaggactccaaggccgtgcacgcggacatgggttactggatcgagtccgagaagaacgagacctggaaactcgccagggcctcgttcatcgaggtaaagacctgcatctggcccaagtcccatacgctctggagcaacggggtgctggagtcagagatgatcataccgaagatctacggggggccaatctctcaacataactaccgacccggatacttcacccagaccgccgggccatggcacttgggcaagctagaacttgatttcgacctatgcgaaggcaccacggtagtggttgatgagcactgcgggaaccggggcccgagtctccgcaccactaccgtcacggggaagattatccacgagtggtgctgcaggagctgcaccttgccgcccctgcgcttccggggcgaagacggctgctggtacggcatggagattcgccctgtgaaggagaaggaagagaacctcgtgaagtctatggtcagcgcgggcagcggggaagtcgactccttctcgctgggcttactctgcatctccatcatgattgaggaggtgatgcggagccggtggagccggaagatgctaatgaccggcacccttgcggtgttcttcttactgataatgggtcagctgacgtggaacgacctcatccgcctgtgcattatggtgggggctaacgcgagcgaccgcatgggcatgggcactacctacctcgccttaatggccaccttcaagatgcggccgatgttcgcggtcggtctgctgttccgtaggttaacctcccgcgaggtcttactgctcaccatcggtctttctttggtagcctccgttgagctgccaaacagcctagaggagctcggggacggcctcgcaatgggcatcatgatcctgaaactgctcaccgacttccagtcccaccaactatgggccaccctgctcagcctgactttcatcaagaccaccttctccctgcactacgcgtggaaaaccatggcaatggtactctcgatcgtgtccttatttccactgtgtctctcaactacgtcccaaaagactacctggttgcccgtcctgctcgggtccctgggatgcaagccgctgacaatgttcctcatcgccgagaacaagatctgggggagaaagagttggccattaaacgaaggcatcatggcggttgggatcgtgagcatactgctctcttcgctgctgaagaacgacgtccccctggccggccccctgatcgcaggtgggatgctgattgcgtgttacgtaatcagcggctcctcagcagatctctcgctggaaaaagcggccgaggtgagctgggaggaagaagccgagcactccggggccagccacaatatcctggtcgaggtgcaggacgacggcaccatgaagatcaaagacgaggagcgggacgacactctcaccattctgctgaaggccaccctcctggccgtctccggagtgtaccccctatcgatacccgccaccctcttcgtgtggtacttctggcagaagaaaaagcagcggagcggggtgctgtgggacacccccagcccgcccgaggtagagcgcgcggtgctggacgacggcatctaccggataatgcagcgggggctcctcggccggagtcaagtgggggtcggtgtttttcaggagaacgtgttccacacaatgtggcatgtcactcggggcgcggtcctgatgtaccagggaaagcggttagaacccagttgggcctccgtgaagaaggacctcattagctatggcgggggctggagacttcgggggtcctggaatacgggggaggaagtccaggttatcgcagttgagcccggaaagaaccccaaaaacgttcagaccgccccgggcaccttcaagacacccgagggcgaggttggggcgatcgctctagactttaagcccggcacgagcggatccccaattgttaaccgcgagggcaagatcgttggtctctacgggaacggcgtcgtgaccaccagtgggacctatgtcagcgccatcgctcaggcaaaggcctcccaggagggccccctgcccgagatcgaggatgaggtattccggaagaggaatctgacgatcatggacctccaccctgggagcgggaagacccggcgatatttgccagccatcgtgcgggaggccatcaagcgcaagctgcgcaccctcatcctggcccccacacgggtggtggcgagtgagatggccgaggccctgaaaggtatgccaattcgctaccaaacgaccgccgtcaagtcggagcacaccgggaaggagatcgtagatctcatgtgtcacgccacctttaccatgcggctgttgagtcccgtgcgcgttccgaattacaacatgatcattatggacgaggcgcatttcacggacccctcgtctatcgcggccaggggctatatcagcacgcgtgtcgggatgggtgaggccgcagcgatcttcatgaccgccacgccgcccggttctgtggaggcattcccgcagagcaacgccgtaatccaggatgaggaacgggacatcccggagcgctcctggaacagcggctacgagtggatcaccgacttccccggaaagacggtctggttcgtgccctccattaagagcggcaacgacatcgcgaattgcctccggaagaacggaaagcgggtcatccagttgagccggaaaaccttcgacacggagtaccagaagacgaagaacaacgactgggactacgtcgttaccaccgatatcagtgagatgggggctaatttccgtgctgaccgggtcatcgacccgcgccggtgtctgaagcccgtcatcttaaaggatggacccgagcgcgtgatcctggccgggcccatgcccgtgacggtcgcttccgccgcccagcggagggggcggattggccgcaatcacaacaaggaaggggaccaatacatctatatgggccagcctctgaacaacgatgaggaccacgcccattggaccgaggccaaaatgctactggacaacatcaacacacccgaaggtatcatccccgccctgttcgagcctgagcgcgaaaagagtgcggccgtggacggcgagtaccggctgcgcggagaggcccgcaagaccttcgtggaactgatgcgccgtggtgacctccccgtgtggctcagctacaaggtggcgtccgagggcttccagtactcggaccgccggtggtgctttgatggggagcgcaataaccaggttttagaggagaacatggacgtggagatctggactaaagagggcgagcggaagaagctccgcccacggtggctcgacgcccgcacatactccgaccccctggcgctgagagaatttaaagagttcgccgccggtcgtcggtcagtgagtggcgacctcatcttagagatcggcaagttgccgcagcatttaacccagcgagcccagaacgcacttgacaacctggtcatgctccacaacagcgagcagggcgggagagcttaccggcacgccatggaggagttacccgacaccatcgagaccctgatgttgctggccctcatcgcagtgttgaccgggggggtgaccctgttcttcctgtccgggcggggcttgggtaagaccagtatcgggctgctttgcgtcatggcgtcgagcgtgttgctgtggatggcctctgttgagccccactggatcgccgccagcatcattctcgaattcttcctcatggtcctgctgatccccgaacccgaccgccagcggacgccccaagacaaccaactcgcatacgtggtgatcggcctgctcttcatgattctcacggtcgcggccaacgagatggggctgctggagaccaccaagaaggacctcggcatcgggcacgtggcagtggagaaccatcaccacgccgccatgttggacgtagacctgcaccccgcctcagcctggactctctacgcggtggccacgaccataatcaccccgatgatgcgccacaccatcgagaacacgaccgccaacatcagcttaaccgcgatcgccaaccaggccgcaatcctaatgggcctggacaaagggtggcccatctccaagatggacattggggtaccactgcttgcgcttggctgctactcacaggttaatcccctgaccctgacggccgcagtcttgatgctggtggcgcactacgccattatcggcccgggccttcaggcgaaggcgacacgcgaggcccagaaacggactgccgccggaatcatgaagaaccccactgtcgatggcattgtggcgatcgaccttgaccccgtggtctatgacgcgaagtttgagaaacagctagggcaaataatgcttcttatcctgtgcacgtcccagatcctgctgatgcgcaccacctgggcactgtgcgagagcatcaccctggccacggggcctctcacaaccctgtgggaaggctccccggggaagttctggaacaccaccatcgcagtaagtatggcgaacatattccgggggtcctacctggccggggccggactcgccttctcgctgatgaagagcctaggcgggggccgacggtcgaccggggcgcaaggggagactctcggcgaaaagtggaagcgccagctaaaccaactatcaaagtccgaatttaacacgtacaagcggagcggcatcatggaagtggacagatccgaggctaaggaaggcctcaaaaggggcgaaaccaccaaacacgccgtcagcaggggcaccgccaaattacggtggttcgtggaacgtaacctagtcaaacccgagggcaaggtcatcgacctgggctgcggaaggggtggatggtcctactactgcgccgggcttaagaaggtgacagaggttaaggggtatacgaaaggcggcccaggccacgaggagcccatcccgatggctacctacgggtggaaccttgtaaaattacacagcggcaaggatgtgttttttatcccgcccgagaagtgtgacaccttgctctgcgacattggggaatccagccccaatccgaccatcgaggagggacggacactgagagtgctaaaaatggtcgagccttggcttcgcgggaaccaattctgcatcaagattctgaacccctacatgccctccgtggtggagactctcgagcagatgcaacgaaaacacggcggcatgctggtccgcaacccgctgagcagaaactccacccacgaaatgtactgggttagctgcggtaccggcaacatcgtctccgctgttaatatgaccagtcgcatgttgctgaacagattcaccatggcccaccggaagcccacctatgagcgcgatgtggacttagggaccgggacccggcacgtggccgttgagcccgaggtggcaaacctcgatataatcggtcagcgtatcgagaacataaagcacgagcacaagtccacctggcactacgacgaggataacccctacaaaacctgggcgtaccacgggagctacgaggtgaagccttccggtagcgccagctccatggtcaacggtgtggttaagttactgactaagccctgggatgtgatccccatggttacacagatcgcgatgacggacacaacccccttcggccagcagagagtcttcaaggagaaggttgatactcgcactcccaaggccaagcggggaactgctcagataatggaggtgactgcgcgatggctctggggcttcctgagcagaaacaagaagccccggatatgcacccgggaggagtttacacgcaaggtccggtccaacgctgctatcggggctgtgttcgtggacgagaaccagtggaactcggccaaggaagccgtagaagacgagcgcttctgggacctcgtgcacagagagagagagcttcacaagcagggcaagtgcgcgacatgtgtgtacaatatgatgggcaagagagaaaagaaactgggagagttcggcaaggccaaagggtccagagccatttggtatatgtggctgggcgcgcggttcctcgagtttgaggccctgggctttatgaacgaagaccactggttcagccgcgaaaactctctaagcggggtcgagggcgaggggctacacaagttgggttacatcctacgggacatctcgaagatccccgggggaaacatgtacgccgacgacaccgccggctgggacaccagaatcaccgaggacgatctccagaatgaggccaagattaccgacatcatggagccggagcatgcgctgctggccaaggcaatcttcaagcttacctatcagaacaaggtggtgcgagtacagcggcccgccaagaacggcacagtgatggatgtgatcagccgccgggaccagcggggatccgggcaagtcggaacgtatggcctgaatacattcaccaacatggaggcccagttaatccggcagatggaaagcgagggcatcttctccccctccgagctcgagacccccaacctggcggagcgcgccctgaactggctcgagaagtacggcgtggaaaggttaaagcgtatggccatcagcggggatgactgcgtggtgaagccgatagacgaccggttcgccacggccctgaccgcgctcaacgacatgggcaaggtgcgcaaggatatcccccagtgggagcccagcaaagggtggaacgattggcagcaggtccccttctgttcccaccattttcaccagctgatcatgaaggacggccgagagatcgtcgtaccgtgtaggaaccaggacgagctggtgggccgggcccgggtcagccaaggagctggctggagcttaagagagaccgcctgtctggggaaatcctatgcgcagatgtggcagttaatgtacttccacaggcgcgacctccgcctagctgccaacgccatatgtagtgccgtgcccgtagattgggttcccaccagtcggacgacgtggagcatccacgcccaccatcagtggatgacaaccgaggatatgctgtctgtttggaaccgcgtgtggatcgaggaaaacccgtggatggaggacaagacgcatatctcatcttgggaagacgttccgtacctcggcaagcgcgaggaccagtggtgcgggagcctgattggtttaacagcgcgggccacctgggctaccaacatacaggttgcaataaaccaagttcgccggctcatcggcaacgagaactacctggactacatgacctccatgaagagattcaagaatgagagcgaccccgaaggggcgctctggtag

SEQ ID NO: 24190 - RNA, 9879 nt, synthetic construct
  misc_feature 1..9879: note = derived and/or modified CDS sequence (opt11) from DENV-1__FJ547063__SS-prME
  source 1..9879: mol_type = other RNA
agcgtaaccatgttgctcatgctgatgcctaccgccctggccttccacctcactacccggggcggggagccacacatgatcgtgtcgaagcaagagcggggtaagtcactgctattcaagaccagcgccggtgtcaacatgtgtaccttgatcgctatggacttgggcgaactgtgcgaggacaccatgacctacaagtgtccccggatcaccgagaccgaacccgacgacgtggactgctggtgtaacgcgacggacacctgggtgacttacggtacctgtagccagacgggtgagcatcggcgggacaagcggtcagtagcccttgcgccccacgtgggcctcgggctcgagacccgcaccgaaacttggatgagctccgagggcgcgtggaaacaaatccagcgggtagagacgtgggctctccggcaccctgggttcacagtgatcgccctgttcttggcccacgctatcggcacaagcatcacccagaaggggataatcttcatcctcctgatgttagtgactccctccatggccatgcgatgcgtaggaatcggatcgcgggacttcgtcgagggcttatccggcgccacctgggtggacgtcgtgctggaacacgggtcatgtgtgaccaccatggccaaggacaagcctacgctggatatagagctcttaaagacagaagtcaccaaccccgcggtgctgaggaaactctgcatagaggcaaagattagtaataccacgaccgacagccgctgccccacacagggcgaagccacattggtggaggagcaggacgctaacttcgtctgccggcgcacgttcgtagaccgagggtggggtaacgggtgcgggctgttcggcaaggggagcctaataacgtgcgccaagttcaagtgcgtaaccaagctagaggggaaaatcgtgcaatatgagaacttgaagtactcagtgatcgttaccgtccacaccggcgaccaacaccaggtggggaatgagtcaacggagcacggcaccacagccacaatcaccccccaggcgcccacgaccgagatccagttaactgactacggtgctctgacgctggattgtagtccccgcaccggtttggacttcaacgagatggtccttttgaccatgaaggagaagtcctggttggtgcataagcaatggttcctggacctgccattgccttggacaagcggtgccagcacatcccaggagacctggaaccggcaggatctgctggtgaccttcaagaccgcccatgccaagaaacaggaggtcgttgtgttgggctcgcaggagggcgcgatgcacacagcactgaccggggccaccgaaattcaaacctccggcacgaccaccattttcgccgggcacctaaagtgcagacttaagatggacaagctgactctgaagggaatgagctacgtaatgtgtacaggatccttcaagttggaaaaggagctagctgagacccagcacggcacggtgctagtgcagattaagtacgagggcacagatgcgccctgcaagatcccgttcagcacgcaagacgagaagggggttactcagaacggccggctgattaccgctaacccgatcgtgacggataaggaaaagcccgtgaacatcgaggctgagccccccttcggggagagctacatcgttataggggccggcgagaaggcgctgaagctgtcgtggttcaagaaagggtcaagcatcggcaagatgttcgaggctacggcccgcggagcccggcgcatggccatcctgggcgatacagcttgggacttcggatccatagggggcgtgtttaccagtgtggggaaactcgtccaccagatctttggcaccgcctatggtgtgctgttctcgggcgtgagctggacgatgaaaatcgggatcggagtcctgttaacctggctgggcttaaactcccggagcacgtctttaagtatgacgtgtatcgccgtcgggctggtaacgctgtacctcggcgtcatggtgcaggccgacagcggctgtgtgatcaactggaaaggcagagagttaaagtgcgggagcggcatctttgttaccaacgaggttcacacatggaccgaacagtacaaattccaggccgatagcccgaagcgcctctccgccgctatcggcaaggcttgggaggagggggtatgcggcatccgatccgcaacgcgcctcgaaaacataatgtggaaacaaatctccaacgagctgaaccacatcctgcttgagaacgacatgaagttcacggtcgtggtgggggacgtcgcaggcatcctggcgcaggggaaaaagatgattcggccccagcccatggaatacaagtacagctggaagagctggggtaaggccaagatcatcggcgccgacgtgcaaaacaccacattcataatcgacgggcccaacaccccggagtgccccgacgaccagcgtgcttggaacatctgggaggtagaggattatggtttcgggatcttcacgaccaacatctggttaaagctccgggacagctacacccaggtttgcgaccaccgcctgatgtccgcggccatcaaagactcgaaggccgtgcacgccgatatgggctactggatagagtccgagaagaacgagacatggaagctggcccgcgcgagcttcatcgaggtcaagacgtgcatttggccgaagtcgcacaccctctggtctaacggcgtcctggagtcagagatgataatccccaaaatctatgggggccctatcagccagcataactaccgcccggggtacttcacccagaccgccggcccctggcacctggggaagctcgagttggactttgatctgtgcgaagggacgaccgtcgtggtcgacgagcattgtggcaaccgggggccgtccctcaggaccaccacggtgactggcaaaatcatacacgagtggtgttgccggagctgcacgctgccgccgctgcgcttccgcggggaggacggttgctggtacgggatggagatacgccccgtgaaggagaaagaggagaacctcgtcaagtccatggttagcgccggctccggtgaggttgactccttcagcttagggctactctgcatctccatcatgattgaagaagtcatgcggagtcgctggtcccggaagatgctgatgacgggcaccctggccgtctttttcctcttgataatggggcagctgacctggaatgacctcatccggctgtgcattatggtgggcgccaacgctagcgaccgcatgggtatgggcaccacctatctggcactcatggccacgttcaagatgcggccgatgttcgccgttgggcttctgttccgacgtctcactagccgagaagtcctgcttctcaccatcggactgagcctggtggcctcagtggaactccctaactcgctggaggagctgggggacggactcgccatggggatcatgatcctgaagctgctcacggacttccaatcacaccaattgtgggccacgcttctgagcctgaccttcattaagaccaccttctcactacactatgcctggaaaacgatggcaatgattttaagcatcgtgtccctgttccccctgtgcctctccaccacctcccagaagactacgtggctgccagtcctgctcggcagcctgggttgtaagccattgaccatgttcctcatcgcggagaacaagatctggggccggcgctcctggcccctgaacgaggggatcatggcagtgggcatcgtcagcattctgctgagctccctgttaaagaacgatgtccccttggccgggcccttaatcgccggcggtatgctgatcgcctgttacgtgatcagcgggtcgtccgcggacttatccctggagaaggccgccgaggtgagttgggaggaggaggccgagcacagtggagcgagccataacatccttgtcgaagtgcaggacgacggaaccatgaaaataaaggacgaggagcgggacgacaccttgaccatattactgaaagcgacactcctggccgtgtccggcgtctaccctctaagcatcccggccacgctcttcgtctggtatttttggcagaagaagaagcaacgatcgggtgtgctatgggacacgccctccccgccggaagtggagcgtgcagtgctagacgacgggatctaccgcatcatgcagcggggcctgctagggcgctctcaggtgggcgtcggagtgttccaggagaacgtctttcacaccatgtggcatgtcacgcggggcgccgtcctgatgtatcaggggaagcgcctggagcctagctgggcgtcagtgaagaaggacctcatcagctatggcggggggtggcggctccaggggtcatggaacactggtgaagaggtccaggtaatcgctgtggagcccggcaaaaaccccaagaatgtccaaacggcccccggaacctttaagacgcccgagggcgaggtgggggcaatcgcccttgattttaagcccggtaccagcggcagccccatcgtgaaccgcgaggggaagatcgtcggcctatacggcaacggggtggtgaccacctctggcacttacgtctccgcaatcgctcaggccaaggcatcccaggaggggccgctacccgagatcgaggacgaggtgttccggaaacgcaacctgaccataatggacctccacccggggagcgggaaaactcggcgttacctcccggcgatcgtacgggaagccataaagcgcaagctgcgcaccctcatcctggcgccgacgcgggtggtagccagcgagatggccgaggcgttaaaaggcatgcccatccgctaccaaaccacggcggtaaagagcgagcacaccgggaaggagattgttgacctcatgtgtcacgccacgttcaccatgcgcctgctgtcccccgtgcgggtaccgaactacaacatgatcattatggacgaagcccacttcaccgacccatcttccatcgctgcacgcgggtacataagtaccagagtcggcatgggtgaggccgccgccatcttcatgacagccacgccgcccggttccgtggaggcgttcccgcaatcgaacgctgtgatccaggacgaggagcgggacattcccgaaaggagctggaacagcgggtacgaatggatcaccgatttcccagggaaaacggtttggttcgtgccctccattaagagcggaaatgacatagccaactgccttcggaagaacgggaagcgcgtgatccagctgtcacggaagacgttcgacacggagtaccaaaagaccaaaaacaatgattgggactacgttgtgacgacggacatctccgaaatgggagccaatttccgcgcggaccgggtgattgacccgagacggtgtctgaagcccgtcatcctcaaggacgggccagaacgcgttatccttgccggacccatgccggtgaccgtcgcctcggctgcacagcggagagggaggataggcaggaaccacaataaggagggcgaccagtacatttacatggggcagcccctgaacaacgacgaggaccacgcgcactggaccgaggccaagatgctattggacaatatcaatactccggagggcatcatccccgcgctgtttgaacctgagagagagaagtccgcagctatcgacggggaatatcggctccgcggcgaggcgcggaagacgttcgtggagcttatgcgccgcggcgacctgcccgtctggttaagctacaaagtggcctcggaaggattccaatatagcgaccgccggtggtgtttcgacggagagcgcaacaatcaagtgctggaggagaacatggacgtcgagatctggaccaaagaaggcgagcggaagaagctgcgccctcggtggttagatgcgcgcacctactccgaccccctggccttgcgagagttcaaggagttcgccgcaggccgacggtcggtaagtggggacctcatcctggagatcggcaagcttccgcaacatttaacccagcgcgcccagaacgccctggacaacctcgtgatgttgcacaacagcgagcagggcggacgtgcataccgccacgcgatggaggagctgcccgacacgatcgagaccctgatgctgctggccctgatcgccgtccttaccgggggtgtcaccctgttcttcctgtcgggccgagggctcggcaagaccagcatcggcctgctgtgcgtgatggcctccagcgtcctcctgtggatggcctcggtagagccccactggatcgcggccagcataatcctggagttcttcctcatggtgttgctgatccccgagccggatcgccaaaggactccccaggataaccagctcgcgtatgtcgtaatcggactgctgttcatgatcctcaccgtggccgccaacgagatgggcctgctggaaaccaccaagaaggatctcgggatcggccatgtcgcggttgagaaccatcaccacgccgcaatgctcgacgtcgacctgcaccccgccagcgcctggactctatatgcggtcgccaccaccatcattacaccgatgatgcggcacacgatcgaaaacacaaccgccaatatcagtctcacagcgatcgccaaccaggcggccattctgatggggctcgacaagggctggccaatctccaagatggacatcggtgtgcccctgttggctctcgggtgctatagccaggtgaatccgctaacgctgaccgctgctgtcttgatgctggtggctcactacgccattatcgggccagggctgcaggccaaggccacacgcgaggcgcagaagcggacagcagccgggataatgaagaaccctacggttgacgggatcgtcgcgatcgacctcgaccccgtggtgtatgacgcgaagtttgagaagcagctgggccagatcatgctgctaatactgtgcacatcccagatcctgctcatgaggaccacatgggcgttgtgtgagagcattacgctggccaccgggcccctgaccaccctttgggaggggtccccggggaagttctggaacaccacaattgccgtttccatggccaacatcttccgggggtcctacctggccggcgcgggccttgcctttagcctgatgaagtccttggggggcggccgccgggggactggtgcccaaggcgagaccttaggggagaagtggaagagacagctgaaccagttatccaagagcgagttcaacacgtataagcggtccggtataatggaggtggaccggtccgaggccaaggagggcttgaagcgaggtgagaccaccaagcacgccgtatcgcgcggcactgccaagctgcgttggttcgtcgagagaaacctggtgaagccagaaggtaaagtgatagacctgggctgcggccgtggggggtggtcgtactattgcgccggcctcaagaaggtcacggaggtgaaggggtacacaaagggcggtcccggccacgaggagcccataccgatggccacctatgggtggaacctagtaaagctgcacagcggaaaggacgtcttctttatcccgcctgaaaagtgcgacaccctcctctgcgacatcggtgaaagttcccccaacccgacaatcgaggaggggcgcaccttaagagtactcaagatggtcgagccctggctccgcgggaaccagttctgcattaagatccttaacccctacatgccgagcgttgtggaaaccctcgaacagatgcagagaaaacatggcgggatgttagtgcgcaatccgctgcagagaaactctacccacgaaatgtactgggtctcctgcgggaccggtaacatcgtgagcgcggtgaacatgacgagccgaatgctcctgaaccgattcaccatggcgcaccggaagcccacctacgagcgcgacgtcgatctcggggccgggacacggcatgtggccgtggagcccgaagtcgccaacctagatatcatcggtcagaggatcgagaatatcaagcacgagcataaatccacatggcattacgatgaggacaacccctataagacctgggcctaccacgggtcatacgaggtcaagccctctggcagcgcctcctccatggtgaatggagtcgtgaagctgctgacaaaaccctgggacgttatccccatggtaacccagatcgccatgacggatacgacccctttcggccagcaacgggtgttcaaagagaaggttgacacccgcacgccgaaggcaaagcgcgggactgcccagatcatggaggtgaccgccaaatggctctggggcttcctgagccgcaacaaaaagcccaggatctgtaccagagaggagttcacgcggaaagtgcgctccaacgcggcaatcggcgccgtcttcgtggatgagaaccagtggaacagcgccaaggaggccgttgaggacgagcgtttttgggacctggtccatcgggagcgggagctccacaagcaggggaagtgtgcgacctgcgtttacaatatgatgggcaagcgcgagaaaaagctgggagaattcggcaaggccaaggggtcccgggccatttggtatatgtggttaggcgctcgcttcctcgagttcgaagcactggggttcatgaacgaggaccactggttcagcagagagaactccctgagcggggttgaaggtgaagggttgcacaagctcggctatatcctacgtgatatctcaaagatccccgggggtaacatgtacgcggacgataccgcaggctgggacactcggattacggaggatgatctccagaacgaagcccgtatcaccgacatcatggagccggaacacgccttactggccaagagtatcttcaagctaacttaccagaataaggtggtgcgcgtgcaacgacccgccaagaacggcaccgtcatggatgtgatctcccggcgagaccagcgaggcagtggccaggtggggacgtatggccttaacaccttcactaacatggaagcccagctgataaggcagatggagtccgaggggatctttagcccctccgagctagagacgccgaacctcgcagagcgcgtccttgattggctcgagaagtatggagtggagcgactgaagcgcatggccatctcaggggacgactgcgtggtcaagccgatcgacgacaggtttgctaccgccctgaccgccctcaatgatatgggcaaggtgcgcaaggacatcccccagtgggagcccagtaaggggtggaacgactggcagcaggtacccttctgcagccaccatttccaccagctaatcatgaaggacggccgggagatcgtcgtcccgtgccgtaaccaggacgaactggtcgggcgggcccgtgtctcccagggggccggttggtcgttacgggaaaccgcgtgcctgggcaagagttacgcccagatgtggcagctgatgtacttccataggcgcgacctccgcctggccgccaacgcgatctgctccgccgtaccagtggactggatccccaccagccggacgacctggagtatccatgcccaccaccagtggatgacaaccgaagacatgctaagcgtttggaaccgcgtgtggatcgaggaaaacccctggatggaggataagacgcacatctcgtcgtggggtgacgtgccgtacctagggaaacgcgaggaccaatggtgtggctccctgatcgggttgacggcgcgggccacctgggcgaccaacattcaggtcgccattaaccaggtcaggcggctcatcggtaacgagaactacttagactacatgacaagcatgaagcgctttaagaatgaatccgaccccgagggcgctctttggtga

SEQ ID NO: 24191 - RNA, 9879 nt, synthetic construct
  misc_feature 1..9879: note = derived and/or modified CDS sequence (opt11) from DENV-1__FJ410218__SS-prME
  source 1..9879: mol_type = other RNA
agcgtaaccatgctgctcatgctgatgcccaccgccctagcctttcacctgactaccaggggcggggaaccacacatgatcgtgacaaagcaggagcggggcaagagcttgctgttcaagaccagcgccggggtgaacatgtgtaccctcatcgcaatggaccttggggagctgtgcgaagacactatgacctataaatgccctcggatcaccgaggcggagccggacgatgtagactgctggtgtaacgccaccgacacctgggtgacttacgggacctgctctcagactggggagcatcggcgcgacaagcggtctgtcgccttggcgccccacgtggggctgggtctcgagacgcgcacggagacctggatgtccagcgaaggagcgtggaagcagatccaacgggtggagacctgggccctaagacaccccgggtttaccgtgatcgccctgttcctggcacacgccatcggcacctccatcacccagaaagggatcatctttatcctcctcatgttagtcacgccgagcatggccatgcggtgcgtcggcattggctcgcgtgacttcgtagaggggctcagcggggccacctgggtggacgtcgtgctggaacatgggtcctgtgtgacgaccatggccaaggacaaacccactttggatattgagctcttgaaaaccgaggtcaccaaccccgcggtgctacggaagctctgcatcgaggcaaagataagtaatacaactaccgactcgcgctgccccacccagggcgaggccaccctcatggaggagcaggacgctaacttcgtgtgtcggcgcacgttcgtcgacaggggatggggtaacggctgcggcttattcggcaaggggagcctcatcacgtgcgcgaagttcaaatgcgtgaccaagctagaaggaaagatcgtccaatacgagaacctcaaatattctgtcatcgtgaccgtgcacacaggcgaccaacaccaggtagggaacgaatcaaccgaacacggcaccaccgcgaccatcacgccccaagcgcccaccagtgaaatccaactcaccgactatggggccctgactctcgactgctctccccgtacgggtttggacttcaacgaaatggttctgctgaccatgaaggagaaatcgtggctcgttcacaagcagtggttcttagatctgcccttaccttggacaagcggggcctccacatcccaagagacctggaatcggcaggacctgctcgtgaccttcaagaccgcgcacgcgaaaaaacaagaagtggtcgtgctcggaagccaggagggcgcaatgcataccgccctgacgggggctaccgagatccaaaccagcggtaccaccaccatcttcgccgggcacttgaaatgccgcctcaagatggacaaacttactctaaaaggcatgagctatgtgatgtgcaccggctcatttaaacttgagaaagaggtggcggagacacagcatggcaccgtgctagtgcagatcaagtacgagggcaccgacgcgccatgcaagatccccttttcaacccaggatgaaaaaggggtcactcagaacggccggctcattaccgccaacccgatcgtgactgataaggagaagcccgtgaacattgaggccgagccccccttcggggagtcctacattgttatcggcgcgggcgagaaggccctgaagctcagctggttcaaaaaggggagtagcatcggtaagatgttcgaggcaaccgcccggggtgcgcgacgcatggcgatcttaggagacactgcctgggatttcggatcgatcggtggcgtgttcacgagcgtagggaagcttgtacatcaaattttcggcacagcgtacggggtcctgttctcaggcgtgtcttggaccatgaagatcgggattggcgtcctgttaacgtggttgggacttaactcccgttcgaccagcttatcaatgacctgcattgccgtagggctagtgaccctgtatctgggtgtaatggtgcaggccgattcaggctgcgtgatcaattggaaaggacgggaactcaaatgcggaagcggcatcttcgtcacgaacgaggtgcacacctggacggagcagtacaagtttcaggcggactccccgaagcgcctgagcgccgccatcggaaaagcctgggaagagggggtctgtggcatccggtccgcgacccgcttggagaatataatgtggaagcagatatccaatgaattgaaccatatcctactggagaacgacatgaagttcaccgtcgtggtcggggacgtcgtgggtatcctcgcgcaggggaagaagatgatcaggccacagcctatggagcataagtactcgtggaagagctggggtaaggccaaaataatcggggccgatgtacagaacacaaccttcatcatcgatgggcccaacacaccggagtgcccagatgaccagcgcgcctggaacatatgggaggtcgaggactacggcttcggcatcttcacgacgaatatctggctgaaactgagggacagttacacccaagtgtgtgatcaccgcctcatgtccgcggctatcaaggacagcaaggccgtgcacgcggacatgggctactggattgagtctgagaaaaatgagacctggaagctcgcacgggcgtcgttcatcgaagtcaaaacatgcatatggcccaagtcccacacgttatggagcaatggcgtactcgagtccgaaatgatcatccccaaaatctacggaggacctatctcccaacacaactatagaccagggtactttacgcagaccgccggcccctggcatctggggaagctggagctcgacttcgacctgtgcgagggcacaacggtggttgtggacgagcactgcggaaatcgaggcccgtccctgcgcacgaccaccgttaccggaaagataatccacgagtggtgctgccggagctgcacactgcccccactccgcttcaagggagaggacggctgctggtacggtatggagattagacctgtaaaagagaaggaggagaacctggtgaagtccatggtgagcgccggcagcggcgaggtagactcgttcagcctcggcctgctttgcatctcaattatgatcgaggaggtaatgcgtagccggtggtcccgtaagatgctcatgaccggtaccttagccgtattcctgctcttaatcatgggccaactgacgtggaacgacctcattcggctgtgcataatggtcggcgctaacgcgagcgaccgcatggggatgggcacaacgtacctggccctgatggccaccttcaagatgcgcccgatgttcgccgttggcttgctgttccggcgcctcacgtcccgggaagtactgctgctcaccatcgggctgagcctggtcgcctccgtcgagttacctaacagcctggaagagctgggagacgggttggcgatgggcattatgatccttaagttgttgaccgactttcagtcccaccagttgtgggccaccctgctcagccttacgttcatcaagaccaccctgtcgttgcactatgcctggaagaccatggccatggtcctgagcattgtgtccctattccccctctgcctgtctacgacatcccagaaaactacgtggttaccagtgctacttggctctctggggtgcaagccgttgacgatgtttctgatcgtggagaataagatctggggtcgcaagtcctggcccctgaacgagggaatcatggccgtaggcgttgtatccattctcctgagctccctcctcaagaacgacgtgcccctggccgggccactgatcgcaggcggcatgctcatcgcttgctacgtgatctccgggtcatcagccgatctgtccctggagaaggcggccgaggtcagctgggaggaagaggccgagcactctggagctagccacaacatcctagtggaggttcaggacgacggtaccatgaagatcaaggatgaggagcgggacgacacactgaccattttattaaaggccaccctgctggcggtgagcggggtgtaccctttaagtatccccgccacgttattcgtctggtacttctggcaaaagaagaaacagagaagtggggtgctatgggatacaccctcgccgccggaggtggaacgggccgtcctcgacgatggaatataccgcatcatgcagcgtgggctcctggggcgctcacaagtaggcgtgggggtgtttcaagagaacgtcttccacaccatgtggcacgtgacccgtggcgccgttcttatgtaccagggcaagcggctggagccgtcgtgggccagtgtcaagaaggacctgatcagctatggcggagggtggaggctgcagggctcctggaatacgggggaggaagtccaggtgatcgctgtcgaaccagggaagaaccctaaaaacgtgcaaaccgcgcctggaaccttcaagacccccgagggcgaggtaggcgctatcgccttagactttaaaccggggaccagcggctcccccatagtcaaccgcgaggggaagattgtgggactatacggcaacggtgtggtcacaaccagcggcacctacgtgagtgcgatagcgcaggccaaggcgtcgcaagaggggccactgcccgaaatcgaggacgaggtgttccgcaagcgcaacctcacgatcatggacctgcatccaggctcagggaagacccggcgctacctgccggccatagttcgggaggcgattaagcgcaaactccgcaccctcattctggcccccacccgcgtagtagcctcggaaatggcggaggccctcaagggcatgcccattcgctaccagacgaccgcggtcaagagcgagcacaccggcaaggaaatcgtggacctaatgtgccacgctacctttacgatgcgtctcctatcccccgtgcgcgtccctaactataatatgatcataatggacgaagcacactttaccgatcctagctcgatcgccgcccggggatacatcagcacccgcgtcggcatgggagaagcagccgcaatcttcatgaccgccactccgcccggtagtgtggaggccttccctcagagcaacgcggttatccaggacgaggagcgtgacatccctgagcgctcgtggaactcggggtatgaatggatcaccgatttcccaggtaagactgtctggttcgtaccctccatcaagagtgggaacgacatcgccaactgcttacggaaaaacggcaaacgcgtcatacagctgtcacggaagacgttcgatacggagtaccaaaagacgaagaataacgattgggactatgtagtgacgaccgacatctccgaaatgggcgccaacttccgggccgaccgggtaatagaccctagaagatgccttaagcccgtaattctgaaggacgggcccgagcgcgttattctggcaggccccatgccggtaacggtagcatcagcagcacagcggcgcggtcggatagggcggaatcacaataaggagggcgaccagtacatctatatggggcagcccctcaataacgacgaggatcatgcgcactggacggaggcgaagatgctgctggacaatatcaacacccccgagggcatcatccccgccctctttgagccggagcgggaaaaatccgccgccatcgacggggagtaccgcctgcgcggcgaggcccggaagaccttcgtggagctgatgcgccgcggggacctcccggtgtggctgagttacaaagttgcgtccgagggattccaatactcggaccgtcggtggtgcttcgacggtgagcggaacaaccaggtactggaagagaacatggacgtggaaatttggaccaaggaaggcgagcggaagaaattgcgccccagatggctagacgcccgcacctactcagacccactggcgctccgagagtttaaggagttcgccgccggccgccggagcgtgtccggggacctgatcctcgagatcggcaagttgcctcagcacctgacccagcgcgcgcagaacgctctggataaccttgttatgctgcataatagcgaacagggggggcgggcgtaccgtcatgcaatggaagaattgcccgacacaatcgagacgttaatgctgctggcgctaatcgcagtgttaaccggcggggtgaccctgttcttcctctccgggcgggggctgggcaaaacctccatcggtctgttgtgtgtcatggcctcgagtgtactgttatggatggcttccgtggagccgcactggatcgccgcgtctattatcctcgagttttttctgatggtcctgctgattcccgaacctgaccgccaacggacaccgcaggacaaccagctggcctacgtggtgataggcctcctcttcatgatcctaacggtcgccgccaacgagatgggcctgctcgagacaactaagaaagacctgggcatcgggcatgtcgcggtggagaaccaccaccacgccaccatgttggatgtcgacctccatcccgcctctgcgtggacgctgtatgccgtcgcgacgacaataattacgccgatgatgcgccacacgatagagaacaccacggccaatataagcctgacggctatagcaaaccaagcagccatcttgatggggcttgacaagggctggcccattagcaaaatggacataggcgttcccctgctcgcgctggggtgctacagccaagtaaatcccctgacgctcacagctgctgttctaatgctggtggcacattatgcgatcatcggcccaggtctccaagctaaggccacacgggaggcccaaaaaagaaccgccgcagggatcatgaagaatccaacggtcgatgggatagtcgccattgacctggacccggtggtctacgacgccaagtttgagaagcagttagggcagatcatgctccttatcctatgcaccagccagatcctcctcatgcgcaccacctgggccttatgcgagagcataacgctcgctaccggccccctgaccaccttatgggagggatcaccgggcaagttttggaatacgaccatagcggtgagcatggccaacatcttcagggggagttacctcgcaggggccggcttagcgttctcactgatgaaatcactcggtggcggacggcggggaaccggtgcacaaggcgaaaccctgggcgagaagtggaagcgacagctgaaccagctgtccaaatcggagtttaacatctacaagcggtcggggatcatggaagtggatagaagcgaggccaaagagggcctgaagcgcggggagaccacccgccatgccgtctctagaggaaccgcgaaactgcgctggttcgttgaacgcaacctcgtgaagcccgaggggaaggtcatcgacctgggttgcggccgcgggggctggagctattattgcgctgggctcaagaaagtgaccgaggtcaagggctatactaaaggcggccccggtcacgaggagcccatccccatggcaacctacggatggaacctggtcaagctccactcaggcaaggatgtgtttttcacgccgcccgagaagtgcgacaccttgctgtgcgacatcggtgagtcatcccccaacccgacgatcgaagagggtcgaaccttgcgcgtgctaaagatggtcgagccgtggctgcgggggaaccagttttgcataaagatcttgaatccctacatgccgtctgtggtggaaacactggagcagatgcagcgaaagcacggcgggatgctggtccggaatccgctctcccggaacagtacccatgagatgtactgggtgtcctgcgggacgggcaacatcgtgtctgccgtcaatatgacatcccgaatgcttctgaacagattcaccatggcccaccgcaagcccacctacgagagggacgttgacctcggggccggcacccgccacgtagcagttgaaccggaagtggccaacctggatatcatcggccagcgaatagagaacataaagcacgaacacaaaagcacatggcactacgatgaggacaacccgtacaagacctgggcctaccacggttcctacgaggtaaagccatcaggctccgccagcagcatggtgaatggggttgtaaaactgctcactaagccctgggacgtgatacctatggtgacccagatcgccatgaccgatacaactccgtttggccagcagcgtgtcttcaaggaaaaggttgacaccaggacgcccaaggctaagcgcgggacagcccagatcatggaggtgaccgcccgatggctgtggggcttcctgtcccgtaacaagaagcctcgtatttgtactagagaggaattcacgaggaaggtgcgcagcaacgccgcaattggcgcggtgttcgtagatgaaaaccagtggaacagcgccaaggaagccgtggaagacgagcgcttctgggacttagtacaaaaggagcgcgaactacacaagcaagggaagtgcgcgacatgtgtgtacaacatgatgggcaagagagagaaaaaactgggcgagttcggcaaggccaagggaagtcgcgctatctggtacatgtggctcggagcccgctttctggagtttgaagccctcggcttcatgaatgaggaccattggttttcccgcgagaactctttgtccggggtcgagggtgagggtctgcacaagttgggttacatcctccgtgacatcagcaaaatacccgggggcaacatgtacgcggacgacaccgctggatgggacaccagaataacggaggatgacctacagaacgaagcaaaaatcaccgacatcatggagccagagcatgccttactcgccactagtatcttcaaactgacctaccagaacaaggtggtgagggtccagcggccggccaagaacgggactgtgatggacgtgataagccgccgtgatcaacgcggctccgggcaagtcggcacctatggtctgaacaccttcactaatatggaggcgcaattgatccggcagatggaaagtgaggggatcttctcccccagcgaactggagataccgaacctggcggagcgcgtattagactggctggagaagtacggggtggagcggctgaagcggatggcgatctccggggacgactgtgtcgtgaagccgattgacgacagattcgccacggccctcaccgcgctgaatgatatgggtaaggtccgcaaggatgtccctcagtgggagccctcaaaagggtggaacgactggcaacaggtcccattttgctcccaccactttcaccagcttatcatgaaggacggccgggaaatcgtggtcccctgccgcaaccaggacgagctggtgggccgggccagggtgtcgcaaggtgccggctggagcctgcgggagacggcctgtctggggaagtcctacgcccagatgtggcagctcatgtacttccaccgccgggacctacgcctggccgctaatgcgatctgcagcgctgtgcccgtggactgggtgcccacctcccggacgacatggagcatccacgctcaccaccagtggatgacgacggaggacatgctatccgtctggaaccgtgtgtggatcgaggagaacccctggatggaggacaagacacacgtgtctagctggggcgatgtcccgtacctgggtaagcgggaggaccaatggtgtggcagtctgatagggctcacagcacgcgcgacttgggcttccaatatccaagtggccatcaaccaagtacgccgactgatcgggaatgaaaactatctagactacatgacctcaatgaagcgcttcaaaaacgaaggtgaccccgaaggagcgctctggtga

SEQ ID NO: 24192 - RNA, 9879 nt, synthetic construct
  misc_feature 1..9879: note = derived and/or modified CDS sequence (opt11) from DENV-1__FJ461316__SS-prME
  source 1..9879: mol_type = other RNA
agcgtgaccatgctgttgatgttaatgcccaccgcgctggccttccacctcaccacccgaggaggcgaaccacacatggtggtgagcaaacaggaacgggggaaatctttactcttcaaaaccagcgcgggggtgaatatgtgtaccctcatcgctatggacctgggcgagctgtgcgaggacaccatgacctataagtgtccgaggatcaccgaggccgaacccgacgacgtggactgctggtgtaatgccaccgacacgtgggtgacctacgggacctgtagccagactggcgagcaccggcgcgacaagcggtcagtggccctcgcgccccacgtgggcctgggcctagaaacgcgcaccgagacctggatgagcagcgagggcgcctggaagcagatccagcgggtcgaaacctgggccctccgacacccggggttcacggtgatagccctattcttagcccacgccatcggtaccagcattacgcagaaagggattattttcatcctcctgatgctggtaaccccctcgatggccatgcggtgcgtagggatcggcagccgcgacttcgttgaaggcctctccggcgctacgtgggtcgatgtggtcctggaacacggaagctgtgtcaccaccatggccaaggataaacctactctggacatcgagctcttaaaaacggaggtcaccaaccccgccattctgcggaaactctgtatcgaggccaagatctccaacaccaccaccgacagccgctgccccacccagggcgaggccaccctggtggaggaacaggacgccaactttgtctgccggcgcacctttgtggatcggggctggggaaacggctgtgggctgttcggcaaagggtccctcatcacgtgtgccaagttcaagtgcgtgaccaagcttgagggcaagatcgtacagtatgagaacctgaagtacagcgtgatcgtgaccgtccacactggcgaccagcaccaagtcgggaacgagtccacggaacacggcaccaccgcgaccatcacgcctcaggcccccactaccgagatccagctcactgactacggggcactgactctggactgcagcccccgaacgggcctcgacttcaacgagatggtcctgctgaccatgaaggaaaaatcctggctagtgcacaagcaatggttcctggacctgccccttccctggaccagcggggcctccacttcccaagagacgtggaaccggcaggacctgctggtgacattcaagaccgcccacgcgaagaagcaggaggtggtcgtgctcgggtcacaggagggcgccatgcataccgctctcacgggggccactgagatccaaacttccggcacaaccaccatcttcgcggggcacttaaaatgccgcctcaagatggacaagttgaccctgaaggggatgtcatacgtcatgtgcacaggttccttcaaactggagaaggaggtggcggagacgcaacacggaaccgtgctggtccagatcaagtacgagggcactgacgccccctgcaagatcccgtttagcacccaagacgagaagggggtgacgcaaaacggccggttaataactgccaacccgatagtgactgacaaggaaaaacctgtcaacatcgaggccgaaccgccctttggggagtcctacatcgtaatcggtgcgggcgaaaaggccctgaagctctcatggttcaagaaagggtccagcatcggcaaaatgttcgaagcaacagcacgcggggcccggcgtatggcaatcctgggcgacacggcctgggacttcgggagtataggcggtgtgttcaccagcgtggggaaactggttcaccagatcttcggcacggcctacggggtccttttcagcggcgtctcctggaccatgaaaatcgggctcggcgttttactcacatggttgggcctgaactcccgctcgacctccctctcgatgacctgtatcgccgtggggttggtcaccctatacctcggcgtgatggtacaggctgacagcgggtgcgttatcaactggaagggtcgggagctcaagtgcggaagcgggatcttcgtgacaaacgaggtgcacacatggaccgagcaatacaagttccaggcagactccccgaagcgcctgtccgcggccataggcaaggcttgggaggagggggtctgcggcataaggtccgccacccgcctcgagaacgttatgtggaagcagatctccaacgagctgaaccacatcctgctcgaaaacgacatgaagttcaccgtagtcgttggggacgtggccggcatcctggcacaagggaagaagatgatccggcctcaaccgatggagtacaagtacagctggaagtcatggggcaaggccaagatcatgggcgccgacgtacagaacacgaccttcatcatcgacgggcccaacacccccgagtgcccagacgatcagagagcgtggaacatctgggaggtcgaggattacggcttcgggattttcaccacgaacatctggcttaagctccgggacagctatacccaggtgtgcgaccaccgactcatgtcagccgccatcaaggacagcaaagccgtccacgctgacatgggctattggatcgagtcagagaagaatgagacctggaagctcgcgagggccagcttcatagaagttaagacgtgtatctggcctaaatcccacacgctctggagcaacggcgtcctggagtccgaaatgatcatccccaaaatttacgggggcccgatcagccaacacaactatcgcccggggtatttcacccagactgccggcccctggcacctggggaagctggagctggacttcgacctgtgcgagggcacaacggtcgtagtggacgagcactgcggcaaccgggggccgtccctccgcaccactaccgtcaccggcaagatcatacacgagtggtgttgccggtcctgcacactgccgcccttgcgcttccgcggggaggacggctgttggtacgggatggagatccgcccggtgaaggagaaagaggagaatctcgtgaagtccatggtctcggccggcagcggcgaagtggactccttcagcctagggctgctctgcatttccatcatgatcgaggaggtgatgcggagcagatggtcccgaaagatgctgatgaccggcacactggccgtcttcctcttactgatcatgggccagctgacgtggaacgacctgatccgcctgtgcatcatggtgggtgcgaacgccagcgaccgcatggggatgggcaccacctacctagccctgatggccaccttcaaaatgagaccgatgttcgccgtggggcttctcttccgccgattaacctcacgtgaggtcttgttgctaaccataggtttgagcctcgtggcgtcggtagagttacccaattcgcttgaagaactcggagacgggctggccatgggcatcatgatcttgaagctcctgaccgacttccaatcccaccagctgtgggcgaccctcctaagcctgacgtttatcaagacgaccttctccctccactacgcctggaagaccatggcgatggtgcttagcatcgtctccctgttccccttatgcttgagcactacctcccagaagactacgtggctgcccgtcctcctgggctctctggggtgcaagccgttaacgatgttcctgatcgccgagaacaagatatggggccggaggtcctggcccctgaacgagggcatcatggccgtgggaatcgtgagcatcctattgtcttcccttctcaagaacgacgtcccactggccgggcccttgatcgccggcggcatgctcatcgcgtgctacgtgatcagcggctcctcggccgacctgagtctagagaaagcagccgaagtgagctgggaggaggaggccgaacactccggcgcgagccacaacatcttagtcgaggtgcaggacgacgggaccatgaagatcaaggacgaggagagggacgacaccctcaccatcctgttaaaggccaccctgcttgctgtgtccggcgtctatccgctcagcatccccgctacgctgttcgtgtggtatttctggcagaagaaaaagcagcggtccggggtgttgtgggacacgcctagcccaccggaggtcgagcgggccgtgctggacgatggcatctacagaatcatgcagcgcgggctcctggggcgctcccaggtaggggtcggggtgttccaagagaacgtgttccacaccatgtggcacgtcacccggggtgcggtattaatgtaccagggaaagcgcctggagcccagctgggcctctgtgaagaaggacttaatttcttacggcggcggctggcgactgcagggctcctggaatacgggggaggaggtacaagtgatcgccgtggagccaggcaagaaccccaagaacgtacagaccgcccccgggactttcaagacccccgagggagaggtgggggcgatcgcgctcgactttaagcccggaacgtcaggatcccccatcgtgaaccgcgaggggaagattgtcggactgtacggtaacggggtggttaccaccagcggcacctacgtctcggccatagcccaggccaaggcttcgcaggaggggcccctgcccgagatcgaggacgaggtgttccggaagcgcaacctcacgataatggacctgcatcccggcagcgggaaaacccggcgctacttgcccgctatcgtgcgggaggccatcaaacgaaagctccgcaccctgatattggcccccacccgagttgtggcctccgagatggccgaagccctcaagggcatgcccatccgctatcagactaccgccgtcaaaagtgagcacactggcaaagagatcgtcgacctgatgtgccacgccactttcactatgcgacttctcagtccagtgcgtgtgcctaactacaacatgatcatcatggacgaggcccattttaccgaccccagttccatcgcggcccgggggtacatctcaacacgagtcggaatgggggaggccgccgccatcttcatgacagcgacgccccccggctcagtggaggctttcccgcaaagcaacgccgttatccaagatgaagagcgggacatccccgagcgctcctggaacagcgggtacgagtggataaccgatttccccggtaaaaccgtctggttcgtgccttccatcaagagcggcaacgacatcgccaactgcctgcggaagaacgggaagcgggtgatccaactgtcccgtaagacattcgacacggagtatcaaaagaccaaaaacaacgactgggactacgtagtgacgaccgacatcagcgagatgggcgccaacttccgcgccgacagagtgatcgacccgcgccgatgtctcaagcccgtcattctgaaggacgggcccgagcgcgtcatcctggccggacccatgccagtcacggtagcctccgcagcgcagagacgtgggcggatcggccgtaaccataacaaggaaggcgaccagtacatatacatggggcagcccctcaacaatgacgaagaccatgcccactggaccgaggccaagatgctgctggacaacattaacacccctgagggcatcatccccgccctctttgagccggagcgagagaagagtgccgcgattgacggcgagtatcggctgcgcggcgaagcccggaagaccttcgtggagctgatgcgcaggggggacttgcccgtctggctgtcctacaaggtagcctcggagggattccaatacagcgatcgacggtggtgcttcgacggcgagcgcaacaaccaagtgttagaggagaacatggatgtcgagatctggacgaaggagggggagcggaagaagctcagaccccggtggctggacgcccgcacctactccgaccccctggcactccgggagttcaaggagttcgccgccgggcgccggagcgtgtccggggacctgattctggagattggaaagttgcctcaacacctgacccagcgcgcccagaacgccctggataacttagtgatgctgcacaacagtgagcagggcgggagagcgtatcgccacgccatggaggagctgcctgacaccattgagacgctcatgcttctcgcactcatcgccgtgctaaccggcggggtgaccctgttcttcctctccggccgggggcttggcaagacgagcatcgggctgctctgcgttatggcttccagcgtcctgttgtggatggcgtccgtggagccccactggatcgccgccagcatcatcctcgaatttttcctgatggtcctgcttatacctgagcctgaccggcagcgcacgccgcaggacaaccagctggcctacgtcgtgatagggcttctcttcatgatcctgactgtggcggcgaacgaaatgggcctgctcgagaccaccaaaaaggacctggggatcggccacgccgctgtcgggaaccaccaccacgccgccatgctggacgtggacctacatccagcgtccgcctggactctgtacgccgtggcaaccactatcataaccccgatgatgcgccacaccatcgagaatacgaccgccaatatcagcctgactgcgatcgccaatcaggccgcgatcctgatgggcctggacaaaggctggcccatctccaagatggacatcggtgtccccctgttggcgctgggctgctatagccaagtgaatcccctgactctcacggccgccgtcctgatgctggtcgcccactacgccattatcgggccgggcctccaggcgaaggccacccgtgaggctcagaagcgaactgctgccgggatcatgaagaaccccaccgttgatggtatcgtggccatcgatctcgacccggtcgtgtacgatgccaagttcgagaagcagctgggccagataatgttgctgatcctgtgcacctcccagattctcctgatgcgcaccacttgggccctttgcgagagcatcacccttgccacggggccactgacaacgttgtgggagggctccccggggaaattctggaacaccacgattgcagttagcatggcgaacatatttcggggctcctacctcgccggcgccgggctggcgttcagcctgatgaagtccctcggcggcggcagacgggggaccggtgctcagggcgagacactgggggagaaatggaagcgacagttgaaccagttatcgaagtccgagttcaacacctacaaacggtccggcatcatggaggtcgacagaagcgaagcgaaggaggggctgaagcggggcgagacgaccaagcacgccgtctccaggggcaccgctaaactgcggtggttcgtcgagcgaaacctggtcaagcccgagggaaaggtaatcgacctcggttgtgggcggggcggttggagctactattgcgctggactgaagaaggtgaccgaggtcaagggttacacgaagggtggccccgggcatgaagagcccataccgatggcgacgtacggctggaacttagtaaagctccattctgggaaagatgtgtttttcataccgcccgagaagtgcgacaccctgctctgcgacatcggtgaaagcagccccaatccgaccatcgaggaggggcgcacgttgcgtgtattaaagatggtggagccatggctgcgcggcaatcagttttgcatcaagatcttaaacccatacatgcccagcgtggtggaaactctggagcaaatgcagagaaagcacggcggcatgctggtgaggaacccgctatcacggaacagcacccatgagatgtactgggtgagctgcggtaccgggaatattgtcagcgccgtgaacatgacctcccgcatgctacttaacagattcaccatggcacacagaaagcccacctatgagcgcgacgtggacctcggcgccggcacccgacatgtagccgtggaaccagaggtggcgaatctggacatcatcgggcaaaggatcgagaacatcaagcacgaacacaagagtacctggcactacgacgaggacaacccttacaagacgtgggcctatcacggcagctacgaggtcaagccgagcggttcggccagcagcatggtgaacggcgtcgttaagctcctcactaagccctgggacgtcatccccatggtcactcaaatcgcgatgaccgacacgacgcccttcggacagcaacgcgtgtttaaggagaaagtggatacccgcaccccgaaggctaagcggggaactgcgcagatcatggaggtcaccgcaaaatggttatggggcttcttatcccgcaacaagaagccccggatctgcaccagggaggagttcactcggaaggtgcgcagcaacgccgccatcggtgctgtgttcgtcgacgaaaatcaatggaactccgctaaggaggccgtggaggatgagcggttctgggacctcgtgcaccgcgagcgagagctgcataagcaaggcaagtgcgcgacctgcgtctacaatatgatggggaaacgggagaagaaactgggcgagttcgggaaggccaagggcagcagggccatctggtacatgtggctaggcgcccgattcctggagttcgaggccctgggattcatgaacgaggatcactggttctccagggagaacagcctatccggggtggagggggagggtctgcataagctggggtacatcctacgcgacatctcgaagatacccggaggcaacatgtacgccgacgacaccgcgggatgggatacccggattaccgaggacgacttgcagaatgaagcccgcatcacggatatcatggagccggagcatgctttactcgcaaaatccatctttaagctcacctaccagaacaaggtggtccgcgttcagcggcctgccaagaatggcaccgtcatggacgtaatatcgcggagggaccagcgcggatccgggcaggtgggaacctacggcctgaacaccttcaccaatatggaggcccagcttatccggcaaatggaaagcgagggaatcttctcccccagcgagctggagacccccaacctggcggagcgcgttctcgactggctggagaagtacggggtcgaaaggctgaagagaatggcgatatccggagacgattgcgtcgtaaagccgatcgatgataggttcgccaccgcattgacggccctcaacgacatgggcaaggtccgcaaggacatcccccagtgggagcccagcaagggctggaacgactggcagcaggtccccttctgctcccaccacttccaccagctgatcatgaaggacgggcgggagatcgtggtgccatgccggaatcaagacgaactcgttgggcgggccagggtgagccagggcgccgggtggtcactgcgggagacagcctgcctgggcaagtcctacgcccagatgtggcagcttatgtacttccaccgacgggacctgagactcgcggccaatgccatatgcagcgcagtcccagtggactggatacccacatcccggaccacgtggtcaatccatgcccaccaccagtggatgacgaccgaggacatgttgtcggtgtggaaccgcgtctggatcgaagagaacccctggatggaggacaagacccacatcagctcctggggcgacgtaccgtacctgggcaagcgcgaggaccagtggtgtggctccttaatcggcctcacggcgcgggccacctgggccaccaacatccaggtggccatcaaccaggtgcgccggctgatcggcaacgaaaactacctggattacatgacgtccatgaagcgcttcaagaacgaatcagaccccgagggagcactctggtga

SEQ ID NO: 24193 - RNA, 9879 nt, synthetic construct
  misc_feature 1..9879: note = derived and/or modified CDS sequence (opt11) from DENV-1__FJ410220__SS-prME
  source 1..9879: mol_type = other RNA
agcgtgactatgctgctgatgctgatgcccaccgccttagcctttcacttaaccacacggggcggggagccccacatgattgtgagcaagcaggagcggggaaagagcctgctgttcaagaccagcgcaggggtgaacatgtgcaccttaatcgccatggacctgggcgagctttgcgaggatactatgacctacaagtgcccccggatcactgaggccgagcccgacgacgtggactgctggtgcaacgccacggacacatgggtgacctacgggacctgcagccaaaccggtgagcaccggcgagagaagcggtccgtggccctggcgccacacgtgggacttggtctggagacgcggaccgagacttggatgtcttccgagggcgcctggaagcagattcagcgggtcgagacctgggctctccgccaccctgggttcaccgtgatagccctgttcctagcgcacgccataggcaccagcatcacccagaaggggatcgtgttcatcctcctgatgttagtcaccccctctatggccatgcggtgcgtgggcatcgggtcccgtgactttgtggagggcttatccggagccacgtgggtcgacgtggtgctggagcatggatcatgcgtcaccaccatggccaaggacaagcctaccttggacatcgagcttctgaagacagaggtgactaaccccgcggtgctgcggaaactctgcatcgaggccaaaatctctaacaccaccaccgacagccggtgcccgacccagggcgaggccaccctggtcgaggagcaggacgccaatttcgtgtgccggcgcaccttcgtggatcggggctgggggaacggatgcgggctgttcggaaaggggtccctactcacgtgtgccaagttcaaatgcgttaccaagttagagggtaaaatcgttcaatacgaaaacctcaagtacagcgtgatcgtaaccgtgcacaccggcgaccagcatcaagtcgggaacgagagcacagagcacggtactaccgcgacaatcacgccccaggcccccacaaccgagatccagttgaccgactatggggccttaaccctcgactgcagtccccggacgggcctggacttcaacgaaatggtactcctcaccatgaaagagaagtcctggctagtgcacaagcagtggttcctagacctccccttgccatggaccagcggggccagcacctcccaagagacgtggaaccggcaggatctgctcgtcaccttcaaaaccgcccacgcaaagaagcaggaagtggtggtcttaggcagccaggagggcgccatgcacacggccttgacgggggccaccgagatccagacgtccggcacaacgaccatcttcgccgggcacctcaagtgccgcctaaagatggacaagctgacgctcaagggaatgtcctacgtgatgtgcaccgggtcattcaagctggagaaggaagtggcagagacgcagcacggcaccgtactggtgcagatcaagtacgaaggcaccgacgccccctgcaagatacccttcagcacgcaggacgagaagggagtgacgcagaacggccggctgatcaccgccaacccgatcgtcacggataaggagaagccagtaaacatcgaggccgagccgcccttcggcgaatcctacatagttatcggagcgggtgagaaggccctgaagctgagctggttcaagaagggctccagcatcggcaagatgttcgaggccaccgcccgcggggcacggcgcatggcgatcctgggtgacacggcgtgggacttcgggtccatcggcggcgtgttcaccagcgtggggaagctcgtgcaccagatctttggcaccgcctacggggtcctgttctccggcgtgagctggaccatgaagatcgggatcggcgtgctgctcacgtggctgggcttaaactcccgcagcacctccctcagcatgacctgcatcgccgttgggctggtgacactgtaccttggtgtgatggttcaagcggactcagggtgcgtgatcaactggaagggtcgcgagctgaagtgcgggagcggcatctttgtgacaaacgaggtacatacctggaccgaacagtacaagttccaggcggacagcccgaagcgactgtcagcagccatcggaaaggcctgggaggagggggtctgcggcatcaggagcgccacccgcctcgagaacatcatgtggaagcagatttccaatgagcttaaccacatcctcctcgagaatgatatgaaatttactgtggttgtgggcgacgtggctggcatcctggtccaagggaagaaaatgatccggccccagcccatggagtacaagtacagctggaagtcatggggcaaggccaagattatcggcgccgacgtgcagaacagcacgttcattatcgacggccccaacaccccggagtgccccgacgatcagcgcgcctggaacatctgggaggttgaggactacggcttcgggatcttcaccaccaatatctggctgaagctccgggactcctatacgcaggtctgcgaccacaggctgatgtctgcggccataaaggattccaaggccgtccacgccgacatgggctactggatcgagagtgagaagaacgagacctggaagttagcccgtgcgtccttcatcgaggtaaaaacctgcatctggcccaagagccacaccctctggtccaacggagtcttggaaagcgagatgatcatacccaagatccacgggggccccatatcccagcacaactaccgccccggatacttcactcagaccgccgggccctggcacctggggaagctcgagcttgacttcgacctgtgcgagggtacgacagttgttgtcgacgaacactgcggcaaccggggaccgagcctgaggacgacgaccgtcaccggcaagatcatccatgaatggtgctgccggtcgtgcacgctgccacccctgaggttccgcggggaagacggctgctggtacgggatggagatccgccccgtcaaggagaaggaggagaacctcgttaagtccatggtgagcgccggctccggcgaggtggacagcttctccctagggctgctctgcatcagcatcatgatcgaggaggtaatgcggtcccgctggagccggaagatgctgatgaccggcactctggctgtgttcttcctgctgatcatggggcagttaacctggaacgacctcatcaggctgtgcataatggtgggcgccaatgcgtcagaccgcatggggatgggcacgacctacctggccctcatggccacattcaaaatgcggccaatgttcgccgtcggcctgctgttccgccggctcaccagccgcgaggtgctactgctcactatcgggctgagtctggtcgccagcgtggagctccccaactccctggaagagctgggcgacgggctcgcgatgggcatcatgatcctgaagctcctcaccgacttccagagctaccagctgtgggccaccctgctctccctaaccttcatcaaaacgaccttcagcctgcactacgcctggaagaccatggccatggtgctctccatcgtcagcctgttccccctgtgcctttcaacaacgagccagaaaacaacctggttacccgtgctgctcggctccctggggtgcaagccgctgaccatgtttctaatcgcggagaataagatctggggccgcaagtcctggcctctgaacgaggggatcatggccgtgggcatcgtcagcatactgctctctagcctgctgaagaacgacgtgcccctagccggacccctcatcgccggtggcatgctgatcgcctgctacgtgatctccgggtcttccgccgacctcagcctagagaaggccgccgaggtctcctgggaggaggaggccgagcacagtggcgcttcccacaatatcctggtggaggtccaggacgacgggactatgaagatcaaagacgaggagcgcgacgacacccttaccattctgctgaaggcgacgctcctggcagtctccggcgtgtacccgttatccatcccagccactctcttcgtttggcatttttggcagaagaagaagcagagatccggggttctatgggacacgcccagcccgcccgaggtggagcgcgcagtgctagacgacggcatctatcgaatcatgcagcgcgggctgttagggcggtcccaggtcggcgtgggggtattccaggagaacgtcttccacaccatgtggcacgtgacccgtggcgccgtgctgatgtaccaaggtaaacggctggagccttcctgggcgagcgttaagaaggacctcatttcctacggcggagggtggcgcttccagggcagctggaacaccggtgaggaagtccaagtgatcgccgtcgagcccggcaagaaccccaagaatgtgcagacggcgcccgggaccttcaagacccccgagggcgaggtgggcgccatcgccctggacttcaagcccgggacctccggcagtcccatcgtcaatagagaggggaaaatcgtgggcctgtacggcaacggggtggtgacgacgagcggcacctacgtttccgcgatcgcccaggccaaggccagccaggaagggccgttgcccgagatcgaagacgaggttttccgcaagaggaatctgaccatcatggatctgcaccccggctccgggaagacgcgccggtatctcccggccatcgtccgcgaggccatcaagcggaaactgcgcaccctaatcctggcgcccactcgtgtggtcgccagtgaaatggcagaggcgctgaagggcatgcccatccgataccagacaacggccgtcaagtccgagcacactggcaaggagatcgtggacctgatgtgtcatgccaccttcacaatgcgcctcctaagccccgtccgggtcccgaactacaacatgatcatcatggacgaggctcacttcacggatccctcaagcatagccgctcgcggatacatatctacccgagtgggcatgggggaggccgccgccatctttatgaccgccacgccgcctggcagcatggaagcatttccgcaatccaacgccgtcatccaagacgaagagcgcgacatccccgagcggtcttggaacagcgggtatgagtggattacggacttccccgggaagaccgtctggttcgtgcccagcatcaaggccggcaacgacatcgcaaactgtctgcgcaagaacgggaagcgggtgatccaactctcccgcaagaccttcgacaccgagtaccagaagacgaagaacaacgactgggactacgtcgtgaccaccgacatctccgaaatgggcgcgaactttagggccgaccgcgtgatcgacccgcggcgctgcctgaagccagtcatcctgaaagacgggcccgagcgggtcatcctcgcgggcccgatgccggtcacggtggcctccgccgcccagaggcgggggcgcataggccggaaccacaacaaggagggcgaccaatacatctacatgggacaacccctgaacaacgacgaggaccacgcccactggaccgaggccaagatgttactcgacaacatcaacacccccgagggcatcatccccgccctattcgagccggagcgcgagaagtccgccgcgatcgacggggagtaccggcttcggggcgaggcccgcaagaccttcgtggagctcatgcggcgcggggacctgcccgtgtggctgtcctacaaggtggccagtgagggatttcaatactcggacaggcgctggtgcttcgacggcgagcggaacaaccaagtgctcgaggaaaatatggacgtggagatttggacaaaggaaggggagcgcaagaagctgcggccccgctggctggacgcacggacgtactccgacccgctagccttaagggagttcaaggagttcgctgccggccggcgcagcgtgtccggcgacctgatcctcgaaatcggcaagttgccgcagcacctcacccagcgggcccaaaacgctttagacaacctggtgatgctacacaacagcgagcagggcgggcgggcgtatcggcacgcgatggaggagctccccgacaccatcgagacactgatgctgctcgctctgatcgcggtcctgacgggcggagtaaccctgttcttcctgagtggcaaggggctgggcaagaccagcatagggcttttgtgtgtgatggccagctcggtcctcctctggatggcgtccgtggagccccactggatcgccgccagcatcatcctggaattcttcctgatggtgctgctgattcccgagccggacagacagcggacaccccaggacaaccaattggcgtacgtggtcatcgggctcctgttcatgatcttgaccgtagccgcgaatgagatgggcctgctggagacgaccaagaaggacctggggatcgggcatgtcgccgtggaaaaccatcatcacgccgcaatgctcgacgtggatctgcaccccgccagcgcgtggaccctgtacgccgtggccaccacgatcataaccccgatgatgcgccacaccatcgagaacaccactgccaacatcagcctcaccgcaatcgcgaaccaggccgcaatcctaatggggctggacaagggctggcccatctccaagatggacatcggcgtgcccttgctggcactggggtgttacagccaggtgaaccccctcaccttgactgcggccgtccttatgctcgtggcccattatgccatcatcggcccggggttgcaggccaaggctacgcgggaggcccagaagcgcaccgccgccggcatcatgaaaaaccccaccattgacggtatcgtcgcgatcgatctggaccctgtcgtgtatgacgcgaaattcgagaagcagctcggccagatcatgctgctgattctctgcacctcccagatcctgctgatgcgtaccacctgggcgctatgcgagagtatcaccctggcgaccggacccctgactactctctgggaggggagtccgggcaagttctggaacacaaccatcgcagtgagcatggcgaacatatttcgggggagctacctggcgggcgctgggctggcctttagcctcatgaagtccctcggaggcgggcggcgggggacgggggcccaaggcgaaaccctgggcgagaagtggaagcgccagctcaaccaattaagtaagtccgaattcaacacctataagcggtccgggatcatggaggtcgaccgctccgaggcgaaagagggtctgaaacgcggtgagaccacaaagcacgccgtgagccgcggcacggccaaactccgatggtttgtggagcgcaacctggtcaaacccgaggggaaggtgatcgacctgggctgcggccgagggggctggagctattactgcgcggggctcaagaaagtcaccgaggtgaagggctacaccaagggcggccccggccacgaagagcccatcccgatggctacttacggctggaacctcgtgaagctgcattccggcaaggacgtgttcttcattcctcccgagaagtgcgacaccctgctctgcgacatcggggagagctctccgaacccgaccattgaggagggccgcaccctgagggtcctgaagatggtggagccctggctcagagggaaccaattctgcatcaaaatcctaaacccctacatgccctccgtggttgagacgctggagcagatgcagcggaaacacggtggcatgctcgtgcgcaaccccctgagccggaacagcacccacgagatgtattgggtgtcctgcgggaccggcaacatagtcagcgcggtgaacatgaccagccgtatgctcctcaatcggttcacgatggcccatcgcaagcccacgtacgaacgcgatgtggacctgggggccggcacccggcacgtagcggtggaacccgaggtcgcaaacctggacattatcggccagcgcatcgaaaacataaagcacgagcacaagagcacctggcactacgacgaggacaacccctacaagacttgggcgtaccacgggtcatacgaggtcaagcctagcggctccgccagcagcatggtgaatggggtcgtgaaacttctaacaaagccctgggacgtgatccccatggtcacccaaatcgccatgaccgacaccacgcccttcggccagcagcgagtgtttaaggaaaaggtggacacccgcacccccaaggcgaaacgtgggactgcacagataatggaggtgacggcgagatggctgtggggcttcctctcccggaacaagaagccccgcatttgcacacgggaggagttcacccgcaaggtgcggagcaacgccgccatcggcgccgtcttcgttgacgagaaccagtggaactccgcgaaggaggccgtggaggacgaccgcttctgggacctggtgcaccgggagcgcgaactccacaaacagggtaagtgcgcgacctgcgtctacaatatgatgggcaagagagagaagaagttgggtgagttcgggaaagccaaggggagccgagccatctggtacatgtggctaggcgcgcgtttcctggagttcgaggccctcggcttcatgaatgaagatcattggttctcccgggagaacagcctgtccggggtcgagggcgagggtctgcacaaactaggctacatcctgcgggacatcagcaagatccccggcggcaacatgtacgccgacgacacggcgggctgggacacccgcattaccgaggacgatctgcagaacgaggccaaaatcaccgacatcatggagccggaacacgcgctcttggccaaatccatctttaagttaacataccagaacaaggtggtacgggtgcagcgacctgccaagaacgggacagtgatggacgtcatctcaagacgggatcagcgcggctcgggccaggtggggacctatggcctcaacaccttcactaatatggaggcccagctgatccggcagatggagagcgaggggatcttcctgcccaacgaattggagacccccaatctggccggccgagtgctggactggctcgaaaagtacggggtcgagcggctaaagcgcatggcgatctccggagacgactgcgtggtgaagccgattgacgatcggttcgccaccgccctgaccgccctcaacgacatggggaaggttcgcaaagacatcccgcaatgggagcccagcaaaggctggaatgattggcagcaggtccctttctgctcccatcacttccaccagctaatcatgaaggatggccgtgagatcgtggtcccgtgccgcaaccaggacgagctggtgggacgagcgagagtgagccaaggcgcggggtggtcactccgtgagacggcctgcttgggcaaaagctacgcccagatgtggcagctgatgtacttccaccgccgggatctccgcctagccgcaaacgccatctgcagcgcggtccccgtggactgggtgcccacatcccggaccacctggagcatccacgcccaccaccagtggatgacgaccgaggacatgctgtccgtttggaaccgggtctggatcgaagagaacccctggatggaggacaagacccggatcagcagctgggaggacgtgccgtatcttgggaagcgcgaggaccaatggtgcggcagcctgattggcttaaccgctcgcgcgacttgggccaccaatatccaggtagccatcaaccaagtgagacgcctcatcgggaacgagaactactccgattacatgaccagcatgaaacggttcaaaaacgaatcggagcccgaaggggccttgtggtag

SEQ ID NO: 24194 - RNA, 9879 nt, synthetic construct
  misc_feature 1..9879: note = derived and/or modified CDS sequence (opt11) from DENV-1__JF937649__SS-prME
  source 1..9879: mol_type = other RNA
agcgtcaccatgctgctgatgctgatgcccaccgccctggccttccatcttaccacccggggcggtgagccacatatgatcgtgtcaaaacaagagcggggcaagagccttctgttcaagaccagcgccggcgtaaacatgtgcacattaatcgctatggatctgggcgagctgtgcgaggacaccatgacttataagtgcccccgaatcaccgaggtagagcccgacgacgttgactgttggtgtaataccaccgacacctgggtgacctacgggacctgcagccagacgggagagcaccggcgcgacaaacggagcgtggccttagccccccacgtcggtctgggcctggagacccgcgcggagacgtggatgtcgtccgagggcgcgtggaagcaaatccagaaggtggagacttgggccttgcgtcaccccgggttcacggtgatcgccctgttcctggcccacgctatcggcacctcgatcacccagaaggggatcatcttcatcctcctgatgctagtcaccccctcgatggccatgcggtgcgtgggcatcggttcacgggatttcgtggaggggctcagtggggccacgtgggtagacgtggtgctggagcacgggagctgcgtcactaccatggctaaggacaaacccaccctggatatcgagctcttgaagaccgaggtgacgaaccccgccgtgctgcgcaagctctgcatcgaggctaaaatctcgaacaccaccacggacagccggtgtccgacgcaaggcgaggccaccctggttgaggagcaggacgctaacttcgtgtgtcgccggacatttgttgaccgcggatgggggaacggctgcgggctgttcggcaaggggtcactaatcacgtgcgccaagttcaagtgtgtcactaagctggagggcaagatcgtgcaatacgagaatctgaagtacagcgtgatcgtcaccgtgcacactggcgaccaacaccaagtcgggaatgagtccacggagcacggcaccaccgccaccatcacgccccaggcgccaacgagcgagatccaacttacggactatggggccctgaccctggactgtagcccacgcaccggcctcgattttaacgagatggtactgctgacgatgaaagagaagtcctggcttgtgcacaagcagtggttcctggacctgcccctgccctggaccagcggggccagcaccagccaggagacatggaaccggcaggacctactggtcacgttcaagaccgcgcacgcaaaaaagcaggaggtggtggtgctaggcagtcaggagggcgccatgcacaccgcactgacgggggctacggagatccagaccagcggcaccacgacgatctttgccgggcatttaaagtgccggctcaaaatggacaagctgaccctgaagggcatgtcctacgtgatgtgcacaggaagcttcaagctcgagaaagaggtcgccgaaacccaacacggtacggtcctggttcagatcaagtacgagggcaccgacgcgccctgcaagatccccttcagtacccaggacgaaaagggggttacgcagaatggccgcctgatcacggcaaatccgatcgtcaccgacaaagagaagcccgtgaacatcgaggccgagccgccctttggggagagctatatagtgataggcgccggcgagaaggcgcttaaactctcctggttcaagaaggggagctccatcggcaagatgttcgaggccaccgcgcgcggggccaggcgtatggccatcctgggtgacactgcgtgggacttcgggtcaattggcggggtcttcacgtccgtagggaagctagtgcaccagatcttcgggaccgcctacggggtcctcttcagcggcgtgtcctggacgatgaagattgggatcggcgtgctgctaacctggctcggcctgaatagccgcagcaccagcttgtccatgacctgcatcgccgtcggcctcgtcaccctgtacctgggcgtaatggtccaggccgacagcgggtgcgtgatcaattggaagggccgcgagctcaagtgcgggagtggcattttcgtgaccaacgaagtgcacacctggaccgagcagtacaagttccaagccgactccccgaaacggctcagcgcggccatcggcaaagcctgggaggagggagtgtgcggaatccgctccgctacccggctggaaaacatcatgtggcgccaaattagtaacgagctaaaccacatcctcttagagaacgacatgaagtttaccgtggtcgtgggtgacgttgtcggcatcctcgcccagggaaagaagatgatacggccccagcccatggaacataagtattcgtggaagtcctggggcaaggcgaaaatcatcggcgccgacgtgcagaacaccacgttcatcatcgatgggcccaacaccccggagtgccccgacgaccagagagcctggaacatctgggaagtggaggactacgggttcgggatcttcaccacgaacatctggctaaagctgcgggactcctacacgcaggtctgtgaccatcgcctcatgtcggccgcgatcaaggactcgaaggccgtgcacgccgacatggggtactggattgagagcgagaagaacgagacgtggaaattagcccgggcctccttcatcgaggtgaagacctgcatatggcccaagagccataccctgtggagtaacggcgtcctcgagagcgaaatgatcatccccaagatctacgggggcccaatctcccaacacaactaccgccccgggtatttcacacagaccgcgggaccgtggcacctagggaagctggagctcgacttcgacttgtgcgagggcaccaccgtcgtggtcgatgagcactgcggcaaccgggggccgtccctgcgcacgaccacagtgaccggcaagatcatccatgagtggtgctgtcggtcctgcacactgccgcccctccgcttcaaaggggaggacggctgctggtacgggatggagatccggcccgtgaaggagaaggaagaaaacctcgttaagagcatggtgtcagcaggcagtggggaggtggacagcttctccctcgggctgctgtgtatctcaatcatgatcgaggaggtaatgagatcccggtggagccgcaaaatgctcatgaccggcaccctggctgtgttcttcctgctcatcatggggcagctgacctggaacgacctgatcaggtcctgcatcatggttggcgccaacgccagtgaccgcatggggatgggtacgacatatctcgcgctgatggccaccttcaagatgcgcccgatgttcgccgtcgggctgctgtttcggcgcctgacctcccgggaggtcctgttgctgacgatcgggctgagcctagtcgcctccgtggaactgcccaacagcctggaggagctcggtgacgggctagccatgggcatcatgatcctaaagctcctgaccgatttccagtcctatcagctgtgggccaccttattgtcgctgacattcatcaagacgaccttcagtctccactacgcctggaagaccatggccatggtgctgtcaatcgtttccctgctccccctgtgcctgagtaccacgtcccagaagaccacctggcttcccgtactgctgggcagtctcgggtgtaagccgctgaccatgttcctgatcgccgagaataaaatctggggccgcaagagctggcccctcaacgagggcatcatggcagtgggcatcgtctccatcctgctaagctccttactcaagaacgacgtgcccctggccggtccactcatcgccggcggcatgctgatcgcctgctatgtgatcagcggatccagcgcagatctgtccctcgagaaggcggccgaggtcagctgggaggaggaggccgagcactccggtgccagccacaatatcctggtggaagtgcaggacgatgggacgatgaagatcaaagacgaggaacgggacgacactttaaccatcctcctgaaggccaccctgctcgcggtcagtggagtgtaccctctgagcatccccgccaccctgttcgtttggtacttctggcagaagaagaaacagcgctccggggtcctctgggatacgcccagccctccggaagtggagcgggccgtgctggatgacggcatttaccgcataatgcagaggggcctgctggggcgctcgcaggtcggcgtgggggtgttccaagagaacgttttccacaccatgtggcacgtgacccggggcgctgtgctcatgtaccaggggaagcgtctggagcccagctgggcctccgtgaagaaggatctgataagctacggcggcggatggcggctccagggctcctggaatacaggggaggaagtccaagtgatcgctgtagagccagggaagaaccccaagaacgtgcagactgcccccggcacattcaaaacccccgagggagaggtgggcgcgatagccctggacttcaagcccgggacgtcgggcagccccattgtaaatagggaggggaagatcgtgggtctgtacggcaacggggtggtcacgacctccggcacctacgtaagcgccatcgcgcaggccaaggcttcccaggaggggccactccccgagatcgaggacgaggtgttccggaagcgcaacctgaccatcatggacctgcacccaggcagcgggaagacgcggcgctacctcccggcaatcgttcgggaggctatcaagcgcaagctgcggaccctcatcctcgcccccacccgggtagtggcctccgagatggccgaggccctgaagggcatgcccattagataccaaaccacggcggtcaagagcgagcacacaggccgggaaatcgtggacctaatgtgccacgccacgttcactatgcgcctactgtccccagtaagagtgccgaactacaacatgatcattatggacgaggcccacttcacggaccccagcagcatcgctgcccgcgggtatatcagcacccgggtgggtatgggggaggcggccgccatcttcatgaccgccacgccgcccggctcagttgaggccttcccgcagagcaatgcggtcatccaggacgaggagcgcgacatccctgaacggtcctggaatagtgggtacgagtggatcacggacttccccgggaaaacagtctggttcgtgccttctatcaaaagcggcaacgatatcgccaactgcctgcgcaagaacggaaaaagggtcatacaactctcgcggaaaaccttcgacaccgaataccagaagacgaagaacaacgactgggactatgtggtgaccaccgacatcagcgagatgggcgctaactttcgggccgatcgagtaatcgatccgagacgctgcctgaagcccgtgatcctgaaggacgggcccgagagagtcatcctcgcgggccccatgccggtgaccgtggcctccgcggcccagcgccgtgggcgcatcggccggaaccataacaaagagggcgaccagtacatatacatggggcagcccctaaacaacgacgaagaccacgcccactggacggaggcgaagatgctgctcgataacatcaacacccccgagggcatcatccccgccttattcgagccggagcgcgaaaagtccgccgccatcgacggggaataccgcctgcggggagaggctcgcaagacgttcgtggaactcatgcggcgcggggacctgcccgtgtggctgagctacaaggtggcctccgagggctttcagtactctgatcggcgctggtgcttcgacggggagcggaacaaccaggtcctcgaggagaacatggatgttgagatctggaccaaagaaggggagcgcaagaagctgcggccccggtggctagacgcgcgaacgtactccgacccccttgccctgagagagttcaaggagttcgccgccggtcggcgcagcgtgtccggagatctgatcctggagatcggtaagctgcctcagcacctgacccagcgggcgcagaacgccttggacaacctggtcatgttgcacaatagcgagcagggcgggcgcgcctaccggcacgccatggaggagctccccgacaccatcgagaccctgatgctgctcgcgctcatcgccgtgttgacgggcggggtgaccctcttcttcctttccggcaagggcctgggcaagaccagcattggtttgctgtgcgtcatggcctcctctgcactgctctggatggcctccgttgagccccactggattgcggcctctattatcctggagttctttttaatggtcctcctgatcccggagccggaccgccagcggacgccccaggataaccagttagcctacgtcgtgatcgggttgttattcatgatcctcaccgtcgccgccaacgagatgggcctcctggaaacgaccaagaaggacctggggataggccacgtcgcggtggagaaccaccaccacgccactatgctcgacgtggacctgcaccccgcgtccgcctggaccctctacgccgtcgcgaccaccataatcactccgatgatgcgccacaccatagagaacaccaccgcaaacatcagtctcaccgccatcgccaaccaggcagcaatcctaatggggctggacaagggctggcccatctccaagatggacataggcgtgcccctcctggccctgggctgctactcccaagtgaatcccctcaccctgacggccgcagtcctgatgcttgtcgcgcactacgccattataggcccggggctacaggccaaggccacccgcgaagcccagaaacgcaccgcggccggcattatgaaaaaccccaccgtggacgggatcgtcgccatcgacctggatcccgtggtgtacgacgccaagtttgagaaacagctcgggcagatcatgttactgatcctctgcacatcccagattctgctgatgaggaccacgtgggccttatgcgagagcatcacgcttgcgacgggccccctgaccaccctctgggaggggtccccgggcaagttctggaacaccacaatagctgtctctatggcgaacatcttccgggggagctacctggccggtgccggactggcgttctcgctcatgaagtctctcggcggtgggcgccggggtaccggtgcccaaggcgagactctgggcgagaagtggaagcgccaactcaaccaactgtccaaaagcgagttcaacacctacaagcggtccggtatcatggaggtggaccgcagcgaggccaaggagggcctgcggcgcggggagaccacgaaacacgccgtatcccggggcaccgcgaagctccgctggttcgtcgagcgtaacctggtgaagcccgaggggaaagtgatcgaccttggctgcggtcgcggggggtggagctactattgcgccgggttaaagaaggtcactgaggtgaagggctacacaaagggcggacctgggcacgaggagccaattccgatggctacctacggttggaacttagtaaagctgcactccggcaaggacgtcttctttatcccgcccgagaagtgtgacacgctgctctgcgacatcggagagtcgagccccaacccaactatcgaggagggccgaacgcttcgcgttctaaagatggtggagccctggctccggggcaatcaattctgcatcaagatcctgaacccctacatgccaagtgttgtagagaccctggagcagatgcagcgcaagcacggcggcatgctggtgcggaacccgctgtcccgcaacagcacccacgaaatgtactgggtgtcctgcgggactggcaacatcgtgagcgccgttaatatgaccagccggatgctgctgaaccgcttcacgatggcccaccgcaagccaacttacgagagagacgtcgatctgggtgcgggaacccgccacgtagccgtggagccagaggtcgccaacctggacatcatcggccagcggatcgaaaacatcaaacacgagcacaagagtacctggcactacgacgaggacaacccctacaagacgtgggcctatcacggatcttatgaggtgaagccgagcggcagcgcctccagcatggtcaacggggtggtgaagctgctgaccaagccatgggacgtcatccccatggtgacccagatcgcgatgacggacacgacccccttcggccagcagcgcgtgttcaaggagaaagtcgacacccgcaccccgaaggctaaacgcgggacggcccagataatggaggtcaccgccaggtggctgtggggctttctgtcgcgcaacaagaagccccggatatgcactcgcgaggagtttacccggaaggtgcggagcaacgcagcgatcggagctgtgtttgtggacgaaaaccaatggaacagtgccaaggaggccgtggaggacgaacgattctgggacttagttcatcgcgaacgggagctgcacaaacaggggaagtgcgcgacctgcgtttacaacatgatgggcaaaagagagaagaaactcggggagtttgggaaggccaagggaagccgggcaatttggtacatgtggttaggcgcccgcttcttagagttcgaggccctcggcttcatgaatgaggaccactggttctcccgggaaaactctttgtccggggtggagggcgagggtttgcacaagttgggctacatcctgcgcgacattagcaagatccccgggggcaacatgtacgcagacgacaccgcaggctgggacacccggatcaccgaagacgacctacagaacgaggccaagataacggacatcatggagccggaacacgccctcttagccacctccatcttcaagctgacctaccagaataaggtcgtgcgcgtgcaacgccccgcgcggaacgggaccgtcatggatgtgatatcacgccgggaccagcgcggctccggccaggtgggcacgtacgggctcaacactttcacgaatatggaggcccagctgatacggcagatggagtccgagggtatcttctcccccagcgagctggaaacccccaatctcgccgagcgggtcttagactggctggagaagcacggcgttgagcggctcaagcgcatggccatctccggggacgactgtgtagtcaagccgattgacgaccggttcgcgacggcgctgagcgcgctgaatgacatgggcaaggtccgcaaggacatcccccagtgggagcccagcaagggatggaacgactggcagcaggttcccttctgcagtcatcacttccaccagctcataatgaaggacggtcgcgagattgtcgtgccgtgtcgcaaccaggacgagctggtcggccgggcaagggtcagccaaggggccggttggtccctccgggagaccgcctgcctcggcaagagctacgcgcagatgtggcagctgatgtattttcaccgccgggacttacgcctcgccgctaatgccatctgcagcgcggtgccggttgactgggtccccaccagccggaccacttggtccatccacgcccatcaccagtggatgacgacggaggacatgctgtcagtgtggaacagggtgtggatcgaggagaatccctggatggaggacaaaacccatatctcctcttggggcgatgtcccgtacctggggaagcgcgaggaccagtggtgcggctccctcatcggcctgacggcccgggctacctgggccaccaacattcaagtggcgataaaccaggtccgcaggctgatcgggaacgagaactacctcgactacatgaccagcatgaagcgcttcaagaacgagtccgaccccgaaggagccctgtggtaa

SEQ ID NO: 24195 - RNA, 9879 nt, synthetic construct
  misc_feature 1..9879: note = derived and/or modified CDS sequence (opt11) from DENV-1__FJ410222__SS-prME
  source 1..9879: mol_type = other RNA
tcggtgacaatgctgctcatgctgatgccgaccgctttggcctttcacctcactacccggggaggggaaccccacatgatcgtcagcaaacaggagcgggggaaatctctgctgtttaaaacgagtgccggggttaacatgtgcacgctaattgcgatggacctgggcgaactctgcgaggacacaatgacctacaagtgcccccggatcaccgaaactgagcccgacgacgtggactgctggtgtaacgccacggacacctgggtcacttacggcacatgtagccagaccggcgagcaccgtcgggataaacgtagcgtcgcccttgccccgcacgtgggcctggggctcgagacacgaaccgagacatggatgagctccgagggggcctggaagcagatccaacgagtcgaaacgtgggctctaaggcaccccgggttcacggtgatcgcactgtttcttgcccatgcgattggcacaagcatcacccagaaagggatcatattcattctcctgatgttggtgacgccgtcgatggccatgcggtgcgtcggcatcgggagccgcgatttcgtggaagggttaagcggcgcgacctgggtcgacgtcgtgctggagcatgggtcttgcgtgaccaccatggccaaggataaacccacgctggacatcgagctcttgaaaaccgaagttactaaccccgccgtgctgcggaaattatgcatcgaggctaaaatctccaacaccacgaccgatagccggtgccccacgcaaggggaggccactctggttgaggaacaggacgctaacttcgtctgccggcgcacatttgttgaccggggctgggggaacggctgcgggctatttggtaaagggtccctcataacgtgcgccaagtttaagtgcgtgaccaagctggagggcaaaattgttcaatacgagaacttaaagtacagcgtgatcgttaccgtccatacgggcgatcagcatcaggtgggcaacgaatcgactgagcacggcaccacggctaccatcacgccccaggcccccacaacagaaatccagctcactgattacggggccttgacgctggactgttcccccagaaccggcctggacttcaacgagatggtgctgctgaccatgaaggagaaatcgtggttggttcacaagcaatggtttctggacctgccgctcccctggacctccggggcaagcacgtcacaggaaacatggaaccggcaggacctgctggtcacattcaagaccgcacatgccaagaaacaggaggttgtagttctggggtctcaagaaggggcgatgcatactgccctgacaggggccacggagatccaaacatccggcacaaccactatcttcgccgggcacttgaaatgcaggttgaagatggataagttaaccctgaagggcatgagctacgtgatgtgcacggggtctttcaagctagagaaagaactggcggagacccaacacggcacggtgctagtacagatcaaatacgagggcactgacgcgccctgtaagattcccttctccactcaagacgagaagggggtaacgcagaatggccggctaatcacggcaaaccccatcgttacagataaggagaaacccgtgaacattgaagccgagccgcccttcggcgagagctacatcgttatcggcgccggcgagaaagccctgaagctgagctggttcaagaaagggtcctcgatcggaaaaatgtttgaggcgacggcccgcggggccaggcgcatggccattctcggggacacggcgtgggactttggttccatcggaggcgtgttcaccagcgttggcaagctcgtccaccagattttcggcaccgcctatggggtacttttctccggcgttagctggacgatgaaaatagggataggcgttctgctcacctggctgggcttgaactccaggagcacctccctcagcatgacctgcatcgccgttgggctggttacgctgtacctcggcgtgatggtacaggctgacagtgggtgcgtcatcaattggaagggcagggagctgaaatgcgggagcggtatcttcgtcaccaacgaggtgcacacgtggaccgaacagtacaagtttcaagccgattctccaaagcgcctgtcagcggccatcggcaaggcctgggaggagggggtgtgtggcatccggtctgccacccggctcgagaacatcatgtggaagcaaatcagcaatgagctgaatcacatcctgctagagaacgacatgaaatttactgtggtcgtcggggatgtcgccggcattctggcgcaaggtaagaagatgatccgtccacaacccatggagtataagtacagctggaagtcctggggtaaggccaagatcataggcgccgacgtccagaacaccaccttcataatagatggaccaaacacccctgagtgccccgacgatcaacgcgcctggaacatctgggaagtggaggactacgggttcggtatttttacgaccaacatctggctaaaattgcgggacagctatacacaggtgtgtgaccaccgcttgatgtccgcggctatcaaggactctaaggcagtgcacgccgacatggggtactggatcgagagcgagaaaaatgagacttggaagctggcccgggcttccttcatcgaagtgaagacatgcatctggcccaaatcccataccttatggtctaacggcgtattagagtctgagatgatcattcctaaaatctacgggggcccaatttctcaacacaactaccgccctggctattttacccaaactgcgggcccctggcacctggggaagctcgagctggacttcgacttgtgcgagggcacgactgtggtcgtcgacgagcactgcgggaatcggggtccgtcattgcgcaccaccacggtcaccggtaagatcatccacgagtggtgctgccgctcttgcacactgccacccttgagatttcgcggggaggatggatgttggtacgggatggagatccggcccgtgaaggagaaggaggagaacctcgtcaagtctatggtatcggctggcagcggcgaagtggactccttcagcctggggcttctctgcatttccatcatgatcgaagaggtcatgcgttcgcgttggtcaagaaagatgttgatgacagggacgctggccgttttcttcctgttaataatggggcaactgacctggaatgatctgattaggttatgcatcatggtgggcgcaaatgcaagcgaccgcatgggcatgggcaccacctacttggcactcatggccacgttcaagatgcgtcccatgttcgccgtcggcctcctgttccgccggctcacctcccgggaggtactgttactaactataggactgagtctggtggcctccgtagagctacccaactcactggaggagctgggcgacgggttggccatgggcatcatgatccttaaactgcttaccgacttccagagccaccaactgtgggctactctactctcactcacattcatcaagaccaccttctcccttcattacgcctggaagacgatggccatggtgttgagtatcgtgagcctgctccccttgtgcctgtctaccacatcccagaagactacgtggctgcccgtgctcctgggttcattggggtgcaagccgctcaccatgttcctgatcgccgagaataaaatctggggtcggcgctcctggcccctgaacgagggaattatggccgtagggatcgttagcatcctcctcagctccctactcaaaaatgatgtgcccctagccgggcccctgatagccgggggtatgttgatcgcatgctacgtaatctcggggtctagcgcggacctttcgctggaaaaggccgccgaggtatcgtgggaggaggaggccgagcactctggagccagccacaacattctcgtggaagtgcaggacgacgggactatgaagatcaaagacgaggaacgggacgacacgctgactatcctcttgaaggcaactctgttagcggtgagtggcgtctatccgttgagcattcccgccaccctcttcgtttggtacttttggcagaaaaagaagcagcgatcaggggtcctgtgggacactcccagccctcccgaagtcgagcgggccgtacttgacgacggcatttaccgtataatgcagagaggcctgcttggtcgctcccaggtcggcgtgggcgtattccaggagaatgtctttcacaccatgtggcacgtgacgcgtggggccgtgctgatgtaccaggggaaacgcctagagcccagctgggcttctgtcaaaaaggaccttatcagctacggaggcgggtggcggctgcaggggtcctggaacaccggggaagaagtgcaagtcatcgccgtcgagccgggcaaaaaccccaaaaacgtacaaaccgcacctgggaccttcaaaacgcccgagggcgaggtgggcgccatagcgctcgacttcaaaccaggaaccagcggctcccccatcgtcaatcgcgaggggaagatcgtaggactctatggcaacggtgtggtcaccacatcaggcacgtacgtgtccgcgatcgcgcaggccaaagcatcccaggaagggccgctacctgaaatcgaggacgaggttttccgcaaacgcaatctcaccatcatggacctgcatccgggctccgggaagactcggcgttacttgccggcgatcgtacgggaggcaatcaagcgcaagctcagaacactgatactggcccctacgagagtggtggcctccgagatggccgaggctctcaagggcatgcccatccgctaccaaactaccgcggtaaaaagcgaacatacaggcaaagagatcgtggatctaatgtgccacgcaacattcacaatgcggctactctcccctgtgcgcgtcccgaattacaatatgatcatcatggacgaagcccacttcacagacccctccagtatagccgcgagagggtacatcagcacacgcgttggcatgggggaggccgcagccatattcatgaccgccacgccgccaggttccgtcgaagcgtttccgcagagcaatgccgtcattcaggatgaggaacgtgatatacccgagcgctcctggaactcagggtacgagtggatcactgactttcccggcaagaccgtgtggtttgtgccctcaatcaaatcgggcaatgacatagccaattgcctgcggaaaaacgggaagagagtcatccagctgtcacggaagacatttgacaccgagtaccaaaagaccaagaataacgactgggactacgtggtaaccacagacatcagcgaaatgggcgccaacttccgcgctgatcgggtcatagaccccaggcgatgcctcaagcccgtgatcctaaaggatgggcccgaacgcgtgatacttgccgggcccatgcctgttacggtagcctccgccgcccagcgtcgcggccggatcggccgcaatcacaataaggaaggcgaccagtacatctacatgggacaacccctcaacaacgacgaagaccacgcgcactggactgaggccaagatgctgttagataacatcaacacccccgagggaatcatccccgccctcttcgagccagaacgagagaagtcggcagccattgacggcgaataccggctgcgcggggaggcgcgaaagacgttcgtagagctgatgcgccgaggagacctacccgtctggctgagttacaaggtggcttccgagggcttccaatactctgataggagatggtgcttcgatggcgagagaaacaaccaagtcctggaggaaaatatggacgttgagatctggaccaaggagggggagcggaagaaacttcgcccgcggtggctcgacgctcgaacctactccgacccccttgctctgcgggagttcaaggagtttgccgctggtagacgttcggtctccggcgacttaatacttgagatcggcaagctcccgcaacacctgacgcagcgcgcgcaaaacgcacttgacaacctcgtcatgttacacaactccgagcaaggcggtcgggcctaccgccacgcaatggaggagttgcccgacacgatcgaaaccctcatgctgctcgccctcatcgccgtgctcacgggtggggtaaccctgttcttcctctcgggcagagggctaggcaagacttcaatcggactgctctgcgtaatggcgtcctcagtattattatggatggcgtccgtggagccccactggatagcggcctccatcatcctcgagttcttcctgatggttttattaatccccgaacccgaccggcagcggacgccccaggacaaccagctggcctatgtggttatcggacttctctttatgatcctgacggtggccgccaacgagatgggcctactggaaaccactaagaaagacctgggtatcggccacgtagcggtggaaaaccatcaccacgctgcaatgcttgacgtcgatttgcaccccgcctccgcgtggacgctgtacgcggtggccaccaccataatcacacccatgatgcgacataccatcgagaacactaccgccaacatatccctcaccgccatcgccaaccaagcggccatactgatggggctcgacaagggctggcccataagtaaaatggacatcggcgtgccgctgctcgcgctcgggtgttacagccaagtcaaccccttgacgttaaccgccgccgtgttgatgctggtggcccactacgccattatcgggcctgggctccaggctaaagctacccgcgaggctcagaaacgtaccgccgccggcattatgaagaacccaactgtggacgggatcgtggcaatagacctggaccccgtggtatacgacgcgaaatttgagaagcagctaggccagatcatgttgctgatcctgtgcacctcccagatcctcctcatgcgcaccacctgggccctgtgcgaaagcatcacgttggccaccggtccactaaccacactgtgggaaggctccccagggaagttctggaacacgaccatcgccgtgtccatggccaacatcttccgcgggtcctatctcgccggcgctggtcttgccttcagcctcatgaagtccctagggggagggaggcggggcaccggagcgcaaggcgagacactcggcgaaaagtggaaacgccaactgaatcagctcagtaagtcagagtttaacacgtataagcggtcaggtatcatggaggttgatcgctccgaggcaaaggagggactaaagagaggggagaccacaaagcacgcggtctcccgcggcaccgcgaaactgaggtggttcgtggagcgcaatctggtgaagcccgaaggtaaagtcatcgacctcggatgtggtagaggtgggtggagctactactgcgccgggttaaagaaagtcaccgaggtcaaggggtacacgaagggcggaccaggtcacgaggaaccgatccctatggccacatacggttggaacctggtcaagttgcattccgggaaagacgtgttcttcataccacccgagaagtgcgataccttgctgtgcgacattggggagagctcccctaatccgaccatcgaggaaggccgcactcttcgagtgctcaaaatggtagaaccctggctccggggaaatcaattttgcatcaaaatcctcaatccctatatgcctagcgtggtggagactctggaacagatgcagcgcaaacatggcgggatgttagtccgaaacccgttgtccagaaatagcacacacgagatgtactgggtgagctgcggaaccggtaacatcgtcagtgccgtcaatatgacgtcccggatgctactgaaccggttcaccatggctcaccggaagcccacctacgaacgcgacgtagacctcggggctggcacacggcacgtggcagtcgaaccagaagtggccaatctagacataataggtcagcgcattgagaacatcaaacacgagcacaaaagtacgtggcactacgatgaagacaacccatataagacgtgggcgtaccacggatcctacgaggtgaagccgagtggtagcgccagcagcatggttaatggggtcgtcaagctgctcaccaagccctgggacgtgatcccaatggtgacccagatcgccatgactgacaccaccccgttcggccaacagcgtgtcttcaaggagaaggtggacaccaggaccccaaaagctaagcgtggaaccgcccagataatggaggtcaccgctaagtggctctggggctttttgagtaggaacaaaaagccccgaatctgcacccgcgaggagttcacgcgtaaggttcgcagcaacgcagccatcggtgccgtatttgtggacgagaaccaatggaactccgccaaggaggctgttgaagacgagcggttctgggatctggtacacagggagcgggagctgcataagcaggggaagtgcgcgacctgcgtgtataacatgatgggcaaacgggagaagaagctgggggagttcgggaaggctaaaggaagcagagccatctggtacatgtggctcggtgctcgctttctggagttcgaggcactgggatttatgaatgaggaccactggttcagccgtgagaacagcctctccggggtcgagggcgagggacttcataaacttgggtacatcttgcgagacataagtaaaatcccagggggaaacatgtacgccgacgacacggctggctgggacacccgtataacggaggatgacctgcaaaacgaggcacgtatcacagacattatggaaccagagcatgcacttctggctaagagtatatttaagttgacataccagaacaaggtggtacgcgtccagaggcccgctaagaacggcaccgtgatggacgtgattagccgccgggaccaacgcggctccgggcaggtcggcacgtatggtctcaacacgtttaccaacatggaggcccagcttatccgacagatggaaagcgagggaatcttctcccccagcgagcttgagactcccaacctggctaaacgcgtcttggactggctggagaagtatggcgtagagcggctgaagcgcatggccatctctggggacgactgcgttgtgaaaccgatcgacgaccggtttgcgacggctctcaccgccctgaacgatatgggcaaggtgcgcaaggacatcccccaatgggaacccagcaaggggtggaacgactggcagcaggtccccttctgctcccaccacttccatcagctgataatgaaggatggccgggagatcgtggtgccctgccgcaaccaggacgagttggtgggccgggcccgggtttcgcagggagctggatggagcctgcgggaaaccgcttgtctgggcaagtcctacgcccagatgtggcaactcatgtatttccaccgccgggacctgcgactggcggccaacgcaatctgtagcgccgtccccgtcgactggattccaacctcgcggacgacctggtctatccacgctcatcaccagtggatgaccacggaagatatgctctctgtttggaatcgcgtgtggatagaggagaatccctggatggaggacaaaacgcacatcagctcctggggcgacgtcccatacctagggaaacgagaggatcagtggtgcggctccctgatcggactcaccgcacgggcgacctgggcaaccaatatccaagtggcgataaaccaggtgcgaaggctgatagggaacgagaactacctggactacatgacgtccatgaagcgcttcaaaaacgaaagcgaccccgaaggcgcgctatggtag

SEQ ID NO: 24196 - RNA, 9879 nt, synthetic construct
  misc_feature 1..9879: note = derived and/or modified CDS sequence (opt11) from DENV-1__FJ461319__SS-prME
  source 1..9879: mol_type = other RNA
agcgtgaccatgctgctaatgctgatgcccacggccctggcctttcatctaaccacccggggcggggaaccccatatggtggtttcaaagcaagaacggggcaagagccttctgttcaagaccagcgccggggtaaatatgtgtaccctcatcgccatggacctcggcgagctgtgcgaagacaccatgacctacaagtgcccccggatcacagaagcagagccagacgacgtggactgctggtgcaatgctaccgatacgtgggtcacctacgggacctgttcacaaaccggcgagcaccggcgagacaagcgctccgtggcgctcgcgccccacgtcggcttggggctcgagactcgcaccgagacgtggatgtcctccgagggagcatggaagcaaatacagcgtgttgagacctgggccctccgccacccggggttcacggtgatcgccttgttcctagcccacgctatcggcaccagcataacccaaaaggggataatcttcatcctcctgatgctggtcaccccctccatggccatgcggtgtgtgggcatcggcagccgcgacttcgtggaggggttatccggcgccacgtgggtcgacgtggttctggagcacgggtcttgcgtgaccaccatggccaaggacaagcccacactggacatcgagctcctgaaaacggaggttaccaacccggccatcctgcggaagctctgtatcgaggcgaagatttccaacaccaccacggactctcgctgcccgacccagggcgaggcgaccctggtcgaggagcaggacgccaacttcgtttgccgacgtaccttcgtcgacagaggctggggtaatgggtgcggcctgttcggcaagggatccctcatcacgtgcgccaagttcaaatgcgtgacaaagctggagggcaaaatcgttcagtacgagaacctgaagtactcggtaattgtgaccgtccacaccggcgaccagcaccaggtgggcaatgaatccacggaacacggcaccaccgcgaccatcacgccccaggcccccacgaccgagatccaactcaccgactacggagccttgactctagactgcagcccccgcacgggcctcgacttcaacgagatggtgctgctgaccatgaaggagaagtcttggcttgtgcacaagcagtggttcctggacctgccgctcccctggaccagcggggccagcacaagccaggagacgtggaaccggcaagacctgctggtgaccttcaagaccgcccacgcgaagaagcaggaagtcgtggtgttgggtagccaggagggcgctatgcacactgccctgacgggggccaccgaaatccaaacctcgggcaccacgaccatcttcgccgggcacctgaagtgccgccttaagatggacaagctgaccctgaagggcatgagctacgtcatgtgcaccgggtccttcaagctcgagaaggaagtggccgagacacaacacggcaccgtgctggtgcagatcaagtacgaggggaccgacgccccatgcaagatccccttcagcacccaggacgagaagggggtcacgcagaacggccggctaatcaccgccaatccgatagtgaccgacaaagagaagcccgtcaacatcgaagccgaaccgccctttggggagtcatatatcgtgatcggcgccggggagaaggcgctgaagctcagctggttcaagaaggggtccagcatcggcaagatgtttgaggccaccgcccgcggggcccgaagaatggcgatcctgggtgacactgcatgggatttcgggtccatcggcggcgtgttcaccagcgtcgggaagctggtccaccagattttcgggaccgcatatggggtcctgttcagtggggtctcctggaccatgaagatcggcctgggcgtcctactcacgtggctgggcctgaactcccgcagcacctctctaagcatgacctgcatcgcggtgggcctcgtcaccctgtatctcggcgtcatggtgcaagccgactccggttgtgtcatcaactggaaggggagggagttgaagtgcgggagcggaatcttcgtgacgaacgaggtgcacacctggacggaacagtacaaatttcaggctgacagccccaagcgcctgtccgccgccatcgggaaagcctgggaggagggggtctgcggcatccggagcgccaccagactcgagaacgtgatgtggaagcaaatctccaacgagctcaaccatatcttactcgagaacgacatgaagttcacagttgtcgtgggcgacgtggcgggcatcctggcccaagggaaaaagatgatccggccccagcccatggagcataagtacagctggaagtcctggggcaaggcaaagataatcggcgccgacgtccagaacacgacgttcattatcgacgggccgaacacgccggagtgccccgacgatcagcgcgcgtggaacatctgggaggtggaggactacggcttcgggattttcactacgaatatctggctaaagctccgggactcctacacccaggtgtgcgaccatcgtcttatgtccgcggccatcaaggacagcaaagccgtccacgccgacatgggctactggatcgaaagcgagaagaatgagacctggaagctcgcgcgcgccagcttcattgaggttaaaacctgtatctggcccaaaagtcacacactctggagcaatggcgtgctcgagagtgaaatgataattcccaagatctacgggggcccgatcagccagcacaattaccgccccgggtacttcacacagaccgccggcccctggcacctggggaaacttgagctggacttcgacctgtgcgagggcacgacggtcgtagttgacgaacactgcggcaaccgtgggccgtccctccgcacaaccaccgtcacaggcaagatcattcacgagtggtgctgccggagctgcactcttccgccgctgcgcttcaggggagaggacggctgctggtacgggatggagatccgccccgtgaaagaaaaggaagagaacctcgtgaagtccatggtgagcgccgggagcggcgaagtggactccttcagcctgggcctgctctgcatctcaatcatgatcgaggaagtaatgcggagccgctggtcgcgcaagatgctgatgaccggtactcttgccgtcttcttactgctcatcatggggcagctcacgtggaacgatctgatccgcctgtgtatcatggtgggcgcgaacgcttctgaccgcatggggatgggcaccacgtacctcgccctgatggccactttcaagatgcggccgatgttcgccgtggggctgttatttcgccgactgacgtcacgcgaggtcctcctactcaccatcgggctgagcctcgtggcttccgtcgagctgccgaactccctggaggagttgggggacggactggccatgggcatcatgatcctgaaattactgaccgacttccagtcccaccagctctgggccactctcctcagcttgacattcataaagaccactttctccctccactacgcctggaagaccatggcgatggtcctgagcatagtgtccttatttcccctatgcctgtctacgacctcccagaagaccacctggcttcccgtgctcttgggcagcctggggtgcaagccgctgacgatgttcctgatcgctgaaaacaagatctggggccgtcgatcgtggcccctgaacgaagggattatggccgtgggcatcgtgagcatcctcctgtcttccctgctcaagaatgacgtccccctggccgggccactaatcgccggcggcatgcttatcgcgtgttacgtgataagcggaagcagcgctgacctgtccctggagaaggcagccgaggtaagctgggaagaggaagccgagcattccggcgcgagccacaacatcctggtcgaggtccaggatgacgggaccatgaagataaaggacgaggagcgagatgacaccctgacgatcctgcttaaagccaccttgctggctgtaagcggcgtctacccgctcagcatccccgccacgctgtttgtgtggtatttttggcagaagaagaagcaacgttccggagtactgtgggacacccccagcccgcccgaagtcgaaagagccgtgctggacgacggaatataccgcatcatgcagcgtggcctcctggggcgctcccaggtgggcgttggcgtgttccaagagaacgttttccataccatgtggcacgtcacccgaggcgcggtgttgatgtaccaggggaagcgcctcgaacccagctgggcctccgtgaagaaggacctcatctcatatggcggcgggtggcggctgcagggttcctggaatacgggggaggaggtccaggtgatcgcggtcgagcccggcaagaaccccaagaacgtccagaccgcccccggaaccttcaaaacgcccgagggcgaggtgggcgccatcgccttagactttaaaccggggacgagtggctctcccatcgtgaaccgagaggggaagatcgtaggcctatacggcaacggtgtcgtgaccacaagcggcacctacgtttcggccatcgcccaggccaaggcgtcccaggagggcccgcttcctgagatcgaagacgaggtgttccggaagcgtaacctcacgataatggacctgcaccctggcagcgggaagacccggcgctatctgccggccatcgttagagaggccatcaagcgaaagctgcgcacgctcatactggcccccacgcgggtagtcgcgagcgagatggccgaggccctcaaaggcatgccgattcgctaccaaaccaccgccgtcaagagcgagcacacaggcaaggagatcgtcgatctgatgtgtcacgccaccttcaccatgcggctactctctcccgtgcgcgttcctaactacaacatgataattatggacgaggcccacttcaccgaccccagctccatcgcggcccgaggttatatcagcacccgcgtcggcatgggggaggctgctgccatcttcatgactgcgacgccgcctggctccgtcgaggccttcccgcagtcgaacgccgtaatacaagacgaggagagggacatccccgaacgctcctggaacagcggttacgagtggatcaccgacttccccggcaaaaccgtctggttcgtcccctccatcaagagcggcaatgacatcgccaactgcctgcggaagaatgggaagcgcgtgatccagttatcccggaagaccttcgatacagagtatcagaagaccaagaacaatgattgggattacgtcgttactaccgacatctccgagatgggggcgaacttccgcgccgaccgcgtaattgacccgcgccggtgcctaaagcccgtcatcctgaaggacgggccggaacgcgtgatcctggccggccccatgccggtaacggtggcctccgccgctcagcggcgcggtcggatcggccgcaaccacaacaaggagggcgatcaatacatctacatggggcagcccctcaacaacgacgaggatcatgcccactggaccgaggctaaaatgctgctggacaacatcaacacgcccgagggcatcatccctgccctcttcgaaccggaacgcgagaaatccgcagcgatcgacggggagtaccggctacgcggcgaggcccggaagacctttgtggagcttatgcgcaggggtgacctcccggtatggctgtcctacaaggtggccagcgagggttttcagtacagcgaccgccggtggtgcttcgacggcgagcgcaacaaccaagtgctagaggaaaacatggacgtcgagatctggacgaaggaaggcgaacggaagaagctcagaccccgttggctggacgcccgcacctattccgaccccctggccctccgggagttcaaggagttcgcggccggccgccggagcgtgtctggggacttgatactggagatcgggaaactcccgcaacacctgacgcaacgcgcacaaaacgcactggacaatttggtgatgttacacaactcggaacagggcgggcgggcgtacagacacgccatggaggaactgccggacaccatcgagacgctcatgctgctagccttaatcgccgtgctgaccggcggggtcaccttgttcttcttaagtggccgtgggctgggcaaaacctcgattggccttctctgcgtgatggcatccagcgtcctgttgtggatggcgtccgtggagccccactggatagccgcctcgatcatcctcgagttctttctgatggtgctgctcatcccagagccggaccgtcagcggacgccccaggacaaccagctagcttacgtcgtaataggcttactcttcatgatcctgacggtggccgcgaacgagatgggcctgctggagacgaccaagaaagacctggggatcggccacgccgccgtcggaaatcatcaccacgccgccatgcttgacgtggacctccatcccgcatccgcctggactctgtacgccgtggccactacgatcattaccccgatgatgcgccacacgattgaaaatacgaccgccaacatcagcctgacagccatcgccaaccaggccgctatcctcatgggcctggacaaaggctggccaatctcaaagatggacattggcgtccccttgctcgctctggggtgctactctcaagttaaccctttaaccttgactgcggccgtgctgatgctagtcgctcactacgccatcatcgggccaggcctccaggcgaaggcgacacgcgaggcccagaagcgaaccgccgcggggatcatgaagaatcctaccgtggatggtatcgtggctatcgatttagaccccgtcgtgtacgatgccaagtttgagaaacagctgggtcagattatgctcttaatcctttgcacgtcccagatcctcctgatgcgtactacatgggccctgtgcgagagcattacactcgccgccgggccgctgacgactctttgggaaggatctccggggaagttctggaacacgaccatcgcggtcagcatggccaacatcttccggggctcctacttggccggggctgggctggcgtttagcctcatgaagtccctcggcggagggcgccgggggactggcgcccagggcgagaccttaggggagaagtggaagcggcagctgaaccagctcagtaagagcgagttcaacacctacaagcgatccgggatcatggaggtagacagatcagaggccaaggaggggctgaaaaggggcgagaccacgaaacatgccgtgtcccggggcaccgccaaacttcggtggttcgtggagcgcaacctggtcaagcccgagggcaaggtgatcgacctcggctgcgggcggggcgggtggagctactattgcgcgggcctgaagaaggtgaccgaggtcaaagggtacacgaaagggggccccggacacgaggagccgatcccgatggccacttatggctggaacctggtgaagctccactccggcaaagacgtgttcttcatccctcccgagaaatgcgacactttactgtgtgacataggcgaaagctcccccaatccgaccatcgaggaggggcggaccctccgggtcctgaagatggtggagccgtggctgcgcggaaatcaattctgcataaagatcctcaacccctatatgcccagtgtcgtcgagacgcttgagcagatgcaacggaaacacggcgggatgctggtgcgcaaccccctctcccggaacagtactcatgagatgtactgggtatcctgcgggactgggaatatagtcagcgctgtaaacatgacttcccgcatgcttctgaatcgttttaccatggcccaccgaaaacccacgtacgagcgcgacgtggacctcggagccggcacccggcacgtggcggtggagcccgaagtggccaacctggacattatcgggcagcgcatcgagaatatcaagcacgaacacaaaagcacctggcactacgacgaggacaacccctacaaaacatgggcctaccacggctcctatgaagtcaaaccgtcaggttccgcctcctcgatggtgaatggagtcgtcaagctgctcacgaagccctgggatgtgatcccaatggtcacccagatcgccatgaccgacacgacgcccttcggacagcagcgcgtgttcaaagagaaggtggacacccgcacccccaaggcgaagcgcggcaccgcccagatcatggaggtgacggccaagtggctctggggcttcctgtcccgaaacaaaaagccccggatctgcaccagggaggagttcacccgcaaagtgcgcagcaacgccgcgatcggggccgtgttcgtcgatgagaaccaatggaactccgccaaggaggcggtggaggacgagcgtttctgggatctcgtacaccgcgagcgggaactgcacaagcagggcaaatgtgcaacctgcgtctacaacatgatgggaaaaagggagaagaaacttggtgagttcgggaaggcgaagggcagccgggctatctggtacatgtggctcggcgcccgcttcctggagtttgaggcactggggttcatgaatgaggatcactggttctcccgggagaacagcctttccggcgtggagggggaaggcctgcataagctgggatacattctgcgcgacattagcaagatacccggtggcaacatgtacgccgacgatacggcggggtgggacacgcgcataaccgaggacgacctacagaacgaggcccgcatcaccgacattatggagccggagcacgcactcctcgcgaagtcgatatttaagctgacgtaccagaacaaggtcgtacgcgtacagcggcccgccaagaatggcacagttatggacgttatcagccgcagagatcagagaggctccggtcaggtgggaacctacgggctgaacaccttcacgaatatggaggcgcagttaatacggcagatggaatctgagggcatcttttcaccatcggagctggaaacccccaacctggccgagcgcgtgctagactggcttgagaagtacggagtcgagcggctgaagaggatggcaatttccggcgacgactgtgtggtgaaaccgattgacgatcggttcgccactgccctcaccgcgctgaacgacatgggaaaggtccgaaaagacatcccccaatgggagcccagcaagggttggaacgactggcaacaagtcccattctgctcccaccactttcaccagctgatcatgaaggacggcagagagatcgtggtcccgtgccgaaaccaggacgagctcgtggggagggcccgcgtgagccaaggcgcgggatggtccctgcgggagacggcctgcctgggcaagtcctacgcgcagatgtggcagctcatgtacttccaccgacgcgacctacgccttgccgccaacgccatttgcagcgccgtccccgtggactggatcccaaccagccggaccacctggagcatccacgcgcaccatcagtggatgacgaccgaagacatgctctccgtctggaatcgcgtctggatcgaagagaacccttggatggaagacaagacccacatctcgtcctggggcgacgtaccgtacctgggcaaacgggaggaccagtggtgcggcagcctaatcgggctaaccgcccgggcaacatgggccaccaacgtgcaggtcgccatcaaccaggtgcggcggctgatcggtaacgagaactacctggactacatgacgtccatgaagcgctttaaaaacgaaagcgaccccgaaggagcgctatggtga

SEQ ID NO: 24197 - RNA, 9879 nt, synthetic construct
  misc_feature 1..9879: note = derived and/or modified CDS sequence (opt11) from DENV-1__FJ461320__SS-prME
  source 1..9879: mol_type = other RNA
tcagtgaccatgctgctcatgctgatgcccaccgccctggccttccacctgactacccgggggggcgagccccatatgatcgtgaccaaacaggagcgcggcaaaagcctgctgttcaaaaccagcgcaggggtaaacatgtgcaccctcatcgccatggacctgggggagctttgcgaggacacaatgacctacaagtgcccccggatcaccgaggccgagcccgacgacgtggattgttggtgcaacgccaccgatacatgggtgacctacgggacctgctctcagacgggagagcaccggagagacaagcggagcgtagcactcgcgccacacgtgggtctagggctggagacgcgaaccgaaacctggatgtccagtgaaggcgcctggaagcagatccagcgggtggagacgtgggccctccgccaccccgggttcaccgtgatcgcgctgtttctggcgcacgctatcggcaccagtatcacacagaaggggatcatcttcatcctcctgatgctggtgacgccctcaatggccatgcggtgcgtcggcatcggatcccgcgacttcgtggaggggctctcaggcgccacctgggtggacgtggtactggagcatgggtcctgtgtgaccaccatggccaaggacaaacccaccctggacatagagctcctgaaaacggaagtcaccaaccccgccgtgctgcggaaactctgcatagaggccaagatcagcaacaccacaacagattcccgctgcccgactcagggcgaggccaccctaatggaggagcaggacgcgaacttcgtgtgcagacgcacgttcgtcgatcggggctgggggaacggctgcgggctgttcggcaaggggagcctcatcacgtgcgccaaattcaagtgcgtgaccaagttggagggcaagattgtgcagtacgagaacctcaagtactccgtaatcgtgacggttcatacaggcgaccagcatcaggtcggcaacgagagcacagaacacggcaccaccgcgaccattacgccgcaggcccccacctccgagatacagctgaccgactacggggccctgaccctggactgcagcccccgtacgggcctcgacttcaacgaaatggtcctattaaccatgaaggagaagtcctggctcgtccacaagcagtggttcctggacttgccgctgccttggaccagcggggcgagcacctcacaggagacgtggaaccggcaggacctgctggtgacctttaagaccgcccatgcgaagaagcaagaagtggtcgtgctcgggagccaggagggcgcaatgcataccgcgctgacgggggccaccgagatccagacatccggcaccactaccatcttcgccggacacctgaagtgtcgactcaagatggataagctgaccctgaagggaatgtcctacgtgatgtgcaccgggtcctttaagctcgaaaaggaagttgcagagacgcagcacggcaccgtgctggtgcagatcaagtacgagggcaccgacgccccctgtaagatcccattcagcactcaggacgagaagggggtaacgcagaacggtcggctgatcaccgccaacccgatcgtgaccgacaaggagaagcctgtgaacatcgaggccgagccgcccttcggggagtcctacatcgtcatcggcgcgggcgagaaggccctgaaactcagctggttcaagaagggctccagcatcggaaagatgttcgaggccaccgcccgcggtgcccggcgcatggccatcctgggcgacacggcctgggacttcggatccgtgggcggcgttttcaccagcgtcgggaagcttgtccaccagatctttggcaccgcctacggggtccttttcagcggcgtcagctggaccatgaagatcgggatcggcgttctgctgacttggctcggcctgaactcccggagcacctccctgagtatgacctgcatcgcagtggggctcgtcacgctgtacctaggagtgatggtgcaggccgactccgggtgcgtcatcaactggaagggccgtgagctcaagtgtgggtcgggcatcttcgttacgaacgaggtgcacacatggaccgagcagtacaagttccaagcggacagcccgaagcgcctgtccgccgccatcggaaaggcctgggaagagggggtatgcggcatcaggtcggccacccgcctggagaacattatgtggaagcagatctccaacgagcttaaccacatcctgttggagaacgacatgaagtttaccgtggtagtcggggacgtggtgggcatccttgcgcagggtaaaaagatgatccggccccagcccatggagcacaagtacagctggaagagttggggcaaagccaagataataggcgccgacgtccagaacacgaccttcatcatcgatgggcctaacaccccggagtgccccgacgaccagagggcatggaacatatgggaggtagaggactatggcttcgggatattcaccacgaacatatggttgaaactgcgcgacagctatacccaggtctgcgatcaccgactcatgtctgcggcaatcaaggattccaaggccgttcacgccgacatgggctactggatcgagtctgagaagaacgaaacctggaagctggcccgggcgagcttcatcgaggtgaagacttgcatctggcccaagtcacacacgctctggagcaacggcgtgctcgagtccgagatgataatccccaagatctacgggggcccgatctcacagcacaactataggccagggtatttcacccaaacggccgggccctggcacctagggaaactggagctcgacttcgatctgtgcgagggcaccacggtcgtggtggacgagcactgcggtaaccgggggccgtccctgcgcaccaccaccgtcacaggaaagatcattcacgagtggtgttgcaggagctgtaccctgccgccactcagatttaaaggggaggacggatgttggtacgggatggagatccggcccgtaaaggagaaggaggagaatctagtgaagtccatggtcagcgctggtagcggtgaggtggactccttcagccttgggctgctgtgcatctccatcatggtggaggaggttatgcgcagcagatggtcccgcaagatgctcatgacgggcaccctggccgtattcctgctcctcatcatggggcagctcacgtggaatgacctcatccggctgtgcatcatggtgggcgccaacgccagcgaccgcatgggcatgggaaccacgtatctggccctcatggccactttcaagatccgcccgatgttcgctgtcggcctcttattcagacgattaacgtcccgggaagtgctgctgctcaccatcggtctgagcctggtcgcctccgtcgaactcccgaacagcctggaggagctgggcgacgggttagcgatgggcattatgatcctgaagcttcttaccgacttccaatcgcatcagctgtgggccacgctgttaagcctgactttcattaagaccaccctctccctccactacgcctggaagaccatggccatggtgctgtctatcgtctccctgttccccttgtgcctgagcacgacttcccagaagaccacgtggctccccgtgttactgggcagcctggggtgcaagccgttaacgatgttcctgatcacagagaacaagatctggggccgcaagtcctggcccctgaacgaggggatcatggcggtgggcgtggtgtccatcttactgagctccctgctcaagaatgacgtccccctggctgggccgctgatcgcaggcggtatgctcatagcctgctacgtgatcagcggctccagcgcggacctgtctctggaaaaggcggccgaagtgagctgggaggaggaggccgaacactctggcgccagccacaacatactcgttgaggtccaagacgacggcaccatgaagatcaaggacgaggagcgggatgacaccctgaccatcctgctcaaggccaccctgctggcggtttccggtgtgtacccgctcagcatcccagcaaccctgttcgtctggtacttctggcagaagaagaagcaaaggtccggcgtgctgtgggacacccccagcccgcccgaggtggagagggccgtcctggacgacggcatttaccgcatcatgcagcggggcctcttggggcgctcccaggtgggcgtgggggtcttccaggagaacgtgttccacaccatgtggcacgtgacgcggggtgccgtgctgatgtatcagggaaaacgccttgagcccagctgggcctccgtgaagaaggacctgatcagctacggcggcgggtggcggttgcagggctcctggaacaccggggaggaagtgcaggtcatcgctgtggagcccggcaagaacccgaaaaacgtacaaaccgcgccaggtaccttcaagactcctgagggcgaggttggtgccatagcactcgacttcaagcccggaacctctggctcgcccatcgtgaaccgggagggcaaaatcgtcggcctgtacggcaacggggtcgtgaccaccagcggcacttacgtcagcgccattgcgcaggctaaggcctcccaggaggggccgctgcccgagatcgaggacgaggtcttccggaagcgcaacctcaccatcatggaccttcaccccggaagcgggaagacgcggcgctaccttccggccatcgtgcgggaggcgatcaagagaaagctccggaccttaatcctggcccccacgcgcgtggtcgcttccgagatggccgaggccctcaagggcatgcccatacgctatcagacaaccgcggtcaagagcgagcacaccggcaaggagatcgtggacctgatgtgccatgccacgttcaccatgagactgttatctccggtccgagttcctaactataacatgataattatggacgaggcccatttcaccgaccccagctccatcgccgcccgtgggtacatcagcacgagagtggggatgggagaggcggccgcgatcttcatgacggccacgccgcccggctccgtcgaggccttcccgcaaagcaacgcggtgatccaggacgaggaacgggacatccccgagcgctcctggaacagcgggtacgagtggataaccgacttccccggcaagaccgtctggttcgtcccatccataaagtccggcaacgacatcgccaactgcctgcggaagaacgggaagcgcgtcatccagctctcgcggaagacgttcgacaccgagtaccagaagaccaagaacaatgactgggattacgtggtgacgacggatatcagcgagatgggcgccaatttccgcgctgaccgggtaatcgaccctcgccggtgcctcaagccggtgatcctgaaggacggccctgaacgcgtgatcctggcgggccccatgccggtgaccgtcgcctctgcggcccagcgccgcgggcggatcggccgcaaccacaataaggagggcgaccagtatatctacatggggcagcccctcaacaatgacgaggaccacgcccactggaccgaggcgaagatgctgctggacaacatcaacaccccggagggcatcatccccgccctcttcgaaccagagcgggagaagtccgctgccatagatggcgagtaccgcctcagaggagaggcccggaaaacgttcgtggagctgatgcgccgcggggatttacccgtgtggctgtcctataaggttgcgagcgagggcttccagtattcggaccgacggtggtgcttcgacggcgagagaaacaaccaggtgttggaggaaaacatggacgtggagatctggaccaaagagggggagcgcaagaaactccgcccccggtggctggacgcccgcacctattccgaccccctggctctccgggagttcaaggagttcgccgccggccgccggagcgtctccggggacctgatcctggagatcggcaagcttccgcagcacctgacccagcgcgcgcaaaacgccctggacaatctagtgatgctccacaacagcgagcaaggggggcgggcctaccgccacgccatggaggagttgcccgacaccatcgagaccctcatgctgctggctctcatcgcagtgctgaccggcggggtaaccctgttcttcctctccggccgagggctgggcaagacgtccatcggccttctctgtgtgatggccagcagcgtgctgctctggatggccagcgtcgagccccactggatcgccgcgagcatcatcctagagttcttcctgatggtgctgctaatcccggagcccgatcgacagcggacgccccaagataaccagctggcgtatgtggtaatcggtctcctcttcatgattctgacggtggccgccaacgagatgggcctgctcgagaccaccaagaaggacctgggaattggccacgtggcggtggagaaccaccaccacgcgacgatgctggatgtggatctccaccccgcctccgcctggaccctgtacgccgtggccactaccatcatcaccccgatgatgaggcacacgatcgaaaacaccaccgcgaacatcagcctaacggccatcgctaaccaggccgccatcttgatggggctggacaaaggctggcccatctccaagatggatatcggcgtccccttgctggctctggggtgctatagtcaggtgaatcccttaaccttaaccgcggccgtgctgatgctggtcgcccactacgcgatcataggcccggggctccaggccaaagccacacgggaggcccagaagcgtactgccgcgggcatcatgaagaaccccaccgttgacggtatcgtggccatcgacctggaccccgttgtgtacgacgccaagttcgagaagcagctgggccagatcatgctcttaatcctgtgcacctcgcagatcctcctgatgcgcaccacgtgggcattgtgcgagagcatcaccctcgctaccggccccctgaccacgctgtgggaggggtcccctggcaagttttggaacacaaccatcgctgtgagcatggccaacatcttccggggtagctacctcgccggcgctggcctggccttcagcctgatgaagtccctcggaggcggccgccggggcacgggggcgcagggcgagacgttgggagagaagtggaagcggcagctgaaccaactctcaaagagcgagttcaacatatacaagcggtccgggatcatggaggtcgaccgctcagaggccaaagaaggcctgaagcgcggggagaccacacgccacgctgtcagccgcggcaccgctaagttgcgatggttcgtggaacggaacctggtcaagcctgaggggaaggtgatcgacctcggctgcggacgcgggggctggagctactactgcgcggggctgaagaaggtgacggaggtcaagggctacaccaagggcgggcccgggcacgaagagcccatcccgatggccacctacgggtggaacctagtaaaactccacagcggcaaggatgtattctttacgccgcccgagaaatgcgacacgctgctgtgcgacataggcgagtcttcccccaatccgacaatagaggaggggcggaccctgcgtgtcctgaagatggtggaaccatggctgcgggggaaccagttctgcatcaagatcctcaacccctacatgccctccgtggtcgaaacccttgagcagatgcagaggaaacacggcgggatgctggtgcggaacccgctttcccgcaatagcacccatgagatgtactgggtgtcctgcggaacgggcaacatcgtcagcgccgtgaacatgacatcacgaatgctgctgaaccgcttcaccatggcccacaggaaacccacctacgagcgggacgtggacctcggcgccggcacgcgccacgtcgcggtggagcccgaagtcgccaacctcgacatcatcggccagcggatcgagaacatcaagcacgaacacaaaagcacgtggcactacgacgaggacaatccctataaaacctgggcctatcacgggtcctatgaggtgaagccgagtggctccgccagcagcatggtgaacggagtcgtgaagctgctcacgaagccttgggacgtgattccaatggtcacgcagatcgcaatgaccgacaccactcccttcggccagcagcgcgtgttcaaagagaaggtggatacgcggaccccgaaagccaaacgcggaaccgcccagataatggaggtgactgcgcggtggctgtggggcttcctgtcccgtaacaagaagcctcggatctgcacgcgcgaggagtttactagaaaggtgcgtagcaacgccgctattggcgcggtgttcgtcgacgagaaccagtggaatagcgcgaaggaggccgtggaggacgagcggttctgggacctggtgcagaaagaacgcgagctgcataagcagggaaagtgcgcgacctgcgtgtacaacatgatgggcaagcgggaaaagaagctgggtgagttcggcaaggcgaaagggagccgggccatctggtacatgtggttaggcgcccgattcctggaatttgaggccctcggattcatgaacgaggaccactggttctcccgcgaaaatagcctctcgggggtggagggggaggggttgcacaagctgggctacatcctccgggacatctctaagatccccgggggcaacatgtacgctgacgacaccgcgggctgggacacgcgcattaccgaggacgacctgcaaaatgaggcaaagatcaccgacataatggagccggagcacgccttgctcgccacctccatttttaaactgacgtaccaaaacaaggtagtccgtgtgcagcgccccgctaagaacgggaccgtgatggacgtcatcagcaggcgcgaccagcgcggctccgggcaggtgggcacctacggactgaacacatttaccaatatggaggcgcagctcatccggcagatggagagcgaggggatttttctgccttctgagctggagacccccaatctcgcggagcgcgtgctggactggctggagaagtacggcgtcgagcggctcaagcgcatggccatcagcggagatgactgtgtggtgaagccgatcgatgaccggttcgccactgccttgacggcgctgaacgacatgggtaaggtccgcaaggacatcccccaatgggagccctccaagggctggaacgactggcaacaagtgcccttctgcagccaccacttccaccagctcatcatgaaggatggccgggagatcgtggtaccgtgccgcaaccaggacgagttagtaggccgggcacgcgtgtcgcagggggccggctggagcttacgagagactgcctgcctcggcaagagctacgcccaaatgtggcagctgatgtactttcaccggcgggacctgcgccttgcggccaacgccatctgctccgccgtccccgttgactgggtgcccaccagccggacgacctggtccatccacgcccaccaccagtggatgacgacagaggacatgctgagcgtctggaaccgcgtgtggatagaggagaacccctggatggaggacaagacccacgtgtcaagctggggcgacgtcccgtacctggggaagagagaggaccaatggtgcggctccctcatcgggctaaccgctcgcgccacctgggcaagcaacatccaagttgccattaaccaggtgcgccggcttatcggcaacgagaactatctcgactacatgacgtccatgaagcgcttcaagaacgagggcgaccccgagggggcgctgtggtag

SEQ ID NO: 24198 - RNA, 9879 nt, synthetic construct
  misc_feature 1..9879: note = derived and/or modified CDS sequence (opt11) from DENV-1__FJ410225__SS-prME
  source 1..9879: mol_type = other RNA
tcggtgaccatgttgctcatgctgatgcccaccgctctcgcttttcacctcaccacccgtggtggggaaccccacatgatcgtgtccaagcaggagcggggaaagagcctgctgttcaagaccagcgctggcgttaacatgtgcaccctcatcgccatggacttaggggagttatgcgaagatactatgacctacaagtgcccccgcatcacagaaaccgagcccgacgacgtggactgctggtgcaacgccacggacacttgggtgacctacgggacctgtagccaaactggcgagcatcggcgtgacaagcggtccgtagccctcgcgccccacgtgggcctggggctcgagacgaggaccgagacctggatgtcatccgaaggcgcctggaagcagattcagcgggtggagacatgggccctccgccacccggggttcactgttatcgccctgttccttgctcacgcaataggcaccagcatcacccagaaagggattatcttcattctcctcatgctggtgacgccctccatggccatgcggtgcgttggcataggcagccgcgattttgttgagggcctctcgggtgccacctgggtggatgttgtgctcgagcatgggagctgcgtgaccaccatggccaaggataagcccacgctggatatcgagctcttgaagaccgaagtcacgaaccctgccgtactgcggaagctctgcatcgaggccaagataagcaacacgacaaccgactcgcgctgcccgactcaaggcgaggccacccttgtggaggaacaggacgctaacttcgtctgccggcgtactttcgtggaccggggctgggggaatggctgcggactcttcggcaaagggtccctaatcacgtgcgccaagttcaaatgcgttaccaaactggaaggcaaaatcgttcaatacgagaaccttaagtacagcgttatcgtgaccgtccatacgggcgaccagcatcaggtggggaatgagagcaccgagcatggcaccaccgccaccataactccccaggcgcccaccaccgaaattcagctcaccgactacggggcgctgaccttggactgcagcccccgcaccggcctcgactttaacgagatggtcctgctcaccatgaaggagaaatcctggctggtccacaagcaatggttcctggacctgcccctcccgtggaccagcggggccagcacgtcccaggagacatggaaccggcaagacctactggtgacattcaagaccgcccacgcaaagaagcaggaggtcgtagtgctcggctctcaggagggggcgatgcacacggccctgaccggtgcgaccgagatccagaccagtggtacgacaacaatctttgccgggcacctcaagtgtcgactaaagatggacaaactgacacttaaggggatgtcatatgtcatgtgcacggggagctttaagctggaaaaggaggttgccgagacacagcacggcacggtgctggtccagattaagtacgagggcactgatgctccctgcaagatccccttcagcacgcaggatgagaagggggtgacgcagaacgggcggctcatcacggcgaatccgatagtgaccgacaaggagaagcccgttaacatcgaggccgagccgcccttcggggagtcctacatcgtaatcggggccggcgagaaggcgctgaaactcagctggttcaagaagggttcctcaatcggcaagatgttcgaggccacggccagaggggcacggcgcatggccatcttgggcgacaccgcgtgggattttgggtccatcggcggggtgttcacgtccatcggcaaactggtccaccagattttcggcactgcctacggtgtgctgttctccggcgtgagctggacgatgaagatcggaatcggcgtcctgctcacctggctcggcctgaactcccgctcgacctccctgagcatgacctgcatcgctgtgggactcgtgacgttatacctgggcgtaatggtgcaagccgactccggctgcgtgattaactggaaggggcgggagttaaagtgcgggagcggcatcttcgtcaccaatgaggtgcacacctggaccgagcaatataagttccaggccgacagcccgaagcgtctgtccgcggccatcggtaaggcatgggaggagggggtgtgcggcatccggagcgctacccgactcgagaatatcatgtggaaacagatctccaacgagctgaaccacatcctgctggagaacgacatgaagttcacggtcgtcgtgggggatgtcgccggcatcctagcccaggggaagaagatgatccggccccagcccatggagtataagtacagctggaaaagctgggggaaagccaaaatcattggggccgacgttcagaataccaccttcattatcgacgggcccaacaccccggagtgccccgacgaccagagggcctggaatatctgggaggtggaggactatggctttgggatattcacaaccaacatctggctgaagctgcgggacagctacactcaagtatgcgatcatcgcttaatgtccgcggcgatcaaggactccaaggccgtacacgccgacatgggctactggatcgaatccgagaaaaacgaaacctggaagctggcccgggcgagcttcattgaagtgaagacgtgcatttggcctaagtcccacaccctgtggagcaacggtgtactcgaatcagaaatgatcataccgaagatatacggagggccgataagccagcataactaccgccccgggtacttcacccaggcggccgggccctggcacttggggaagctggagctcgacttcgacctgtgcgagggcaccacggtcgtggtagacgagcattgtggcaaccggggtccgtcactgcgcacaacaaccgtgacaggcaagatcatccacgaatggtgctgccgaagctgcaccctgcctcccctccgctttcgcggggaagacggttgctggtacgggatggaaatcagacccgtgaaggagaaagaggaaaacctagtcaagtccatggttagcgccggcagcggcgaagtcgactctttctccctcgggctgttatgtatcagtatcatgatcgaagaggtcatgcggtcgcgatggtctcggcgcatgctcatgactggcacgctggccgtgttcttcttattaataatgggacaactgacgtggaatgacctgatccgcctctgtatcatggtgggagcgaacgcatcagaccggatgggaatgggaaccacctacctggccctgatggccacctttaagatgcgcccgatgttcgcggttggcctcctgttccggcgcttaacttcccgggaggtgcttcttctgaccatcgggctcagcttggtagcgtccgtagaactgcccaactctctcgaggagctgggcgacgggctggccatgggcataatgatcctcaagctgctgacggacttccagtcccaccaactctgggctaccctgttaagcctcacgttcataaagaccaccttctcgctgcactacgcctggaagaccatggctatggtgttgagcatcgtatccctctttcccctgtgcctgagcaccacctcccagaagaccacatggctccccgttctgctgggctcgctcgggtgcaagccgttgaccatgttcctgatcgcggagaacaagatctggggccgccggtcctggccgttaaacgagggaatcatggccgtgggcattgtctcgatcttactgagttccctcctgaaaaacgatgtccccctcgccggacccctcatcgccgggggtatgctgatcgcttgctatgtaatatcaggttccagcgccgacctgagtctcgagaaggcggccgaaatcagctgggaagaggaggcggagcacagtggcgcgtctcataacattttagtggaggtacaggacgacgggacgatgaaaatcaaagacgaggagcgagacgacaccctcaccatcctcctgaaggcaaccctcctcgcggtgtctggcgtatacccgctgtctatccccgccacgttattcgtatggtatttctggcagaagaagaagcagcgctcgggggtgctctgggacaccccgagtccacccgaagttgagcgtgccgtactggacgatgggatctacaggatcatgcagcgcggcctgctggggcggagccaggtgggcgttggggttttccaagagaacgtgttccacaccatgtggcacgtcactcgcggcgcggtgttgatgtaccaagggaaacggctggagccgtcttgggcatccgtgaaaaaggacctgatcagctatggcgggggatggcgcctccagggctcctggaacacgggagaagaagtacaggtgattgccgtggaaccgggcaagaaccccaaaaacgtccagaccgcccccggaaccttcaagacccccgaaggcgaagtaggtgccatcgcattggattttaagcccggcaccagcggctccccgatcgtgaatcgggaggggaagatcgtcggcctgtacggcaacggggtggtgaccacctctggcacctacgtcagcgccattgcccaggccaaagcgtcccaagagggtcccctacccgagatcgaggacgaggtgttccgcaagcggaatctaaccatcatggaccttcaccccggttctgggaagacccgccggtacctcccggctatcgtgcgcgaggccatcaagcggaaactgcggaccctgatcctcgcccccacccgagtcgtggcctccgagatggcagaagctctgaaaggcatgcccatccggtaccagaccacggccgtcaaatcggagcacacggggaaggagatcgtcgacctgatgtgtcacgcgacattcacgatgcgcctcttatcccccgcaagggtaccgaactacaacatgatcataatggatgaagcgcatttcaccgacccctcttccatcgccgcccgcgggtatatatctacccgggtgggtatgggtgaggcagccgcgatttttatgaccgccactccgcccggctccgttgaggccttcccgcagtcgaacgcggtgatccaggacgaggagcgcgacatccccgagagatcatggaacagcgggtatgagtggataaccgacttccccggcaagaccgtgtggttcgtcccctccatcaaaagcggcaacgacatagccaactgccttcgcaagaacggcaagcgcgtgatccagctgtcacgcaagaccttcgacacggaataccagaaaacgaagaataacgactgggactatgtggttaccaccgacatcagcgagatgggcgccaactttcgagcagacagagtgatagacccacggcgctgcctgaagcccgtgatcctgaaggacgggcccgagcgggtcatcctcgccggcccaatgccggtgacagtggcctccgcggctcagcgccgtggacgcatcggccgcaaccacaacaaggagggcgatcagtacatctatatgggtcagcccttaaataacgacgaagaccatgcccactggaccgaggccaagatgctgcttgacaacatcaatacgcccgaggggatcatccccgccctgttcgagccggagcgggagaagtccgctgccatagacggggaatatcgcctgagaggcgaggcccgcaagacattcgtagagctgatgcggagaggggacctgcctgtgtggctgtcctacaaggtcgccagcgagggcttccagtactcggaccggcggtggtgcttcgacggcgaacggaacaaccaggtgctcgaagagaatatggacgtggagatctggaccaaggagggagagcgcaagaagctacggccccgctggctagatgcccggacatactccgaccccctcgcgctgcgcgagttcaaggagtttgccgccggccgccgctcagtctccggagacctcatcctggagatcggcaagctgccgcagcacctgactcaacgggcccagaacgcgctagacaatctggtgatgctgcacaatagcgagcaaggcgggagggcctacagacacgcaatggaggagctacccgataccatagagacgctgatgctgctcgctctgatcgctgtgctgaccggcggggtcacactcttcttcctgtccggccgtggactgggcaaaacctctatcggcctgttgtgcgtgatggcctccagcgtgttactctggatggcgtcggtcgagccccactggatcgccgccagcatcatcctcgagtttttcctgatggtgctcctgatcccggagccggaccgacaacgcactccccaggacaaccagctggcctatgtggtcatcggactcctgtttatgatccttaccgtggccgccaacgagatgggcttactggaaaccaccaagaaggacctggggatcggccatgttgccgtcgagaaccaccaccacgccgccatgttagacgtggacctgcacccagcgtccgcttggacactgtacgctgtggccacgacgatcatcacgccgatgatgcggcacaccatcgagaatacaaccgccaatatcagcctcaccgcgatcgcaaaccaggcggccattttaatgggcctggacaagggctggcccatcagtaagatggacatcggcgtgccactcctggcgctggggtgttacagccaggtgaatcctctcaccttgacggctgctgtgctgatgctcgtcgcccactatgccatcatcggcccagggctgcaagcgaaggccacccgggaagcccagaagcgcaccgccgccggcataatgaagaaccccaccgtggacgggatagttgcgatcgatctggaccctgtcgtatacgacgccaaattcgagaagcagttgggccagatcatgctcctgatcctctgcacgtcccagatcctgttgatgcggacaacttgggccctctgcgagagcatcaccctggcaactggccccctgaccaccctctgggagggctccccgggcaaattctggaacaccacgatcgccgtgagcatggcaaacatcttccgcggatcctacctggccggagccggcctggccttcagcttaatgaaaagcctcggaggagggagacgcgggaccggggcgcagggggagaccctgggcgaaaagtggaagcggcagctcaaccagctgtccaaatcggagttcaacacctataagcgttccgggatcatggaggttgaccggtcggaggccaaggagggcttgaagcgcggggaaacgaccaagcacgccgtgtcccgggggaccgccaagctccgctggttcgtcgagcggaacctggtcaagcccgagggtaaggtgatcgacctgggctgcggccgcggcggctggtcgtattactgcgcgggcctaaagaaggtgactgaggtcaagggttacacgaagggcgggccaggtcacgaggagcccatcccgatggctacctacgggtggaacctggtgaaattacactccggcaaggacgtattcttcatcccgcctgaaaagtgcgacacactactctgcgacatcggagaaagctcccccaacccgaccatagaggagggcagaacgctgagggtcctgaagatggtggagccttggctccgggggaaccagttctgcatcaagatcctgaacccctacatgcccagcgtggtcgagaccctggagcagatgcagcgcaagcacggcggcatgctagtgcggaatccgctctcccgcaacagcacacacgagatgtactgggtgtcctgcggcacaggaaacatcgtcagcgccgtaaacatgacctccagaatgctgctcaaccggtttacgatggcccaccgcaaacccacctacgaacgcgacgtggacttaggggcaggcactcgccatgtagcggtggagcccgaggtcgctaacttagacatcatcgggcagcggatcgaaaatatcaagcatgagcacaaaagcacatggcactacgatgaggacaacccatacaaaacgtgggcttaccacgggtcctacgaggtaaagccgagcggctccgccagctctatggtgaacggggtagtaaagctcctcactaagccctgggacgtgatcccgatggtgacccagatagctatgaccgacacgacccccttcggccagcaacgcgtcttcaaagagaaggtcgacacccggacaccgaaggccaagcgcgggactgcgcagatcatggaagtcaccgccaagtggctctggggcttcctctcccggaacaagaagccccggatctgcacccgcgaggagttcacccgtaaggtacgaagcaatgccgcgatcggcgcggtgtttgtggacgagaaccagtggaatagcgccaaagaagccgtggaagacgagcgcttctgggaccttgtccacagagagagggagctacacaagcaggggaagtgtgccacgtgcgtctacaacatgatgggcaagcgggagaagaagctcggggagttcggcaaggccaaggggagccgcgcgatctggtatatgtggctaggcgcccggttcctggagttcgaggccctcggcttcatgaacgaggaccactggttctcccgcgagaactctctgtcaggggtggagggcgaggggctgcacaagctcggctacatcctgcgcgacatcagcaagatccccgggggcaacatgtacgcagacgacaccgccggctgggacacacgcatcactgaggacgacctgcagaacgaggcgcggataacagacatcatggagccggagcatgccctcctcgccaagtccattttcaagctgacctaccagaataaggtggtccgggttcagaggccagctaagaatgggaccgtgatggacgtcatctcccggcgcgatcaacgaggctccggccaagtggggacctatggcctcaacactttcacaaacatggaagcccagctaattcgccagatggagagcgaggggatcttctcccccagcgagctagagacgcccaacctcgcggagcgggtcttggactggctggagaaatacggcgtagagcgcctaaagaggatggccatctccggtgatgactgcgtcgtgaagcccatcgacgaccgcttcgccactgccctgaccgccctcaacgatatgggcaaggttcggaaggacataccacagtgggagccaagcaagggctggaacgattggcaacaggtcccgttctgtagtcatcacttccatcagctcataatgaaggatggcagggagatcgtggttccgtgccggaatcaggatgagctggtgggccgtgcgcgagttagccagggggccggttggagcctgcgcgagaccgcctgcttagggaagtcctacgcccaaatgtggcagctgatgtactttcaccggcgcgacctgcgactggcggcaaacgcgatctgcagcgccgtccccgtggactggatccccacctcccgcacgacgtggagcattcacgctcaccaccagtggatgaccaccgaggacatgttatctgtatggaaccgggtgtggatcgaggagaacccctggatggaggacaaaacccacatcagctcctggggcgacgtgccgtacttgggtaagcgggaggatcagtggtgcggctctcttattggcttgacggctcgcgccacctgggcgaccaacatccaggtagccatcaaccaggtcagacgcttgatcgggaacgagaactatctcgactacatgacctctatgaagcggttcaagaacgagagcgatccggaaggcgccttatggtga

SEQ ID NO: 24199 - RNA, 9879 nt, synthetic construct
  misc_feature 1..9879: note = derived and/or modified CDS sequence (opt11) from DENV-1__FJ410226__SS-prME
  source 1..9879: mol_type = other RNA
agcgtgaccatgctgttgatgttaatgcccaccgcgctggcctttcacctcacgacccgtggcggcgaaccccacatgatcgtgagcaagcaggagcggggcaagtccctcctgtttaagacctctgccggagtgaacatgtgcacgttaatcgccatggaccttggcgagttttgtgaggacaccatgacatacaagtgcccccgcatcaccgaggccgagcccgacgacgtggactgctggtgcaacgccacggacacgtgggtgacctacgggacatgcagccagaccggcgagcaccggcgggacaagcggtcggtggccctggcgccccatgtgggcctcgggctggagacgcgcaccgagacctggatgagctccgagggcgcctggaagcaaatccagagggtcgagacctgggcgttacgccaccccggattcacggtgatcgccctctttctggcgcacgctatcggcaccagcattacccagaaggggatcattttcatcctgcttatgctggtgaccccctccatggcgatgcgctgcgtcgggatcggatcgagagacttcgtggaggggttgtccggagcgacgtgggtggacgtcgttctcgagcacgggagctgcgttaccaccatggcaaaggacaagcctaccctggacattgagttgctcaagactgaggtcacgaaccccgctgtgctgaggaagctgtgcatcgaggccaagatttccaacacgaccacggatagccgctgtccgacccaaggagaggccaccctcgtggaggaacaggacgccaacttcgtctgccggcgtaccttcgtagatagaggctgggggaacggctgcggactgttcggcaaagggtccctgataacatgtgccaagttcaagtgcgtgaccaaactcgaaggcaaaatcgtccagtatgaaaatctgaagtacagcgtgattgtgaccgtccacacaggcgaccagcaccaggtggggaacgagtctacggagcatggcaccaccgcgaccatcacaccccaggcccccagtacggaaattcagctgacagattacggagcgcttactctggactgttccccgcggaccggcttagactttaacgaaatggtactcctgaccatgaaggagaagtcctggttggtgcacaagcagtggttcttggacctgcccttaccgtggaccagcggggcctcgaccagccaagaaacctggaaccggcaggacctcctggtgacgttcaaaaccgctcatgcgaaaaagcaggaagtcgtggtgctgggatcccaggagggcgcaatgcacaccgctctcaccggcgcaacggagatccagacaagcggcaccaccacgatcttcgccgggcacctgaaatgccggctgaagatggacaagttgacgttgaagggtatgtcctacgtcatgtgcacagggagcttcaagttagagaaggaggtggctgagacccagcacggcacggtgctcgttcagatcaagtacgagggcaccgacgccccttgcaagatccccttctccactcaggacgagaaaggggtgacccaaaacggccggctaattacggccaaccctatcgtgactgacaaggacaagcccgtcaacatagaggccgaaccgccctttggggagagctatatcgtgatcggcgcgggcgagaaggccctgaaactgtcatggttcaagaagggatcatccatcggcaaaatgttcgaggcaaccgcgcgcggggcccggcgtatggcgatcttgggcgacacggcctgggactttgggagcataggcggcgttttcacgtccgtcgggaaactggtgcatcagatcttcggcaccgcatacggggtgctattcagcggcgtgtcctggaccatgaagatcgggatcggggtgctcctgacctggctggggctgaacagccgctccaccagcctatccatgacctgcattgcggttgggctggtcaccctgtatctcggcgtaatggtgcaagccgactctgggtgcgtggtgaactggaagggccgggagctgaagtgcgggtcaggcatattcgtgactaatgaggtccacacgtggaccgagcagtacaaattccaggcggattccccgaagcgcctctctgccgctataggcaaagcgtgggaggagggggtgtgtggcatccggtccgccacccgcctggagaatattatgtggaaacagatcagcaacgagttaaaccacatcctcttagagaacgacatgaagttcaccgtggtcgtgggggatgtggcgggaatcttagcgcaggggaagaaaatgatcagaccccagcccatggaatacaagtactcctggaagtcctgggggaaggcaaagatcataggcgccgacgtccagaacaccacgttcataatcgacgggccgaacactccggaatgccccgacgaccaaagggcgtggaacatctgggaggtagaggactacggcttcgggatctttaccaccaacatctggctcaagctgcgggactcctatacccaagtttgcgaccaccgcctgatgagcgccgctatcaaagactccaaggccgtgcacgccgatatgggctattggatagagtctgagaagaatgagacttggaagctcgcgcgggccagcttcatcgaggtgaaaacctgtatctggcccaagtcgcacaccctgtggtcaaatggagtgctggagagcgagatgatcatcccgaaaatctacgggggaccgatctcccagcacaactaccgccccggctactttactcagaccgccggcccctggcacctcgggaagctggaactggacttcgacctctgcgagggcaccaccgtagttgtggacgagcactgcggaaaccgcgggccgagcttgcgcacgacaaccgtcacggggaagatcattcacgagtggtgctgccggtcctgcacactgccgccgctgcgtttcaagggcgaagatggctgctggtacgggatggagatccggccagtgaaggagaaggaagagaacctggtcaaatcgatggtcagcgccggctccggcgaggtggattcattctcccttgggctgctgtgcatctcaataatgatcgaggaagtgatgcgctcacgctggtcgcgcaagatgctgatgaccggcactctcgccgtcttcttcctgcttatcatggggcaactcacctggaacgacctgatccggctgtgcataatggtgggtgcgaatgcctccgaccgcatgggtatgggtacgacttatctcgccctgatggccacctttaaaatgaggccgatgttcgcggtgggcctcctgttccgccgcctgacctcccgcgaggtcctgctcctgacgatcgggctgtcgctcgtggcttcagtcgagctgccaaattccctggaggagttgggcgacggcttagccatgggcatcatgattctgaagctcctaaccgacttccagagccaccagctgtgggccaccctcctgtccttgaccttcatcaagacgacctttagcctccactacgcctggaaaacaatggcgatggtgctgtccatcgtcagcctgttccccttatgcatgagcacaacaagccagaagacaacatggctgcccgtcttactcggttccctggggtgcaagccgctgactatgttcctcatcgccgagaacaagatctggggccggaaaagctggcccctgaacgagggaatcatggcagtgggcatcgtgagcatcctgctctcctcacttcttaaaaatgatgtcccactagccgggccgctgatcgccggcggtatgctgatcgcgtgctacgttatctccgggtcatccgcagacctcagcctggagaaagccgccgaggtgtcctgggaggaggaggccgagcactccggcgcttcccacaacatcctagtggaagtgcaggacgatgggacgatgaagattaaggacgaggagcgggacgataccctaaccatactgctgaaggccaccttgctggccgtgagcggagtctacccgctgtccatcccagcgaccctctttgtgtggtacttctggcagaagaagaagcagaggagcggggtgctgtgggacacgccgagtccgccggaggtcgagcgcgccgtgttggacgatggtatctatcgcatcatgcagcggggcctccttgggcgcagccaggtgggcgtaggggtgtttcaggaaaacgtgttccacaccatgtggcacgtcacgcggggcgcggtactgatgtaccagggtaaacgtctggagccttcatgggctagcgtgaagaaggatctcatctcctacgggggcgggtggcggctgcagggtagctggaacactggggaagaggtccaggtcatcgccgtcgagcccggcaagaaccccaagaacgttcagacagcacccggtacctttaaaacctccgagggagaggtgggcgctatcgccctggacttcaagcccgggacctctggtagccccatcgtgaaccgcgagggtaagatcgtgggcctctacggaaacggggtggtgacgacctccggcacttacgtcagcgcgattgctcaggccaaggcctcgcaggaggggcccctgccggagatcgaggacgaggtgttccggaagcgcaacctgaccattatggacttgcaccccgggagcgggaagacgagacgctacctgcccgccatcgtgcgggaggccattaagcgcaagctgcgcacgctcatcctggccccgacccgggtcgtcgcctccgaaatggcggaagctctgaaaggcatgcccatccgctatcagaccacggccgtcaagagcgaacacaccggcaaggagatcgttgacctcatgtgccacgccacctttaccatgcgtttactgtcccccgtacgagtgcccaattacaatatgattatcatggacgaggcccacttcactgacccgagctctatagcggcccgggggtacatcagcacacgcgttggtatgggggaggccgccgccatattcatgaccgcgacaccacccggcagtgtggaggccttcccccagtccaatgccgtgatccaggacgaggagcgggacatcccagagcgctcctggaacagtgggtacgagtggatcacggacttccctggcaagaccgtgtggttcgtgccatccatcaaaagcggcaacgacatagccaactgcctcagaaagaacgggaagcgcgtgatccagctatcccggaaaaccttcgacaccgagtaccagaagacaaagaacaatgactgggattacgtcgtgacgaccgacatcagcgagatgggcgcgaactttcgcgcggaccgggtgattgacccccgacggtgcctgaagccagttatcctcaaggacggtcccgaacgcgtgattctggccgggcccatgcctgtaacagtggcctccgcggctcagcgacgcgggcggatcggccgcaatcacaataaggagggcgaccagtacgtttatatggggcagccactgaacaacgatgaggaccacgcccactggaccgaagccaagatgctgttagacaatattaacacccccgagggcatcatccccgccctgtttgaacccgagcgggaaaagagcgctgcgatcgacggggagtacaggctacgcggcgaagcccggaaaacctttgtcgagctgatgcgtcgcggagatctgccggtgtggctctcgtataaggtggcctccgaggggttccagtacagcgaccgccgctggtgctttgatggcgaacgcaacaaccaggtcctggaggagaacatggacgtggagatctggaccaaggagggggaacgaaagaagctccgccccagatggctcgacgcccgcacgtactcggaccccctggccctcagggagttcaaggagttcgcggccggccgccggagcgtgtccggggatctcatcctggagatcggcaagctaccccaacacctcacccagcgcgcacagaacgcactggacaatctggtcatgctccacaacagcgagcagggcgggcgggcgtatcgccacgccatggaggaactgcctgataccatcgagaccctgatgctactggcgctgatcgcggtactcaccggcggggtaacgctgttcttcctgtccggtcggggactcggcaagaccagcatcggcctgctgtgcgtcatggcttccagcgtactactatggatggcgtctgtggagccccactggatcgccgcctctatcatcctggagttcttcctcatggtgctcctgatccccgagcccgaccgccagcggacgccgcaggacaaccagttagcgtacgtggtgatcgggctattattcatgatcctgacagtagcagcgaacgagatggggctgcttgagacgaccaagaaggacctcgggataggccacgtggccgtggagaaccaccatcatgccgccatgctagacgtcgacctgcaccccgcttcagcgtggactctctacgccgtggccaccacgattatcacccccatgatgcgacataccatcgagaacaccacggctaatataagcctaacagccatcgcgaaccaggctgccatcttgatggggctcgacaagggctggccgataagtaagatggacataggcgtgccgctgctggccctcgggtgctactcacaggtgaaccctctgaccctgaccgcggcggtgctcatgctggtggcccattacgcaatcatcgggcctggtctgcaggccaaggcgacgcgcgaggcccaaaagcgcaccgccgccggcatcatgaagaacccgaccgtcgacgggatcgtggctatcgacctcgaccccgtggtctacgacgcgaagtttgaaaagcagttgggccagattatgttgctgatcctgtgcacatcccaaatcctgctcatgcgcacgacctgggccctgtgcgaaagcatcaccctggcaaccggccccctcacgaccctgtgggagggctcgcccggcaagttctggaacaccactatcgccgtgagcatggcaaatatcttccgggggtcgtatcttgcgggcgcagggctcgccttctccctgatgaagtcattaggaggagggcgccgggggacgggggcgcaaggcgagaccctcggtgagaagtggaagcgccagctaaaccagctgtccaagagcgagttcaacacctacaagcggtccgggatcatggaggtcgaccgcagcgaggcgaaggagggcctcaagcgcggggagaccacgaagcacgccgtcagtcgcggcacggccaagctgcggtggtttgtagagcgcaatctggtaaaaccagagggaaaggtaatcgacctcggctgcggtcgtggtggttggagctactactgcgccgggctgaagaaagttacagaggtgaagggttataccaaagggggccccggccacgaggagcccatccccatggccacatacgggtggaacctggttaagctgcactccggcaaggacgtgttctttatcccgcccgagaagtgcgataccctcctgtgcgatattggggagtcctcccccaacccaactattgaggaaggccgaaccctgcgggtgctcaagatggtagaaccgtggctgcgcgggaaccagttctgcatcaagatcctgaacccctatatgcccagcgtggtggagacgctagagcagatgcagcggaaacatggaggcatgttggtccgtaatccactgtcgagaaactccacccacgagatgtactgggtgtcctgcggcactggcaacatcgtgagcgcggtcaatatgacttcacgcatgctcctgaaccggttcaccatggcccaccggaaaccgacctacgagcgcgacgtcgacctgggggcaggcacccggcacgtcgccgttgagcctgaggtggccaacctcgacatcatcggccagcgcatcgagaacatcaagcacgagcataagagtacgtggcactacgacgaggacaacccctacaaaacgtgggcctaccatgggtcatacgaggtcaagcccagcggcagcgcctccagcatggtgaacggtgtggtcaaactacttacaaagccgtgggacgtgatccccatggtgacccagatcgccatgaccgacaccacgcccttcgggcagcagcgggtctttaaggagaaggttgacacccgaacccctaaggctaagcgtgggaccgctcagatcatggaagtgacggccaagtggttatggggattcctatcccgcaacaagaaaccgcggatctgcactcgcgaggagttcactcggaaagtgaggagcaatgcggccataggtgccgtgttcgtggacgaaaaccagtggaactccgcgaaggaggccgtcgaagacgagcggttctgggacctggtgcaccgtgagcgagagctccacaagcaggggaaatgcgcgacctgcgtgtacaacatgatgggcaagcgcgagaagaagctaggggagttcggcaaagccaaggggtcacgggccatctggtacatgtggctcggcgcacgatttctcgagttcgaggccctgggattcatgaacgaagaccactggttctcccgcgaaaacagcctgtccggggtggagggcgaggggctacacaagctgggctacatcctgcgcgacatcagcaagatcccagggggcaacatgtatgcggacgacacggctgggtgggacaccaggatcaccgaggacgacctccagaacgaggcaaagataaccgatatcatggagccagagcacgcattactcgcgaagtccatcttcaagctcacgtaccagaacaaggtggtgcgcgttcagcggccggccaagaacgggaccgtgatggacgttattagccgccgggaccagcggggctctggccaggtcggcacctacggcctgaatacgttcactaatatggaggcccagctaatccgccagatggagtctgaggggatcttctccccctcggagttggagaccccaaacttggctggcagagtcctggactggttggaaaagcacggggtggagcgcctgaagcggatggcgatctccggtgacgactgcgtcgtgaagcccattgatgaccgctttgcgaccgccctgacggcactcaacgacatggggaaggtgagaaaggacataccgcagtgggagccctccaagggctggaacgactggcagcaggttcccttctgctctcatcatttccaccagctgatcatgaaggacggccgtgagatcgttgtgccctgccggaaccaggacgagttagtggggcgcgctcgggtctcccagggtgccgggtggagcctccgcgaaacggcctgcctgggcaagagctacgcacagatgtggcaactgatgtatttccaccggagagatctccggctggcagccaacgcaatctgcagcgccgtgcctgtagactgggtgcccacctcgaggaccacgtggagcatccacgctcaccaccagtggatgacgaccgaggacatgctgtccgtgtggaaccgggtctggatagaggagaacccctggatggaggacaagacccacatcagctcctggggagacgtgccctacttggggaaacgtgaagaccagtggtgtggatctctgataggactcactgcccgggccacatgggccaccaacatacaggtggccatcaaccaagtccgccgcctcatcggcaacgagaactacctagactacatgacgagcatgaagcgattcaagaacgagagcgatcctgagggcgccctatggtag

SEQ ID NO: 24200 - RNA, 9879 nt, synthetic construct
  misc_feature 1..9879: note = derived and/or modified CDS sequence (opt11) from DENV-1__FJ410227__SS-prME
  source 1..9879: mol_type = other RNA
agcgtgacaatgctcctcatgctgatgcctaccgcgctggccttccacctgaccacaagaggcggggagcctcacatgatcgtgtccaagcaagagcggggcaagagtctactgttcaagacctccgcgggcgtgaatatgtgcactctcatcgccatggacctaggcgagttctgcgaagacacgatgacgtacaaatgtcctcgcatcaccgaggccgagccagacgacgtggactgctggtgcaatgcgaccgacacatgggtaacctacgggacctgcagccagactggcgagcaccgacgggacaagcggtccgtggctctcgctccccatgtgggcctcgggctggagacgcgaaccgagacctggatgagctccgaaggggcctggaagcagatccagcgggtggagacctgggccctgcgccaccccgggtttacggtgatcgccctcttcctggctcacgccattggcacctcgatcacccagaaggggatcatctttatcctactgatgttggtgaccccttctatggccatgcggtgcgtcggcatcggcagtcgcgacttcgttgaggggctgtcgggcgccacgtgggtggacgtcgttctcgagcatgggagctgcgtgaccactatggcgaaggacaagcccaccctggatattgagctgctaaaaacggaggtcaccaaccccgcagtgctgcggaagctgtgtatcgaggctaagatctcgaatacaactacggactcccgctgcccgactcaaggcgaggccaccctcgtggaagagcaggacgccaacttcgtctgccggcgcaccttcgtggaccggggctggggtaacggctgtgggctcttcggtaaggggtccctcatcacctgcgccaaattcaagtgtgtgaccaagctcgaaggcaagatagttcagtacgagaacctcaaatacagcgtcatcgtgaccgtccacaccggcgaccagcatcaagtgggtaacgaatccacggagcatgggaccaccgcgacgatcacgccccaggccccgtcaaccgagatccagctgaccgactacggggccctaaccctggactgctcaccacggactggcctggactttaacgagatggtcctcctgacgatgaaagagaagagttggctggtgcataagcagtggttcctcgaccttcccctgccctggacgtcgggggcgagtacaagccaggaaacctggaaccggaaggatctcctggtgacgttcaagaccgcccacgcgaagaagcaggaggtcgtggtgctgggctcccaggagggagccatgcataccgccctgacgggggccacggagatccagaccagcggcaccactacgatcttcgccggccacctgaaatgcagactgaagatggacaagctcacccttaagggcatgtcctatgtcatgtgcacagggagcttcaagctggagaaagaagtggcggagacgcagcatggcaccgtgctcgtgcagatcaagtacgagggcaccgacgctccctgcaagattcccttctccacccaggacgagaagggggtgacccagaacggacggctgatcacggccaacccgatcgtaaccgacaaggaaaagcccgtaaatattgaagcagagccgcccttcggggagtcttacatcgtgatcggcgccggcgagaaggcattgaagctcagctggttcaagaaagggagctctatcggcaaaatgttcgaggctaccgcacgcggcgcccggcgtatggcgatcctcggcgacaccgcctgggacttcgggagcattggtggggtgttcacgtctgtcgggaagctggttcaccaaatcttcgggaccgcctacggggtgctgttcagcggcgtctcatggacaatgaagatcgggatcggtgtcctcttaacctggctgggcctcaacagccgctccactagcctttcaatgacctgcatcgccgtggggctggtgaccctctacctgggcgtcatggtgcaggccgactcggggtgtgtcatcaactggaaaggccgagagcttaaatgcggctctggcatctttgtgaccaacgaggtgcacacttggaccgagcaatataagtttcaagccgactccccgaaacgcctcagcgctgccatcgggaaagcatgggaggaaggggtctgcggcatccgatccaccacccgcctggagaacataatgtggaagcagattagcaatgagctaaaccacatcctcctggagaacgacatgaagttcaccgtggtggtaggggacgtggccggcatcttagcgcaggggaagaagatgatccggccccaacccatggagtataagtactcctggaaatcctggggcaaagccaagatcataggcgctgacgtgcagaacacgaccttcatcatcgacgggcccaataccccggagtgccccgacgaccagcgcgcgtggaatatctgggaagtcgaggactacggttttgggatattcaccacgaacatctggctcaagttacgggactcctacacccaggtgtgcgaccaccgcctgatgagcgcggctatcaaggactccaaggccgtgcacgccgacatgggctactggatcgagagtgagaagaacgagacttggaagctcgcccgggcgtccttcatcgaggtaaagacctgcatatggccaaagagccacacgctgtggtctaacggcgtgctggagagtgaaatgatcatccccaaaatctacgggggaccgatctcacaacacaactaccgacccggatactttacacagaccgccggcccctggcacctcgggaagctcgaactggacttcgacctctgcgaaggcaccacggtggtagtggacgagcactgcggcaaccgggggccaagcctccgcaccaccaccgttactggcaagattatccacgagtggtgttgccggtcctgcacccttccgcccctgcgcttcaagggggaggacggctgctggtacgggatggaaatccggcccgtcaaggagaaggaggaaaacctggtcaagagcatggttagcgcgggctccggcgaggtcgatagctttagtctggggcttctgtgtatctcgatcatgatcgaggaagtgatgcgctcccggtggagccgcaagatgctgatgactggcacactcgccgtgtttttcctgctgatcatggggcagttaacgtggaacgacctgatccggctgtgcatcatggtcggcgccaacgcctccgaccgcatggggatgggcaccacctacctggctctgatggccaccttcaaaatgcgcccgatgttcgccgtcggtctcctgttccggcgcctaacgtcgagagaggttttactcctgaccatcgggctttccctggtagcgagcgtagagctgcctaactccctggaggagttgggcgacgggctcgcgatgggcatcatgatcctgaagctcctgaccgacttccagtctcatcagctgtgggccaccctactgtccctgacgttcatcaagaccaccttcagcctccactacgcctggaagactatggccatggttctgtccatcgtcagcctgttccctctctgccttagtacgacaagccagaagactacctggctgccggtgctcctgggctccctagggtgcaagccgctcactatgttccttatcgctgaaaacaagatctggggccgaaagagctggccgcttaacgaagggatcatggccgtcgggatcgttagcattctcctgagtagcctgctcaagaacgatgttcccctggccggccccctaatcgccggcggaatgttaatcgcctgctacgtcatctccgggagcagtgcggacttgagcctggaaaaggcggccgaggtgtcctgggaggaggaagccgaacacagcggggcttcccataacatactcgtggaggtccaggatgacgggacgatgaaaatcaaggacgaggagagagacgacaccctgaccatactgctcaaggcgacccttctggccgtgtctggcgtgtacccgctatcaatccccgcgacactctttgtctggtacttttggcaaaagaagaagcagcgttcaggggtgctttgggatactccctccccgcccgaggtggagcgggctgtcctcgacgacggcatctatcgcataatgcaacggggcctgctgggccgctctcaggtgggcgtgggggtctttcaggagaacgtgttccacaccatgtggcacgtgacacgtggcgctgtcctgatgtaccaaggtaaacgcctcgagccttcctgggcgtcagtgaaaaaagacctgatctcctacggaggcgggtggaggctacagggctcttggaacacgggggaggaagtgcaagtcatcgcggtggagcccggcaagaaccccaagaacgtgcaaaccgcgccagggaccttcaagacttccgagggcgaggtcggggccatcgcgctcgacttcaagccggggaccagcggcagccccatcgtaaacagagaggggaagatagtgggtctgtacggcaacggagtcgtgaccacttccggcacctacgtgtctgcgatcgcccaggccaaggcctcccaagaggggcccctgccggaaatcgaagacgaggtcttccggaagcgcaacctgacgatcatggacctgcaccccggcagcgggaagaccaggcgctacctgcccgctatcgtgcgggaggccatcaagcgtaagctacggaccctgatcctcgccccgacgcgcgtggtggcttcagaaatggccgaagcgttaaagggaatgcccatacgctatcagacgaccgccgtgaagtcagagcataccggcaaggagatcgtggatttgatgtgccacgcgaccttcacgatgagactgctctcccccgtccgcgtgccaaactacaacatgatcatcatggacgaggcgcacttcaccgaccctagctccatagccgcgcggggctacatcagcacccgcgtcggcatgggtgaggccgcagccatctttatgaccgccacgccccccggcagcgtagaggcgttcccccaaagcaacgccgtgatccaggacgaggagcgggacatcccagagcggagctggaactcagggtacgagtggatcaccgacttccccggcaagacggtgtggttcgtcccctccattaaatctggtaatgatatcgccaattgcctccggaaaaatgggaaacgcgtgatccagctgagtcgaaagaccttcgacacggagtaccagaagaccaagaacaacgactgggactacgtggtcaccacggatatcagcgaaatgggtgccaacttccgcgccgatcgggtcatcgatccccgccggtgcctcaagcccgtgattttaaaggacgggcccgagagggtcattctggctgggcctatgccggtgacggtcgcctcagcggcccagcggcgtggccggatcggccgcaaccacaacaaggagggagatcagtacatatacatggggcagccgctcaacaacgacgaggaccacgcccactggaccgaggccaagatgcttctggacaatatcaacacacccgagggtatcataccggccctattcgagcccgagcgggagaagtcggcggccatagacggagagtaccgcctgcggggcgaagcgcgcaagaccttcgtagagctgatgcgccgcggcgacctcccggtctggctaagctacaaggtcgcctccgagggcttccagtatagcgatcgacggtggtgcttcgacggcgaaaggaacaaccaagtcttagaggagaacatggacgtggagatctggacgaaggagggggagcgtaagaagctccgcccccggtggctcgacgcccgcacctactcagaccccctggccctccgggagttcaaggagtttgccgcgggccgtcggagcgtgtccggggacctgatcctcgagatagggaagctcccccagcacctgacccagcgcgcccaaaatgctctcgacaatctcgtgatgctgcacaattcggagcagggcgggcgggcctaccgccacgcgatggaagagctgcctgacaccatcgagactctcatgctgctggcactgatagccgtgctcacaggcggggtcactctatttttcctatccggtcggggcctgggcaagacaagcatcggcctgttgtgcgtaatggcttccagcgtgttactgtggatggcgagtgtcgaaccacattggattgctgccagcattatcctagagttcttcctgatggtgctattgattcccgaacccgaccgccaacggacgccacaggacaaccaactggcctacgtggtgatcggactcctcttcatgatcctgacagtcgcagccaatgagatgggcctgctcgaaaccaccaagaaggacctggggatcggccacgtagcggccgagaaccaccaccacgccgccatgctggacgtcgacttgcaccccgcctccgcgtggaccctctatgccgtggccacgaccatcatcacccccatgatgcgccacaccatcgagaatacgaccgccaacatcagcctgaccgccatcgcgaaccaggctgcaatcttaatggggctggacaagggttggccgatctccaagatggacatcggtgtaccacttctcgccctggggtgttatagccaggtcaaccccctgaccctcactgctgcagtactgatgctggtggcccactatgcaatcataggccccgggctccaggccaaggcgacccgcgaggcccaaaagcgcacggccgccggaataatgaagaacccaaccgtggacggtatcgtggccatagacctggatcccgtggtctacgatgcaaaattcgagaagcaactgggccagatcatgctcctgatcctgtgcacgtcccagatcctcctgatgcgcaccacatgggccctgtgcgaaagcataaccctcgctactggacctttaaccaccctgtgggagggatcccccggaaaattctggaacaccacgatcgccgtgtctatggccaacatatttcgggggtcttacctcgcgggcgctggcttggccttcagtctgatgaagtccttggggggcgggcgccggggcaccggggcccagggcgaaacgctgggcgagaagtggaaacgccagctgaaccagctttccaagagcgagttcaacacgtacaagcggagcgggattatggaggtagaccgcagtgaggcgaaagaaggcttaaagcgcggggagacaaccaaacacgccgtttcccgcggcaccgccaagctgagatggttcgtggagcgcaacttagtgaagcctgaggggaaggtcattgacctgggctgcggacgcggcgggtggagctactactgcgcgggcctgaagaaagtgaccgaggtaaaggggtacacaaagggcgggccaggccacgaagagcccatccccatggctacctacgggtggaatttggtcaagctccactccggcaaggacgtgttcttcatcccgcccgagaaatgcgacacgctgttatgtgacatcggtgaaagcagcccgaaccccacaatcgaggagggccgaactctccgggtgctgaagatggttgagccgtggctgcgcgggaaccagttctgcattaagatcctcaacccctacatgccctctgtagtggaaaccctggagcagatgcagcgaaaacacggcggcatgctcgtccgcaaccccttatcccgtaacagcacccacgaaatgtattgggtgtcgtgcgggaccggtaacattgtgagcgccgtcaacatgacctcccgcatgctgttgaaccggttcactatggcgcaccgcaagccaacgtacgagagggacgtggacttaggcgccggcacgagacatgtggctgttgagcccgaggtggccaacttagatatcatcggccagcgtatcgagaatatcaagcacgagcacaaaagcacgtggcactatgacgaggacaatccctacaagacgtgggcgtaccacgggtcctacgaggtgaagccctcaggcagcgcctccagcatggtcaacggggtggtcaaactgcttactaaaccttgggacgtgattcctatggtgactcagattgccatgaccgacacgactcccttcggccagcagcgggtcttcaaggaaaaggtggacacacggactcccaaggccaaacgggggacggcgcagatcatggaggtgaccgcgaagtggttgtggggattcctgtcccgcaacaagaagccgcggatctgcacccgcgaggaattcacccggaaagtccgcagcaacgccgccataggagccgtgttcgtggacgagaatcagtggaactccgcgaaggaggcggtcgaagacgagcggttctgggacctagtgcaccgcgaacgggagcttcacaagcaggggaagtgcgctacgtgcgtatacaacatgatgggcaagcgcgaaaagaagctgggggagttcggaaaggccaagggaagccgggccatctggtacatgtggctcggcgcgcgtttcttagaattcgaagccctgggcttcatgaatgaggaccactggttctcccgggagaacagcctctctggggtagagggagaggggctgcacaagctgggctacatactccgcgacattagcaagatccctgggggtaacatgtacgccgacgataccgccggctgggacacccgaattaccgaggatgacttacaaaacgaggccaagatcacggatatcatggagcccgagcacgcgctgctcgcgaagtccatattcaagctgacctaccaaaacaaggtggtgcgcgtccagcggcctgccaagaacgggaccgtgatggatgtgatcagccgccgcgatcagcgcggctccgggcaggtcggcacttacggcctcaacacgttcacaaacatggaggcgcagctgatccgccagatggaaagcgaaggcatcttctcccccagcgagttggagactcccaacctggccggccgggttttggactggctggagaagcatggggtggagcggctgaagcggatggcaatctcgggcgacgactgcgtcgtgaagcccatcgacgaccgtttcgctacagctctcacggccctgaacgacatgggcaaggtccggaaggacataccccaatgggagcccagcaagggctggaacgactggcaacaggtccccttctgctctcaccacttccaccagctgattatgaaggacggccgagagatagtggttccctgccgcaatcaggacgagctcgtcggacgcgctcgggtgtcccagggcgcggggtggtccctgcgtgaaaccgcctgcctgggaaagtcctacgcccagatgtggcagttaatgtacttccacagacgcgatctgagactggctgcgaacgcaatctgctcggcagtgccggtcgactgggtgcccacgtcgcgcaccacgtggagtatacacgcccaccaccagtggatgaccaccgaggacatgttgtcagtgtggaaccgggtttggatcgaggagaacccctggatggaggataagactcacatctcttcttggggagacgtgccatacctgggcaagcgcgaggaccagtggtgcggcagcttaatcggcctcacggcccgggcgacttgggccaccaacatccaggtggcaataaaccaggtccgccgcttgataggcaatgagaattacctggactacatgacctccatgaagcggttcaagaacgagagcgacccggagggggccctgtggtga

SEQ ID NO: 24201 - RNA, 9879 nt, synthetic construct
  misc_feature 1..9879: note = derived and/or modified CDS sequence (opt11) from DENV-1__FJ859029__SS-prME
  source 1..9879: mol_type = other RNA
agtgtgaccatgttgcttatgcttatgcccaccgccctggcctttcatttaactactcgcggcggtgagccccacatgatcgtgtccaaacaggaacgcggcaagagcttactgttcaagacgagcgccggggtgaatatgtgcactctaatcgctatggaccttggcgagttttgcgaggataccatgacctacaagtgcccccggatcaccgaggccgagcccgacgacgtggactgctggtgcaacgccaccgatacgtgggtcacctacggcacctgcagccagacaggcgagcaccggcgtgacaagcgctcagtggccctggcgcctcacgtaggtctcgggctggagacgcgcactgagacctggatgagctcggagggagcctggaaacagatccagaaagtcgagacatgggccctgagacaccctggcttcacggtgatcgcgttatttctggcgcacgccataggcaccagcatcacccaaaaggggatcatcttcatcttgctcatgcttgtgactccctccatggccatgcgctgcgtcggcatcggcagccgggactttgtggaagggctgtccggtgccacgtgggtggacgttgtgctcgagcacgggagttgtgtgaccacgatggccaaggacaagcccaccctggacatcgagctgctcaagaccgaggtcaccaatcccgcggtcctaaggaagctgtgcatcgaggctaagatctccaacactaccacggacagccgttgcccgacccagggcgaagcaaccctcgtagaggagcaggacgccaacttcgtatgccgccggaccttcgtggacagaggctgggggaacggctgcgggctcttcggcaaaggctccctgatcacgtgcgccaagttcaagtgcgttaccaaactcgagggcaagactgtacaacacgagaatttaaaatacagcgttatcgtgactgtccacacgggcgaccagcaccaggtggggaacgagtccaccgagcatggaaccacggccaccatcacaccgcaggcccccagcaccgagatccagctgacagactacggggcgctcaccctggactgcagcccgcggactggactggacttcaatgagatggtactcttaaccatgaaggagaagagttggctggtgcacaagcagtggtttctcgatctgccgctgccctggaccagtggggcatccaccagccaggagacgtggaacaggaaggacctgctcgtgacttttaagaccgcacacgcgaagaaacaggaagtggtagtcctgggctctcaagagggcgctatgcataccgcccttactggcgccaccgagatccagaccagcggtaccacgaccatatttgccggtcacttgaagtgcagactgaagatggataagctcacccttaaaggcacctcatatgtcatgtgcacggggagcttcaagctggagaaggaggtcgcggagacacagcacggcaccgtgctggttcaaatcaagtatgaaggcacggacgccccctgcaaaatcccattctccacccaagacgaaaaaggggtgacacagaacggtcgcttgatcaccgcaaaccccatcgtaaccgacaaggagaagcctgtcaatattgaagccgagccgccgttcggggaaagctacatagtcatcggtgcgggcgagaaggccttaaagctgtcctggtttaagaaagggagctccatcggcaagatgttcgaggccacggccaggggggcccgtcggatggccatcctaggagacaccgcctgggacttcgggagcatcggcggtgtcttcacctccgtcgggaaattagtgcaccagatcttcggtaccgcctacggcgtcctattcagtggcgtctcctggacaatgaagattggtattggcgttctactcacctggctgggactcaacagcagatccacaagcctgtcaatgacctgcatcgccgtgggactggtcacactctacttgggggtgatggtccaggcagacagcggttgcgtcatcaattggaagggccgcgagctaaagtgcggtagcggcatcttcgtcaccaacgaggtgcacacctggaccgagcaatacaagttccaggcggactcgccgaagcggctcagcgcggccatcggaaaggcttgggaggagggtgtctgcgggatacgctctgccacacggctggagaatatcatgtggaagcagatcagcaacgagctcaatcacattctcttagaaaacgacatgaagttcacggtggtcgtaggggacgtggcagggatcctggcccaggggaagaagatgatcagaccccagcccatggagtataagtattcctggaaatcctggggaaaggccaagatcattggagccgacgtccagaacaccacattcatcatcgacgggcccaacaccccggagtgccccgacgaccaacgggcgtggaatatctgggaggtggaagactacggctttgggatcttcacgaccaacatttggttgaagctccgcgacagttacacccaagtgtgcgaccaccgtctgatgtccgccgcgatcaaagactcgaaagccgtccacgccgatatgggctactggatagagagcgaaaagaacgagacctggaagctcgctcgcgcgtcctttatagaggtcaagacgtgcatctggcccaagtctcacacactctggtccaacggggtgctggagagcgagatgatcatccccaagatctatgggggacctatcagccagcacaactacagacccgggtatttcacccagacagccggtccctggcacctcggcaaactggaactggatttcgacctctgcgagggcacaacggtcgttgtcgacgagcactgcggcaatagagggccgagcctacggaccaccacggtcaccggcaagatcatccacgagtggtgctgccggtcgtgtacgctgcctcccctccgcttcaagggggaggatggctgttggtacggtatggagatacgcccggtgaaagagaaagaggagaatctggtcaagtccatggttagcgccggctcgggcgaggtcgacagcttctccctaggtctcctatgcatcagcatcatgatcgaggaggtgatgagatcccgctggagccggaagatgctgatgactggaacgctcgccgtgttcctgctgctcatcatgggacagctgacgtggaacgacctgataaggctctgcatcatggttggcgcgaacgccagtgaccgcatgggcatgggcacgacctaccttgcgttgatggctacgttcaagatgcgcccgatgttcgccgtggggctccttttccgccggctgaccagccgcgaggttctgctcctgaccatcgggctctcactcgtagcgagcgtggagctgcccaactccctcgaagagttgggtgacggactggccatgggcataatgatcctcaaacttctgaccgacttccagtcccatcagctatgggctactctgctgtccttaacctttatcaaaaccaccttcagcctgcattacgcctggaagacgatggcgatggtcctgtccatcgtgagcctctttcccctgtgcctttctaccacaagccagaagaccacgtggctccccgttctactcggctccctcggatgcaagcctctgaccatgtttctcatcgcggaaaacaagatatggggccgcaaaagctggcccttaaatgagggaatcatggccgtgggaatcgtcagcatactgctttcaagtctcctgaagaacgacgtcccgctggcggggccccttattgccgggggcatgctgatcgcgtgttacgtcatttccgggagctccgccgacctgtcgctcgagaaagccgccgaggtgtcctgggaggaggaggccgagcactctggcgcatcccacaacatcctggtggaggtccaggatgatggaacaatgaaaatcaaggacgaggagcgtgacgacactctgacgattctcctgaaagcaacgcttctggccgtgagtggggtgtacccgctgtctattcctgctaccctgttcgtctggtacttctggcagaagaagaaacaacggtctggggtgttatgggacacaccaagccctcccgaggtggagcgagccgtcttagatgatggtatataccgcatcatgcagaggggtcttcttgggcggagtcaggtgggcgtgggggtcttccaggagaatgtcttccacacgatgtggcacgtgacccgcggcgccgtgttgatgtaccagggaaagcgcctggaacccagttgggcctctgtaaagaaagacctaatcagttacggcggcggatggagactccaaggcagctggaacaccggcgaagaagttcaggtgattgccgtcgagcccggcaaaaacccaaagaacgtgcagaccgcccccgggacctttaaaacatccgagggcgaggtgggtgccatcgccctggactttaagcccgggacaagcggctcacctatcgtgaaccgggaggggaagatcgtgggcctgtacggcaacggggtcgtaaccacttccggcacgtacgtgagcgccatcgcccaggctaaggcctcccaagaggggcctctcccggagatcgaggacgaggtcttccgcaagcggaacctaaccatcatggatcttcaccccggaagcggtaagacacgaagatacctcccagccatcgtgcgcgaggccatcaagcggaagctgcgcaccctgatactagcccccacgcgggtagttgcctccgaaatggcggaagccttaaagggcatgcccatacgataccaaaccaccgccgtgaagggcgagcatacggggaaggagatagtggatctgatgtgccatgccacattcacgatgcgactcctcagccccgtccgggtgccgaactacaacatgatcatcatggacgaggcccacttcactgacccatccagcattgcggcccgcggctacatcagtactcgggtggggatgggcgaggccgccgccatcttcatgacggcgacaccccccgggtcagtcgaggccttcccccagtcgaacgccgtgatccaggacgaggagagagacatcccggagcggagctggaactcagggtacgagtggataaccgattttcccgggaagactgtgtggttcgtcccttccatcaagtccgggaacgacatcgctaactgtctgagaaagaacggcaaacgggtgatccagctaagtcgcaaaacgttcgacaccgaatatcagaagacgaagaacaatgactgggactacgtcgtcaccacggacatctccgagatgggggccaacttccgggccgaccgcgtgatcgaccctcggcgctgtctaaagccagtgatcctgaaggatggccccgaacgggttatcctggccgggcccatgcccgtgacagtcgctagcgcagctcagcgcaggggccgcatcggccggaaccacaacaaggaaggcgatcagtacatctacatggggcaaccgttgaataacgacgaagaccatgcccattggaccgaggccaagatgctactcgataacatcaataccccggaggggatcatccccgccctgttcgaaccagagcgcgaaaagtccgctgcgatcgacggagagtatcggctgcgcggggaagcccgtaagacatttgtggaactcatgcggcgcggtgatttaccggtgtggctgagctacaaggtagcaagcgagggtttccagtattccgacaggcgctggtgcttcgatggggaacgaaacaaccaggtgctggaggagaacatggatgtggaaatttggacgaaagagggcgagcgcaaaaagctgaggccccggtggctggacgcgcggacctacagcgatcccttagccctgcgcgagttcaaggaattcgcggccgggcggaggtccgtcagcggggacctgatcctggagatcggcaagctgccccagcatctgacccagcgggcgcagaacgccttggacaatctggtgatgctgcacaatagcgagcagggcgggcgcgcctatcggcacgcgatggaggagctcccggatacgatcgagactctcatgctgctagccctgattgccgtgttaaccgggggcgtcacgctcttcttcctgtctgggcgcggcctgggcaagacctccatcgggctcctgtgcgtgatggccagctccgcgttgctgtggatggccagcgtggagcctcactggatcgccgcatccatcattttagagttcttccttatggtcctcctgattcccgagcccgatcggcagcgaactccgcaggacaatcaactggcctacgtggtgattggcttgctattcatgatcctgactgtcgcggcaaacgagatgggcctcctggagaccaccaagaaggatctgggcatcgggcacgttgcagtagagaaccatcaccacgccgccatgctcgacgtcgaccttcaccccgcgagcgcctggacactgtacgccgtggccaccacaattatcacccccatgatgcggcacacgatcgagaataccaccgctaatatctccttaaccgcgatcgccaaccaggcggccattctgatgggcttggacaaggggtggccgatcagcaaaatggatatcggggtgcctctgctggccctgggctgctactcacaagtgaaccccctcacgctgaccgccgccgtcctgatgctcgtggcccactacgctatcattggacccgggttacaagccaaggccacccgcgaggcccaaaagcggactgccgcaggaatcatgaagaaccctacggtcgatggcatcgtcgcgatcgacttagaccctgtggtctacgacgccaagttcgaaaagcaactcgggcagatcatgctgctggtgttatgtactagccagatcctcctgatgcgcaccacctgggccctctgcgagtccatcactctggccactgggcccctgaccaccctctgggaaggaagccccgggaagttctggaacacgaccatcgccgtgtccatggcgaacatcttccgcggcagctatttggccggagccgggcttgcattcagcctcatgaagtcgctgggcgggggccggagggggaccggagcccagggcgaaacccttggtgagaagtggaagcggcaactcaatcagctgagtaagtccgaatttaacacttataagcgcagcggcatcatggaggtcgaccgctcagaggcaaaggagggactgaagcgcggcgagacaacgaagcacgccgtgtctagggggaccgcaaagctccggtggttcgtggagcggaacctggttaagccggagggcaaggtaatagacctcggctgcggccgtggagggtggtcctattactgcgccggcctaaagaaggtgacggaggtaaaggggtacacgaagggcgggcccgggcacgaggagcccatcccgatggcgacctacggctggaacctggtgaagctgcacagcgggaaggacgtgtttttcatccctccggagaagtgtgacaccctactctgcgacattggcgagtcgagccccaacccgacgatagaagaggggcgtaccctgcgcgtgctgaagatggtggagccgtggctgcggggtaaccagttctgcataaagattctgaacccatatatgccctccgtggtcgagacccttgagcagatgcagaggaagcacggcggcatgctcgtccgaaaccccctgtcacgcaactccacccacgagatgtactgggtgtcctgtggcacagggaacatcgtttccgccgtcaacatgacgtcacgcatgctcctcaaccggttcacgatggcccaccggaaaccgacctacgagcgcgacgtggacctgggcgccggcacccgccacgtcgccgtagagcctgaagtggcaaacctggatattatcgggcagcggatcgagaacattaaacatgagcacaagtccacatggcactacgacgaggacaacccgtataagacctgggcctaccatgggtcttacgaggcgaagcccagtgggagcgcgagctccatggtcaacggtgtagttaaattactgacaaaaccgtgggacgtgatccccatggttacccagatagccatgacagacaccacgcccttcgggcagcagcgcgtctttaaggaaaaggtcgacacgaggacgcccaaggctaagcgcggcaccgcacagataatggaggtgaccgccaagtggctgtggggctttctgagccggaataagaagccgcgcatctgcacccgggaggagttcacacgtaaggtcaggtccaatgccgcgatcggagccgtgttcgtcgacgagaaccagtggaacagcgccaaagaggccgtcgaggacgagcgcttctgggatctggtgcaccgggagcgagagcttcataagcagggcaagtgcgctacctgcgtgtacaatatgatgggcaagcgggagaaaaagctcggcgagtttgggaaggcgaagggctcgcgcgccatctggtacatgtggctgggtgcccggttcttagagtttgaggccttggggtttatgaacgaggaccactggttcagccgagagaactccctttcgggagtagagggcgagggcttacacaagctcgggtacattctgcgggacatctccaagatcccaggcggcaacatgtacgccgacgacaccgcggggtgggacacccgcatcacggaggacgacctgcagaatgaggccaagatcaccgacattatggaaccagagcacgccctcctggcgaagtcaattttcaagctgacctaccagaacaaggtggtgcgagtgcagcgccccgccaagaacggtacagtgatggacgtgatctcccgacgcgaccagcgcgggagtggtcaggtcggaacgtatggactgaacacatttacgaacatggaggcccagctgatccgacagatggagtccgaggagattttctctcccagcgagctggaaaccccgaacctcgcaggccgcgttctggactggctcgagaagcacggggtggagcggctcaaacgcatggccatcagcggcgatgactgcgtcgtgaagccgatcgatgaccggttcgcaacagccctcactgcgctgaacgacatggggaaggtgcgcaaggacattccccagtgggaaccctccaaaggctggaacgattggcagcaggtccccttttgtagccaccactttcaccagcttatcatgaaggatgggcgcgagatagtggtgccctgccgtaaccaggatgagttggtcggacgggcccgtgtgtcccagggagccgggtggtccctccgggagaccgcctgtctcggtaaaagttacgcgcagatgtggcagctgatgtacttccaccgccgcgacctgcgcctggccgcaaacgccatatgctctgccgtgccggtcgactgggtacccacctcgcggacgacgtggtccatccatgcgcaccaccagtggatgaccaccgaggacatgctgtcagtgtggaaccgcgtctggatcgaggagaacccgtggatggaagataagacgcacatctccagctggggcgacgtgccgtacctgggcaagcgggaagatcagtggtgcggctctctcatcggtctgaccgcacgcgctacgtgggccaccaacatacaagtcgccatcaaccaggtccgacgtcttataggcaacgagaactatctcgattatatgacttccatgaagagattcaagaacgaaagtgacccggaaggggcgctgtggtga

SEQ ID NO: 24202 - RNA, 9879 nt, synthetic construct
  misc_feature 1..9879: note = derived and/or modified CDS sequence (opt11) from DENV-1__FJ547065__SS-prME
  source 1..9879: mol_type = other RNA
agcgtaacgatgctgctcatgctgatgcctacagccctggcctttcacctaaccacccgtggaggcgaaccccatatgattgtgagcaaacaggagcggggcaagtcactgcttttcaaaacctcagccggtgtgaacatgtgcacgctcatcgcgatggacctgggcgagctctgcgaggatacgatgacctacaagtgcccacgcataacagagactgaacccgatgacgtggactgctggtgcaacgcgacggacacctgggttacctacggaacctgcagtcaaaccggcgagcaccggcgcgacaagcggtccgtagcactcgcgccccacgtcggattagggctggagacaaggaccgaaacctggatgagctccgagggcgcgtggaaacagattcagcgggtggagacatgggccttgcgccaccccgggttcaccgtgattgccctgttccttgcccacgctataggcactagcatcacccagaaagggattatcttcatattgctgatgttggtgacaccctccatggccatgcggtgcgtcggcatcggtagccgcgactttgtcgagggcttgtccggcgccacctgggtcgatgtggtgctggagcatggtagctgcgtgaccaccatggcaaaggataaaccaacgctggacattgagctccttaagaccgaggtcaccaacccagccgtgctgcgaaagttgtgcatcgaagcgaagatctctaacaccacgaccgacagccgctgtccgacccagggcgaggcaaccctggtggaagaacaggatgccaatttcgtatgccggcgcacgttcgtggaccggggctgggggaatggctgcggtcttttcggcaaggggtccctcatcacgtgtgccaagttcaagtgcgtaacgaaactggagggaaagatagttcagtacgagaacctcaaatacagtgtgatagtgaccgtccacacgggcgaccaacaccaggtgggtaatgaatccaccgagcacggcaccacagccaccatcacgccgcaggcgccgaccaccgagatccagcttaccgactacggggccctgactctggactgtagcccccgcaccggcctcgactttaacgagatggtcctgctgacaatgaaggagaagtcctggctagttcacaagcaatggtttttagacctgcccctaccttggacctctggggccagcacatcgcaggagacttggaacagacaagacctcctggtaactttcaagaccgcacacgccaagaaacaggaggttgtggttttgggcagccaggagggcgcaatgcacacggcactgactggggccactgagatacagacctccggtactaccaccatcttcgccgggcacctgaagtgccgcttaaagatggacaagttgaccctcaaaggcatgtcttacgtcatgtgcaccggatccttcaagctcgagaaggaagtggccgaaacccagcacggaacagtactggtccaaatcaagtacgaaggcacagacgcgccctgcaagatcccctttagcacacaggatgagaagggggttacacagaacggtcgcctgatcacggccaacccgatcgtaactgacaaggagaagcccgtcaacatcgaggccgagccgcctttcggagagagttatatcgttatcggcgcgggagagaaggcgctgaagctcagctggttcaagaaggggtctagcatcggcaagatgtttgaggcgacggcccgcggggcccggagaatggccatactgggagataccgcgtgggacttcggatctattggcggtgtcttcaccagcgtcgggaagctggtgcaccagattttcggcaccgcctacggtgtgttattctccggtgtctcctggacgatgaagatcgggatcggagtgctgttaacgtggctcggactgaactcacgtagcacctccctgagcatgacctgtatcgccgtggggctcgtcactctatacctgggcgttatggtccaggcggactccggttgcgttataaactggaaggggcgcgaactgaagtgcgggagcgggatttttgtgaccaatgaggttcacacatggaccgagcagtacaagttccaggccgacagcccgaagcgactgtccgcggcgatcgggaaggcttgggaggagggtgtatgcggcatccgcagcgctacccgcttagaaaacattatgtggaaacaaatttcaaatgagctcaaccacatcctactcgagaacgacatgaagttcacagtcgtggtcggagatgtagctgggatcctcgcgcaagggaaaaagatgatccggccccagcccatggagtataaatactcgtggaagtcctggggaaaggccaagatcatcggagccgacgtgcaaaacaccaccttcatcatcgatggtcccaacactccggaatgccccgacgacctccgtgcctggaacatctgggaggtcgaagactacggcttcggtatcttcaccaccaacatctggttaaagttgagagacagctatacccaggtttgcgaccatcgcctaatgtcggcggctattaaggactcaaaagccgtgcacgccgatatgggctactggatcgagtccgagaagaacgagacctggaagctggcccgggcgtctttcatcgaggtcaagacgtgcatctggcccaagtcccacaccctctggtcgaacggcgttctggagtctgagatgattatccccaagatctacggtggcccgataagtcagcataactaccgtcccgggtatttcactcaggccgccggcccctggcatctgggaaagctcgagctcgacttcgatttgtgcgagggcacaacggtcgtcgtggacgagcactgcggcaaccgggggccgtccctccgcaccactaccgtgaccggcaagatcatccacgagtggtgctgccgttcctgtaccctaccgccccttcgctttcgaggggaggatggctgctggtatgggatggagattcggcccgtcaaggagaaggaggaaaacctagtgaagtccatggttagcgccggctcaggagaggtagactcctttagccttggactgctatgcatatccatcatgattgaggaggtgatgcggagccgctggtcccggcgtatgctgatgactggcaccttggccgtcttctttctccttatcatgggccagctaacgtggaacgacctcatccgcctgtgcatcatggtcggcgcgaacgcctctgaccggatggggatgggcaccacctacctggccctcatggccaccttcaagatgcggccgatgtttgcagtggggctgctgttccggcgcctcacgtcccgggaggtgctgcttctgaccataggcttaagcctggtagcgtccgtggagttacccaacagcctggaggagctaggcgacgggctcgccatggggataatgattcttaaactacttaccgacttccaaagtcaccaactgtgggccaccctgctcagcctgacgttcattaagaccaccttctcgctgcactacgcctggaagaccatggcgatggtccttagcattgtatccttattccctctgtgccttagcacaacctcccagaagactacctggttacccgttctgctcggcagcctgggatgcaaaccgctcacgatgttccttatagccgagaacaagatttggggccgccggagctggccactgaacgaggggataatggcggtcggcattgtcagcatactgctctccagcctgctgaagaatgatgtgcccctagccggacctctgatcgccggcggtatgttaattgcctgttacgttatctccgggagtagcgccgacctctctctggaaaaggccgcggaggtgagctgggaggaggaggccgaacactccggcgcaagccacaacatcctggtagaggtgcaagacgatggcaccatgaagatcaaggacgaggagcgcgacgacacattgacgatactacttaaagcaaccctcctggccgtttccggcgtgtacccccttagcattcccgcgacgctcttcgtctggtacttctggcagaagaagaagcagcgatcaggggtgctgtgggacacaccctctccaccagaggtggagcgtgctgtcctggacgacggcatctaccgaatcatgcagcgcggcctactcgggcggtcccaagtgggcgtgggggtgttccaagagaacgtctttcacaccatgtggcacgtgacccgaggcgctgtcttgatgtaccagggcaagcggctggagcctagctgggccagcgttaaaaaggacctcatcagttacggcggcgggtggcgcctgcagggttcctggaacacgggggaggaggtgcaggtcatcgccgttgagcccggcaagaaccccaagaacgtgcagaccgccccgggtaccttcaagactcccgagggcgaggtgggcgccatcgctctcgacttcaaacccggtacctccggctcccccatcgtgaacagagaagggaagatcgtgggcctctatggtaacggggtcgtgacaactagcggcacctacgtttccgccatcgcccaggccaaggcatcccaggaggggccgctaccagagatcgaagacgaggttttcaggaagaggaacctcaccatcatggatctccaccccggcagcgggaagactcgccggtatctgccggcgatcgtcagagaagccattaagcgcaagctgcggaccctgattctggcgcctaccagggtggttgcctcggagatggcggaggcccttaagggcatgcccatccgatatcagaccacagcagtcaagagcgagcacaccggcaaggagatcgtggacctcatgtgccacgcaaccttcacgatgcgcttgctttcccccgtgcgagtgcccaattacaacatgataatcatggatgaggcccacttcaccgacccctcgtccatcgcggcacgtgggtatatatcgactcgggtgggaatgggggaggcagccgcgatattcatgacggcgacaccgcccggctccgtcgaagcctttccgcagagcaacgcagtgatccaggacgaggagcgcgacatcccggagcggtcttggaacagcgggtacgaatggatcaccgacttcccgggcaagacggtctggttcgtcccatcgataaagagcgggaacgacatagccaactgcctcagaaagaacgggaagcgtgttatccagctgtctcgcaagaccttcgacacggagtaccagaagacccggaacaatgactgggattacgttgtaacgacggacatcagcgaaatgggtgcgaacttccgcgcagaccgggtgatcgaccctcgacggtgcctgaagcccgtgatcctaaaggacgggcccgagcgcgtcatactcgccggccctatgcccgtgacggttgcctccgccgcgcaaagacgcgggaggatcggcagaaaccacaataaggagggcgaccagtacatatacatgggccagccccttaacaacgacgaagaccatgcccactggaccgaagcaaagatgttactggacaacatcaacacccccgagggcataatccccgccctttttgagcccgagcgcgagaagtcagccgcgatcgacggggagtaccggctcagaggcgaggctagaaagaccttcgtcgagctgatgagacgcggggacctgcccgtgtggctctcgtacaaggtcgcaagcgaaggtttccagtatagcgaccgtaagtggtgcttcgacggagagcggaacaatcaggtgctggaggagaatatggatgtagagatatggaccaaggagggtgagagaaagaagctgcgcccccgctggctcgatgcccggacctactccgaccccctggccttacgcgagttcaaggagttcgctgcaggacggcgcagcgtctccggggatttgattctggagatcggcaagctaccgcagcaccttacccaacgggcccagaacgccctggacaacctagtgatgctacacaacagcgagcagggcgggcgcgcttaccggcacgccatggaagagctacccgataccattgaaacgttaatgctactggccctaatagccgttctcaccggaggggtcaccttattcttcctttccggccgcggcttggggaaaacctctatcggactcctgtgtgttatggcgtccagcgtcctcttatggatggcgagcgttgagccacattggatcgctgcatcaatcattctggagttcttcctcatggtgttactgatccccgagccggaccggcagcgcacgccccaggacaatcagctcgcctacgtagtcatcggcctactgttcatgatcctgacggtggctgcgaacgagatgggcttactcgagaccactaagaaagatctcggaatcggccacgtggccgtcgagaaccatcatcacgccgccatgctggacgtggatttacaccccgcctccgcgtggaccctttatgccgtggcgaccaccatcataaccccgatgatgcgccacacgatcgagaacacgaccgctaacataagcttgaccgccatagcgaaccaagccgccatcctcatggggctcgacaagggctggccgatctccaagatggacattggcgtccccctgttagctctggggtgctatagccaggtgaaccctctgacactgacggcggctgtgctaatgctggtggctcactacgccatcatcggcccggggttgcaggccaaggcgacccgggaggcccagaagcgcactgccgctggcatcatgaagaatcccaccgtggacgggatcgtggccatcgatttagaccccgtcgtgtacgatgctaagtttgagaagcaattgggccagatcatgttgctcatcctgtgcacgtcccagatcctcctcatgcggacaacttgggccctttgtgagagcatcaccctggccacgggcccactcaccaccctctgggagggatcccccggcaaattctggaacaccacgatcgccgtcagcatggctaacatatttcgcggttcttacctagcgggcgccggcctggcttttagcctgatgaagtccctcggtggcggccggcggggcaccggggcccagggcgagaccttaggcgagaagtggaagcggcagctgaaccagttaagtaagtctgagtttaacacctacaaaaggtccgggatcatggaggttgaccggtcagaagcgaaagagggcctcaagcggggggaaacgaccaagcacgccgtctccagaggcacggccaagctgcgctggttcgtggagagaaacctggtcaagcccgaggggaaagttatagacctgggctgcggccgcgggggctggagctattactgtgccgggctcaagaaagtgactgaagtcaagggctatacgaagggaggacccggccacgaggagcccatccccatggccacctacggatggaacctggtgaagctgcactcaggcaaggacgtgttcttcatcccgcccgagaagtgcgacaccctcctttgcgacattggggagagctcccccaacccgaccatcgaggaaggtagaactctgcgcgttctcaaaatggtggagccctggctgcgggggaaccagttctgcataaagatccttaacccctacatgcccagcgttgtcgaaacccttgagcagatgcaacgcaagcacggtggaatgctggtgcgtaaccccctttcccgcaactcaactcacgagatgtactgggtgtcctgcgggaccggcaatatcgtcagcgcggtaaatatgacctcccgaatgctactgaaccgctttacgatggcacaccgcaaacccacctatgagcgggacgtggacttgggggccggcacccgccacgtagccgtggagcccgaggtggcgaacctcgacattatcggccaacggatcgaaaacatcaaacacgaacacaaatcaacctggcattacgacgaagacaacccctacaagacgtgggcgtatcacgggtcctacgaagtcaagccgagcggctccgcgagcagcatggtgaatggggtcgtaaaactcctgaccaagccttgggacgtgatccccatggtgacccagatagcaatgaccgacactactccgttcggccagcaacgcgtcttcaaagagaaggtggacacccggacaccgaaagccaaacgcgggacggcccagatcatggaagtcacagcaaaatggttgtgggggttcctgtcgcgcaacaagaagcctcggatatgcacccgagaggagttcaccagaaaggtgcggagcaacgccgccatcggcgcagtgtttgtcgatgagaaccagtggaattccgcgaaagaggcagtggaggacgagcgattttgggacctggtgcaccgggagcgggagctccacaagcagggcaagtgcgctacctgcgtctacaacatgatgggcaagcgggagaagaagctgggggagtttggcaaggccaaggggtcgcgcgcaatatggtacatgtggttgggcgcccggttcctcgagttcgaggccctcggcttcatgaacgaagaccactggttttctcgtgagaacagcctatctggggtggagggcgaggggctccataagcttggatacatcttgcgagacatctcgaagatccccgggggcaacatgtacgccgatgacaccgcggggtgggacacccgtatcaccgaagatgatctccagaacgaggcgagaattacggatatcatggagccggagcacgcgctgctggctaagagtatcttcaagctaacataccagaacaaggtcgtgcgagtgcagaggcccgccaagaacggtacggtgatggacgtcataagcagacgtgaccagagaggttccggccaagttggcacctacggtctgaacacgttcaccaacatggaggcccagctgattcggcagatggagagcgaggggatcttttcccccagcgagctagaaacccccaacttggccgagcgcgtgctggactggctcgagaagtacggcgtcgagcgactgaagcggatggctatttccggggacgactgcgtggtaaaaccgatcgacgaccgcttcgcaaccgccctgacggcactcaacgacatgggcaaggtcagaaaggacatcccccagtgggagccatctaaggggtggaacgactggcagcaggttcccttctgctcccaccattttcatcagttgataatgaaggacggccgggaaatcgtggtgccgtgccggaaccaggacgaactggtgggccgcgccagggtcagccagggcgcgggatggagcctccgcgagactgcctgtctagggaagtcctacgcccagatgtggcagttgatgtactttcatcggcgcgacctcagactggccgctaacgccatctgctcggccgtccccgtcgactggatacccacctcacgcacaacgtggtcaatccatgcccaccaccaatggatgacaaccgaggacatgctgtctgtatggaaccgcgtgtggatcgaggagaacccctggatggaagataaaacacacatcagctcctggggcgatgttccgtaccttgggaagcgggaggaccagtggtgcggttcactaatcggcctgacggcccgcgcgacctgggctaccaatatccaggtggcaatcaaccaggtacggcggctcatcggaaatgagaactacctggattacatgacgtccatgaagcggttcaagaacgagtctgacccggagggcgccctgtggtga

SEQ ID NO: 24203 - RNA, 9879 nt, synthetic construct
  misc_feature 1..9879: note = derived and/or modified CDS sequence (opt11) from DENV-1__FJ410230__SS-prME
  source 1..9879: mol_type = other RNA
agcgtgacgatgttactgatgctgatgcccacggctctggccttccacctcaccacccgtggcggggagccccatatgatcgtgagcaagcaagagcgggggaaatctctcttatttaagacctccgccggggtcaacatgtgcactctcatcgcaatggacctgggtgaactgtgcgaggacacgatgacctacaagtgtccccggatcaccgagaccgagcccgatgacgtggactgctggtgcaacgcaactgacacctgggtcacttacgggacatgcagccagacgggcgagcatcgccgcgacaagcgatccgtggccctcgcgccccacgtcggcttggggctggagacgcggacagagacctggatgagctccgagggcgcgtggaagcagatccagcgggtcgagacctgggccttacgccatcctgggttcacggtgatcgccctgttcctggcccacgcgatcggcaccagcatcacccagaaagggatcatcttcatcctcctgatgctagtgactccctccatggccatgcggtgcgtcggtatcggcagtcgcgacttcgtggaggggctatccggcgccacctgggtggacgtagtgctggagcatgggagctgtgtgaccaccatggccaaggacaaacccacgctggacatcgagctcctgaagaccgaagtcacaaacccagccgtgctgcgcaagctctgcatcgaggcgaaaatctccaacacaacgacagattcgcgctgcccgactcagggcgaggccaccttggtagaggaacaagacgccaatttcgtctgccggaggacgttcgtggaccggggctgggggaacggctgcgggctgtttgggaaaggatccctcatcacgtgcgccaagttcaagtgcgtaactaagctggagggcaagatcgtccaatatgagaacctgaagtacagcgtgatcgtgacggtccacacgggagaccagcaccaggtggggaacgagtcgaccgagcacggcacaacagctaccatcacgccgcaggcgcccacaaccgagatccagctcaccgactacggggctctgacgcttgattgtagcccccgcactggcctcgacttcaacgagatggtcctgctgaccatgaaggaaaagtcctggctcgtgcacaagcagtggttcttagatctgcccctcccctggacctctggggccagcacgtcccaggaaacctggaaccggcaggatctgctggtgaccttcaagacagcccacgcgaagaagcaggaggtcgtggtacttgggagccaggaaggcgcgatgcacacagctctgatcggggccaccgagatccagacgtccggaaccacgaccatcttcgccggtcatctaaagtgccgcctcaagatggacaagctgacgctgaagggcatgagttacgtcatgtgcaccggttccttcaagctcgagaaagagctggctgagacgcagcacggaaccgtgctggtgcagatcaagtacgagggcacggacgctccctgcaagatcccctttagcacccaggacgagaagggcgtcacgcagaatggccggctgatcacagccaacccgattgtgaccgacaaggagaagcccgttaacatcgaggccgagccgcccttcggggaatcctatatcgtaatcggcgccggcgagaaggccttgaagctgtcatggttcaagaaggggtccagcatcggcaagatgttcgaagcaaccgcccgcggagccagacgtatggccattctgggtgacactgcgtgggatttcgggtccatcggtggcgttttcaccagcgtggggaagctcgtccaccaaatcttcggcacggcttacggggtgctattcagcggcgtgagctggaccatgaaaatcgggatcggcgtgttactgacgtggctgggcctgaactcccgcagcacctccctcagtatgacctgcatcgccgtggggttagtgaccctctacctcggggtgatggtacaagccgactcagggtgtgtgataaactggaagggccgggagctgaagtgcgggtctggcatcttcgtcacgaacgaggtgcatacgtggaccgagcagtacaagtttcaggccgacagtcctaagcgactgtccgcggccatcggcaaagcctgggaggagggggtgtgcggcatccgaagcgccacccgcctcgagaacatcatgtggaagcagatctcaaacgagctgaaccacatcctgttagagaacgacatgaagtttaccgtagtcgtgggggacgtcgccggcatcctggcgcaggggaagaaaatgatccgaccccagcccatggagcacaagtacagctggaagtcctggggcaaggccaaaatcataggcgccgacgtgcagaacacaaccttcatcatcgacgggccgaacaccccggagtgccccgacgatcagcgtgcctggaacatttgggaggtggaagactacggcttcgggatcttcacaacgaacatttggctgaagctccgggacagctacacgcaggtctgtgatcaccgcctgatgtccgcggccatcaaggacagtaaagctgtgcacgctgacatgggctattggatcgagagtgagaagaacgagacctggaagctagcacgggcgagcttcatcgaggtgaagacttgtatttggcccaaatcccatacgctctggtcgaacggcgtgctggagtcagagatgataatacccaagatctacgggggcccgatttctcagcacaattatcgccctgggtacttcacccagaccgcaggcccctggcatctgggtaagctcgagctggacttcgacctgtgcgagggcaccacggtagtggtcgacgagcactgcggcaatagggggccgtccctccgcaccacgaccgtcacgggtaagatcatccacgagtggtgctgccggagctgcacgttgccgcctttacgcttccgcggggaggacggatgctggtacgggatggagatccgccccgtgaaggagaaggaggagaacctcgtaaagagtatggtcagcgcaggctcaggcgaggtcgattccttcagtctggggctgctctgcatctccattatgatcgaggaggttatgcggagccgttggtcccggaagatgctgatgaccgggaccttagcagtgtttttcctcctcatcatgggacagctgacgtggaacgacctcatccggctgtgcatcatggtgggcgccaacgctagcgaccggatggggatggggaccacctacctggcactcatggccaccttcaagatgcggcccatgttcgccgtcggcctgctgttccgtcggctaacgtcccgcgaggtgctgctgctcactatcgggctgagcctggtggcgtctgttgagctcccaaacagcctggaggagctgggcgacgggctcgccatgggcatcatgatcctgaagctcctcaccgatttccagtcccaccagctgtgggccaccttgctcagcctgacgttcataaagaccaccttctccctgcactacgcctggaagaccatggccatggtgctctcaatcgtctctctgtttcccctgtgcctaagcacgacgtcccagaagaccacgtggctgcccgtgctgcttggctcactggggtgtaagccgctgacgatgttcctcatcgctgagaacaagatatggggccggcgctcttggcccctgaacgaggggatcatggccgtcggcatagtctccatcctgttgagctccctgctgaagaacgatgtaccgctcgccgggcccctgatcgcaggcggcatgctgatcgcgtgctacgttatcagcgggtccagcgcggacttgtccctggaaaaggccgcggaggtttcgtgggaggaggaggccgagcactctggcgcatcccacaacatacttgtggaggtgcaggacgacgggaccatgaagattaaggacgaggagcgggacgacaccctcaccatcctcttaaaggcgacccttctggccgtctccggcgtgtacccgctgagcatccccgcaaccttgttcgtgtggtacttctggcagaagaagaagcagcgctccggtgtcctctgggatacccccagtcctcccgaagtggagcgggctgtgctggacgacggcatctaccgtatcatgcagcggggcttactcggacgctcccaggtcggcgttggggtattccaagagaacgtcttccacactatgtggcacgtgacccgtggagctgtgctgatgtaccaggggaagcgactggagcccagctgggcgagtgtgaagaaggacctcatctcatatggcggcgggtggcggctgcagggcagttggaacacgggggaggaggtccaggtcatcgcggtcgagccaggcaagaatccgaagaacgtgcagaccgcgcccgggacattcaaaaccccagagggggaggtgggcgccatcgccctggatttcaagcctgggacgagcgggtcccccatcgtcaacagggaggggaaaattgtgggcctctacggcaacggggtggtcaccaccagcggcacctacgttagcgcaatagcccaagccaaagcctcccaggaggggccgctgcccgagatcgaagacgaggtgtttagaaagcgcaacctaaccattatggacctccaccccggcagtgggaagacccggcgctacctcccggctatcgtacgggaggccattaagcgaaagttgcgcaccctcatccttgcacccacccgggtggtggcatccgagatggccgaggcgctaaaaggcatgccgatccgctaccaaacgaccgccgtcaagtccgagcacaccggtaaggagatcgtggacttaatgtgccacgccacctttacgatgcgtcttctgtcccctgttcgcgtccctaactacaacatgatcataatggacgaggcacatttcaccgaccccagctcgatcgccgcgcgggggtacatcagcacacgcgtgggcatgggggaggccgccgccatatttatgaccgccacgccgcccggcagtgtggaggcgttcccgcagagcaacgccgtaatccaggacgaggagcgggacatcccggaacgctcctggaactccgggtacgagtggatcaccgacttccccggcaagaccgtgtggttcgtgccatccattaagtccggaaacgacatcgccaactgcctccggaagaacgggaagcgcgtcatacagttatcccggaagaccttcgacacggagtaccaaaagaccaagaacaatgactgggactacgtcgtgaccaccgacatcagcgagatgggcgcaaactttcgcgcggaccgggttatcgacccgaggcggtgcctgaagcctgtcattctcaaggacggtcccgagcgcgtgatcctggccggacccatgccggtcacggtggccagcgccgcccagcggcgcgggcggatcggccgcaaccacaataaggagggcgaccagtatatctacatggggcagcccctgaacaacgatgaggaccacgcgcactggaccgaggccaagatgctcctcgacaacatcaacacccccgagggcatcattcccgccctgttcgagccggaacgcgagaaatccgccgctatcgacggcgaatatcgtctacgcggcgaggcgaggaaaaccttcgtggagctgatgcgccgcggtgacctccccgtttggctctcctacaaggtggccagcgagggcttccagtacagcgacaggcggtggtgcttcgatggggagcgcaacaaccaggtcctggaggagaacatggacgttgagatctggacgaaggagggggagcggaagaagctgcgaccccggtggcttgacgcccgcacgtactccgaccccctggccctgcgggagttcaaggagttcgccgcgggccgccggtcagtgtccggggacctcattctggagatcggcaagctgccgcagcatttaacccagcgcgcccagaacgccctggacaacctggtcatgctccacaactccgagcagggcgggcgggcctacaggcatgcgatggaggagctccccgataccatcgagacgctgatgctcctggccctgatagcagtgcttaccggcggggtaaccctgttcttcctctcaggccgggggctcggcaagacaagcattggattactttgcgtcatgtccagctccgtgctcctgtggatggcctccgtggaaccgcactggatcgctgcatccatcattctggagttcttcctcatggtccttctgatccccgagccggaccgccaaaggacgccccaggacaaccagctcgcctatgtggtgattgggctgctgttcatgatcctcacggtcgccgccaacgagatgggcctgctcgagactacaaagaaagacctcgggatcggtcacgtagcggtcgagaaccaccaccatgcggccatgctggacgtcgacttacatcccgccagtgcctggaccctttacgccgttgcgacgaccattataacaccgatgatgcgccacaccattgagaatacgaccgccaacatctccctgactgccattgccaaccaggccgcgatcctgatggggctcgacaagggctggcccatcagccgcatggacatcggggtgccccttttagcgctcgggtgctatagccaggtcaaccccctaaccctgacggccgcagtactgatgctggtagctcactatgccatcattggcccggggctgcaggccaaagccacccgggaggcccagaagcgcacagcggcagggatcatgaagaatcccaccgtcgacgggatcgtggccatcgacctcgatcccgtggtctacgatgcgaagttcgaaaagcagctgggccagataatgctgctcatactgtgcacgagccaaatactcctcatgaggacgacctgggccctgtgcgagtcgatcaccctggcgacgggacccttgaccacgctgtgggaggggagcccgggcaagttctggaacaccacgatagccgtatccatggcgaacattttccgcggtagctacctggccggcgccggactcgcttttagtttaatgaagtccctcgggggcgggagacgcggtacaggggcacaaggggagactttaggtgagaaatggaagcggcagctgaaccagctatctaagtccgagttcaacacctacaagcgcagcggcatcatggaggtggacagaagcgaggcgaaggagggccttaagaggggggagacgaccaagcacgccgtgagccgaggcaccgcgaagcttcggtggttcgtggagagaaacctggtgaaaccagaggggaaagtcatcgacctgggctgcggacgcgggggctggagctactattgcgccggactcaagaaagtgaccgaggttaaaggctatactaaaggcgggccgggtcacgaggagccgatccctatggccacctacgggtggaaccttgtcaagctgcatagcggcaaggacgtgttcttcataccgcccgagaagtgcgacacccttctgtgcgatataggggagtccagccccaacccgaccatcgaggagggccggacactgcgcgtgctcaagatggtcgagccctggctgcgagggaaccagttctgcatcaagatcctcaacccctacatgccgtccgtggtggagacactcgagcagatgcagcgcaagcacggcgggatgctggtgcggaacccgctgagccgaaactccacccacgagatgtactgggtgagctgcgggaccggcaacatcgtttccgccgtcaacatgaccagccgcatgctcctgaaccggctgacgatggcccaccggaaacccacctacgagcgggacgtggaccttggggcgggcacgcgacacgtggccgtagagcccgaagtggcgaacctggatattatcggtcagcggatcgagaacatcaagcacgagcacaaatccacctggcactacgacgaggacaacccttacaaaacgtgggcctatcacgggtcatacgaggttaagccgtccggcagcgccagctccatggttaacggggtggtaaagctgctcaccaagccctgggacgtaatccccatggtgacccagatcgcgatgaccgacacaacccccttcggccagcagcgcgtatttaaggagaaggtggacacccggaccccaaaggccaagcgcgggactgcccagatcatggaggtgaccgcgaagtggttgtggggttttctgagccggaataagaagcctagaatctgcacccgagaggaattcacccgcaaggtccggtccaacgccgcgatcggcgccgtgtttgtggacgaaaaccaatggaactccgccaaggaggccgtggaggacgagcgattctgggaccttgtgcaccgtgagagagagctgcacaagcaggggaagtgtgcgacgtgcgtgtataacatgatgggcaagcgagagaaaaagctcggggagtttggcaaagccaaggggtcccgcgccatctggtacatgtggctaggagcccggttcctggagttcgaagccctgggttttatgaacgaggaccactggttcagcagggaaaacagtctcagcggcgtcgaaggcgaaggtctgcacaagctgggctacatcctacgagatatctccaagatcccggggggcaacatgtacgcggacgacacagccggctgggacacccgcatcactgaggacgacttgcagaacgaggcccgcataacggacatcatggagcctgagcacgccctgctcgctaagtccatcttcaaactgacctatcagaacaaggtggtgcgggtccagcgcccagcaaaaaacggtaccgtgatggacgtgatctcccggagagaccagaggggcagcgggcaggtcggtacctacggcctgaacacgttcaccaacatggaggcccagctcatccgccaaatggaatccgaagggatcttcagcccctccgagttagagacccccaacctggccgagcgggtgctggattggctggagaagtacggggtggagcgcctgaagcggatggccatcagcggggatgactgcgtcgttaagcctatcgacgaccgcttcgccaccgctctaacggccctgaacgacatgggcaaggtccggaaggatatcccgcagtgggaacccagcaaggggtggaacgactggcaacaggtccccttctgcagccaccacttccaccagctgatcatgaaggacggccgtgagatcgtggtgccgtgccggaaccaagacgagctcgtgggccgcgctcgtgtgtcgcagggagccggatggtcccttcgcgaaaccgcctgcctcggtaagagttacgcgcagatgtggcagctaatgtacttccaccggcgtgacctgcggcttgccgccaacgccatctgctccgcggtccccgtcgactggatccccaccagccgcacgacgtggtccatccacgcccaccaccaatggatgaccaccgaggatatgctcagcgtgtggaaccgcgtgtggatcgaggagaacccctggatggaggacaagacacatatctcctcatggggggacgtaccatatctggggaagcgcgaggaccagtggtgcggctccttgatcggtctcacggcccgcgccacctgggccaccaacatccaggtggcgataaaccaggtgaggcgcctaattggaaacgagaactacctggactacatgaccagcatgaagcggttcaagaacgagtccgaccccgagggtgccctctggtag

SEQ ID NO: 24204 - RNA, 9879 nt, synthetic construct
  misc_feature 1..9879: note = derived and/or modified CDS sequence (opt11) from DENV-1__FJ410231__SS-prME
  source 1..9879: mol_type = other RNA
agcgttaccatgctgctcatgctcatgccgaccgcattagctttccacctcacgacaagaggaggggaaccccatatgatcgtgagtaagcaggagcggggcaagagcctgctgtttaagacaagcgccggggtgaacatgtgtaccctgatcgccatggacctaggcgagctgtgcgaggacacaatgacctacaagtgcccccgcatcaccgaggtggaacccgacgacgtggactgctggtgcaacaccaccgacacctgggtgacatacggtacctgcagccagacgggcgagcaccggcgagacaaacgcagcgtggcactcgcgccccacgtcggcctggggctggaaacgcgcgctgagacctggatgagctccgagggcgcatggaagcagattcaaaaggtggagacctgggccctccggcaccccggtttcaccgtgatcgcgctgttcttggcccacgcgatcggcaccagcatcacccagaaggggatcatcttcatcctcctgatgttagtcactccctccatggcgatgcggtgcgtggggatcggcagccgggactttgtggaggggctctccggcgcaacgtgggtcgacgtggttctggaacatggcagctgcgtcaccaccatggccaaagacaaacccaccctggacatcgagctactaaaaacggaagtgaccaaccccgccgtgctgcgcaagctctgcattgaggcgaagatcagcaacaccaccacggacagccgctgtccgacccaaggcgaggcaaccctggtagaggagcaagatgccaacttcgtatgccggcggacgttcgtagaccgcggctgggggaacggttgcggcctcttcgggaaggggtcactcataacgtgcgccaaattcaagtgcgtgaccaagttagagggcaagatcgtacaatacgagaatcttaaatatagcgtgatcgttaccgtgcacaccggtgaccagcaccaggtggggaacgagtccacggagcacggcaccaccgccaccatcacgccccaggcccccaccagcgagatccagctcactgactacggggccctgactctggactgcagcccccggaccggcctcgattttaacgagatggtcctgcttacgatgaaggagaagtcatggctcgtgcacaagcagtggtttttggacctcccgctcccctggaccagcggggcctccacgagccaggagacgtggaaccgccaggacctgctggtcaccttcaagaccgctcacgcgaagaagcaggaggtggttgtcctcggctcccaagagggcgctatgcatacagccctgaccggggccactgagatccaaaccagcggcaccaccacgattttcgcaggacacctgaagtgtcggctcaagatggacaagctgacccttaagggcatgtcctacgtgatgtgcaccggcagcttcaaactcgagaaggaggtggccgaaacacagcacggcacggtcctcgtgcagataaagtatgagggcaccgacgcgccatgcaaaatccccttctccacccaagacgagaagggcgtgacccagaacggccgactgatcacagccaacccgatcgtcacggacaaagagaagcccgtgaacatagaggctgagccacctttcggggagagctacatcgtgatcggtgctggcgagaaggccctgaagctctcctggtttaaaaaggggagctccatcggcaagatgttcgaggccacagccagaggggcccgccggatggccatcctgggcgataccgcctgggacttcgggagcatcggcggcgttttcacatccgtggggaagctggtgcaccagatcttcgggaccgcctacggagttctattctctggcgtgtcctggaccatgaagatcgggatcggtgtgttgctaacctggctcggcctgaacagccgctctacgagcctgtccatgacctgcatcgccgtcgggctcgtgaccctgtacctgggcgtgatggtccaggccgactccgggtgcgtgatcaactggaagggccgcgagctaaagtgcgggagcggcatcttcgtaaccaacgaggtgcacacgtggaccgagcagtacaagttccaggccgactccccgaagcggttaagcgcggccatcggcaaggcctgggaagagggggtttgcggcatccgatccgccacccggctggagaacatcatgtggcgccagatcagcaacgaactaaatcacatcctgctggagaatgatatgaagttcaccgtagttgtgggtgacgtggtcggcatcctggcccagggaaagaagatgatccggcctcagcccatggagcacaagtactcatggaagtcctggggcaaggcgaagatcatcggcgccgacgtgcagaacaccacgttcatcatcgatgggcccaacaccccggaatgccccgacgaccagcgcgcctggaacatatgggaggtggaagactacgggttcggcatcttcaccacaaacatctggctgaagctgcgggactcttacacacaggtctgcgatcaccggctcatgagcgcggcgatcaaagactccaaggctgtgcacgccgacatgggctactggatagagagcgagaagaacgaaacctggaagctggcccgggcctccttcatcgaggtgaaaacctgcatctggcccaagagccacaccctttggtccaacggcgtcttggagagcgaaatgatcatcccaaaaatctacgggggcccgatctcccagcacaactaccgccccgggtatttcacgcagaccgcagggccctggcacctgggcaagctggagctcgactttgacttgtgcgagggcaccaccgtggtggtcgatgagcactgcggtaaccgggggccgagcctgcgcacgactactgttacaggcaagattatacacgagtggtgctgccgttcctgcactctgccgcccctccgcttcaagggggaggacggctgctggtacgggatggagatccgacccgtaaaggagaaggaagagaacctggtcaaaagcatggtgagcgcgggctccggcgaggtggacagcttctccctcggcctgctgtgcatcagcatcatgatcgaggaggtcatgcgctcccggtggagcaggaagatgctcatgaccggcaccctggccgtgtttttcctgcttatcatggggcagcttacttggaacgacctgatccggagttgcatcatggttggcgccaacgcgagcgaccggatggggatggggacgacctacctcgcgctgatggccaccttcaagatgcgcccgatgttcgcagtggggctattgttccgacgcctaacctcgcgggaggtactgctcctgacgatcgggctgtcgctggtcgcctccgtggagctgcctaactccctggaggagctcggcgacgggctggctatgggtatcatgatcctgaagctcttaaccgacttccagtcctaccagctgtgggccaccctcctgagccttaccttcatcaaaacgaccttctccctacactacgcctggaagacaatggccatggttctgagcatcgtatccctgctccccctgtgtctgagcacgacttcccagaagacgacgtggctccccgtgctgctgggcagcttggggtgtaagcctctgactatgttcctaatcgccgagaacaagatctggggccgcaagagctggcccctaaacgaggggattatggctgtgggcatagtctccatcctgctgagctccctccttaagaacgatgtgcccctggccggtcccctcatcgccggcggaatgttgatcgcctgctacgtgattagcgggtcttcagccgacctgtccctcgagaaggcggctgaggtcagctgggaggaggaagccgagcattcaggcgccagccacaacatcctggtggaggttcaggacgatgggactatgaagatcaaggacgaggagcgggacgacaccctgaccatcctcctgaaggccaccctgctcgctgtcagtggcgtgtacccgctgagcatccccgcgaccctgttcgtgtggtacttctggcaaaagaagaagcagcgctccggggtcctctgggacacgcccagcccgcctgaggtggagagagccgttctcgacgatggaatctacaggatcatgcagcggggccttctgggacgatcccaggtcggcgtgggggtgttccaggagaacgtcttccacaccatgtggcatgtgacccggggagccgtgctcatgtaccaggggaagcgcctggagccaagctgggcctcggtcaagaaggacctgatcagctacggaggagggtggcggctccaaggctcctggaatacgggggaggaggtccaggtgatagcggtcgagcccggcaagaaccccaagaacgtgcagactgcccccgggaccttcaagacccccgagggcgaggttggcgccattgccctggatttcaagccgggaacctcaggcagccccatcgttaaccgcgaggggaagatcgtgggcctgtacgggaacggggtagtgacgacctccggcacttacgtgagtgccatcgcacaggccaaggcctcccaggaggggccgctccccgagattgaggacgaagtgttccggaaacgcaacctgaccatcatggaccttcaccccggcagcggtaagacgcggcgctacctcccggcaattgtccgggaggctatcaagaggaagctgaggaccttaatcctcgcccccacccgcgtggtggccagtgagatggccgaggcgctgaagggcatgcccatccgctaccagaccacagcggtcaagagcgagcacaccgggcgggagatcgtggatctgatgtgtcacgccacctttactatgcgcctcctgtcccccgtccgggtcccgaactacaacatgatcatcatggacgaggcgcacttcacagacccgtcgagtatcgccgcccgcgggtacatcagcacacgggtgggcatgggagaggcggccgcgatctttatgacagccaccccgcctgggtccgtggaggccttccctcagagcaacgctgtcatccaagacgaagaacgcgacatccccgagcggtcctggaatagcgggtacgaatggatcacggacttccctggcaagaccgtgtggttcgtgccctccatcaagagcggcaacgacatcgccaactgcctgcgcaagaacggaaagcgggtcatccagctctcccgcaagactttcgacaccgagtaccagaagacgaagaacaacgattgggactacgttgtgaccaccgacatcagcgaaatgggcgcaaacttccgggcggaccgcgtcatcgatcctcgacgctgcctgaagccggtcatcctgaaggacgggcccgagcgggtcatcctcgcgggccccatgccggtgaccgtcgcctccgcagcccagcgccgggggagaatagggcggaaccacaacaaggagggcgaccaatatatctacatggggcagcccctaaacaacgacgaggaccatgcacactggaccgaggcgaagatgttactcgacaatatcaatactcccgaggggatcatcccagcccttttcgagccggaaagagagaagtccgccgccatcgacggggagtatcgcctgcgaggcgaggcccgcaagacattcgtggagttgatgcggcgcggtgacttacccgtctggctgagctacaaggtggcctccgagggcttccaatacagcgaccggcgctggtgcttcgatggggagcgcaataaccaggtactcgaagaaaacatggatgtggagatctggactaaggagggggagcgcaagaagctccgccctcgctggctggacgcccggacatacagcgaccccctcgccctacgcgagttcaaagagttcgcggccggacggcgcagcgtgtccggggacctgattctcgagataggcaagttgccgcagcaccttacccagcgggcacagaatgccctcgacaacctggtaatgctgcacaatagcgagcagggcggccgcgcctaccggcacgccatggaggaactccccgataccatcgagaccctgatgctcctcgcgctgatcgccgtgctgactggcggggtgaccttgttcttcctgtccggcaaggggctgggcaaaacctccatcggcctcctgtgcgtcatggcgagtagcgcgctcctctggatggcctccgtggagccccattggatcgctgcctcgatcatcttagagttcttcctgatggtcttacttatacctgagccggacagacagcgcacgccccaggacaaccagctggcctacgtcgtgatcggtctcctgtttatgatcctgaccgtggccgccaacgagatgggcttattggagacaaccaaaaaggacctggggatcggccacgtagcggtggagaaccaccaccacgccaccatgctagacgtggacctgcaccccgcctcagcctggaccctgtacgccgtcgcaacgaccatcatcacaccaatgatgcgtcacaccattgagaacacgactgccaacatcagtctcaccgccatcgcaaatcaggctgcgatcctgatggggctggataagggctggcccatctccaagatggatatcggcgtgcccctcctggccctgggctgctacagtcaggtgaaccccctcaccctgacggccgccgtcttgatgctcgtggcgcactacgcaatcatcggcccggggctgcaggccaaggccacacgggaggctcagaagcggaccgcggctggcatcatgaagaaccccaccgtcgacggtatcgtcgccattgacctggaccccgtggtatacgatgccaagttcgagaagcagctcggccagattatgctgcttattctctgtacgtcccagatcttgctgatgcgcacgacctgggccttatgcgagtcaattaccctcgcgacgggccccctgaccaccctctgggaggggtccccgggtaagttctggaacaccacgatcgctgtaagcatggccaacatcttccgggggagctacctggccggcgccggcctagcgttttccctcatgaagtcgctcgggggcggacgccgcgggaccggcgcccagggcgagactctaggcgagaagtggaagcgacagctcaaccaactgtcaaagagcgagttcaacacctacaagaggtccgggatcatggaggtcgaccggagcgaggccaaggaaggccttcggcgcggggagacaaccaaacacgccgtgtcccgaggcaccgcgaagctgcgctggttcgttgagcgtaacctggtgaagcccgaggggaaggtgattgacctgggctgcggaagagggggctggagctactactgcgccgggctgaagaaggtcactgaggtgaagggctacacgaagggtgggcccggccacgaggagcctatcccgatggcaacctacggctggaacctcgtcaagctgcacagtggcaaggatgtctttttcattccacccgagaagtgtgacaccctgctctgcgacatcggggagagctcccccaacccgaccatcgaagagggccggacgctgcgcgttctgaaaatggtggagccctggctccggggcaaccagttctgtatcaagatcctgaacccctacatgcccagcgttgtggaaacactggagcagatgcagcgcaagcatggcggcatgctcgtgcggaatccgctgtcccgaaattcaacccacgagatgtactgggtatcctgtgggaccggaaacatcgttagcgccgtgaacatgacatcacggatgttgctcaatcgcttcacgatggcccatcgcaaacccacctacgaacgggatgtcgacctgggggcgggcacccgccacgtggctgtggaacccgaggtcgccaacctggacatcatcggacagcggatagagaatatcaagcacgagcacaagagcacatggcactacgatgaagataacccctacaagacgtgggcctaccacgggtcctacgaggtgaagcctagcggtagcgcctcttccatggtcaacggggtggtgaagttgctaaccaagccctgggatgtgatccccatggtgacccagatcgcgatgaccgacacgacccccttcggccagcagcgcgtattcaaagaaaaggtagacacccggacacccaaggccaaaagggggacggcccagatcatggaggtcacggccaagtggctgtggggctttttgtcccggaacaagaagcctcgcatctgcactcgggaggagttcacccgcaaggttcgaagtaacgccgcgattggtgccgtcttcgtggacgaaaaccagtggaactccgccaaggaggctgtggaggacgagcgcttctgggacctcgttcatcgggaacgcgaactgcataagcaggggaagtgcgcgacgtgcgtctacaacatgatggggaaacgggagaagaaactcggcgagttcggcaaggccaaaggtagtcgcgccatctggtatatgtggctgggcgcccggttcctggagttcgaggccctcggatttatgaacgaagaccactggttctcccgcgaaaacagcttatcgggggtggagggcgaggggttacacaagttgggctacattctgcgggacattagcaagattcccggaggcaacatgtacgccgacgacaccgccggctgggacacccgaatcaccgaggacgacctgcagaacgaggccaagattactgacatcatggagccggagcacgccctcctagccacgagcatcttcaagctcacctaccagaacaaggtggtgagagtgcagcgccccgcgcgcaacggcacagtcatggacgtgataagccggcgcgatcaaagagggtcgggccaggtgggcacctacggcttaaacaccttcaccaatatggaggcccagttaatccgccagatggagagcgaagggatcttctcccctagcgagttagagactcccaatctcgccgagcgggtcctggactggctggagaagcatggcgtggagcgcctcaagcggatggcaatctccggggacgattgcgtggtcaagcccatcgacgaccggttcgccacggcgctgagcgccctaaacgacatgggcaaggttcgaaaggacatcccgcaatgggagcccagcaagggatggaacgactggcagcaagtccccttctgctcccaccacttccaccagctgatcatgaaggatggacgcgagatcgtcgtgccgtgccggaaccaggatgagctggtgggtcgcgcccgggttagccaaggcgccggttggtccctgcgtgagaccgcctgcctcggcaagagctacgcgcaaatgtggcagttgatgtacttccaccggcgcgacctgcggctcgcagcgaacgcgatctgcagtgcggtgcccgtagactgggtccccacctcgcgcaccacgtggtccatccatgcccaccaccagtggatgacaaccgaggatatgctaagcgtgtggaaccgggtgtggatcgaggagaacccatggatggaggacaagacccacataagctcctggggcgatgtcccgtacctgggaaagcgcgaggatcaatggtgcggctcactcatcggcctgacggcgcgcgccacctgggccaccaacatccaggttgcgatcaaccaggtgcgtcgcctaatcgggaacgagaactacctcgactacatgaccagcatgaaacggttcaagaacgaatcagaccccgagggagccctgtggtga

SEQ ID NO: 24205 - RNA, 9879 nt, synthetic construct
  misc_feature 1..9879: note = derived and/or modified CDS sequence (opt11) from DENV-1__FJ461323__SS-prME
  source 1..9879: mol_type = other RNA
tccgtgacaatgctactaatgctcatgccgaccgcgctagcgttccacctaacgaccagaggaggggaaccacacatgatagtcagcaaacaagagcggggaaagagcttactattcaaaacaagcgcaggggtaaacatgtgtacactcatagccatggacctaggcgagctgtgcgaggatacgatgacctataaatgccctagaataactgaggccgaaccggatgacgtagactgctggtgcaacgctacagatacatgggtaacctacgggacatgctcacaaacaggggagcatcggcgggataaaaggtcagtcgcgctagccccacacgtgggactcgggctggaaacccggactgaaacttggatgtcgagcgaaggggcctggaaacagatacaacgggtggaaacttgggtgctgagacacccgggttttacagtgattgcactcttcctcgcacacgcaattggtacgtctataacacaaaaaggcataatattcatcctgctaatgttagtaacgccatccatggcaatgcgatgcgttgggatcggatccagagacttcgtcgaaggactgagcggagccacctgggtagacgtagttcttgaacatggctcctgcgtaaccacgatggcaaaagacaaaccaaccctcgacatagaactactaaagacggaggtcaccaacccagctgttctccgcaagttatgcatagaagccaagatctccaacacaacaactgacagtcgttgcccaacccaaggcgaagccaccctcgtcgaggaacaagacgcgaacttcgtatgtaggcgaacattcgtagaccgcggctgggggaacggctgcggcctattcggaaaaggaagtctcatcacgtgcgcaaaattcaaatgcgtcacaaaactagaagggaaaattgtgcaatatgagaacctcaagtactcagtgatagtaactgtacacaccggcgaccagcaccaagtcggcaacgagagtaccgagcacgggaccacagccacaataactccccaagccccgacgacggagattcaattaacggactacggcgctttgaccctggactgctctccgagaactggactcgacttcaacgagatggtcctcctcaccatgaaggaaaaatcttggctcgtccataaacagtggtttctcgacctccccctaccctggacatctggggctagcaccagccaggaaacgtggaacagacaggatctactcgtaaccttcaaaaccgcccacgcgaagaagcaggaagtagtagtactaggttcccaagaaggcgctatgcacacagctttaaccggcgcgaccgagatacaaacatcaggaacaacgacaatattcgctggccacctcaagtgcagattgaaaatggacaaactgacattaaagggaatgagctacgtcatgtgcacgggttcattcaaactagagaaagaagtcgcggagacccaacatggcacggtactggtacaaataaaatacgagggcaccgatgcgccttgcaaaataccattcagcacgcaagacgaaaagggcgtaacccagaacggcagattaatcacggcaaatcctatagtaactgataaagagaagccggtcaatatagaggcggagccaccctttggggaaagctacatcgtcatcggcgccggagaaaaagcactaaagttgagttggttcaagaaaggctcaagcatcggaaagatgttcgaagcaacagccagaggcgcgcggagaatggccattctaggtgacaccgcctgggacttcggatcaataggcggagtctttaccagcgtcggtaagctagtacaccaaatcttcggcaccgcttatggggtgctgtttagtggggtcagctggacaatgaaaatagggatcggcgtgctacttacttggttagggttaaattcccgcagcacctccctaagcatgacctgcatcgctgtcggcttggttaccctatatctaggagtaatggtccaggcagacagcggctgcgtcatcaactggaaaggacgagagttaaagtgcgggagcggaatcttcgtaacaaatgaggtccatacctggaccgaacagtataaatttcaggctgactccccgaaacgactaagcgctgcgatcggtaaggcttgggaagagggtgtttgcgggattcgctctgcaactagactggaaaacataatgtggaagcaaatcagtaacgagctaaaccacatccttcttgaaaacgacatgaaactgactgtagtagtgggtgacgtcgctggaatcctcggtcagggcaagaaaatgattcgcccccagccgatggaatacaaatacagttggaaatcctgggggaaagccaagataattggcgcagacgcccagaataccacgtttataatcgacggcccaaacacaccggaatgccccgatgatcagcgtgcctggaacatatgggaagtcgaagactatggcttcggtatattcacgacaaacatctggcttaagctccgagactcgtacacgcaggtttgtgaccataggttgatgtccgcagccatcaaagacagcaaggccgtgcacgcagatatgggatactggatagaatcggaaaagaacgaaacatggaaactggcacgcgcgagcttcatcgaggtcaaaacctgtatctggccgaagtcacacacactatggtctaatggcgtgctggagtcggaaatgataattcccaaaatctacggcggaccgatatctcagcacaactatagaccagggtacttcacccagacagcaggaccctggcacctgggaaaactcgaactggacttcgacctatgcgaaggcacaacagtagtggtagacgagcattgcggcaatcgaggacccagcttaagaaccaccaccgtaactggcaaaatcatccacgaatggtgctgtcgcagctgtaccctcccaccccttagattccgcggagaggatggatgttggtacggaatggaaatacgccccgtaaaggagaaggaagaaaacctagtcaagagcatggtatccgctggcagtggggaagtagactcgttcagcctggggctcctctgtatctcaattatgatagaagaggtaatgcggtcgcgatggtcgcgtaagatgctgatgaccggtacactagctgtcttcttcctcctcatcatggggcaattaacgtggaacgacttgatacggctctgtataatggtaggagcaaatgcgagtgataggatggggatggggacaacctacctcgctttgatggcgacattcaagatgaggccgatgttcgccgtagggctacttttcaggcgattaacatcccgcgaagtcctgctactcacgataggtttgagcttagtcgccagcgtcgaactcccaaacagcctggaggaattaggggatggtctcgccatgggcatcatgatcctgaagttactgaccgatttccaatctcaccagctatgggccactctactgagcctgaccttcatcaaaacaactttctccctccactacgcatggaagacaatggccatggtactatccatcgtctccctctttccattgtgtctaagtacaacgagtcaaaagacgacctggcttccagtgttactaggaagcctagggtgcaaacctttaaccatgttcctgatcgcagaaaacaaaatttgggggcgaaagagctggcccctaaacgaagggatcatggcggttgggatagttagtatactactgagctcgctactcaaaaacgacgtacctctggccggtcccctaatcgccgggggaatgctaatcgcatgctatgtcataagcgggagttcggcagacctttccctggaaaaggcagcggaagtatcctgggaggaggaggcagagcattcaggagccagccacaatatcctagtcgaggtgcaagatgacggtacaatgaagataaaagatgaggagcgagacgacaccctaacgatcttactcaaagccacattgctggccgtatcaggggtgtatccactatccataccagcaacgctattcgtctggtatttctggcaaaagaaaaagcagcgatcaggcgtgttgtgggacactccatccccgcccgaggttgagagagcagtcctcgacgacgggatataccggattatgcaaaggggactcttagggcgtagccaggtgggcgtcggggtatttcaggaaaacgtcttccatactatgtggcatgtcactaggggcgccgttctaatgtatcagggcaagagacttgagccgtcttgggcgagcgtaaagaaagacctcatatcatacggcgggggatggcgcctacgggggtcgtggaataccggcgaagaagtacaagttatcgcagtggaaccgggtaaaaacccaaagaacgttcagaccgcccccggcacctttaagaccccagagggagaagtcggagctatagcgctcgactttaaacctggcacatccggcagccccattgtcaatagagaagggaagatagtgggcctgtatggaaacggagtagtcacgacgagcggaacctacgtaagcgcgatagcgcaagccaaggccagccaggaaggccccctccccgagatagaggacgaagtgttccggaagcgaaacctgaccatcatggacctacaccccggatctgggaaaacaaggaggtacttgccggcgatcgtgagggaggccatcaaacgaaaactaagaacgttaattctggcccctacacgagtcgttgcaagcgagatggccgaggcactaaagggtatgccaatccgttaccaaaccacagctgtaaaaagtgagcacacaggcaaagaaatagtcgacctgatgtgccatgcgaccttcacaatgcgcctcttatctcccgttcgcgtgccaaactataacatgataataatggatgaagcgcacttcacagacccaagtagcatcgcagcaagaggttacatcagcacacgcgtcggaatgggcgaagccgcagccatattcatgacagcaacacctcccggaagtgtagaggccttcccccaatcaaacgcagtaatccaggacgaagaacgcgacatccccgagcgtagttggaactctggatacgaatggataacggactttcctggcaaaaccgtatggttcgtaccgagcataaagagcggcaacgacattgcaaactgcctccggaagaacgggaaacgagtgattcagctaagccgaaaaacgttcgatacagaatatcagaaaaccaagaacaatgattgggattatgtggtcacaaccgatatcagcgaaatgggggcaaatttccgggcagatagggtcatcgacccacgccgctgcctcaagcccgtaattctaaaggacggaccagaacgcgtcatcctggcaggccccatgccagtcaccgtagcctcggcggcccagcggagaggacgcattggaagaaaccataataaagagggcgatcagtacatatacatggggcaacccctaaataatgacgaagaccatgcgcattggactgaggcgaaaatgttgctagacaacataaacacgccggaaggcatcatacctgccctattcgaaccagaacgcgagaaaagtgcagcagtagacggggagtaccggcttagaggcgaagcacggaaaacattcgtcgaactgatgcgcaggggcgacctaccagtctggctgagctacaaagtagcttccgaggggtttcaatactcagaccgacgctggtgcttcgacggcgaacggaacaaccaggtgcttgaagaaaacatggatgtagagatctggactaaggaaggagagagaaagaaactccgccccaggtggctcgacgcaagaacctactccgacccattagcactccgagagtttaaagagttcgcagccggcagacgtagtgtatcaggagacctcattctcgagatcggaaagctaccacaacacctgactcaacgagcgcagaatgcgctagacaatctagtcatgcttcacaacagcgaacagggaggacgggcctacaggcacgccatggaagaactgcctgacaccatcgaaacactaatgctattagccttaattgccgtactaacgggcggggttaccttattcttcctctcgggacgcgggctcgggaagacaagtatagggttactttgcgtgatggcgtcatccgtgttactctggatggcttccgtcgagccccactggatagccgcaagtatcattctagagttcttccttatggttcttctcataccagaacccgatcgccaacgcacgccgcaagataaccaactagcctacgtcgtgataggcctattgttcatgatcctaacggtggccgcaaatgaaatgggattgttggaaacgactaaaaaggacctcggcataggacacgtagcggttgaaaaccaccatcatgccgccatgctcgacgttgacctacaccccgcatcagcctggacgttgtatgcagtagcaacaaccatcattacccccatgatgaggcacacaatagagaacaccactgcaaatatctcactaaccgcaatcgcgaaccaagcagcaattctcatggggctagataagggctggcctatttcaaaaatggacataggggttccacttctagccttggggtgttacagtcaagtaaacccgctaacgttaacggcagctgttctgatgctggtcgcgcactacgcaatcatcggccctggtctacaagcgaaagctacccgcgaagcgcagaagcgaacagcagcggggatcatgaaaaacccaaccgtagacggaatagtagcaatagacctagatcctgtggtatacgacgcaaaattcgaaaaacaacttgggcaaataatgctgctgatcctctgcacctcccaaatcctactgatgcgaactacatgggccctatgcgaaagcatcaccctagcaaccggaccactcaccacactatgggaaggctcgccaggaaaattctggaatacgaccatagcagtttccatggcgaacatcttccgaggaagctacctggccggggccggactggcgttcagcctgatgaaatcactaggcggaggacgtaggggtacaggggcacagggcgaaacattgggcgaaaagtggaagcgccaacttaaccaattaagcaaaagcgaatttaacacgtataaacggagcggcataatggaagtcgatcgcagtgaagccaaagaggggctaaaacgcggggagacgactaagcatgccgtatccaggggtaccgcaaaactccgctggttcgtcgaacggaacctagttaagccggagggtaaagtcatcgatctaggttgcgggcgaggcggatggtcctactactgcgcggggctgaaaaaggtgacagaagtaaaggggtacacaaaaggcgggccgggccacgaagaaccaatacctatggctacctacggatggaacctcgtgaagctgcacagtggcaaagacgtgttcttcatccctccagagaaatgcgacacgttgctctgtgacatcggggaaagctcccccaacccgacgatcgaagaagggcgcactctacgggtcctaaaaatggtcgaaccatggctacggggaaaccaattctgcattaaaatcctaaacccctacatgccctcggtagtagagaccctggaacaaatgcaacgaaaacacggcgggatgctagttcgaaatcccctcagccgaaactccacacatgaaatgtactgggtaagttgcggcacaggcaatatagtgtccgcagtcaacatgacaagcagaatgctactcaaccgcttcacgatggcgcacagaaagccaacgtacgagcgcgacgtcgatctaggtaccgggactcggcatgtggctgtagaaccagaagtagcaaatctagacattatcggtcaacgaatcgaaaacatcaagcatgagcacaagtctacatggcactacgacgaggacaatccatacaagacctgggcataccacgggtcttatgaagtcaaaccttccggcagtgcatcgagcatggttaacggggtagtaaaactactcacgaagccatgggacgtcatcccgatggtcacccaaatagcgatgaccgacacgacgccattcggacaacaaagagtcttcaaagaaaaagtggatactagaacccccaaggccaaaagagggaccgctcaaatcatggaggtgaccgcccgatggctgtgggggtttctatcacgaaacaagaaaccacgcatctgcactcgtgaagagttcaccaggaaggttcggtcgaacgcggcgataggcgccgtcttcgtggacgaaaatcagtggaacagcgcgaaggaggcagtcgaggacgagcgcttttgggacctagtccacagagaaagagaattgcataagcagggcaaatgcgcaacatgcgtctacaacatgatgggaaagcgagagaagaaactaggcgagttcggcaaggcaaaagggagccgcgcgatatggtacatgtggctgggcgcaagattcctagagttcgaggccttaggtttcatgaacgaggatcactggttcagcagagaaaactccctcagcggggtagaaggagaagggctacacaaactgggctatatcctgcgcgatatatcaaagatacctggcggcaatatgtacgcggacgacaccgcgggatgggacacgcggataaccgaagacgatctgcaaaacgaggcgaaaataacagacataatggaacccgaacacgcactgctcgccaaggccatattcaagctaacctatcaaaataaggtagtgcgcgtacaacgacctgccaaaaatgggaccgttatggatgtaattagccgaagggaccaacgagggtccgggcaggtaggaacctatgggttgaacacgttcacgaacatggaggcccaactcattcgacaaatggagagcgaggggatattcagcccctccgaacttgagacaccgaacttggccgaacgagccctagactggttagagaagtacggcgtcgaacgactaaagcgtatggccatatcgggtgacgactgcgtcgtgaaaccgatcgacgatcggttcgcaacagcgctcacggcgctcaacgacatgggaaaagtcagaaaagatataccccaatgggagccaagcaaagggtggaatgactggcaacaagtcccattctgctctcaccatttccaccagctcatcatgaaggacgggagagaaatagtcgtgccgtgcaggaaccaagacgagctggtcggccgcgcccgtgtatcgcagggagcaggctggagcctgagagagaccgcgtgcctaggaaaatcctacgcccagatgtggcagctcatgtattttcaccgaagggacctacgcctagccgcaaacgctatatgctccgcagtcccagtagactgggtacctacgtcgcgaacaacttggtcaatacacgcccatcaccaatggatgacgacggaggatatgctctcggtttggaacagggtctggatcgaggaaaacccatggatggaggataagacccacattagttcctgggaagacgtaccgtacctaggaaaacgagaagatcaatggtgtggttcactcatagggctaacagctcgggcaacatgggcaaccaacattcaggtggcaataaaccaggtaagacgactgatcggaaacgagaactacctggactacatgaccagcatgaaacgcttcaaaaacgagacagacccagaaggggctctctggtaa

SEQ ID NO: 24206 - RNA, 9879 nt, synthetic construct
  misc_feature 1..9879: note = derived and/or modified CDS sequence (opt11) from DENV-1__FJ461325__SS-prME
  source 1..9879: mol_type = other RNA
agcgtgacgatgctgctcatgctgatgccaaccgcactggccttccacctcaccacccggggcggtgagccccacatgatcgtgagcaagcaagagcggggcaagagcctactgtttaagacctcagctggggtgaatatgtgcaccctcatcgccatggacctgggggagctgtgcgaggacaccatgacttacaagtgtccccgcatcacggaaaccgagcccgacgatgtggactgctggtgtaacgctacggacacctgggtgacctatgggacctgtagtcaaaccggcgagcaccggcgcgacaagcggtccgtggccctcgccccccacgtgggcctggggctggagacacgcacggagacctggatgagctccgagggcgcctggaaacagatacaacgggtagaaacgtgggccctcagacaccccgggttcaccgtgatcgccctgttcctggcccacgcgataggtaccagcattactcagaaggggatcatcttcatcctcctgatgttagtcacgccctctatggccatgcggtgcgtcggcattggcagccgcgacttcgtagagggtctctccggagccacctgggtggacgtggtactggagcacggaagctgtgtgactaccatggccaaggacaaacccacgctggacattgagctcctgaagaccgaggtcactaaccccgccgtgctgcggaagctctgcatcgaggcgaagatctccaacaccacgaccgacagccgctgcccgacccaaggcgaggccaccctagtggaggagcaagacgccaacttcgtctgccggaggactttcgttgaccggggctgggggaacggctgcgggttattcggcaaggggagcctcatcacgtgcgcaaaattcaagtgcgtaaccaaactggaaggcaagatcgtccagtacgagaacctgaagtactcagtgatagtgacagtccacacgggcgaccagcaccaggtggggaacgagtccaccgagcacggcaccacagccaccataacgccccaggcacctaccacggagatccagttaaccgactacggtgccctcacgctagactgctcgcccaggaccggcttggacttcaacgagatggtcctgctgacaatgaaggaaaagtcctggctggtgcacaagcaatggtttttggacctgcccctaccctggacctctggggccagcacgtcccaggagacctggaaccggcaggacctgctggtgaccttcaaaaccgcccacgccaagaagcaggaggtggtggtgctcggctcacaagaaggcgccatgcacaccgccctcaccggggccacagagatccagacctccggaacgaccaccatcttcgccggtcatctgaagtgtcgcctcaaaatggataaactgaccttgaagggcatgagctacgtgatgtgtacggggtcctttaagctcgagaaggaggtggccgagacccagcacggcaccgttctcgtccagatcaagtacgagggcacggacgcgccctgcaagatccccttcagcacccaggacgagaaaggggtgacccagaacggccgtctgataactgccaacccgatcgtgaccgataaagagaaacccgtcaacatcgaggccgaaccgcccttcggggagtcgtacatagtgatcggcgccggcgagaaggcgctgaagctcagctggttcaagaaagggtccagcatcggtaagatgtttgaggccacggcccgcggggcccggcgtatggccatcctcggtgacaccgcatgggacttcgggtccatcggtggcgtgttcacgagcgtagggaagcttgtgcaccagatcttcggcacggcctacggggtgctgttctcgggcgtaagctggacgatgaagatcgggatcggcgtgctgctgacctggctcggcctgaactcccgcagcacctcccttagcatgacctgcatcgccgtaggcctcgtcacgttatacctgggcgtgatggtgcaagccgacagtgggtgcgtcatcaactggaagggccgggagctcaagtgcgggagcggcatcttcgtgaccaacgaagtgcacacctggacggagcagtacaaattccaggccgatagcccgaagcgtctgtccgcggccattggtaaggcatgggaggagggggtctgcggcatacggagcgctacccgactggagaacatcatgtggaagcagatctccaatgagctcaaccacatcctgttagaaaacgacatgaagttcacggtggtggtcggagacgtggccgggattctcgctcaggggaagaagatgatccggccgcagccaatggagtacaagtacagctggaagtcatggggcaaggccaagatcatcggcgccgacgtacagaacaccaccttcattatcgacgggccaaacacgccggaatgccccgacgatcagcgcgcctggaacatctgggaggtcgaggattacggctttgggatcttcacgaccaatatctggctgaagctgcgggacagctacacccaagtctgcgaccaccgcctcatgtcggcggccatcaaagatagtaaagccgtacacgccgacatgggctactggatcgaatccgagaagaacgaaacctggaaacttgcccgagcctcgttcatagaggtcaagacgtgcatctggcccaagtcccacaccctgtggagcaacggggtgctcgagtccgagatgataatccccaaaatctacgggggcccgatcagccaacacaactaccgccccgggtacttcactcaggccgccggaccatggcacctaggaaagctcgaactcgacttcgatctttgcgagggcaccacggtggtggttgacgagcactgcggtaaccgggggccgtccctgcgcaccaccaccgtgactgggaagataatccatgagtggtgctgtcgaagctgcaccttaccgcccctccgcttccgcggggaagacggctgctggtacgggatggagatccgccccgtcaaggagaaggaggagaacctggtgaagtccatggtcagcgccggcagcggcgaggtcgactcgttctcactgggactcctgtgtatatccatcatgatagaagaggtgatgcggagccgctggtcccggcgcatgctcatgacgggcaccctggccgtgttcttcctgctcatcatggggcagttgacgtggaacgatctgatcagactttgcatcatggtcggcgcgaacgccagcgacaggatgggtatgggcaccacctatctggccctgatggccaccttcaaaatgcgccctatgttcgccgtgggccttctgttccggcgcctgacatcacgggaggtgttattgctgaccatcgggttgagcctggtcgcctccgtggagctgccgaacagcctcgaagagctgggcgacgggctggccatgggcataatgatcctcaagctgttgaccgacttccagtcccatcaactctgggccaccctgctcagcctcacgttcatcaaaaccaccttctccctgcactacgcctggaagaccatggcgatggtcttgagcatcgtatcccttttccccctgtgcctgtctacgacctcccagaagaccacctggctccccgtgttgttgggctccctcgggtgcaagccgctgactatgttcctgataaccgagaacaaaatctggggacgccggtcctggccgctcaacgaggggatcatggccgtcggcatcgtgagcatcctgctgagctccctcctgaaaaacgacgtgcccctggccggacccctcatcgcgggcggcatgttgattgcctgctacgtcataagcgggtccagcgcggacctgtccctcgaaaaggcagccgaggtgagctgggaggaggaggccgagcattccggcgccagccacaacatcctggtggaggtacaggatgacggaactatgaagatcaaggatgaggagagggacgacaccctgacaatcttgctgaaggcgacgctgctggccgtgtctggcgtgtacccgctgagcatccccgcaaccctgttcgtgtggtacttctggcagaagaagaagcagcggtcaggggtgttgtgggacaccccgtccccgcccgaagtagagagggccgttttggacgacggtatctaccggatcatgcagcgggggcttcttgggagatcccaggtgggagtgggggtattccaggagaacgtgttccacaccatgtggcacgtgacacgcggcgccgtcctcatgtaccaggggaagcggctggagcccagctgggcgtccgtgaagaaggacctgatcagctacggtggagggtggcgcctccagggatcctggaacaccggggaagaggtgcaggtcattgccgtggagcccggaaagaaccccaaaaacgtgcagaccgccccaggcaccttcaagacgcccgaaggtgaggtcggtgccatcgctctggacttcaagcccgggaccagcggctcccccatcgtgaaccgggaaggaaaaatcgtcggactgtacgggaacggggtagtgaccaccagcggcacgtacgtgagcgcgatcgcccaagctaaggcatcccaggaggggccgttacccgagatcgaggacgaagtgttccgcaagcggaacctaaccattatggacctgcaccccggcagcgggaagacccgccgttacctcccggccatagtgcgtgaggccatcaagcgcaagctgcggaccttaatcctcgcccccacgagagtggtcgcctccgagatggccgaggcgttaaaggggatgccaatccggtaccagaccaccgccgtaaaatctgagcacacaggcaaggagatcgtggaccttatgtgtcacgccacttttaccatgcgcctcctgtcccccgtccgggtgccgaattataacatgatcattatggacgaggcccacttcaccgatcccagctcaatcgccgcgcgcgggtacattagcacacgggttggaatgggggaggcggctgccatcttcatgacggccacgccgcccggctccgttgaggcgttcccgcagtccaacgccgtgatccaggacgaagagagggacatccccgagcggtcctggaacagcgggtacgagtggattaccgacttccccggtaagaccgtgtggttcgtaccctccatcaagtcgggcaacgacatcgccaactgcctgaggaagaacgggaaaagagtgatccagctctcccgcaagacgttcgacaccgagtaccagaagaccaagaataacgactgggactatgtcgtcaccacggacatcagcgagatgggcgccaacttccgggccgaccgcgtgatcgatccgcgccgatgcctgaagcccgtgatcctgaaggatgggcccgagcgggtcatcctcgccggccccatgccggtcacagtcgcctctgccgcccagcgccgaggtcgcatcggtcgcaatcataacaaggagggcgaccagtatatctacatgggacagcccctgaacaacgacgaggatcatgcgcactggacagaggcaaagatgctgctcgataatataaacacacccgagggcattatccccgccctgttcgagccggagcgcgagaagtccgccgccattgacggggaataccgcctgcggggcgaggcgcgcaaaacgttcgtggagctcatgcggcgaggggacctgcctgtgtggctgtcctacaaggtcgccagcgagggattccagtacagcgataggcgctggtgcttcgacggagaacggaacaaccaggtactagaggagaacatggacgtggagatctggaccaaagagggagagcgtaagaagctgcggccccgctggctggacgcccggacctactcagaccccctcgccctgcgcgagttcaaggagttcgccgcgggccggcgctctgtctccggggacctgatcctagagataggcaagctgccccagcacttgacccagcgggcacagaacgcacttgacaatctggtgatgttacacaacagcgagcaaggcgggcgagcctaccggcacgcgatggaggaattgcccgatacgatcgagaccctgatgttgctcgcgctaatcgcagtgctgacaggcggggtcaccctcttcttcctgtccggacgcgggctgggcaagaccagcataggcctcctgtgcgtgatggcctccagcgtgcttctctggatggccagcgtggagccccactggatcgcggccagcatcatcctggagttcttcctgatggtgctcctgatcccggagccagaccggcagcgcaccccacaggacaatcagctcgcctacgtggtcatcggtcttctgtttatgatcctgacggtggccgccaacgagatgggcctcctggagaccaccaagaaagacttaggaattggccacgtagcagtcgagaaccaccatcacgccgcaatgctcgacgttgacctgcaccccgccagcgcctggacgctatacgcggtggccacaacaatcatcacccccatgatgcgccacacgattgagaacaccaccgccaacatctcactgaccgcaatcgccaaccaggcggctatcctgatggggctggacaagggatggcccatctccaagatggacatcggtgtacccctcctggccctgggttgctacagccaagtgaacccattgactcttaccgccgcggtgcttatgttagtcgcccattacgccatcatagggcccgggctgcaggccaaggccacgcgggaagcgcagaagcgcaccgccgccggaatcatgaagaatcccactgtggatggaatagtcgccatcgacctcgaccctgtcgtctatgacgccaagttcgagaaacagctcggccagataatgctgctgatcctttgcacctcccagatcttattgatgcggaccacctgggcgctttgcgagagcatcacgctggcgaccggccccctgaccaccctttgggagggctcccctgggaaattctggaacacaaccatcgccgtgtcaatggccaacatattccgagggagctacttagccggcgcgggcttagccttcagcctcatgaagtcactcggaggcggccggagagggaccggggcgcagggtgagaccctgggggagaagtggaagaggcagctgaaccagctctcaaagagtgaatttaatacgtataagcgctccgggatcatggaggtcgaccggagtgaggcgaaagagggattgaagcgcggggagaccacaaagcacgcggtgagtcggggcaccgctaagctacgctggttcgtcgagcgaaacctcgtgaagcccgaagggaaggtcatcgacctaggctgcggccgcggaggatggagctactactgcgctggactgaagaaggtgacggaagtaaagggctacaccaagggggggcccggccacgaggaacccatcccgatggccacctatgggtggaacctcgtgaagctgcactcgggcaaagacgtgttcttcataccgcccgagaagtgcgacaccctgctctgtgacattggggagagctcccctaacccaacgatcgaggagggccggaccctgcgagtcctgaagatggtggagccctggttacggggtaaccaattttgcatcaagatcctcaacccctacatgccgtccgtagtcgagaccctggagcagatgcaacgcaagcacggcggaatgctcgtgcggaacccgctgtcccgtaacagcacccacgagatgtactgggtgtcttgcggaaccggcaacatcgtgagtgccgtcaacatgacatcccgaatgttactaaaccggttcaccatggcgcatcgcaagcctacctacgagcgggacgtagacttaggggccggcacccgccatgtggccgtggagcccgaggtggccaacctggacattatcggccagcggatcgagaacattaaacatgagcacaagagcacgtggcactacgacgaggacaacccctacaagacctgggcctaccacgggtcatacgaggtaaagccgagcggctccgcgagtagcatggtgaacggggttgtgaagcttctgaccaagccctgggacgtgatccccatggtcacgcaaatagccatgacggacaccacgcccttcggccagcagcgcgtgttcaaggagaaggtggacacgcggacgccgaaggccaagcgcggtacagcccagatcatggaggtcaccgccaagtggctgtggggattcctttctagaaacaagaaaccccgcatttgcacgcgggaggagttcacgcgcaaggtgagaagcaacgcggccatcggagccgtgtttgttgacgagaaccaatggaacagcgctaaagaggcggtcgaggacgagcgcttttgggacctggtgcaccgggagcgagagctccacaagcaggggaagtgcgcgacctgtgtctacaatatgatgggcaagcgggagaagaagctcggggagttcggcaaggccaaggggagtcgggcgatctggtacatgtggctgggcgcacgtttcctggagttcgaggcactcggattcatgaacgaggaccactggttctcccgcgagaacagcctgtcaggggtggaaggcgaggggctgcacaagctcggctatatcctgcgggacattagcaagatacccgggggcaacatgtacgccgacgacaccgcgggatgggatacccgcatcacggaggacgacctgcagaacgaggcgcgcatcaccgacatcatggagccggagcacgccctcctggcgaagtccatcttcaagctgacctaccagaataaggtggtccgggtgcagcgccccgcaaagaatgggacagtgatggacgtcatcagccggcgcgaccagcggggctccgggcaggtggggacgtatggcttaaacaccttcaccaacatggaggcccagctgatccgccaaatggagagcgaggggatcttctctcccagcgagctcgaaacccccaacctcgctgagcgggtgcttgactggctggagaagtacggtgtcgagcgcctcaaacggatggccatttcgggggatgactgcgtcgtgaagccgatcgacgaccgcttcgcgacggcgctgaccgcccttaacgacatgggaaaggtccggaaagacatcccccagtgggagcccagcaaggggtggaacgattggcagcaggtccccttctgctcccaccactttcaccagctgatcatgaaagacggccgcgagatcgtggtaccctgccggaaccaggacgagctggtgggcagggcccgggtgagtcagggagccggctggtcactgcgcgagacggcgtgcctagggaagtcctacgcccagatgtggcagctgatgtacttccaccggcgggacctgcggctcgccgcgaacgcgatctgcagcgccgtccccgtcgactggatccctacctccagaacgacctggagcatccacgcccaccaccagtggatgaccaccgaggacatgctgtccgtgtggaaccgcgtctggatcgaggaaaacccttggatggaggacaagacgcatatctcatcctggggtgacgtgccgtacttagggaagcgggaggatcagtggtgcggcagcctcatcggtctgactgcccgcgcgacctgggcgaccaacatccaggtggccatcaaccaggtccgaaggctgattgggaacgaaaactacctcgactacatgaccagtatgaaacggttcaaaaacgaatctgatcctgaaggcgcactgtggtga

SEQ ID NO: 24207 - RNA, 9879 nt, synthetic construct
  misc_feature 1..9879: note = derived and/or modified CDS sequence (opt11) from DENV-1__FJ410232__SS-prME
  source 1..9879: mol_type = other RNA
tctgtgaccatgctgctcatgcttatgcccaccgccctggccttccacctcaccacacgcggcggggagccgcatatgatcgtgagcaagcaggagcggggaaagagcctgctgttcaagaccagcgccggggtaaacatgtgcaccttaatcgcgatggatctgggagagctgtgcgaggacaccatgacctacaagtgccctcgcatcaccgaggccgagcccgatgacgtggactgctggtgcaacgccaccgacacgtgggtgacctacgggacctgcagccaaacgggcgagcatcggcgcgacaagcggtccgttgccctagcgcctcacgtgggcctgggactggagacacgcacagagacctggatgtcgtccgagggcgcctggaagcagatccagagggtcgagacctgggccctccgccacccagggttcacggtgacagcccttttcctggcgcatgccataggcacaagcattacccagaaagggatcatcttcatcctcctgatgctagtgacgccatccatggccatgcgctgtgtcggcataggcagccgcgacttcgtggaggggctctcgggcgccacctgggtggacgtcgttctggagcacggaagctgcgtgacaaccatggccaaagacaagcccacgctggacatcgaactcctgaaaacggaggtcaccaaccccgcggtgctgcggaagctgtgcatcgaggccaagatctcaaacaccacgactgactcgcggtgcccgacccagggggaagccaccttagttgaggagcaagacgccaacttcgtctgccgtcggacgttcgtggatagaggttggggcaacggttgcggactattcgggaagggatccctgatcacgtgcgccaagttcaagtgcgtgaccaagctagagggcaagattgtccagtacgagaacctcaagtacagcgtgatcgtgaccgtccacacgggtgaccagcaccaggtggggaacgagtccaccgagcacggcactaccgcgaccatcacgccccaagcacccaccacggagatacagttgaccgactacggagccctgactcttgactgtagccccagaaccggcctcgatttcaacgagatggtcttactgaccatgaaggagaagtcctggctcgtacataagcagtggttcctggacctgcccctgccctggaccagtggggccagcacgtcccaagagacctggaaccggcaggatctgcttgtgaccttcaagaccgcccacgcgaagaagcaggaggtcgtggtgctcggtagccaggagggcgccatgcacactgctctgaccggggctaccgagatccagacctccggcacgaccaccatcttcgcgggccaccttaagtgtagactcaagatggacaaattgaccctgaaaggcatgagctacgtcatgtgcacagggtccttcaaattggagaaagaggtggcggagacccagcacggcaccgtgctggtccagatcaagtacgagggcacggacgctccgtgcaagatccccttcagcacgcaggacgaaaaaggggtgacacagaacgggcggctcatcaccgctaacccgatcgtgaccgacaaggagaagccagtcaacatcgaagcagagccgcccttcggggagagttacatcgtaatcggcgcgggcgagaaggccctcaagcttagctggttcaagaagggctccagcatcggcaagatgttcgaggcaacggctcgcggggcccggcgcatggcaatcctgggcgacaccgcctgggacttcgggtccatcggcggcgtgtttaccagcgtagggaagctggtgcaccagatctttggcaccgcctatggagtcctcttttccggggtcagctggacgatgaagatcgggatcggagtgctactcacatggctcggcctgaactcccgcagcacctccctttcaatgacctgcatcgccgtcgggctcgtcacgctctacctgggagtgatggtgcaggccgactccgggtgcgttattaactggaagggccgggagctcaagtgtgggagcggcatcttcgtaaccaacgaggtacacacctggaccgagcagtacaagttccaggcggactcgccgaagcgcctgtccgcggccatcgggaaggcctgggaggagggggtctgcggcatccgaagcgcgacgaggctggagaacatcatgtggaagcagatctccaacgaactcaaccacatcctgttggagaacgacatgaagctcacggtggtggtcggggacgtggcgggcatcctggggcagggaaagaaaatgatccggccccagcccatggagtacaagtacagctggaagtcatggggtaaggccaagatcatcggtgcggacgcccagaacaccaccttcatcatagacggccccaatactccggagtgtcccgacgaccagcgcgcgtggaatatctgggaggttgaagattacgggttcggcattttcactacgaacatctggctgaagctccgggacagctatacccaggtatgcgaccaccgcctaatgtccgccgccatcaaggacagcaaggccgtgcacgccgacatgggctactggatcgagtccgaaaagaacgagacctggaaacttgcgcgggccagcttcattgaggtgaaaacgtgcatctggccaaaatcacacaccctctggagcaacggggtcctggagtcggagatgatcatccccaaaatctatggcgggccgatcagccagcacaactaccgccccggctacttcactcaaaccgcggggccctggcacctgggcaagctcgagctggacttcgatctgtgcgagggcacgacagtggtcgtcgatgagcattgcgggaacagaggcccgtccctccgaaccaccacggttaccgggaagatcatccacgagtggtgctgtcggagctgcaccctgccaccactgcgcttccggggcgaggacgggtgctggtacgggatggaaattcgccccgtgaaggagaaggaggagaacctcgtcaagtccatggtcagcgccggcagcggggaggtggattccttcagcctgggactgctctgcatctctatcatgatcgaggaggtcatgaggagccgctggtcccggaagatgctgatgacggggactctggccgtgttctttctcttgatcatgggccagctgacatggaacgacctcatacgcctgtgcatcatggtgggggccaacgcctcagaccgcatgggcatgggcaccacctatctggccctcatggcaacgttcaagatgcgaccgatgttcgccgttgggctgcttttccgccggctcaccagtcgcgaggtgctgctactcaccatcggcctgagcttagtggcgtccgtcgagctccccaatagcctggaggagctgggggacggcctcgccatgggaatcatgatcctgaagctgctcacagacttccagtcccaccagctgtgggccaccctgctctccctgaccttcatcaagaccaccttcagcctccactatgcctggaagacaatggcgatggtgctcagcatcgtgtccctctttccactgtgcctcagcaccacctcccagaagaccacgtggctacccgtgctgttaggaagcctgggctgcaagccgctgaccatgttcctaattgcagagaacaaaatctgggggcggaaatcgtggcccctgaacgagggcatcatggccgtgggtatcgtctctatcctgctcagctccttgctgaagaatgacgtgcccctcgccggccccctgattgccggcggcatgttgatcgcgtgctacgtaatatctggctccagcgccgacctctccctggagaaggccgccgaggtctcctgggaggaggaggccgaacactccggggcgagtcacaacatcttggtggaggtgcaagacgacggcaccatgaagatcaaggacgaggaacgagacgacacactgaccatcctgttgaaagccacgctcctggccgtcagtggggtgtatccgctgagcatccccgccaccctcttcgtgtggtacttctggcagaaaaaaaagcagcggagtggcgtgctatgggacacccccagccctcccgaggtggagcgggccgtgctagacgacggcatatatcggatcatgcagcgcgggctgctcggtcgatcccaggtcggggtgggcgtgttccaggagaacgtcttccacaccatgtggcacgttacgcgcggggcggtcctgatgtaccagggcaagcggctggagccgagttgggccagtgtcaagaaggacctcatcagctacggcgggggctggcgcctgcgggggtcatggaacaccggggaggaggtccaggtgattgcagtcgagcccgggaagaaccccaagaatgtgcagactgcccccgggacattcaagacgcctgaaggcgaggtgggtgccatcgcgcttgacttcaagcccggcaccagcgggtcccccatcgtcaaccgcgaaggcaagatcgtggggctctacgggaatggcgtggtaacaaccagcgggacctacgtgagcgcaatcgcccaggccaaggcgtctcaagagggcccgctgcccgaaatcgaggacgaagtgtttcgaaagcgcaatctgacaatcatggacctccatcctgggagcggcaagacccggcgctacctgcccgccatagtccgggaggccataaagcgcaagctgcgcacactgatcctggcccccacgcgtgttgtggcctccgagatggccgaagccctgaagggcatgcccatccgctaccagaccaccgccgtcaagagcgagcacaccgggaaggagatcgtggacctcatgtgccacgccacgttcaccatgcggctgctgtcacccgtacgtgtccccaactataacatgatcataatggacgaggcccacttcaccgacccctcatccatagcggccagggggtacatcagcacccgcgtggggatgggcgaggccgccgcaatcttcatgacggcgacgccgcccgggtccgtggaagccttcccccagagcaacgctgtcatccaggacgaggagcgggacatccccgagagatcgtggaacagcggctacgagtggatcaccgatttccccggcaagaccgtgtggttcgtgccatctatcaagagcggaaacgacatcgccaactgcctgcggaagaacggaaagcgcgtcatacagctgagccggaagacgtttgacaccgaataccagaagaccaagaacaacgactgggactacgtggtgaccacggacattagcgagatgggggcgaacttccgcgctgaccgggttatcgaccctcgcagatgcttgaagcccgtgattctcaaggacggccctgagcgcgtgatcctggccgggcccatgccggttacagtagcctccgccgcgcagcggcgcggtcggatcggtagaaaccacaacaaggagggcgaccaatacatctacatgggccagcccctgaacaatgacgaggaccacgctcattggaccgaggcaaaaatgttattggacaatatcaacacccccgaggggatcatccccgccctcttcgaaccagagcgggagaagtccgcagcggtagatggcgagtatagactccgcggggaggcgcgtaagacgttcgttgagctgatgcgccggggggatttacccgtgtggctcagttacaaggtcgcctccgagggcttccagtactccgaccgccggtggtgcttcgacggggagcgcaacaaccaagtgcttgaggagaatatggacgtggaaatttggacgaaagagggcgagcgtaagaagctgagaccccgatggctcgacgcccgcacctactccgaccccctggccctgagggaatttaaggagttcgcggccgggagaaggagcgtttccggggacttaattctcgagattggcaagctgccgcagcacctcacccaacgtgctcaaaacgccctggataacctggtgatgctccacaacagcgagcagggagggagagcctaccgtcacgccatggaggagctgccggacacgattgagaccctgatgctcctggcgctgatcgccgtgctcaccggaggcgtcacgctgttcttcctgtccgggcggggcctcggcaagaccagcatcgggctgctgtgcgtgatggcctcctctgtccttctgtggatggccagtgtcgagccccactggatcgccgccagcataatcctggagttcttcttgatggtgctgctgatccccgaacctgaccgtcaacggacgccgcaggataatcagctcgcctacgtagtcatcggcctgctgttcatgatcctcaccgtggccgcgaacgagatggggctgctggaaaccacaaaaaaggacctcggtatagggcacgtggccgtggagaaccaccaccacgctgccatgctggacgtcgacctgcatcctgcctcagcgtggacgctttatgccgtggcaaccaccatcatcaccccgatgatgcgtcacacgatcgagaataccaccgccaacatctcactgaccgccatagcgaaccaggccgctattctgatgggcctagacaagggttggcccatcagtaagatggacatcggagtccccttactggccctcggctgttactcacaggtgaaccccctgacgctgaccgcggccgtactcatgcttgttgcccactacgccatcatcgggccgggcctgcaggcaaaggcgacccgtgaagcgcagaagcggacagcggccgggatcatgaagaaccccacggtggatgggatcgtcgccatcgacctcgaccccgtagtctatgacgcgaagttcgagaaacagctcgggcagatcatgctgctcatcctgtgtacctcacagatcctgctcatgcgcaccacctgggccctgtgcgagagcatcacgctggccaccggtcccctcaccaccctgtgggaaggctccccgggaaagttctggaacacgaccattgcagtgtcaatggcaaacatcttccggggcagctacctggcgggcgccggtctcgccttcagcctgatgaagtctctgggcgggggccgccggggcaccggcgcccagggggagaccctcggggagaaatggaagcgccagctgaaccagctgtctaagagcgagtttaacacgtacaagcggtccggtatcatggaggtcgaccgcagcgaggcgaaggaagggctcaagcggggcgagaccaccaagcacgccgtgtcccgcggaaccgccaagctacggtggttcgtggaacgcaacctggtaaagcccgagggcaaggtgattgacctcggctgcgggcggggcgggtggagctactactgtgccggcctcaagaaggtgacggaggtcaaagggtacaccaagggaggcccggggcacgaggagcccatcccgatggccacctacggatggaatctggtgaagctgcattccgggaaggacgtcttcttcatcccgcccgagaagtgcgacacccttctgtgcgacatcggcgagtcgtcccccaacccgacgatcgaggaggggcgcaccctgcgggtcctcaagatggtggagccctggctacgcggcaaccagttctgcatcaagatactgaacccttacatgccttctgtcgtcgagaccctcgagcagatgcagcggaagcacggagggatgctggttcgcaatccgttgtctcggaacagcacccacgagatgtactgggtctcctgcgggaccgggaatatcgtaagcgcggtgaacatgacaagtcgcatgctcctgaacaggttcaccatggcacaccggaagcctacctacgagcgcgacgtggacctgggtaccggcacgaggcacgtcgccgtggagcccgaggttgctaaccttgacataatcgggcagcgcatcgaaaacatcaagcacgagcacaagtcgacctggcactatgacgaggataacccctacaagacctgggcctaccatggctcctacgaggtcaagcctagcgggtccgcgagcagcatggtcaacggcgtggttaagctgctgaccaagccttgggacgtgatcccgatggtcacgcagatcgccatgaccgatactacccctttcgggcagcaacgggtgttcaaggagaaagtggacacgcggactccgaaggccaagcggggcaccgcgcaaataatggaggtcaccgcccgctggctctggggcttcctgagtcggaacaagaagccgcgcatctgcacgagggaggagttcacacgcaaggtccgaagcaatgccgccataggggccgtattcgttgacgagaatcagtggaactccgccaaagaggcggtggaggatgagcgcttttgggacctagtgcaccgggagcgcgagctccataagcagggtaagtgcgcaacctgtgtctacaacatgatgggcaagcgtgagaagaagttaggcgaattcggtaaggccaaaggcagccgcgccatctggtacatgtggctgggcgcccggttcctcgagttcgaagcgctggggttcatgaacgaggaccactggttctcccgggagaacagcctgtccggcgtggagggggagggcctccacaagctggggtacatcctgagggacataagcaagatccccggcggcaacatgtacgctgacgacaccgcagggtgggacacgcgcatcacggaggacgacctccagaacgaggccaagataacggatattatggagccagagcacgccctgctggcaaaggccatcttcaagctcacctatcagaacaaagtggtccgtgtgcagaggcccgccaaaaatggcactgtgatggacgtcatcagtcgccgagaccagcgcggatcaggccaggtgggcacctacgggctgaacaccttcaccaacatggaagcacagttgatccggcagatggaatccgaaggcatcttcagcccttccgaactcgagacgcccaatctggctgagcgggcgctggactggctcgagaagtacggcgtggagcgcttgaaacgcatggccatctctggcgacgactgcgtcgtgaagcccatcgacgaccggttcgccaccgctctgacagccctcaacgacatggggaaagtgcgcaaggacatcccccagtgggagccctccaagggctggaacgactggcagcaggtccccttctgctctcaccacttccaccagctgataatgaaggatggccgggagattgtggtgccgtgccggaaccaagatgagctcgttgggagagcccgggtgtcccagggcgcagggtggtcgctccgggagacggcctgcctgggcaaaagttacgcgcagatgtggcaactgatgtatttccacaggcgggacctccgcttggcggccaacgccatctgctccgccgtgcccgtagactgggtgcccacgtctcggaccacctggtccatccatgcccaccaccagtggatgaccacggaggacatgctgagcgtttggaaccgcgtctggatcgaggagaacccatggatggaggacaagactcatatctccagctgggaggacgtgccgtacctcgggaagcgcgaggaccagtggtgcggctccctgatcggcctgaccgcgcgggcaacctgggctaccaacatccaggtggcaatcaaccaggttcgccgactaatagggaacgaaaactacctcgactatatgaccagcatgaaacgcttcaagaatgagtccgaccccgagggcgccctgtggtaa

SEQ ID NO: 24208 - RNA, 9879 nt, synthetic construct
  misc_feature 1..9879: note = derived and/or modified CDS sequence (opt11) from DENV-1__FJ461327__SS-prME
  source 1..9879: mol_type = other RNA
agcgtaaccatgcttctcatgttaatgcccaccgcactagccttccaccttaccacgcggggcggggagccccacatgatcgtgagcaaacaagagcggggcaagtcactgcttttcaagacatcggccggggtaaatatgtgcaccctaatcgccatggaccttggcgagctgtgcgaggacaccatgacctacaagtgcccccgaattaccgagacagaacccgatgacgtggactgctggtgcaacgccacggacacgtgggtgacctatgggacctgcagccagacgggcgagcacaggcgcgacaagcggtccgtggccctagcgccccacgtgggcttaggtctggagactcgaacagagacatggatgagctcagaaggggcgtggaaacagattcagcgggttgaaacctgggccttgcgccaccccgggttcactgtaatcgcactgttcctggcccacgctataggaacctccatcacgcagaaggggatcatcttcatcctgctgatgctggtgacgccctccatggccatgaggtgtgtcgggattggatcccgcgactttgtggaggggctaagtggcgcaacctgggtagacgtggtattggaacacgggagctgcgtgaccactatggccaaggacaagcctacgctggacatcgagctcctgaagacagaggtcaccaaccccgccgtgcttcggaagctttgcatcgaggcaaagatctccaatacgacgaccgactctcgctgcccgacacaaggggaggccacgctggtagaggagcaggacgcgaacttcgtctgtagacgcacgttcgtggaccggggctggggtaacggctgcggtctgtttggtaaagggagtctcatcacctgcgccaagttcaagtgtgttacaaaattggagggcaagatagttcagtacgagaatctgaagtattcagtgattgtgacagtccacacgggcgatcagcaccaggtggggaatgagtccaccgagcatggcaccaccgcaacaattacgcctcaggcgcccactacggagatccagctaaccgactatggggcgctgacactggattgcagcccccgcaccggcctagacttcaacgaaatggttttgctcactatgaaagagaagagctggctcgtacacaagcagtggttcctggacctgccccttccctggacaagcggagcgtccacgtcgcaggaaacgtggaaccggcaggacctgttggttacctttaaaaccgcccatgccaagaagcaggaggtcgttgtcctcggaagccaagagggagctatgcacacggccctaacaggggccaccgagatccagacctccggaacgactaccatcttcgccgggcacctgaagtgccgactgaagatggacaagctgacgctgaagggcatgagctacgtcatgtgcaccgggtccttcaagttggagaaggaggtagccgagacccagcatgggacggtgctggttcagatcaagtacgaaggaaccgacgccccctgtaagatcccctttagtacgcaggacgagaagggggtgactcagaacggcagactcatcaccgcaaacccgatcgtgaccgacaaggagaaacctgttaacatagaggctgagccaccattcggagagagttacattgtcatcggggctggcgagaaagcgcttaagctcagttggttcaagaaaggatcgtccatcggcaagatgttcgaggcaactgcgcgcggcgcccgccgcatggccatcctaggcgacaccgcgtgggacttcggatccatcggcggcgtttttaccagcgtcgggaaactggtgcaccagatcttcggcaccgcctacggggtgctgttcagtggcgtcagctggacgatgaagatcgggattggagtgcttctcacctggctaggcctcaactccaggagcacctccctgagcatgacatgcatcgcggtgggcctcgtcacgctgtacctgggcgtgatggtgcaagccgactccgggtgcgtcatcaactggaagggtcgggaactcaagtgtgggtctggcattttcgttaccaacgaggtgcacacttggacagagcagtacaagttccaggcggacagtccgaaacgcctgtccgcggctatagggaaggcttgggaggaaggggtctgcggaattaggagcgccaccaggctggaaaacatcatgtggaaacaaatctccaacgagctcaaccacatcctcttggagaacgacatgaagtttacagtggtggtcggggacgtggccggcatcctcgcgcaggggaagaaaatgatccggccccagcccatggagtacaaatacagctggaaatcatggggcaaggccaagattattggtgccgacgtccagaacacaaccttcatcatcgacgggcccaacaccccggagtgtcccgacgaccaacgcgcctggaacatatgggaagtcgaggactacggctttggtatcttcacaaccaacatatggctgaagctgagagacagctacacacaggtgtgcgatcaccgtctcatgagtgcagccatcaaggacagcaaggcggttcacgcagacatgggctactggatcgagtcggaaaagaacgaaacctggaaattggcacgtgcgagcttcatcgaggttaagacgtgtatctggcccaagtcccacaccttatggagcaacggcgtgttagagtccgagatgatcatccccaagatctacgggggcccgatcagccaacacaactatcgtcccgggtatttcactcaggccgccggcccctggcacttgggaaaactggagcttgacttcgacctgtgcgagggaactacggtggtcgtggacgagcactgcggaaatcgcgggccgtccttgcggaccactaccgttacgggcaagattatccacgagtggtgttgccggagctgcaccctaccccccttgcgcttcagaggagaggatggctgctggtatggcatggaaatacgccccgtgaaggagaaggaggagaacttggtgaagtccatggtgagcgccgggagcggcgaggtggactcctttagtctcggccttctgtgtatctcgataatgatcgaggaggtgatgcggagccgctggtcccgacggatgctcatgacgggaaccctcgcagtcttcttcctgctcatcatggggcagctgacatggaacgacctgatccgcctctgcatcatggtcggcgccaacgccagcgaccgcatggggatgggcaccacctatttggctctaatggccaccttcaagatgcgcccgatgttcgccgtgggcctcctgttccggcggcttacgagccgggaggtgctcctgctaaccatcgggctatccctggtcgcgtccgtggagctgcccaacagcctcgaggagttgggcgacgggctggcaatgggcatcatgatcctcaagttattaaccgactttcagagccaccaactctgggccaccctactcagcctcacatttatcaagaccaccttctccctgcactacgcctggaagaccatggcgatggtactgagcattgtgtcactgttccccctgtgcctgagcacaacttcccagaagaccacctggttgccagtactgctgggctctttggggtgtaagccgctaacgatgtttcttatcgccgagaacaagatctggggacgccgttcctggcctctcaacgaagggatcatggcggtcggcatcgttagcatactactgagcagcctcctgaagaatgacgtgcccctggccggtccattaatcgccggcgggatgctcattgcctgttacgtcataagcgggtcaagcgccgacctaagcctcgagaaagccgcagaagtgtcctgggaggaggaggccgaacattccggagcgtcccacaacatcctagttgaggtccaggacgatgggacgatgaagatcaaggacgaggagcgcgacgacaccctaaccatcctcctgaaggcgaccctgctcgcggtgtccggcgtgtatccgttaagcatacctgccacgctcttcgtctggtacttctggcagaagaagaaacaacggtccggggtgttatgggacaccccctcaccgccagaggttgaacgcgcggtcctggatgacggcatttacaggataatgcagcgcggcctgctggggcggtcccaggtaggcgtgggggtcttccaggagaacgtcttccacaccatgtggcacgttactcgcggcgcggtcctcatgtatcagggaaagcggctggagcctagctgggccagcgtgaagaaggatctgatcagctatggcgggggctggcggctccagggctcttggaacaccggggaagaggtgcaggtcatcgccgtggagccgggcaaaaatccaaagaacgtgcagaccgcccccgggaccttcaagactcccgagggagaggtcggcgccatagcgctggacttcaaacccgggacgagcggctcccctatagtgaacagagaggggaagatcgtcggcctgtacggtaacggggtggtgactacgtccggcacctacgtcagcgccatcgcccaggctaaagcgtcccaggagggaccgctccccgaaatcgaggacgaggtcttccgcaagcggaacttaacgatcatggacctgcaccccggcagcgggaagacccgacgctatttaccggccatcgtgcgcgaggccattaagcgcaagctgcggacactgatcctcgcacccacacgcgtagtcgcctcggagatggcggaggcccttaaaggcatgcccatccggtaccagacgacggccgtcaaatcggaacacactggcaaagaaattgtagacctaatgtgccacgctaccttcacgatgagactcttgtctcccgtccgagttccaaactacaacatgattatcatggacgaggcccactttaccgaccccagctcaatcgcggcccgcgggtatatcagcacccgggtgggcatgggggaggcggctgccatcttcatgaccgctacgccgcccggatccgtcgaagctttcccgcagtcaaacgctgtgatccaggatgaggaaagggacatccccgagcggtcctggaacagcgggtatgagtggatcaccgacttccctggtaagactgtttggttcgttccctccataaagagtggcaacgatatagctaactgcttgcgcaagaacggaaagcgcgtgatccagctctcccgcaaaactttcgacacggagtaccagaagaccaaaaacaacgactgggactatgtggtcaccacggatatcagcgaaatgggtgcgaatttccgggccgaccgcgtgatcgaccctcgccgctgtctgaagcccgttatactcaaggacgggcccgaacgggtcatcctcgcaggccccatgccggtcacagtagcttcggcagcgcaacgccgagggcgaatcggaaggaaccataacaaagagggagaccagtacatatatatggggcagcccttgaacaatgacgaggaccacgcccattggaccgaggccaagatgcttttggacaacatcaacactcccgaaggcatcatcccagccttgttcgagccggagcgggagaagtccgccgcgatcgatggtgagtaccggctccggggcgaagctcgcaaaacgtttgtggagctaatgcggcgcggggacttgcccgtgtggctgtcctacaaggtggctagcgagggcttccagtacagcgaccggcgttggtgcttcgacggcgagcggaacaaccaggtgctcgaagagaacatggacgtggaaatttggacaaaggagggggagcgcaagaagctgcggccccgctggttagacgcccggacgtactcggatcccctcgccctacgcgagttcaaggagttcgcggcgggccggcgcagcgtctcaggggacctgatcctcgagatcggtaagctcccgcaacacttgactcaacgggcccagaacgccctggacaacttggtgatgctacacaactctgagcagggcggtcgcgcgtaccggcatgccatggaggagctccccgacacgatcgagactcttatgctactagccttgattgccgtcctcaccgggggggtcaccctcttcttcctctccggccgaggactggggaagaccagcatcggactcctgtgcgtgatggcatctagcgttctactctggatggcgagcgtcgagccccactggatcgccgcgtccatcatcctagaattctttctgatggtgctcctgattccagagccggaccgccagaggactccccaagataaccaactggcctatgtggtcatcgggctccttttcatgatcctaacggtggccgctaacgagatggggctcctggagaccaccaagaaagacctggggatcggtcacgtggcagtcgagaaccaccaccacgccgcaatgctagacgtagaccttcaccccgcctccgcttggaccctgtacgccgtggccacgacgatcatcaccccgatgatgcgccataccatcgaaaacacgaccgccaacatcagcttgaccgccattgcgaatcaagccgcaatactgatgggtctggacaaaggctggcccatatctaaaatggacatgggcgttcccctccttgccctcggttgctactcacaggtgaaccctctcaccctgacggcggccgttctcatgctagtcgcccactacgcaatcatcggcccgggattgcaggccaaggcgacacgtgaagcccagaagcgcactgccgccggcatcatgaagaaccccacggtagacgggattgtggccatcgacctggatcccgtcgtgtacgatgcaaaattcgagaagcaactcgggcagatcatgctgcttatcctatgcacgagtcaaatcctgctgatgcggacgacttgggcactctgcgaatcgatcacgctagccacaggccctctcaccaccttgtgggagggctcgccgggaaagttctggaacaccaccatcgcagttagcatggccaacatctttcgtgggtcctatctggcgggggccggcctggctttttccctgatgaagtccctcgggggtgggcggcgcgggaccggggcccaaggcgagacattgggcgagaagtggaagaggcagctcaatcaactgtccaagagcgagttcaacacctataagcgctccgggataatggaggtggacaggtcagaggcgaaggagggcctgaagcggggggagacgaccaagcacgcagtgtcacggggcaccgccaagctccgctggttcgtagaaagaaatctggtcaagcccgaggggaaagtcatcgacctgggctgtggccgcggaggttggagctactactgcgccggtcttaagaaagtcaccgaggtaaaggggtacactaagggcggacccggccacgaagaaccaatcccgatggctacttacggctggaatcttgtgaagctgcactccggcaaggacgtgttcttcatcccgcccgagaagtgcgatacccttctctgcgacattggcgagagctcccccaaccccaccatcgaagagggacggactttacgggtcctgaagatggttgaaccatggctccgggggaaccagttctgtatcaagatccttaacccctacatgccaagcgtggtggagactcttgagcagatgcagcgcaagcacggtggtatgcttgtgagaaacccgctgtcccgcaacagtacccatgagatgtactgggtgtcctgcgggaccggcaacattgtcagcgcggtgaacatgacctcgcgtatgctgttgaacaggttcacgatggcccacaggaaaccaacctacgagcgagatgtggacctgggcgcgggcaccaggcacgtcgcggtcgaacctgaggtggccaatctggatatcatcggccaaagaatcgagaatatcaagcacgagcataagtctacctggcactacgacgaggacaacccctacaagacgtgggcctatcacggatcgtacgaggtcaagccgagcggatccgcaagtagcatggtgaacggggtcgtgaagctcctaaccaaaccctgggacgtgatccccatggttacccaaatcgcaatgaccgacacgacccccttcggccagcagagggtgttcaaggagaaggtggacacccggaccccgaaggcaaagcgcggtacggcacagataatggaggtcaccgcaaaatggctgtggggattcctcagtcggaacaagaaaccccgcatctgcacccgggaggagtttaccagaaaggtgcggagcaacgccgccatcggcgcggtgttcgttgacgagaaccagtggaattctgcgaaggaggccgtggaggacgaacgcttctgggacctggtgcatcgggagcgtgagctacacaagcagggtaagtgcgccacgtgcgtctataacatgatgggcaagagagagaagaagctcggggagttcggcaaagccaaggggtcacgagcgatctggtacatgtggctgggggcgcggtttctggaattcgaggccctcggctttatgaatgaggatcattggttcagtcgcgagaattcactttcaggggttgaaggcgaggggctgcacaagttgggctatatactacgggacatcagtaagataccggggggcaatatgtacgccgacgacaccgccgggtgggacacccggatcaccgaggacgacctgcagaatgaggcccgcatcacggacatcatggaaccggagcacgcgcttctggccaagagcatattcaagctgacataccagaacaaggttgtccgggtgcagcgccctgccaagaacgggaccgtcatggacgtgatcagccgccgcgatcagcggggcagcggacaggtggggacctatggattgaacaccttcactaatatggaagcccagcttattcgtcagatggagagcgaggggatcttctccccctctgagctggagacacccaacttggctgagcgcgtgctggactggctggaaaagtacggagtcgaaaggctcaagcggatggcaataagtggcgacgactgcgtagtgaagccgatcgacgacagattcgccaccgccctgacggcccttaacgacatgggcaaggtgcggaaagacatcccccagtgggaaccatcgaaagggtggaacgactggcagcaggttccattctgctcgcatcacttccaccagctcattatgaaggatggcagggaaatcgtggtcccgtgtaggaaccaggacgagctagtgggccgtgcacgggtttcccagggagctggctggagcctgcgcgagactgcatgcctagggaagtcctacgcccagatgtggcagctgatgtacttccatcggagagacctgcggctcgccgcgaacgccatctgtagcgccgtccccgtggattggatccctacatcccgaaccacgtggtccattcacgcccaccaccaatggatgacgaccgaagacatgctctccgtctggaaccgcgtctggatagaggagaatccgtggatggaggacaaaacccacatcagctcctggggggacgtgccgtacctggggaaacgggaggatcagtggtgtggcagcctgatcggactgacggcccgcgccacctgggccaccaacatccaagtggccatcaaccaggtgcggcgcctgatcgggaacgagaactacttagactacatgacctcgatgaagcgcttcaagaacgaaagcgatcccgagggcgctctgtggtga

SEQ ID NO: 24209 - RNA, 9879 nt, synthetic construct
  misc_feature 1..9879: note = derived and/or modified CDS sequence (opt11) from DENV-1__FJ461328__SS-prME
  source 1..9879: mol_type = other RNA
agcgtgacaatgctgctgatgctgatgccaaccgccctggccttccacctcaccacccggggcggcgagccgcatatgatcgtctctaagcaggagcggggcaagagcctgctgttcaagaccagcgccggagttaacatgtgcaccctcatcgctatggacttaggtgagctctgcgaagacacaatgacctataagtgccccagaattaccgaagccgaaccggacgatgtagactgctggtgcaacgccacggatacgtgggtcacgtatgggacctgctctcagacgggcgaacaccgacgtgaaaagcggtccgtagccctcgcgccccacgtcggcctggggctggagacccggaccgagacctggatgagctccgagggcgcctggaagcagatccagcgcgtcgagacctgggccctccgccaccccgggttcaccgtgatcgctttattcctcgcgcatgcgatcggcacaagcatcacacagaagggcatcatcttcatcctcctgatgcttgttacgccatctatggccatgcggtgcgtcggcatcggctcacgcgactttgtggaggggctcagtggcgccacgtgggtggatgtcgtgttggagcacgggtcatgcgtgaccactatggccaaggacaagccgaccctggacatagaactcctgaagacggaggtcactaatcctgcggtgctacgaaagctctgcatcgaggccaagatttccaacaccaccactgacagccgctgtccgacccagggcgaggccaccctggtggaagagcaggacgccaacttcgtatgcaggcgtaccttcgtggaccggggctggggtaatggctgcggactgttcggcaagggctccctcctgacgtgcgccaagttcaagtgcgtgaccaagctggagggcaagatcgtccagtacgagaacctcaagtacagcgtcatcgtgacggtccacaccggcgaccagcaccaagttgggaacgagtccacggagcacggcaccacggcgaccataacgccccaagcccccacaaccgaaatccagctgacggactacggggccctgaccttggactgctcaccccgcacgggcttggacttcaacgagatggtcctgctcacgatgaaggagaagtcctggctggtgcataagcagtggtttctggaccttcctctgccctggacctctggggccagcacctcccaggagacgtggaaccggcaagatctgctcgtgactttcaagaccgcccacgccaagaagcaggaggtcgtggtgctgggctcacaggagggcgccatgcacaccgccctgacgggggccaccgagatccagacctcaggcaccacgacaatcttcgcagggcacttaaaatgccgcctaaagatggataagctgacgcttaagggcatgagctacgtcatgtgcaccgggtcctttaagctggaaaaggaggtagcggagacacagcacggcaccgtgctagtccagatcaagtacgaaggcaccgacgccccctgcaagatacccttcagcacccaggacgagaagggggtgacacagaacggccggctgatcaccgccaacccgatcgtgaccgacaaggagaagcccgtcaacatcgaggccgagccccccttcggtgaatcctacatcgtaatcggcgcgggtgagaaggccctcaagctgtcgtggttcaagaaggggtccagcatcggcaagatgttcgaggccaccgcccgaggggcccggcgcatggcgattctgggcgacacggcatgggatttcgggtcaatcggcggcgtgttcaccagcgtcgggaagctcgtgcaccagatatttggcaccgcctacggggtgttattctccggagttagctggaccatgaagatcgggatcggcgtgctgttgacttggctggggctcaactcccgtagcaccagtctctcaatgacctgcatcgccgtggggcttgtcactctgtatctcggcgtgatggtgcaggccgattccgggtgcgtcatcaactggaaaggcagagagctgaaatgtgggagcggcatcttcgttacgaatgaagtgcacacctggaccgagcagtacaagttccaagcagactctccgaagcgcctgtccgccgcgattggcaaggcttgggaggagggggtctgcggcatacggtcagccacacgcctggagaacatcatgtggaagcagatctccaacgagcttaaccacatactgctcgaaaacgacatgaagttcaccgtggtggtcggcgatgtggcgggcatccttgtgcaggggaagaagatgatccggccccagcccatggagtataagtatagctggaaatcctggggcaaggccaagatcatcggcgcggacgtacaaaacagcacgttcatcattgacgggccgaataccccggagtgcccggacgatcagcgcgcctggaacatctgggaggtggaggattacggcttcgggatattcaccactaatatatggctgaagctacgagactcctacacccaggtgtgcgaccatcgcctgatgagcgcagccatcaaggactccaaagccgtccatgccgacatggggtactggatcgagagtgagaagaacgagacatggaagctggcgcgggcgtcctttatcgaggtgaagacctgcatatggccgaaatcgcacaccttgtggtccaacggcgttctggagagcgagatgataatccccaagatccacgggggaccgatctcacagcacaactaccgccctgggtatttcacgcagaccgccggcccctggcacctgggaaagctggagctcgacttcgacctgtgtgaggggaccaccgtcgtcgtggatgagcactgcggtaaccggggtccaagccttcgcacgaccaccgtaaccggcaagatcatccatgagtggtgctgtcggtcctgcacgctgccgcccctgcgcttccgcggtgaggatggctgctggtatgggatggagattcgccccgtgaaggagaaggaggagaacctcgtcaagtcgatggttagcgccggcagtggggaggtggacagcttctcactggggctactatgcatcagtattatgatcgaggaggttatgcggtcccgatggagccggaagatgcttatgaccgggaccctggcggtcttcttcctcttaataatgggacagttgacctggaacgacctcatacgcttatgtataatggtgggagctaacgcctctgaccgcatgggtatgggcacgacctacctggccctaatggccacctttaagatgcggccgatgttcgcggtgggcctgttattccgccgactcacctcccgcgaggtactgttgctcacgatcgggctgagtctagtggcaagcgtcgagctccctaactccctggaggagttaggggacgggctcgcgatgggtatcatgatcctgaagctgctcaccgatttccagagctaccagctgtgggccaccctgttaagccttaccttcatcaagacgaccttcagcctgcactacgcgtggaaaacaatggcgatggttctcagtattgtgagcttattcccactgtgcctcagcaccacgagccagaagaccacgtggctgcccgtgctgctcggctccttggggtgcaagccgctaaccatgttcttaatagcagagaacaagatctggggccgcaagtcatggcccctgaacgagggcatcatggccgtgggcatagtgagcatcttactctcctcactgttgaagaatgacgtccccctcgccgggcccctgatcgcagggggcatgctaattgcatgctacgtgatatccgggtcctccgcggacctcagcctggagaaggccgccgaagtgtcctgggaggaggaagccgagcacagtggcgcctcgcacaacatactggttgaggttcaggacgacggaacgatgaaaatcaaggacgaggaaagggacgataccctcacaatcctgctaaaggcgacgctcctggcggtgagcggcgtctacccgctgtccatccccgccacattgtttgtgtggcacttctggcagaagaagaaacagcggagcggggtgttgtgggacacccccagcccgcccgaggttgaacgcgctgtgctggacgacggcatctaccggatcatgcagcgcggcctgctcgggcggagccaagtgggcgtcggggtgttccaggagaacgtgttccacaccatgtggcacgttacccggggcgctgtgttaatgtaccaggggaagcggctagagccttcctgggcaagcgtaaagaaggacctcatatcgtatggcggagggtggcgcttccagggctcgtggaatacaggggaggaagtccaggtgatcgctgtggagccaggcaaaaatcctaagaacgtccagaccgcccccggaaccttcaaaacccccgagggtgaggtgggcgccatcgccttggactttaaacccgggaccagtggctctcccatcgtgaaccgggaggggaaaatcgtcgggctgtacggcaatggggtggtgacgaccagcggcacctacgtctccgcgatcgcacaggccaaggcgagccaggaggggccgctccccgagatcgaggatgaggtcttccgcaagcggaacctgaccatcatggacctgcaccccggctccggcaagacgcgccggtacctcccggcgatcgtgcgcgaggccataaaacggaagctgcgcaccctaatcttggcgcccacccgcgtcgtggcaagcgagatggccgaggctctaaagggcatgcctattcggtaccagaccacggccgtgaagagcgagcataccggcaaggagatcgttgatttgatgtgccacgcaaccttcaccatgagacttctgagccccgtgagggtcccgaattataacatgatcattatggacgaggcccactttaccgacccctccagcatcgccgcgcgcgggtacatctccacccgggtcgggatgggagaggcagcggccatcttcatgacggccacaccgcccggcagcatggaggccttcccgcaatccaacgccgtgatccaggacgaggagcgcgacatccccgagcggagctggaactccgggtacgagtggatcacggacttccccggcaagaccgtgtggttcgtcccctcgatcaaggccggcaacgacattgccaactgcctgaggaagaacgggaagcgagtgatccagctctcccgcaagactttcgacaccgagtatcagaaaacgaagaacaacgactgggactacgtggtcactaccgacatctctgagatgggcgcgaatttccgggcagaccgcgtaattgacccgcggcgctgcctgaagcccgtaatcctgaaggatggccctgagcgggtcatcctcgcgggccccatgccggtcaccgtcgcctccgcggcgcaacgccgggggcgcatcggcagaaaccataacaaggagggtgatcagtacatctacatggggcagcccttgaataacgacgaggatcacgcccactggacggaagcgaagatgttgttagacaacatcaacacccccgagggtatcattcccgctcttttcgaaccggagagagagaaatccgccgcaatcgacggggagtaccggctacggggcgaagcacgcaaaacgtttgtagagctcatgcggcgcggggacctgcctgtgtggcttagctacaaagtcgccagcgagggcttccagtacagcgatcggaggtggtgcttcgacggcgagcggaacaaccaggtgttggaagaaaacatggatgtggagatctggaccaaggagggcgagcgcaagaagctgcggccccgatggctagacgcccggacatactccgatccattagccctgcgcgaattcaaagaattcgcggccgggcggcgcagcgtctcgggcgatctgatcctcgagataggcaagctgccgcaacacctgacccaacgggcccagaacgccctcgacaatctggtgatgctgcacaacagcgagcaaggcggtcgcgcttaccggcacgcaatggaggagctcccagacaccatagagaccctgatgttactcgcgctgatcgccgttctgaccgggggggtcaccctcttcttcctttctggcaaggggctgggcaagaccagcattggcctcctctgtgttatggcctccagcgtgctgctgtggatggcgtccgttgagccccattggatcgccgccagcatcatcctggaatttttcctgatggtgctcctgatccccgagcccgaccgccagcggacgccccaagacaaccagttagcatacgtggtcatagggctcctgtttatgatcctgaccgtggccgcgaacgagatggggctgctagagaccaccaaaaaggatctggggatcggccatgtggccgtcgagaaccaccaccacgccgcaatgctcgacgtggatctgcacccggcctccgcgtggaccctgtacgcagttgccaccacgatcatcaccccgatgatgagacacaccattgagaatacaacagccaacatcagcctcacagcgatcgcaaaccaggccgctatactgatgggtctggacaagggctggcccataagtaagatggatataggcgtccccctcctggcactggggtgctacagccaggtgaaccccctcaccctaaccgcggccgtgctgatgctcgtcgcccactacgccattatcggcccggggctacaggccaaggcgactcgggaggcccagaagcgcaccgccgccggcatcatgaaaaacccgaccatcgacggaattgtggccatagacctggatccagtggtttatgacgcgaagttcgagaagcagctcggccagatcatgttgctaatcctctgcacctcccagatcctgttaatgcgcaccacctgggccctatgcgaaagcatcactctggccaccggccccctgacgacgctctgggaggggagccctggcaaattctggaacaccaccatcgccgtgagtatggccaacatcttcagagggtcctacctggcaggcgccggactggcattcagcctcatgaagtccctcgggggcgggagacgggggacaggggcccagggggagacccttggagaaaagtggaagcgccagctcaatcagctgtctaagagcgagttcaacacatacaagcgtagcgggatcatggaggttgatcgcagcgaggcgaaagagggcctgaagcgcggcgagacgacgaagcacgccgtctcccgcggaacggccaagctccgctggttcgtggagaggaacctggtaaagcccgaggggaaagttatcgacctgggctgcggccgcgggggctggtcctattactgcgccgggctgaagaaggtgacggaagtgaaggggtatacaaaaggtggccccggacatgaagagcccatcccaatggccacgtacgggtggaacctcgtcaagcttcactccggaaaggacgttttcttcattcctcccgagaagtgtgataccctcctctgcgatatcggtgagagctcacccaaccctaccatcgaggagggtagaaccctgcgggtactgaaaatggtagaaccctggctccgcgggaaccaattttgcatcaagatactgaacccgtacatgcccagcgtggttgagacactggagcagatgcagcggaagcacggcggcatgctcgttcgcaacccgctctcccggaacagcacccacgaaatgtactgggtgtcgtgcggtactggcaacatcgtatccgcggtcaacatgacctcccgtatgctgctcaataggttcacgatggcccaccgcaagcccacttacgagcgcgacgtggaccttggggccggcacgcgacatgttgctgtcgagcccgaggtggcaaacctggatataatcggccagcgaattgaaaatatcaagcacgagcataagagcacttggcactacgacgaggacaacccctacaagacttgggcctaccacgggtcctatgaggtgaagccgtctggcagtgcaagcagcatggtcaacggtgtggttaagctccttaccaagccatgggacgttataccgatggtgacccagattgcgatgaccgataccacccccttcggccagcagcgggtattcaaagagaaggtagacaccaggaccccaaaggccaagcgcggtaccgcgcagatcatggaggtgacggcgcgctggttgtgggggttcctttcccggaacaagaaaccccgcatctgcactcgagaggagttcacccgcaaggtccggagcaacgccgccataggcgccgtattcgtggacgagaatcagtggaattccgcaaaggaagccgtcgaggacgaccgcttctgggacctggtgcaccgggagcgcgagcttcataagcaggggaaatgcgcgacctgcgtgtataacatgatgggcaagcgggaaaagaagctcggggagtttggcaaagccaaggggagtcgcgccatctggtatatgtggctgggcgctcggttcctcgagttcgaggccctcggcttcatgaacgaggaccactggttctcaagagagaatagcctctccggtgtggagggcgaggggctgcacaagctaggttacatactgcgggacatcagcaagataccggggggcaatatgtacgccgatgacacggccggctgggacacccgcatcaccgaagacgacctgcagaacgaggccaagataaccgacatcatggagccggaacacgctctgcttgccaaaagcattttcaaacttacgtaccagaacaaagtggtccgggtccaacgacctgccaagaacggtaccgtgatggacgtgatcagccgacgggaccagcgcgggtccgggcaagtcggcacctacggcctcaacacgttcacgaacatggaggctcagctgatccggcagatggagtcggaggggatctttctacccaacgagctcgagacccccaacctggccggaagggtgctggactggctcgaaaagtacggtgtggagcggctgaagcgcatggcgatctccggagacgactgcgtcgtaaagcccatagatgaccggttcgccaccgccctgacagccctcaacgacatgggaaaggtgcgcaaggacattccccagtgggagcccagcaagggctggaacgattggcagcaggtccccttctgcagccatcacttccaccagctgattatgaaagatggccgagaaatcgtggtcccgtgtaggaaccaagacgagctggtcgggagggctcgagtatcgcaaggcgccgggtggtccctccgggagacggcctgccttggcaagagctacgcccaaatgtggcagctgatgtacttccaccgaagagacctccgtttagcggccaacgccatatgtagcgccgttcccgtcgattgggtgcccacctcccggaccacctggagcatccacgctcaccatcagtggatgacgaccgaggatatgctgtccgtgtggaaccgcgtctggatcgaagagaacccctggatggaggacaaaacccgtatctcctcctgggaggacgtgccctatctcgggaagcgcgaggatcaatggtgcggtagcctgataggcctgactgcgcgggcgacgtgggcgaccaacatccaagtcgccatcaaccaagttcggcgactcatcggcaacgagaactattccgattacatgaccagcatgaagagattcaagaatgagagtgagcccgagggcgccttgtggtaa

SEQ ID NO: 24210 - RNA, 9879 nt, synthetic construct
  misc_feature 1..9879: note = derived and/or modified CDS sequence (opt11) from DENV-1__FJ410234__SS-prME
  source 1..9879: mol_type = other RNA
agcgtcactatgctgctcatgttaatgcccaccgcgctggcatttcatttaaccacccgcggcggggagccccacatgatagtctcgaagcaggagaggggcaaaagcctgttgtttaaaacaagtgcgggcgtgaacatgtgcacgctcattgcgatggacctgggcgagctctgcgaggacactatgacctacaaatgccccaggataacggaggccgagccggacgatgtggactgctggtgcaatgccaccgacacctgggtgacctatggcacgtgctcccagaccggtgagcacagacgggacaagagatccgtggccctcgcaccccatgtaggtcttgggctcgagactcgcacggagacctggatgagctccgagggagcctggaagcagatccagagagtcgagacgtgggctctccgccaccccggattcactgtgatcgcgctatttttggcccacgccatcggaaccagcataacccagaaagggatcatctttatcctcctgatgcttgtgaccccaagcatggccatgcggtgcgtcgggatagggtcgcgtgattttgtggaagggctatcaggcgccacgtgggtggacgtagttcttgaacacgggagctgtgtgactactatggccaaagacaagcccaccctggacatcgagctcctgaagaccgaggtcaccaaccccgctgtgctgcgcaagctctgcattgaagccaaaatttccaacaccacgacggactctcgctgcccgacccaaggcgaggccacacttgtagaggaacaagacgcaaacttcgtatgcagacgcacattcgtcgaccgaggctgggggaacggttgtgggctgtttgggaaggggtccctcatcacgtgcgccaagttcaagtgtgtgaccaagctggagggcaagatcgtccagtatgagaacttgaagtacagcgtgattgtgaccgtccacaccggggatcaacaccaggtggggaacgagtccacggagcatggcacgaccgcgaccataactccccaagccccaaccaccgagatccaactcaccgactacggtgcactgacactggactgcagcccccgcacgggtctcgacttcaacgagatggtcttactaaccatgaaagaaaaatcctggctcgtgcacaagcaatggttcttggatctgccgctcccctggacaagcggggcgtcgacatcccaggagacttggaaccggcaggacctgctggtcaccttcaagaccgcacacgccaaaaagcaagaagtcgtggtgctcggcagccaagagggtgccatgcacaccgcactaacgggagcgacggaaatacagacatccgggacgacaaccatcttcgctgggcacctgaagtgtagattaaagatggacaagctgaccctgaaaggcatgagctacgttatgtgcaccgggtccttcaagctcgagaaggaagtggctgaaactcagcacggcaccgtgctggtccagattaaatacgagggtaccgatgccccttgtaagatccccttcagcacccaagacgagaagggggtgacccagaacggccggttaataacagccaacccgatcgtgaccgacaaggagaagccggtcaacatcgaggccgagccgcccttcggggagtcgtatattgtcatcggcgccggcgagaaggccctgaagctctcatggttcaagaaaggttcatccatcggcaaaatgtttgaggccactgcgcgtggggcccggcgcatggcgatcctgggagacacagcctgggacttcgggagcatcggaggtgtgttcacgtcggttggaaagctggttcaccagatcttcggcacagcctacggggttctcttctccggtgtcagctggacgatgaagatcggcatcggcgttctgttaacttggctcggcctaaactcccgcagcacctcccttagcatgacctgtatcgcagtgggtttggtgaccctgtacctgggcgtgatggtgcaggccgactccggttgcgtaatcaactggaagggccgggagttgaagtgcgggagcggaatattcgtgaccaatgaggtgcacacctggaccgagcagtataagttccaagcggattcgcctaagcgcctgtccgctgcaatcggaaaagcatgggaggagggggtctgcggcatccgaagcgctaccaggctggagaatataatgtggaagcagatcagcaatgagctgaaccacatcctcctggagaacgacatgaagctaaccgtggtggtcggggatgtggctgggatcctagggcagggcaagaaaatgatcaggccacagccaatggagtacaaatacagttggaagtcctggggaaaggcgaaaatcataggcgccgacgcccagaacaccaccttcatcatcgacggcccaaacacaccggaatgccccgatgaccagcgggcgtggaacatctgggaggtggaggactatggcttcggtattttcaccacgaatatctggttgaagctccgggacagctacacccaggtctgcgaccaccggctaatgtccgccgccataaaagatagtaaggccgtgcacgccgacatggggtactggatcgagtcagagaaaaacgagacctggaagttggcccgagcctcttttatcgaagttaagacctgtatttggcctaagtcccacacgttgtggagcaacggggtattagagtccgagatgatcatccctaaaatctatggcgggccgatcagccaacataactaccggcccggctactttacccaaaccgcaggaccctggcatcttggcaaactcgagttggacttcgacctgtgcgagggcaccacggtggtggtcgatgagcactgtggtaaccgagggccgtccctccgcacgacaaccgtgacgggcaagataatccacgaatggtgctgccgttcatgtaccttacctcccctaaggttccggggcgaggacggttgctggtacggcatggaaattcgccccgtgaaggagaaggaggagaatctcgtcaagtccatggtgtcagccgggagcggggaggtggactcattttcattaggcttgctatgcatatccatcatgattgaggaagtgatgcggtcgcgctggagtcggaagatgctgatgaccgggaccctggccgtattctttctcctaatcatgggccagctgacatggaacgacctcatccgcctctgcatcatggtgggggctaacgccagcgatcgcatgggcatgggcaccacctacttggccctgatggccaccttcaagatgcgcccgatgttcgccgtcgggctactcttccggcggctcacgtcgcgcgaggtgcttttgcttaccatcggcttatcattagtagcgtccgtcgaactccctagttcgctggaggagctgggggacggcctcgccatgggcattatgatcctgaagttactcacggacttccaaagccatcagttgtgggccaccctgctaagtcttacattcatcaagacggccttcagccttcattacgcgtggaaaacaatggccatggtgctctccatcgtcagcctgttccccctgtgcctctccacgacctcccaaaagaccacttggctgcccgtcctgctcggctccctgggctgcaaaccgttaaccatgttcctcatcgcagaaaacaagatatgggggagaaagtcctggcccctgaacgaaggaatcatggccgtcgggatcgtctctatactgctttcgagcttgctgaagaacgacgtgcctctcgcaggcccgttgatcgcaggcgggatgctgattgcctgttacgtcatttcagggagctccgcagacctcagcctggaaaaggccgccgaagtcagttgggaggaggaggcggagcactctggcgcctcccataacatcttagtggaagtgcaggacgatgggaccatgaagatcaaggatgaggaacgcgacgataccctcaccatcctgcttaaggcgacactcctggccgtctccggagtctacccgctatccatccctgccaccctcttcgtgtggtatttctggcagaagaagaaacagcgtagcggtgtactgtgggacacgccgagcccgcctgaggtcgagcgcgcggtgctagatgacggcatctaccggatcatgcagcgcggtctgttaggccggagccaggtcggcgtaggcgtgttccaggagaacgtgttccacaccatgtggcacgttacccgcggggcggtgctgatgtaccagggcaagcgacttgagccctcttgggccagcgtaaagaaggaccttatttcttacggcgggggatggcgcctgcggggtagctggaacactggcgaggaagttcaagtgatcgccgtcgagcccgggaagaaccccaagaacgtgcagacggcacccggcacgttcaagacacccgagggagaggttggggcgatcgccctggacttcaagcccggcacctccgggtctcccatcgtcaaccgagagggcaagatcgtaggcctctacgggaacggcgtggtgacgacgtcggggacttacgtttccgccatcgcacaggccaaggcctcacaggagggtccgctgcccgaaatcgaagacgaagtgttccgaaagcgcaacctgaccatcatggatctccacccagggtccgggaagacacgtcgctacctgccagcaatcgtacgggaggccatcaagcgcaaacttcgaaccctcatcctagccccaacccgggtagttgcctcagagatggcagaagccctgaaaggcatgcccatacgttaccagaccacggccgtaaagagtgagcacactgggaaggaaatcgtggacctcatgtgccacgccaccttcaccatgcggctgctgagccccgtccgcgtcccaaactataacatgatcattatggacgaagcgcacttcacggatccctccagcatagccgcccgagggtatatctccactcgagtgggaatgggcgaggcggccgcgatattcatgaccgctacgccgcccgggagtgtggaggccttcccgcaatccaacgccgtcatacaggatgaggagagagacatccccgagcgctcttggaactccggctacgagtggatcacggatttccccggcaagaccgtgtggttcgtgccctctatcaagtccggtaacgacatcgcgaactgcttgaggaagaatggcaagcgagtcattcagctgtcgaggaagacgttcgacaccgagtaccagaagacgaagaacaacgactgggactatgtagtgaccaccgacatcagtgaaatgggggcaaacttccgcgccgaccgggtcattgacccaagacggtgcctgaagcccgtaatactaaaagatgggccggaacgggtaatacttgctgggcccatgccggttaccgtggccagcgcggcgcagcgacgcggcagaattggacgaaaccataacaaggagggtgaccaatacatctatatgggccagcccctgaacaacgacgaagaccacgcacattggacggaggccaaaatgctcctcgataacataaacacacccgaggggataatcccagccctttttgaaccagagcgcgaaaagagtgctgccgtcgacggcgaataccggctccgcggtgaggccaggaaaaccttcgtagagctgatgcgcaggggcgaccttcctgtgtggctcagctacaaagtcgccagcgaaggcttccagtattccgaccgtcggtggtgcttcgacggggagcgcaacaatcaggtgctggaggagaacatggacgtggagatctggacgaaggagggcgagagaaagaagctgcgcccccggtggctcgacgcccgcacgtacagcgacccgttagcactgcgagagttcaaggagttcgccgcagggaggagaagcgtgagcggggacctcatcctcgagataggcaagctgccgcagcacctcacccaacgcgcacagaatgcgctagacaacctggtgatgctccataactctgaacaaggcgggcgggcctaccgtcacgccatggaggagctgcccgataccatcgagaccctgatgctcttggccttgatagctgtgctcactggcggcgtcaccctgttctttctgagcgggcgtggcctcggcaagacctcaattggcctgctgtgcgtaatggcgagttcagtgttgctgtggatggccagtgtagaaccccactggatcgcggcctccatcatcctcgagtttttcctcatggtactgctaatccctgaaccggaccgtcagcgtaccccacaggataatcaattggcgtacgtggtcatcgggctgctgtttatgatcctcaccgtggccgccaacgaaatgggactcctggagacaaccaagaaggacctaggcatcgggcatgtcgccgtcgagaaccaccaccacgccgccatgctggatgtggaccttcatcccgcgagtgcctggaccctatacgctgtggcgaccacgatcataaccccgatgatgagacacaccatcgagaacaccacagcaaatatctccctcaccgctatcgctaaccaggccgcgattcttatgggcctagacaagggctggccgatatccaagatggatataggggtcccccttttggcgctcggttgctatagtcaggtaaacccactgaccctgactgccgcagtactcatgctggtcgcgcactacgcgatcatcgggccgggcctgcaggcgaaggccactcgagaggcccagaagcgtactgccgccggtatcatgaaaaaccccaccgtagatggcatagttgcgatcgacctcgacccggtagtgtacgacgccaaatttgagaaacagctgggccagatcatgttactcatactatgtactagccagatcctgctgatgaggacgacatgggccctttgcgaatccattacgctggcgaccgggccactcactactctgtgggaggggagcccggggaaattctggaacaccacgatcgccgtgtcgatggctaatattttccggggcagctacctggcgggcgcagggctcgccttctcgctgatgaagagtctcggcggaggccgccgggggaccggcgctcaaggcgagacattgggggaaaagtggaagcggcagctgaatcagctcagcaagagtgagtttaatacctataagcggtccgggataatggaggtggaccggtccgaagcgaaggaaggactgaagcggggcgagaccaccaaacatgcggtgtccagaggaaccgccaagctccgctggttcgtggagcgcaatctggtaaagccagagggaaaggtgatagacctgggctgcggtcggggcggttggtcctactactgcgcaggcctaaagaaggtgactgaagtcaaggggtacactaagggcggccccgggcatgaggagcccatcccgatggcgacgtacggatggaacctggtaaagctacacagcgggaaggacgtgttctttatcccgcccgagaaatgcgacaccctcttgtgcgacatcggcgagagcagcccgaatccgacgatcgaggaggggcgtacgctaagagtcctcaaaatggtggagccctggctgcgcggcaaccagttttgcattaagatcttgaacccgtacatgccttccgttgttgagactttagagcaaatgcaaaggaagcatggagggatgctggtgcgaaacccgctcagccggaactccactcacgagatgtactgggtgagctgcggtacagggaacatcgtatccgcagtgaacatgacgagccgcatgttgctgaacagattcacaatggctcaccggaaaccgacgtacgaacgcgacgtagacctggggaccggcacccgccacgtcgcagtagagcccgaggtcgccaacttagatataatcgggcagcgcatcgagaacataaagcacgagcacaagagtacatggcactacgatgaggacaacccttacaagacgtgggcgtaccacggctcgtatgaggtcaagccgtctggttcagccagctccatggtgaatggcgtcgtgaaacttctcaccaaaccctgggacgtgatccccatggtaacccagatcgccatgaccgatacgacgccattcggacagcagcgcgtgttcaaggagaaggttgacactagaaccccgaaggcaaaaagaggcacagcccagatcatggaagtcaccgcgcgctggttgtggggcttcctgtcgcggaataaaaagccccggatctgcactcgggaggagttcactcgcaaagtacgctccaacgccgccatcggtgctgtatttgtcgacgagaaccagtggaacagcgcgaaggaggccgttgaggacgaacgattctgggacctggtgcaccgagaacgtgagctacataaacagggtaaatgcgcaacctgcgtctacaacatgatgggcaagcgcgagaagaagctgggcgagttcgggaaggccaaaggctcccgcgcgatctggtatatgtggttgggtgcgcgtttcctcgagttcgaggcactggggttcatgaacgaggaccactggttcagccgcgaaaatagcctgagcggcgtggagggggagggcctccacaaattaggatatatcctgcgggatatttccaaaatccccgggggcaacatgtacgccgatgacacagccggttgggacacccgcatcactgaggacgacctccaaaacgaggccaagataacggacatcatggagccggagcatgcgctccttgccaaggccatcttcaagctcacctaccagaacaaagttgtacgcgtccagaggcctgccaagaatgggacggtgatggacgtcatcagccgccgggaccagcgcgggtccggtcaggtgggcacctacgggctgaacactttcaccaatatggaggcgcagctaatccggcagatggagtctgagggcattttctccccaagcgagctcgaaacccccaatctggcggagcgtgccctggactggctagagaagtacggggtggaacggctgaagcgcatggccatctccggggacgattgcgtcgtcaagccgatcgatgaccggtttgccactgcactgacggcgttgaacgacatggggaaggtgcggaaggacatcccccagtgggagccctccaagggatggaacgactggcagcaggtccctttttgctcgcaccacttccatcagctgatcatgaaggatggccgggagatcgtcgtgccatgccgcaatcaggacgagctggttgggcgagcccgcgtgagccagggcgcggggtggagtctccgggagacggcgtgcctgggcaagagttacgcgcaaatgtggcagctgatgtactttcacaggcgggacctgcgcttagcagccaacgcgatctgttcagccgtcccagttgactgggtgcccacctcccgaaccacgtggtctatccatgcacaccaccagtggatgaccaccgaggacatgctctccgtatggaaccgcgtgtggatcgaggagaacccgtggatggaggacaagacacacatttcttcctgggaagacgtgccgtacctggggaaacgcgaggaccaatggtgtggcagcctaattggcctgactgctcgggccacttgggccaccaacattcaagtagccataaaccaagtccgccggctcatcggcaacgaaaattacctggactatatgacctccatgaagcgcttcaaaaacgagagcgaccccgagggcgcgttatggtga

SEQ ID NO: 24211 - RNA, 9879 nt, synthetic construct
  misc_feature 1..9879: note = derived and/or modified CDS sequence (opt11) from DENV-1__FJ410235__SS-prME
  source 1..9879: mol_type = other RNA
tctgtgaccatgctgctcatgctgatgccaaccgccctggccttccacctaacgacccgcggcggggagccccacatgattgtgagcaagcaggagaggggcaagtcactgctgttcaagaccagtgcaggggtgaacatgtgcactctcatcgccatggatctcggcgagttctgcgaggacactatgacgtacaagtgtcctcgcataaccgaggcggagccggacgacgtcgactgctggtgcaacgcgactgatacgtgggtgacatacgggacctgttcgcagactggcgagcacaggcgcgacaaaagatccgtggccttggcgcctcacgtgggcctcgggttagagacgcgcacggagacctggatgagctccgagggcgcctggaaacagatccagcgcgtggagacctgggccctgcgacaccccgggtttacggtcatcgcgctctttctggcgcatgccataggcacaagcatcacacagaaggggatcatcttcatcctgctaatgttggtaactccctccatggcaatgcggtgcgtaggcatcggtagccgcgacttcgtggagggtttgtcaggggccacgtgggtggacgtggtgctcgagcacggtagctgcgtgaccaccatggcgaaggacaagcccacgctggacatcgagctgctaaagacggaggtgaccaaccccgcggtgctgcggaagttgtgcatcgaggccaaaatctccaacaccaccacggacagccgctgccccacccaaggagaggccacacttgtggaggaacaggacgctaatttcgtctgccgtcgtaccttcgtggaccggggctggggtaatggctgtgggctgtttggcaaggggtccctgatcacgtgcgccaagttcaagtgcgtgaccaaattggagggtaagaccgtccagtacgagaacctgaaatacagcgtgatcgtgacagtccacacgggtgatcagcatcaggtggggaacgaatcaaccgagcacggaaccaccgctaccatcacgccccaggcgccgagcacggagattcagctgaccgattacggtgccctcaccctggactgtagcccccgaacgggcctggacttcaatgagatggtccttcttacaatgaaggagaagagttggctggtccacaaacagtggtttctggacctgccgctgccctggaccagcggggccagtacaagccaggagacatggaaccggaaggacctcttggtgaccttcaagacggcccacgcgaaaaagcaggaggtcgtggtgctgggctcccaggagggcgccatgcatacagccctcacgggggccaccgaaatccagacctccggtaccacgaccattttcgccggtcatctaaaatgtcgcctaaagatggacaagcttaccctgaagggcatgagttacgtcatgtgcaccgggagcttcaagttggagaaggaggtcgctgagacgcaacacggcaccgtcctcgtccagattaaatacgagggcacagacgccccctgcaagatccccttcagcacccaggacgaaaagggggtgacgcagaacggccgtttaatcacgaccaatcccatcgtgactgacaaagagaagcccgtcaacatcgaggccgaaccacccttcggggagtcgtacatcgtgatcggcgcgggggagaaggcgttaaaactaagctggtttaagaagggttcatccatcgggaagatgttcgaggccacggctcggggtgctcggcgcatggcaatcctcggcgacaccgcgtgggactttgggagcatcggcggcgtattcaccagtgtcgggaaactggtgcaccaaatcttcggaaccgcctacggagtgctatttagcggagtatcctggactatgaagatcgggatcggggtgctcctcacctggctggggctaaacagcagatcaaccagcctgtccatgacgtgcatcgccgtgggtctggttacattatacctaggagttatggtccaggccgacagcgggtgcgtcatcaactggaagggccgggagcttaaatgcgggagcggtatcttcgtgaccaatgaggtccacacatggaccgagcagtacaagtttcaggccgacagtccgaagcgtctctccgctgctataggcaaggcctgggaggagggggtttgcggcatccggtccgccaccaggctggagaatatcatgtggaagcagatctcgaacgaattaaaccacattctcttggagaacgacatgaagtttacggtggtggtcggggacgttgccggtatcctggcgcagggtaagaagatgatcagacctcagcccatggagtacaaatactcctggaagtcctggggcaaagctaagatcataggcgcagacgtccagaacaccacctttatcatcgatgggccaaacaccccagagtgccccgacgaccagagggcttggaacatatgggaggtggaagactacggcttcgggattttcacaacgaacatctggctaaagctgcgggactcatacacccaggtgtgcgaccatcgactgatgagcgcggccatcaaggactccaaggccgtgcatgccgacatggggtactggatcgagagcgagaagaacgagacatggaagctcgcccgggcatcgtttatcgaggtgaaaacttgtatctggccgaagagccacaccttgtggagtaacggcgtacttgagtcagaaatgatcgttccgaaaatctacgggggccctatttcccaacacaactatcgccctgggtacttcacccaaacagctggcccttggcacctcggcaagctggagctggatttcgacctctgcgagggtactaccgtcgtcgtggacgagcattgcggaaaccgggggccgagccttcgcaccacgaccgtgaccggcaaaatcatccacgagtggtgctgtcggtcctgcacactgccgccgctgcgctttaagggggaggacggctgctggtacggaatggagatacggcccgtcaaggagaaggaggagaacttggtcaagagcatggtctctgctggctccggtgaggtggacagtttttccctcggcctgctgtgcatcagcatcatgatcgaagaggttatgcgatccaggtggtcgcgcaaaatgttaatgaccggcacgctggccgtattcttcttgctgatcatggggcagctcacctggaatgacctgatcagactgtgcatcatggtcggcgcaaacgcgtccgaccgaatggggatgggcacaacttatctcgccctgatggctacgttcaaaatgcgccctatgttcgccgtggggctactgttcaggcgcctcacgtccagagaggtcctgctcctgacgatcggactgtctctcgttgccagcgtcgagttaccaaactccctggaggagttgggggacgggttggcgatgggaatcatgatcttaaagctcctgacagattttcagagccaccaactatgggccacgctcctgtcccttaccttcatcaagaccaccttcagtctccactatgcgtggaagaccatggctatggtgctgtccatcgtcagcctgtttcctctctgcctgagcaccaccagccagaagaccacgtggctacctgtactcctgggctccttaggttgcaagccactcaccatgttcctgatcgcggagaataagatctggggccgcaagagttggcccctgaacgaggggatcatggccgtgggaatcgtcagcatactactgtcctcactattgaaaaacgatgttcccttggcaggtcccctaatcgctggcggcatgctcatcgcgtgttacgtgatctccgggagctcggccgacctgtcactggagaaggccgctgaggtaagctgggaagaggaggcagagcacagcggagcctcccacaatatcctagtggaggtccaggatgacgggaccatgaagattaaggacgaggaacgggacgacaccctgaccatactgttgaaggcgacgctgctggcagtctcaggcgtgtacccgctctccattcccgctacactgttcgtgtggtatttctggcagaagaagaagcagcgctctggggtgctctgggacacccccagcccgcccgaagtcgagcgggccgtgctggacgacggcatataccgcatcatgcaaagggggctgctgggccggagccaggtgggcgtgggtgtattccaagagaacgtgttccacaccatgtggcatgttacgcgcggcgccgttctaatgtaccagggaaagcgcctcgagccctcatgggcgagcgtgaagaaggacctgatctcttacggcggcgggtggcgattgcagggctcctggaataccggggaggaagtacaggtgatcgccgtggagcccggaaagaacccaaagaacgtccagacagcccccgggactttcaaaacgagtgagggcgaggtcggcgccatagccctcgacttcaagcccgggaccagtggtagcccaattgtcaaccgcgaggggaagattgtcggcctgtacggtaatggggtggtgaccacctcaggcacgtacgtgagcgcgatagcccaagccaaggcttctcaagaggggcccttaccggagatagaggacgaggtgttcaggaagcgcaacctaactatcatggacctgcaccccggctccgggaaaacccggcgctacctgcccgcgatagtgcgggaggccatcaagcgcaaactcagaacactcatactggcacctacgcgcgtcgtagcgtccgaaatggccgaggcattaaagggcatgcccattcgctaccagaccaccgccgtcaaaagcgagcacacaggcaaagaaattgtagacctgatgtgccacgccaccttcacgatgcggctgctctcgcccgtgagagtccccaactacaacatgatcattatggacgaggcgcattttactgacccgagcagtatcgccgctcgggggtacattagcacccgcgtgggcatgggcgaggccgccgccatctttatgaccgccacgccgcccggatcagtggaggcctttccccagtcaaacgccattatccaggatgaggagcgcgacattccggagcgcagttggaactctgggtacgagtggatcaccgatttcccaggcaagacggtgtggtttgtaccgtccatcaagagcggtaacgacatcgccaactgcctccggaagaacgggaaaagagtgattcaactgagtagaaagacttttgacaccgagtaccagaagaccaagaacaacgactgggattatgtggtcaccacggacatcagtgaaatgggagccaacttccgcgcagaccgggtgattgacccccgccggtgcctcaagccggtgatactgaaggacgggcccgagcgcgtgatcctcgcgggtcccatgcccgtgacggtcgcctcggccgcccagcggcgcgggagaataggccgcaaccacaacaaggagggcgatcagtacatctatatggggcagccgttaaacaacgacgaagatcacgcgcactggaccgaggcaaagatgctgctggacaacatcaacacgcccgagggcataatccccgccctcttcgagcctgagagagagaaatctgctgcaattgatggagagtaccgcctgcgcggcgaagctcggaagacgtttgtggagctgatgcgccgcggcgacctcccagtgtggctgtcttacaaggtcgcgtccgagggcttccagtatagcgatcgccggtggtgcttcgacggcgagcgcaacaaccaggtcctggaagagaacatggacgtggaaatctggaccaaggagggtgagcggaagaagcttcgcccccggtggctggacgctcgaacctactccgaccccctagcactccgggagttcaaagagttcgcggcggggagacggagcgtctctggggatttgatcctggagatcggcaagctccctcagcacctgacgcagcgtgcccagaatgccctggacaacctagtgatgctgcacaacagcgagcaaggcgggcgggcctatcgccacgctatggaggagctgccggacactattgagaccctcatgctgctggccctcatagcggtgctaaccgggggggttaccctattcttcctctcgggccgggggctcggcaaaacgagcatcggtttactctgcgtaatggcctccagcgtgttgttatggatggcctccgtggagccacactggatcgcggctagcatcatactcgagttcttcctgatggtgctgttgattcccgagcccgaccgccaacggacaccgcaggataaccagctggcctatgtggtcatcgggttactgttcatgatcctgacagtagctgccaatgaaatgggcctactcgaaaccaccaagaaggaccttgggattggacacgtggcggtggagaatcatcaccacgccgcgatgctagacgtggacctccaccccgcttccgcctggacgctgtacgcagtggccaccaccatcatcacgcccatgatgcgacacacgattgagaacacgaccgccaacataagcctgaccgccatcgctaaccaggcggccatcttgatggggctggacaagggctggccgatatcgaagatggacatcggagtcccgctgctcgccctggggtgctacagccaagtaaatccgttgacgctcacagccgcggtgctgatgcttgtagctcactacgctatcataggcccggggctgcaggccaaggccacccgggaggcgcagaaacgtaccgccgccggcatcatgaagaacccgacggtggacgggatcgttgctattgacctggaccccgtagtgtatgacgcaaaattcgagaaacaactgggacagatcatgctccttattctttgcacctcccagatactcctgatgcgcaccacgtgggcgctttgcgagagcatcacgctcgccaccgggccgcttacgaccctgtgggaggggtctcccggcaagttctggaacacaaccatcgctgtcagcatggcgaatatcttccgggggagctacctcgccggggctggcctggccttctccttaatgaagagtctgggtggcgggcgccgcggcaccggcgcccaaggggagactctgggcgaaaagtggaagcgccagctgaaccaacttggaaagagcgagttcaacacgtataaacggagcggaatcatggaagtcgaccgctcagaggccaaggaggggctgaagagaggcgagaccaccaagcacgcggtgtcgcgtgggacggcaaagcttcgctggttcgtggaacgcaacctcgtcaagcctgaggggaaagtgatcgacttaggttgcggacggggtggctggtcttattactgtgccggcctgaagaaggtcacagaggtcaaagggtataccaaaggaggtcctgggcacgaggagcctattcccatggcaacctacgggtggaatctggtgaagctccatagtgggaaggacgtgttcttcatcccgcccgagaagtgcgacaccttactgtgcgacatcggcgagtcctcccctaaccctacgatcgaggaggggagaaccctccgggtcctgaaaatggtagaaccgtggctgcgcggcaatcagttttgtatcaagatcctcaacccctacatgccctcagtggtcgagaccctggagcagatgcagcggaagcacggcggtatgctggttcgcaaccccctcagtcggaactccacccatgagatgtattgggtgtcttgcggcaccgggaacatcgttagtgccgtaaacatgacgagccgtatgctgctgaaccggttcactatggcgcaccgaaagccgacctatgaacgcgacgtggacctaggggcaggaacccggcatgtcgcggtggaacccgaggtggctaacctggatatcatcgggcagcgcattgaaaatattaagcacgagcacaagagcacgtggcactacgacgaggacaacccctacaagacctgggcgtaccacggcagctacgaagtcaagccgagcgggagcgcgtcgtccatggtgaacggcgtcgtgaagctgctcaccaagccatgggacgtgatcccaatggtaacccagatagccatgacggacaccaccccatttggtcagcagagagtgttcaaggaaaaggtggatacccgcacgcccaaggccaagcgcggcaccgcccagatcatggaggtaaccgctaagtggctgtggggcttcttgagccgtaacaaaaagccgcggatctgtacccgcgaggagtttacgaggaaagtgcgctccaatgcggctatcggggccgtgttcgtagacgaaaaccagtggaactctgccaaggaggcggttgaagacgaacggttctgggacctcgtgcaccgcgagcgggaactgcacaagcagggcaagtgtgccacctgcgtctacaatatgatgggtaagcgtgaaaaaaaactgggggagtttggtaaggctaagggctcccgggccatctggtacatgtggttaggcgccagattcttggagttcgaggctctggggttcatgaacgaggaccattggttcagccgcgagaacagcctctcgggggttgaaggagagggcctgcacaagctggggtacatcctccgagacatcagcaaaatccctggagggaacatgtacgccgacgacaccgccggctgggacacgcggataaccgaagacgacctgcagaatgaggcaaagatcacagacatcatggagccggagcacgccctgctcgcgaagagcatatttaagctgacatatcagaacaaggtggtccgcgtacagcggccggccaagaacggcacagtgatggacgttatttccagacgagatcagcgtggaagcggccaggtgggcacgtacgggctgaacacctttaccaacatggaagcccaactcatccgccagatggagagcgaggggatcttcagcccctccgagctagaaacccccaatctggccgggcgcgtgcttgattggcttgagaaacatggcgtagagcggctgaagcggatggccatcagcggggacgactgcgtggtgaagccaatcgatgaccgctttgcgacggcactcactgccctgaacgacatgggcaaagtccggaaggatataccccagtgggagccctccaagggctggaacgactggcagcaggtccccttctgcagccatcacttccaccagctgatcatgaaggacgggcgcgagatcgtggtaccttgccggaatcaggacgagttggtgggccgcgcccgtgtgagtcagggggctggatggtccctgcgcgagaccgcttgcttaggaaagagttacgcccagatgtggcaacttatgtacttccaccgcagggacctgcggctggccgctaatgcgatctgctcggccgtcccggtggattgggtgccgacctctcgcaccacctggtccatccacgcccatcaccagtggatgacaaccgaggacatgttgagtgtctggaaccgggtgtggatcgaggaaaacccctggatggaggataagactcacatcagttcatggggcgacgtgccttatctcggcaaacgcgaggaccaatggtgcgggtcgctaatcggtctcacagcccgagccacatgggcgaccaacattcaggtggccatcaatcaagtgcgcagactgatcggtaacgagaactacctagactatatgaccagcatgaagcgattcaaaaacgagtccgacccagaaggcgccctctggtga

SEQ ID NO: 24212 - RNA, 9879 nt, synthetic construct
  misc_feature 1..9879: note = derived and/or modified CDS sequence (opt11) from DENV-1__FJ410236__SS-prME
  source 1..9879: mol_type = other RNA
tctgtaacaatgctactaatgctcgtacctacggccctcgcattccacctaacaactcgcggcggggaaccacacatgatagtgtccaaacaggaacgggggaaatcgctattgttcaaaacgagcgcaggggtcaatatgtgtacactaatagcaatggatctgggcgaactttgcgaagacacaatgacatataaatgtccgcgtatcaccgaaacggaacctgacgatgtcgactgctggtgcaacgcaaccgacacatgggtaacctacggtacgtgttctcaaacaggcgaacaccgccgcgacaaacggagtgtagcccttgcacctcacgtagggctcggtttagaaacacgcacagagacctggatgagctccgaaggcgcttggaaacagatccaacgggtcgaaacgtgggcccttcgccatcctggattcaccgtaatagcactattcctagcccacgccatcggcacttcgattacgcaaaaaggcataatattcatcctcctcatgctagtgacgccctcaatggccatgcgttgtgtagggatcggcagccgcgactttgtggaagggctatcgggcgcaacatgggtcgacgtagtacttgaacatggtagctgcgtcacaaccatggcgaaagacaaacccacactcgacatagagttgctcaaaacagaagttaccaaccctgccgtcctccgcaaactgtgcatcgaggccaagatctccaacacaaccactgacagccgctgtccaactcaaggagaagcgaccttagtagaggaacaagacgccaacttcgtgtgccgacggactttcgtcgaccggggctggggaaacgggtgtggactattcgggaaggggtccctcattacctgtgcgaagttcaagtgcgttaccaaattggaaggcaaaatcgtacaatatgaaaacctaaagtactccgtaatcgtaacggtacatacgggagatcagcaccaggtgggtaacgaatccactgaacacggtactacagccacgataacaccacaagcgccaaccacggaaatccagttaaccgattacggagcgctgacgctcgactgttcaccacgaaccggactagacttcaacgaaatggtcttgctgacgatgaaagaaaagtcttggctagtccataagcagtggttcctagacctacctctaccatggacctcaggggccagcactagccaggagacgtggaacaggcaggacctcctagtaaccttcaaaactgctcacgctaagaaacaagaggtagtcgttttgggatcccaggaaggcgcaatgcacaccgccctaaccggagcaacggagattcaaacaagcgggaccacaaccatattcgccggacacctaaaatgtcgacttaaaatggacaaactaacactaaaggggatgagctatgtgatgtgcaccggatcgttcaaattagaaaaagaagtagctgaaacgcagcacggcaccgtgcttgtccaaatcaaatatgaagggacagacgctccctgcaagatccccttttccacgcaagatgagaaaggtgtgacacaaaatggccgcctcataaccgctaatccgatcgtaaccgacaaggaaaaaccggtgaacatcgaagcagaaccacccttcggagaaagctacatcgtcataggcgccggggaaaaggcgatgaaactgtcttggttcaagaaaggatcctcaattggaaagatgttcgaggccaccgccaggggagctcggagaatggccatcctcggcgacactgcctgggatttcgggagcatcggaggagtattcacatccgtcggaaaacttgtccaccaaatatttggcacagcgtatggggtgctgttcagtggagtcagttggaccatgaagatcggtattggcgtcttactcacatggcttggactaaattcgcgctccacgtccctatccatgacatgcattgccgtcggtctagtaacactttacctcggagtgatggtccaagccgactcaggatgcgtaatcaactggaaagggcgtgaactcaaatgcggaagcgggatattcgtcacgaacgaagtccacacgtggacagaacagtataaattccaagcagattctcccaaacgtctatctgcagcaatcggtaaggcttgggaagagggagtttgcggcatacggagtgcaactcgactcgagaacatcatgtggaagcaaataagcaacgaactaaatcatatattactcgaaaacgacatgaagttcacagtcgtggttggggacgtagcgggcattctcgcccagggcaagaaaatgatccggccacaacccatggaatacaaatatagctggaaaagctggggcaaagcgaaaataatcggtgcagacgtacaaaacacaacattcataatagacggccctaatacaccagagtgtccggacgaccaaagggcgtggaacatatgggaagtcgaggattacggcttcggaatattcaccaccaacatatggctaaagttaagagatagttacacacaggtatgcgaccaccggctgatgtccgccgccatcaaagactcaaaggcagtccacgcagatatgggctactggatcgagtcggagaagaacgaaacatggaaacttgctcgagcatcattcattgaggtgaaaacatgcatatggccaaagtcccacacactctggtcgaacggcgttctagagtccgaaatgataatccctaaaatatacggaggtccaatcagccaacacaactacagaccgggatacttcacacagacagcgggaccctggcacctcggcaaactagagctggacttcgatctctgcgaaggaaccactgtcgtagttgatgaacactgcggaaacagaggaccgtctttgcgcacgaccaccgtcacaggcaagataatacacgaatggtgctgccgcagctgcaccctacccccactgagattccgtggagaggacggatgttggtacgggatggaaatacgacctgtcaaagaaaaggaagagaacctagtgaagtcaatggtatctgccgggtcaggtgaagtggactcattcagcctgggcctcctctgcataagcataatgatagaagaggtcatgaggtcgcgatggagccgcaaaatgcttatgacagggacgttggcagtattcttcctcctaataatgggccaactaacttggaatgacttaatcaggctatgtataatggttggggctaacgcatcagaccggatgggcatgggcacgacatacctcgcgcttatggctacatttaaaatgcgtcccatgtttgcagtaggactcctctttagacgactcacaagccgcgaggtactactcttaaccatcggcctatccctagttgcttcggtcgagttaccgaacagtctggaggaactgggagacgggctcgcgatgggtatcatgatcctaaagctcctgacagacttccaaagccaccaactatgggcgacactactatccctcacgtttataaaaaccaccttctcactgcactatgcctggaaaacgatggccatggtactaagcatagtatccttattcccactctgcttgtccacgaccagccagaaaaccacttggttgcctgttctcttagggagtttgggctgcaagccgctcacgatgtttcttattgccgagaacaagatatggggccgtcgtagctggccccttaacgaagggattatggctgtaggaatagtaagcatcctacttagctcgctcttgaaaaacgacgtcccgctagcaggacccctcatagcaggcggcatgctcatcgcatgctatgtcatatccggcagtagcgccgatctgtcgctagaaaaggccgcggaggtgagttgggaggaggaagccgaacatagcggcgcgtcccacaatatattggtcgaagtccaggacgacgggacaatgaagattaaggatgaagaacgagacgacaccctcaccatactgctaaaggcaacactccttgcggtcagcggagtctacccgctgagcatacccgcgacgcttttcgtatggtacttctggcaaaagaagaagcaacgctccggagtgctgtgggacacaccctcaccaccagaagttgaaagagccgtactcgacgatggcatctaccgaattatgcaaagaggcctcctcggaagaagccaggtgggagtcggggttttccaagagaatgtgtttcatacgatgtggcacgtaacacggggagcggtactcatgtaccagggaaagcgcctcgaaccaagctgggcctcggtaaagaaagacttgatcagctacggcggcggctggcgactccaaggcagctggaacacaggagaagaagtgcaagtgatcgcagtcgagcctggcaagaaccccaaaaacgtccaaactgctcccggaacatttaaaacccccgaaggagaggtgggcgccattgccctagactttaaacccggaacgtctggcagccccatcgtcaatagagagggaaagatagtcggcctttacggcaatggggtagttacaacatcggggacatacgtctccgcgatcgcgcaggcaaaggcatcccaagaaggccctttacccgaaatagaagatgaagtgttcaggaaacgaaatttaacaataatggacctgcaccctgggagtgggaagacccgtcgctacctacccgccattgtccgagaggcgatcaagcgcaaacttcggacattgatcctggcgccgaccagggtagtcgcaagtgaaatggcagaggcgttaaagggtatgccgatccgctaccagacaacagcagttaagagcgagcacacagggaaagaaatagtagacctgatgtgtcatgccaccttcactatgcgcttactgtcccctgtccgagtgccgaactacaacatgataatcatggacgaagcccacttcacggacccttccagtattgcagcccgaggatacatctcgacgcgcgtaggaatgggggaggcggcagctatattcatgacagctacaccacccggtagtgtcgaagccttcccacaaagtaacgccgttatacaagatgaagagagggacataccagaacgtagttggaactccggttacgagtggatcactgacttccctggcaaaacagtttggttcgtgccatcaataaagagcggcaacgacatcgcaaattgtctaaggaaaaatgggaaaagagttatccagctgagcaggaagacattcgacacggaataccagaaaactaaaaacaatgactgggactacgtagtaaccacagacatcagcgaaatgggagctaacttcagggcggaccgagttatagacccgcgacggtgcttaaagcctgtcatcctaaaagacggccccgaaagggtaattctcgcgggcccgatgccggtaaccgtagctagcgcggcacaaaggcgagggcggatcggtagaaatcacaacaaagaaggggaccaatacatctacatgggccagcccttaaataacgacgaggaccacgcgcactggaccgaagctaagatgttactcgacaatatcaataccccagagggcatcataccagcacttttcgagccagaacgggagaagtcagcagcaatagacggagagtaccgactaagaggggaagccagaaaaacattcgtggaactgatgcgacggggagacctacccgtatggctcagctacaaagtcgcttccgaggggttccaatatagtgacagacggtggtgctttgacggcgaaagaaacaaccaagtgctcgaagaaaacatggacgtggagatttggacgaaagagggggaaagaaagaaattgaggccacgctggctagacgcgaggacttactcggaccctttagcactaagggagttcaaagagttcgcagcgggacggcgatctgtttcgggagatctgatactcgagattggcaagctcccccagcaccttacgcaaagagcacaaaacgccctggacaaccttgttatgctccataactcagagcaaggcgggcgggcataccgacatgctatggaggaactccccgacactatagagacactaatgcttctggcactaatagccgtactaaccgggggcgtaacattattcttcctaagcgggaggggtttaggcaaaacaagtataggtctgctttgcgtgatggcctcgtccgtcctactatggatggcgtcggtagaaccacactggatcgcagcaagtataatcctggaatttttcctaatggtactccttatacccgaaccagacaggcaaaggacaccacaggacaaccagttggcgtacgtcgtcatcggactgctctttatgatactcacagtagcagcgaacgagatgggactattggaaacaacaaagaaagatcttggcataggacacgtagctgtagagaaccaccaccacgctgccatgttagacgtagacctacacccggcctcagcctggacgctttacgccgtcgcaacgactataattaccccaatgatgcgacacaccatagagaacacgactgcgaatatatctctgacggccatcgccaatcaagctgcaatcctgatgggactcgataagggatggcctatctcgaagatggacataggcgtgccccttctggcactaggatgctattcgcaagtaaatccactgaccctcacagcagcagttttaatgttagtggcgcactacgcaattatagggccagggctccaagctaaggctacccgagaggcccaaaaacgaacagcagccggaatcatgaaaaacccaacagttgatggcatcgtcgccattgacctagacccggtagtgtacgacgccaagtttgaaaagcagctcggccaaataatgctactaattttgtgcacgtcacaaatactcctaatgaggaccacttgggctctctgcgaaagcattacactcgcaacaggaccactaacaactctatgggaaggatcaccaggcaagttctggaacacaacaatcgcagtctccatggctaacatctttcgcggctcctatctagcgggcgccggtctagctttcagtctcatgaagtcactcggcgggggacgccgaggtacaggggcacagggcgagaccctcggagaaaagtggaaacgacagctaaaccaactctccaaatctgagttcaacacctacaagcgctccggaataatggaggtcgaccggagcgaggcgaaagaagggctgaagcgcggagaaacaacgaaacacgcagtctcacggggaacggccaaactccgatggttcgtcgaacgaaacctggtcaaaccggaaggtaaagtaatagacctaggatgcggcagaggagggtggagctactactgcgcgggacttaagaaagtcacggaagtaaaagggtacaccaagggtggaccagggcacgaggaacccatccctatggcgacatacggatggaacctcgtgaagctacacagcggaaaggacgtattctttataccaccggagaaatgcgatacactgttatgtgacattggagaaagcagtcctaaccccacaatcgaggaaggccgaacgctgcgggttctaaagatggtggagccatggttacgagggaatcaattctgcatcaaaatacttaacccctatatgccaagtgttgtcgaaaccttggagcagatgcagagaaaacacgggggtatgctagtacgcaacccactctcccgaaactcaacccacgaaatgtactgggtaagttgcgggacaggcaatattgtgagcgcggtgaacatgacctcccgcatgctcctcaaccgctttaccatggctcaccgaaagccaacctacgagagagacgtggacctcggcgccggtacgagacacgtcgcggtagagcccgaggtggcaaacctggacataataggccaacgtatcgaaaatataaaacatgagcacaagagcacctggcactatgacgaagataacccctacaaaacatgggcataccatggctcgtacgaagtaaaaccctccggcagcgcctcgagcatggtcaatggcgtggtaaaactattgacgaagccgtgggacgtcataccaatggtaacccagatcgcgatgactgataccacgccatttggtcaacaacgagtattcaaggaaaaagtcgatacacgaacgccaaaagccaagcgcggcaccgcccagattatggaggtcaccgcgaaatggctatggggattcctctcccgcaacaaaaagcccagaatatgcactcgggaagagttcaccagaaaagttcgcagtaatgccgccataggagcggtgttcgttgacgagaatcaatggaacagcgctaaggaggcggtagaagacgaacgattttgggatctagtccatcgagaacgtgagctgcataaacagggtaaatgtgcaacttgcgtatacaacatgatgggaaaacgtgagaagaaattgggagagttcgggaaggcaaagggctccagagccatatggtatatgtggctgggcgcccgttttcttgagttcgaagctctaggctttatgaacgaagaccactggttttcgcgcgaaaattcactgagcggagtagagggagaaggtctccacaagctcgggtacatactacgggacataagcaaaatacccgggggaaacatgtacgccgacgataccgcaggctgggacactagaatcacagaagacgacctccaaaacgaggcccgaataacagacataatggaacccgagcacgctctccttgccaagtccatttttaagctcacctaccagaacaaggtcgtcagagtgcaacgaccagccaaaaatggaacagtgatggatgttatatcacggcgtgaccaacgggggagcgggcaagtcggaacctacggcctcaacacgttcaccaacatggaagcccagcttattcgacaaatggaaagcgagggcattttctcaccgagcgaattagaaacccccaacctcgctgagcgagtactcgactggctagaaaaatatggagtcaagcgcctgaaaagaatggccatatcaggagatgattgcgtcgtcaaacctatcgacgaccgctttgcgaccgcgttaacagcactcaacgacatggggaaagtccgaaaggatataccacagtgggagccatccaagggctggaacgactggcagcaagtacccttctgttcgcaccatttccatcagttaattatgaaggatgggagagaaatcgtcgttccctgccgaaaccaggatgagctagtcggcagggcgagggtatcccaaggagccggatggtccctacgcgagaccgcgtgcctagggaagtcgtacgcccaaatgtggcaactcatgtacttccaccgaagagacctgcggctggcagcgaatgccatatgctcagcagtcccagtagactggataccaacatctcgaactacgtggagcatccatgcgcaccaccaatggatgacaaccgaagacatgctgtcagtatggaatagggtttggatagaagaaaacccttggatggaagacaaaacacacatcagctcctggggagacgtaccttatctaggcaaacgtgaagatcaatggtgcggaagtcttataggcctaaccgcgcgcgcgacatgggcaacgaatatacaagtggcaatcaaccaagtaaggagactaatcggaaacgaaaattacctcgactatatgacttcaatgaagcgctttaagaacgaaagcgacccagaaggagcactctggtaa

SEQ ID NO: 24213 - RNA, 9879 nt, synthetic construct
  misc_feature 1..9879: note = derived and/or modified CDS sequence (opt11) from DENV-1__FJ410238__SS-prME
  source 1..9879: mol_type = other RNA
agtgtgacgatgctgctgatgctgatgcccaccgccttggccttccatctcaccacccgggggggcgagccccacatgatcgtgtcaaagcaggagagaggcaagagcctcctgtttaaaaccagcgccggcgtgaacatgtgtacccttatcgccatggacttaggcgagttttgcgaggacacgatgacctataagtgcccccggatcacagaggccgagcccgacgacgttgactgttggtgcaacgccaccgacacgtgggtgacttacgggacgtgtagccagaccggagagcaccggcgggacaagcggtccgtggctttagctccccacgtgggcctcgggctggagacgcgcaccgagacatggatgagcagtgagggcgcctggaagcagatccagcgggtggagacctgggccctacgccatcccgggttcacagtgatcgccctctttctagcgcatgccatcggaactagcataacccagaagggcattatcttcatcctgctcatgctggtgaccccctccatggccatgaggtgcgtcggaatcggttcgcgcgatttcgttgaggggctgtccggcgccacttgggtcgacgtagtgctcgagcacggaagctgcgttaccaccatggcgaaggacaagcccaccctagacatcgaactactaaagacggaggtaacgaatcccgcggttcttcggaagctttgtatcgaagccaagatttccaacaccaccacagacagccgctgtccgacccagggcgaagccaccctcgtggaggagcaggacgccaacttcgtctgtcggaggaccttcgtggaccgaggctggggcaacggctgtgggctgttcggcaaggggtcgctaatcacgtgcgccaagttcaagtgcgtgaccaagctcgaagggaaaatcgtccagtacgagaacctgaagtactccgtcatagtgactgtccacaccggcgaccagcaccaggtgggtaacgagtccactgagcacggcacgaccgctaccatcacaccccaagcacccagcaccgaaatccaactgaccgactacggggccctcacgctggactgcagccccaggaccggcctggatttcaatgagatggtcctcctgacaatgaaggagaaaagttggctggtacacaagcaatggtttctcgacctgccgctaccctggaccagcggggcatccaccagtcaggagacttggaaccggcaggacctactggtgacgttcaaaaccgctcacgcgaagaagcaggaggtcgttgtcctgggctcgcaagagggcgccatgcacaccgcgctcacgggagcgactgagatccaaaccagcggcacaacgacgatcttcgccggtcacctgaagtgccgcctgaagatggataagctcaccctgaagggcatgtcctacgtcatgtgcaccggcagcttcaagctggagaaggaagtggcggaaacccagcacggcacggttctcgtccaaatcaaatacgagggaacggatgcgccctgtaagatccccttctccacccaagatgagaagggggtgactcagaacggaaggctgatcacggccaacccgatcgtcaccgacaaggaaaaacccgtcaatatcgaggccgagccgcctttcggggagagctacattgtcatcggggcaggcgagaaggctctaaagctgtcctggtttaagaaggggagcagcatcggcaagatgttcgaggccaccgccagaggtgcgcggcggatggcgatcttaggcgacacggcctgggacttcgggagcatcggcggggtctttacatccgtcggaaagttagtacaccagatcttcggcaccgcatacggggtgctgttcagtggcgtctcttggaccatgaagatcgggatcggcgtgctcctaacctggctgggcctcaactcgcggtccacgagcctgtccatgacctgtatagccgtaggcttggtcaccctgtaccttggcgtgatggttcaggccgacagcggatgtgtcattaactggaagggccgtgagctgaagtgcgggagcggcatcttcgtgactaacgaggtgcacacgtggaccgagcagtacaagtttcaggccgactcccctaaacgacttagcgccgccatcggaaaggcctgggaagagggggtctgcggcatcaggtccgccacccgtctggagaacatcatgtggaaacagataagcaacgagctgaaccacatcctcctagagaacgatatgaagttaaccgtggtggtcggggacgtggcgggcatcctcgcccaggggaagaagatgatcagaccccaacccatggagtacaagtactcctggaagtcctggggcaaggcgaagatcatcggcgccgacgtgcaaaataccacgttcatcatagacgggcccaacaccccggagtgtcccgacgaccagcgcgcgtggaacatctgggaagtcgaggactatggctttgggatcttcaccacaaatatctggctaaagttacgggactcctacacccaggtgtgcgaccaccgcttgatgagcgcagccataaaggactccaaggccgtgcacgccgacatgggctactggatcgagagcgaaaagaacgagacatggaagctggcacgggcctccttcatcgaggtcaagacctgcatttggcccaaatctcacactctctggtctaacggcgttttagaaagcgagatgataataccgaagatctacggggggccgatctcccagcacaactatcgccccgggtacttcacgcagacagccggcccctggcacctaggaaagctggaactggacttcgacctgtgcgagggcaccacggtggtggttgacgaacactgcggcaatcgggggcccagcctgaggaccaccacagtgacgggcaaaatcatccacgagtggtgctgccgctcctgtacgttgcctcccctcagatttaagggggaggacggctgttggtacgggatggaaatacggcccgtcaaggagaaggaggaaaacctggtaaagtcaatggtgagcgccggaagtggggaggtcgactccttttcccttggcctgctatgcatctcgattatgatcgaagaggtgatgcgctcccggtggagccgcaagatgctcatgaccggtaccttagctgtgtttttcctgctcattatggggcagctgacctggaacgacctgatccgcctctgtatcatggtcggtgccaacacgtccgaccgcatgggcatgggcaccacctacctggccctgatggccacgttcaagatgcgcccgatgttcgccgtgggcctcctgttccggaggctgacgagcagagaagtgctcctgctgaccatcggtctctccctggtcgccagcgcggaactgcccaactccctcgaagagctgggcgacggtctagccatgggcattatgatcctcaagctgctgaccgatttccagagccaccagctctgggccaccctgctgtccctcacgttcatccggactacatttagcctgcactacgcctggaaaacgatggctatggttctatccatagtcagcctcttccctctgtgtctatccacgaccagtcagaagaccacctggctccccgtgctgctaggctcccttgggtgcaagccgctgacaatgttcctgatcgcagagaacaagatctgggggcgcaagtcctggcccctcaacgaagggataatggccgtgggtatcgttagtatcttactgagtagcctcctgaagaacgatgtgcctctggccgggcccctcatcgccggtggcatgctgatcgcgtgctacgtgatctccgggagctccgcggacctaagtctcgagaaggccgccgaagtctcctgggaggaggaggccgagcatagcggcgcgtcccacaacatactagtagaggtgcaggacgacgggacgatgaagatcaaggacgaggagcgcgatgacaccctgaccatcctcctgaaggcgacgctgctcgctgtcagcggcgtttaccccctgtccatacccgccacgctgttcgtttggtacttctggcagaagaagaagcagagaagtggtgtcctttgggacacgccgagccctcccgaggtggagcgggctgttctggacgacggaatatatcgtatcatgcaacgcggcctgctggggcggagccaggtcggtgtgggtgtattccaggagaacgtcttccacaccatgtggcacgtgacccgcggcgcggtgctcatgtaccaggggaagaggctagagccttcctgggcctctgtcaagaaggatctgatctcctatggaggagggtggcgactccaaggcagctggaacacgggagaggaggtccaggtgatcgccgttgagcccggcaagaaccccaagaacgtgcagaccgcccccgggaccttcaagacatccgagggcgaagtaggcgccatcgcgctggattttaagccgggcacgtcaggctcaccaatcgtcaaccgggaggggaagatagtaggcctgtacggcaatggggttgtcacgacatcagggacctacgtgagcgccatcgcccaggccaaggcgtcgcaggaggggcccctaccggagattgaagacgaggttttccgcaagcggaacctgacgatcatggacctgcaccccggcagcggaaaaacccgccggtacctccccgccatcgtgcgcgaggccatcaagagacgcttgcgcaccctgatcctcgccccgacccgggtggtcgcatccgagatggccgaggcgctgaagggcatgcccattcgctatcagacaaccgccgtcaagtcagagcacacgggcaaggagatcgtggatctgatgtgccacgccacctttacgatgcgactcctatcccccgtgcgcgtccccaactacaacatgatcattatggacgaggcccacttcacagaccctagcagtatcgcggcccgggggtacatcagcacgcgcgtgggcatgggggaggccgccgccatcttcatgacagctacgccgccaggttccgtggaggccttcccccagagcaacgccgtcatccaggacgaggagcgggacatcccggagagatcctggaacagcggatatgagtggatcactgacttccccggtaagaccgtgtggtttgtgccgtccatcaagagcggcaacgacatcgcaaactgcctgcggaagaacgggaagcgcgtcatccagctctcccggaagaccttcgacacagagtaccaaaagactaagaataacgactgggactacgtggtgaccaccgacatcagcgagatgggcgccaatttccgcgcggaccgggtcatcgacccccggagatgtctgaagccggtgatactgaaggacgggcccgagcgcgtgatactcgctggccctatgccggtcacggtggcctctgcggcgcagcggcgagggagaataggacgaaatcataacaaggagggcgaccagtatatttacatggggcagccgctgaataacgacgaagaccacgcgcactggacggaggccaagatgctcctagataacatcaacacccctgagggcatcatccccgccctgttcgagcctgagcgcgagaagtctgccgcgatcgacggcgagtaccggttgcgcggcgaggccagaaagaccttcgtcgagctcatgcgccgaggggacctgccggtgtggctgtcctacaaggttgcctccgaaggcttccaatacagcgaccgtcggtggtgcttcgacggcgagaggaataaccaggtgctcgaggagaatatggacgtggagatctggacaaaagagggagagcggaaaaagctgcgccccaggtggctagacgcccgaacctattccgaccccctcgccctacgggagttcaaggagttcgcggccggccgccggagcgtgtccggagacctgatcctcgagattggcaaactgccccagcacctgacccagcgcgcccagaacgccctcgacaacctggtaatgctgcataatagcgagcagggcgggcgggtgtaccgccacgctatggaggagttacctgacacgatcgagacgctgatgctgctcgcgctgatcgccgtactgactggcggggtcaccctcttcttcctatccggccgggggttaggaaagacctccatcggactcctgtgcgtgatggcctccagcgtgctgttgtggatggcctccgttgagccccactggatcgcggccagcatcatcctggagttctttttgatggtgctcctgatacccgaacccgaccgccagcggaccccacaggacaaccaactggcatacgtcgtcattgggctcctgttcatgattctgacggtggccgccaacgaaatggggctcctggaaaccaccaagaaggacctgggtatcggacacgtggcggtcgagaatcaccaccatgcggcaatgttggacgtggacctgcacccagcctctgcctggaccctgtacgcggttgcaacgaccatcatcacccccatgatgcgccataccatagagaacacgaccgccaatattagcctcaccgcgatagccaaccaagcggccatcctgatggggctggataaagggtggccaatctctaagatggacatcggcgtgcccctcctggccctggggtgttattctcaagttaaccccctcaccctgacggccgcggtgctgatgctcgtcgcccactacgctatcatcgggcccgggctgcaggccaaggccacccgcgaggctcagaagcggaccgccgcaggcatcatgaagaacccaacagttgacgggatcgtggccatagacttggaccccgttgtctacgacgccaaattcgagaaacagctcggacagatcatgctgctgatcctctgcacctcgcagatactgctgatgcgcaccacctgggctctctgcgaaagcattaccctggccaccggccccctgacaaccctctgggaggggtcccccggaaaattctggaacaccacgatagcagttagcatggctaacatctttcgagggagctatctggccggcgcgggcctggctttcagcctcatgaagtccctcgggggggggcgacgcggaacaggtgcccagggcgagaccttaggcgaaaagtggaaacgccagttgaaccagttgtccaagtcagaattcaacacctacaaacggtccgggatcatggaagtcgaccgcagcgaggccaaagagggcctgaagcgcggggagacgactaagcacgctgtgtcccgcggcaccgcaaaactccgctggttcgtggagcgcaacctggtcaagccggaggggaaggtgattgacctgggctgcggccgtggcgggtggtcttattactgtgccggcctgaagaaagtgaccgaagtcaaagggtacacgaagggcggcccggggcacgaggagcccatccctatggctacatacgggtggaacttggtgaagttgcattccggcaaggacgtgttcttcattccccctgagaagtgtgacaccttgctctgcgacattggtgagagctcccctaaccccacgatcgaggaggggcgcacgttacgggttctgaagatggtggagccgtggctccgcggaaaccagttctgcatcaagatcctgaatccatacatgccctctgtagttgagaccctggagcaaatgcagcggaagcacggtggcatgttggttcgcaaccccttgtcccggaattcgacccacgagatgtactgggtgagctgcgggacgggcaacatcgtcagtgccgtgaacatgaccagccgcatgctgctcaaccgtttcacgatggcgcaccgtaagccgacctacgagcgcgatgtggacctaggagccggcaccaggcatgtcgcggtggaacccgaggtggccaacctggatatcataggccagcgcattgagaacatcaagcatgagcacaagtcaacgtggcactacgacgaggataatccctacaagacgtgggcctaccacggctcttatgaggtgaagccaagcgggagtgcttccagcatggttaacggggtcgtgaagctcctgaccaagccgtgggacgtgatcccaatggtcacccagatcgcgatgactgacacgacccccttcggccagcagcgggtgttcaaggagaaagtcgacacccgcacccccaaagctaagcgggggacggcccaaatcatggaagtcaccgccaagtggctgtggggctttctctcccgcaacaagaagccgcgaatctgcacacgcgaggagttcacacggaaggtgcgctcaaacgcggccatcggcgccgtgttcgtagacgagaatcagtggaactccgctaaggaggcggtggaggatgagcggttctgggacctggtacatcgcgagcgggagctgcacaagcaagggaaatgcgctacatgcgtttacaatatgatgggcaaacgcgagaagaagctcggtgagttcggcaaggccaaggggagccgggccatctggtacatgtggctaggcgcccgctttctggagttcgaggcgctcggcttcatgaacgaggatcactggttctcccgggagaacagcctgtctggtgtagagggcgaggggctgcacaagctcggctacatactacgcgacatcagcaagatccccgggggcaacatgtacgcagatgacaccgccggctgggacacgcgtataaccgaggacgacctgcagaacgaagccaaaatcacggacatcatggagcctgagcacgccctcctggcgaagtccattttcaagctaacttaccagaacaaggtggtccgggtgcagcgcccagccaaaaatgggactgtgatggacgtcatcagccggcgcgaccagcgaggctccggccaggtgggcacctatggcctcaacacgttcaccaacatggaggcccagctcatccgccagatggagagcgagggaatcttctccccaagcgagttggagaccccgaacctcgccggccgggtattggattggttagagaagcatggtgtggagcgcctcaagcggatggcgatctccggcgacgactgcgtggtgaaaccaatagacgacagattcgcgaccgcccttacggccctgaacgacatggggaaagtccggaaagacatcccgcagtgggaacccagcaaaggttggaacgattggcagcaggtcccgttctgcagccaccactttcatcagctcatcatgaaggacggccgggagatcgtggttccctgccggaaccaggacgagctggttgggagggcccgggtgtcccaaggcgccgggtggagcttgcgcgagactgcgtgcttgggcaagtcctatgctcagatgtggcagctgatgtacttccaccggcgggatctacggctcgcggctaacgcgatctgcagcgcagtccctgtggactgggtgcccacatcccgtaccacttggtcaatacacgctcaccaccagtggatgaccaccgaggacatgctgtccgtttggaaccgggtatggatcgaggagaacccttggatggaagacaagacgcacgtgtcttcttggggcgacgtcccctacctcggcaagcgcgaggatcaatggtgcggcagccttattgggctgacggcccgcgccacctgggcgacgaacatacaggtggctatcaaccaggtacgcaggctgctcggcaacgagaactacctggactacatgacctctatgaagcggtttaaaaacgagtctgacccggagggggctctgtggtga

SEQ ID NO: 24214 - RNA, 9879 nt, synthetic construct
  misc_feature 1..9879: note = derived and/or modified CDS sequence (opt11) from DENV-1__FJ410239__SS-prME
  source 1..9879: mol_type = other RNA
agcgtgaccatgctgctgatgttgatgcccaccgcactggcctttcaccttaccacccggggcggggagccccacatgatagtgtctaaacaagagcggggcaagtctctgctgttcaagacctctgccggggtgaatatgtgcactctcatcgccatggacttaggcgaactgtgcgaggacaccatgacgtacaagtgtccccggatcaccgaaaccgagccagacgacgtggactgctggtgcaacgccaccgatacgtgggtgacgtacggcacatgctcgcagacgggtgaacaccggcgggacaagcgatccgttgccctcgcgccccacgtaggcctgggcttagagacccgcaccgagacttggatgagctccgagggcgcctggaaacagatccagcgggtcgaaacgtgggccctccggcaccccggcttcaccgtgatcgcgctattcctggcccacgccatcggtactagcatcacccagaaagggattattttcatactcctaatgctggttacgccatccatggccatgcggtgcgtcggaattggcagccgcgacttcgtggagggattatccggagccacctgggtggatgtcgtactggagcacgggagctgcgtaactactatggcgaaggacaaaccaactctggacatcgagctgctgaagacggaggtcaccaatcctgccgtgcttcggaagctctgcatcgaggccaagatctccaacaccactaccgatagccgctgcccgacccaaggcgaggccaccctggttgaggagcaggatgccaatttcgtatgccggcgcaccttcgtggacaggggctgggggaacggttgcggactgttcggcaaagggtccctcataacctgtgccaagttcaaatgcgtaaccaagttggagggcaagattgtacagtacgagaatctgaaatacagcgtgattgttaccgtacacacgggtgaccaacaccaggtagggaatgagagcaccgagcacgggaccactgccaccatcactccacaggcgcccaccaccgagatacagctcaccgactatggggccctcaccctggattgttcccccaggaccgggctcgacttcaacgagatggtcctgctaaccatgaaggagaagtcctggctcgtgcataagcagtggttcctggacctgcccctcccctggacgagcggtgccagcacgtcccaggagacctggaaccggcaggacctgctggtaaccttcaagacggcccacgccaagaagcaagaggtagtcgtgctcggttcgcaggagggcgcgatgcacacggccctgacgggggccacggaaattcagacctctggcacaaccacgatcttcgcgggacacctgaagtgccgcctcaagatggacaagctgaccctgaagggcatgtcatatgtcatgtgtacgggatcctttaaactcgagaaggaactagccgagacccagcacggtaccgtgctagtgcagatcaaatacgaaggtaccgacgcaccctgcaagatccccttcagcacgcaggatgagaaaggcgtcacccaaaacggccgcctcatcaccgcgaaccccatagtcaccgacaaggagaagcccgtgaacatagaagcagagccgccctttggggagtcctacattgtcatcggcgccggcgagaaggcgttgaagctgagctggttcaagaagggtagcagcataggcaagatgtttgaggccacggctcgcggggcccggcgcatggccatcctgggcgacaccgcgtgggactttggatccatcgggggagtgttcacttccgcagggaagctggtgcaccagatcttcggcaccgcgtacggggtcctattctccggggtgagctggacgatgaagatagggatcggtgttctgcttacttggctgggcctaaattcccggagcacatccctcagcatgacctgcatcgcggtcgggctggtgaccctgtacctcggggtgatggtacaggctgactccggttgcgttatcaactggaagggacgggaactgaaatgcgggagcggcatcttcgtgaccaacgaggtccacacctggaccgagcagtacaaatttcaagcggatagcccgaagcggctctccgccgccatagggaaggcgtgggaggaaggggtgtgcggcatccgcagcgccactcgcctcgagaacatcatgtggaagcagattagcaacgagcttaaccacatcctgctcgagaacgacatgaagttcacggtggttgtgggggacgtagctggcatcctggcccaaggtaagaagatgatccggccccagcccatggagtacaagtacagctggaagtcttggggcaaagccaagatcatcggcgctgacgtccagaacactacgttcatcatcgacggcccaaacaccccggagtgccccgacgaccaacgcgcgtggaacatctgggaggtggaagactacggcttcgggatcttcacgacaaacatctggcttaagctccgggacagctacacccaagtgtgcgatcaccggctgatgtccgccgccataaaggattcaaaggcggttcacgccgacatgggctactggatagagtccgagaagaacgagacctggaagctggcgagggccagcttcatcgaggtcaagacctgtatctggcccaagagccacaccctctggagcaacggcgtgctggaatcagagatgattatccccaagatctacgggggtccgatatcccagcacaactaccggcccgggtacttcacccagaccgctggcccctggcacttggggaagctcgagctggatttcgatctgtgcgagggcacgaccgtggtggtcgacgagcattgcggcaatcggggaccgtccctccggactaccacggttacaggcaagatcattcatgagtggtgttgccgttcatgcaccttgccgcccctgagattccgcggtgaggacggctgctggtacgggatggagatccgccccgtgaaggaaaaagaggagaacctcgtgaagtccatggtctctgccggctccggagaggtggactccttcagcttgggtctactatgcatctccatcatgattgaggaggtaatgaggagccgttggtccaggaagatgctcatgaccggcacgctggcagtcttctttctcctgatcatgggacagctgacctggaacgacctgatccggttgtgcattatggtgggagccaatgccagcgacagaatggggatgggcacaacttacctggccctcatggcaaccttcaagatgcggcccatgttcgcagtgggcctgctgttccgccggctcacctcgcgcgaagtcttgctcctcaccatcggcttaagcctcgtagcgtccgtggagctccccaacagcttggaggagctgggagacggattggccatgggcattatgatactaaagttactcaccgacttccagtcccatcagttgtgggccacgttgctcagcctgacattcatcaagaccactttctcattgcactacgcctggaagacgatggcgatggtcctgtccatcgtttccctgttccccttgtgtctctctaccacctcacaaaagaccacgtggctgcccgtctttcttggctcactgggctgcaagccgctgaccatgttcttaattgccgaaaacaaaatctggggaaggcgcagctggcccctcaatgagggaatcatggcagtcggcatcgtgagcatcctactgagcagtcttctgaagaacgacgtccctctcgccgggccgttaatagccggcggcatgctgatcgcgtgctacgtgattagcgggtccagcgccgacctgtccttagagaaggccgccgaggtgtcatgggaagaggaggcggagcactctggcgcgtctcacaacatcttggtcgaagtgcaggacgacggcacaatgaagatcaaggacgaggagcgggacgacaccttgaccatcctcctgaaagccacgctgctcgccgtctcgggcgtctacccgcttagcatacccgccaccttattcgtgtggtacttctggcagaagaagaaacaacgctccggggtgctctgggacaccccttctccgccggaggtcgagcgcgcagtcctggacgacggaatataccgcatcatgcagcggggcctgctgggacgatctcaggtgggcgtcggcgtgttccaggaaaacgttttccacaccatgtggcatgttacgcgcggagcggtgctcatgtaccaggggaaacgcctggaacccagctgggcgtccgtgaagaaggacctgatcagctatggcggcgggtggcggctgcagggatcctggaataccggtgaggaggtccaagtcatcgctgtagagcctggcaagaatcccaagaacgtccagacagcccccggcaccttcaaaaccccggagggtgaggtcggcgctatcgccctagacttcaaacccgggacctcaggctcccccatcgtcaaccgggaggggaagatcgtcggcctttacggcaacggggtggtaaccaccagtggaacgtacgtgagcgctatcgcacaggcgaaggcgtcccaagagggtccgctccccgagatagaagacgaggtgttccggaagcggaatctgaccatcatggacctgcatcccggctcaggtaagactcggcgctatttaccggcaatagttcgggaggccatcaagcgcaagctgcgcactctgatcctcgcccccacccgggtcgtggcctccgagatggctgaagccctgaagggcatgcccatccgctatcagacaaccgccgtaaagagcgaacacaccggcaaggaaattgtcgacctgatgtgccacgccacgttcacaatgcggctcctgtcccccgtgcgcgtcccgaactataatatgattatcatggatgaggcccacttcaccgacccctcgtcgatcgctgcacgcgggtacatcagcacccgtgtcggcatgggggaagccgcagccatctttatgactgcgacgccaccgggctccgtggaggccttcccacagagcaacgccgtgatccaagatgaggagcgggacatacctgagcgttcgtggaacagcggatacgagtggatcaccgatttccccggcaagaccgtgtggtttgtgccctccatcaagagcggaaatgacatagccaactgcctcaggaagaacgggaagcgagtcatccaactctcccgtaagaccttcgataccgagtatcagaagaccaaaaacaacgactgggactacgttgtgacgacagatatctcggagatgggcgccaacttcagggctgaccgggtgatcgacccgcgtcggtgcctgaagcccgttatcctgaaggacgggcccgagcgcgtgattctcgccggccccatgccggtgaccgttgcctccgccgcgcaacggagggggcggattggccgcaaccacaacaaggagggcgaccagtacatatacatggggcagcccttgaacaacgacgaggaccacgcccactggacggaggccaagatgcttctcgacaacatcaacactcccgaaggcataataccggcccttttcgagccggaacgcgagaagtctgccgcgatcgacggggagtatcgtttacgcggcgaggcccgtaagacgtttgtggagctcatgcgccgtggggacctgcccgtctggctgagctacaaggtggcctcagagggctttcagtattcagaccgccggtggtgcttcgacggcgagcgcaacaatcaagtgctagaggagaatatggacgtcgagatctggaccaaagaaggggagcggaagaagctgcgtccccggtggctggacgccaggacgtactccgatcccttagccctgcgggagttcaaggagtttgcagccggccgccggagcgtgtctggggacctaatccttgagataggcaagctgccacagcacctcactcaacgcgcccagaacgccttagacaacctggtaatgctgcacaacagcgagcagggcggccgggcctacagacacgccatggaggagctccccgacactatcgaaactctgatgctgctcgccctaatcgccgtcttgacgggtggggtgaccctcttcttcctgtccggccggggtctcggcaagacaagcatcggcctcctgtgcgttatggcatcatcagtcttgttatggatggcgtctgtggagccgcactggatcgccgctagtataatattagagttctttctaatggtgctcctgatccccgagcccgaccgccagcggacaccccaagacaaccagctggcctacgtcgtgattggactcctcttcatgatactgaccgtggccgcgaatgagatgggcttgttagaaactaccaagaaggaccttgggatcgggcacgtcgcggtggaaaaccaccaccacgccgccatgctcgacgtggacctgcatcccgcaagcgcatggacgctgtacgcagttgctaccacaatcataacccccatgatgcggcatacgatcgagaacaccacggctaatatcagcttgaccgctatcgcgaaccaggccgccatcctgatggggctggataagggctggccaatatcaaaaatggacataggcgtccctctcctggccctggggtgctacagccaggtgaacccactcacgctgactgcggctgtcctgatgttagtggctcactacgccattatcggcccggggcttcaggctaaggcgacacgcgaggcccagaagcgaacagccgcaggcatcatgaagaaccccaccgttgacgggatcgtggccatcgatctcgaccccgtggtttatgatgcgaagttcgaaaaacagttgggccagatcatgctgttgatcctctgtacctcacagatcctcttaatgcgcaccacctgggctctatgcgagtccatcacgctggccaccggccccctgaccacactctgggaaggctccccgggcaagttctggaacacgaccatcgccgttagcatggccaacatcttccgggggtcctacctggcgggcgccggcttagctttcagccttatgaagtcgcttgggggcgggcgtcgggggaccggagctcagggcgagacgctgggcgaaaaatggaaacggcaactcaaccagctttccaagtctgagttcaatacgtacaaacggtccgggatcatggaggtggatcgcagcgaggcgaaggagggcctgaaacgcggggagaccaccaagcacgcggtgtcacgcgggaccgccaagctgcggtggtttgtagagcgcaatctcgtgaagcccgaggggaaggtgatcgacctgggctgcggccgtgggggttggagctattactgcgccgggctgaagaaagtcacggaggtcaaaggctatacaaagggaggcccagggcacgaggagcccataccaatggccacgtatgggtggaacctcgttaagctgcattccggcaaggacgttttcttcataccgccggagaagtgcgacaccctgttgtgcgacatcggtgagagctcacccaaccctacgatcgaggagggacgcaccctgcgggtgctgaagatggttgaaccttggctccgcgggaaccaattctgtatcaaaatcctgaacccctacatgccctctgtcgtcgagaccttggaacagatgcagaggaagcatgggggcatgctcgtccgcaacccgctgtccagaaattcgacccacgaaatgtattgggtctcgtgtggcaccgggaacatcgtgagcgcggtgaatatgacgtcacgcatgctgctcaatcgctttacgatggcccaccgtaagcccacatacgagcgcgacgtcgacctgggtgccgggacccggcacgtcgccgtggagccggaggtcgccaatctggacataattggccaacgcatcgagaacatcaagcacgagcacaagagcacatggcactacgacgaggacaacccctacaagacctgggcttaccacgggtcctacgaggttaaaccgtcggggtccgcctcgagtatggttaatggcgtcgtgaaactcctgacaaaaccgtgggatgtcatccccatggttacccagatcgccatgacggacacgaccccgttcggccagcaacgggtgttcaaggagaaggtcgacaccaggacgccgaaggctaagcgggggaccgctcagataatggaggtgaccgcaaagtggctgtggggattcctatcccgcaataagaagccgagaatctgcactcgtgaggagttcacaaggaaggtccgcagcaacgccgccatcggcgccgtcttcgtggacgagaaccagtggaacagtgcgaaggaggccgtggaggacgaacgattctgggacctcgtccatcgtgaacgcgagttacacaagcagggaaagtgcgctacctgtgtgtataatatgatgggcaagcgcgagaagaaattaggggaatttggcaaggcgaaggggagccgggcaatctggtacatgtggttaggcgccaggttcctggagttcgaggccctcggatttatgaacgaagaccactggttttccagagaaaacagcctgtccggggtggagggggagggtctgcacaaactcggctacatcctcagagacataagcaagatcccagggggcaacatgtacgctgacgacactgccggctgggatacacggatcacagaggacgacctacaaaacgaagcccgcatcacggatattatggagccggagcacgcgttgctggccaaatccatcttcaaacttacataccaaaataaggtcgtgcgagtgcagcggcccgccaaaaacgggacagtaatggacgttatcagccgccgggaccagcgcggctctgggcaagttgggacgtacggcttaaacaccttcaccaacatggaggctcagctgatcagacaaatggaaagcgagggaatattctccccaagcgagctggagacacccaacctcgccgagagagtcctggactggctagagaagtacggggtcgagcggctcaagcgaatggcgattagcggggacgactgcgttgtcaagccgatagacgatcgcttcgcaacggctctgacggccctcaacgacatgggcaaggtgcgtaaggacatccctcagtgggaaccctcgaaggggtggaacgactggcagcaggtccccttctgctcccaccattttcaccagctcatcatgaaggatggccgagagatcgtcgtgccgtgccgcaaccaggacgagctggtcggtagagcccgcgtcagccagggggctggctggagcctgagggagaccgcctgtctcggtaaatcctacgcccagatgtggcagctgatgtacttccataggcgcgacctgcgcctcgccgctaatgcgatctgcagcgccgtgcctgtggactggatcccgaccagtcgaactacatggagtatccacgcccaccaccagtggatgactaccgaggacatgctgtccgtctggaaccgcgtgtggatagaagagaacccctggatggaggacaagactcatataagctcgtggggtgacgttccgtatctggggaagcgggaggaccagtggtgcggctccctcatcgggctgaccgcccgtgcgacctgggccaccaacatccaggtggccattaaccaagtgcggaggctgattgggaacgagaactacctcgactatatgacctccatgaagcggttcaagaacgaaagcgacccggagggagccttgtggtga

SEQ ID NO: 24215 - RNA, 9879 nt, synthetic construct
  misc_feature 1..9879: note = derived and/or modified CDS sequence (opt11) from DENV-1__FJ410240__SS-prME
  source 1..9879: mol_type = other RNA
agcgtgaccatgctgttaatgctaatgcccaccgccctcgccttccacctcacgacacggggtggggagccccacatgatagtgagcaagcaggagcgggggaagagcctgctgttcaagacaagcgcgggggtgaacatgtgcaccttaatagccatggacctaggcgagttctgcgaggacacaatgacctataagtgcccccgcatcaccgaggcagagcccgatgacgtggattgctggtgcaacgccaccgacacgtgggtcacctacgggacctgcagccaaaccggcgagcaccgtagggacaagcggtccgtcgccctggcaccccacgtcggcctggggttggagactcgcacggagacctggatgtcatccgaaggtgcctggaagcagatccagagagtcgagacctgggccctgcggcaccccgggttcacggtgatcgccctcttcttggcacacgccataggaaccagcatcacccagaagggaatcatcttcatcctgctgatgctggtgacccccagcatggccatgagatgcgtcggcatcggaagcagggacttcgtggaggggctgtccggagctacgtgggtggacgtggtactcgagcacgggagctgcgtgaccactatggccaaggacaaacccaccctggacatcgagctgctaaagacggaggtcaccaacccggcggttctacggaagctgtgcatcgaagccaagatctccaataccaccacggacagccgctgcccgacccagggcgaggccaccctggtggaggagcaggacgcaaactttgtctgccggcgcacctttgtggacagaggctggggaaacggctgcggtctgttcggtaaggggagtctgatcacgtgcgccaagttcaagtgcgtgaccaagctcgaaggaaagacggtccagtacgagaacctgaagtacagcgtgatcgtgaccgcgcacacgggcgaccagcatcaggtcggcaacgagtccaccgagcacggcaccaccgccaccatcacgccccaggcacccagcacggagatccagctcaccgactacggggccctcaccctggattgcagcccccggacgggcctggatttcaacgagatggtgctcctgaccatgaaagagaagtcctggctggtccacaagcagtggttcctcgacctgccgttaccctggaccagcggggccagtaccagccaggagacatggaaccggaaggatctactggtaaccttcaaaaccgcgcacgccaaaaaacaggaggtagtcgtgctaggctcccaggaaggagctatgcacaccgccctcacgggggccaccgagatccagaccagcggcaccacgacaatcttcgcggggcacctgaagtgccgcctcaagatggacaagctcaccctgaagggtatgtcctacgtgatgtgcaccgggtcattcaagctggagaaggaggtcgccgagacgcagcatggcacggtgctcgtgcaaataaagtatgagggaaccgacgccccctgcaagatccccttctcgacccaggacgagaaaggggtcacgcagaacggccgattaatcaccgccaacccgatcgtaaccgataaggagaagccagtgaacatcgaggccgaaccccccttcggggaaagctacatcgtcataggcgccggcgaaaaagctctgaagttatcctggttcaagaaggggagctccatcggtaagatgttcgaggccaccgctcgcggggctcggcgcatggccattcttggcgacacggcctgggacttcggtagcatcggcggcgtcttcacctccgttgggaagctggtccaccagatattcggcaccgcctacggggtcctgttctcgggcgtgtcatggaccatgaagatcggtatcggcgtgctcctgacgtggctggggctgaacagcaggtccacctctctgtccatgacctgtatcgccgtggggctggtgaccctctacctgggcgtcatggtgcaagcggacagcgggtgcgtgatcaactggaaaggccgggagctgaagtgcgggtccggcatcttcgttacaaacgaggtacacacctggaccgagcagtataagtttcaggctgactccccgaaacgtctcagcgcagccatcggcaaggcctgggaggagggggtgtgcggcatccggtccgcgacccgcctggagaacattatgtggaaacaaatcagcaacgagctgaatcacatcctcctggaaaacgacatgaagttcaccgtcgtcgttggggacgtggcgggcatcctggcccagggtaagaagatgatcaggccgcagcccatggagtataagtacagttggaagtcctggggcaaagccaaaataataggggccgatgtgcagaatacgaccttcatcatcgacggccccaacacgcccgagtgccccgacgaccagcgcgcctggaacatctgggaggtagaggactacggctttgggatcttcaccacgaacatctggctcaagctacgggactcctacacccaggtctgcgatcataggctgatgagcgctgccattaaggactccaaggccgtacacgcggacatgggctactggatcgaaagcgagaagaacgagacgtggaagctcgcccgggcctcgttcatcgaggtgaagacttgcatatggcccaagtcgcataccctgtggtccaacggcgttttagagagcgaaatgatcatccccaagatctacggggggccgatctcacagcataactaccgccccgggtacttcacccagactgccggcccatggcatctggggaagctggagctggacttcgacctctgcgagggcaccacggtggtggtcgatgagcattgcggcaaccgggggccgagcctgcgcaccaccacggtgaccggcaagatcatccacgaatggtgctgccgctcttgcactttgccacccttgcgcttcaagggggaggacggctgctggtacgggatggagatccgacccgtgaaggagaaagaggagaacctggtcaaaagcatggtcagcgccggctccggcgaggtggactctttcagtcttggactcttatgcatcagcatcatgatcgaggaggtcatgagatcacggtggagccggaagatgctgatgaccggaaccctcgcggtgttctttctgctgatcatggggcaactcacgtggaacgacctgatccggctgtgtatcatggtgggcgctaacgcctcggaccgcatggggatgggaactacctacctcgccctgatggccacctttaagatgcgtccgatgtttgcggtcggtttgctttttcggcgcctgacgagccgggaggtgctgctcctgactatcgggctgtccctcgtggccagcgtcgagctgcccaacagtctggaggaacttggtgacgggttggcgatgggcatcatgatcctgaagctgctgaccgacttccagagccaccaactgtgggccacactcctgtccctgacgttcattaagaccaccttcagcctccattacgcgtggaagacgatggcgatggtcctgtccattgtcagcctgttccccctctgcctttccacaaccagccaaaagaccacctggctgcccgtgctcctgggctccttggggtgcaaaccgctcacaatgtttctgatcgccgagaacaaaatctggggccgcaaaagctggcccctcaacgaggggataatggccgtgggaatcgtctcaatcctcctgtccagccttttaaagaacgacgtgcccctggccgggcctctgatcgcgggcggcatgctcatcgcctgttatgtgatttccggtagctccgccgacctgtccctagagaaggcggctgaggtcagctgggaggaggaggcagagcacagcggcgcatcacacaacatcctcgttgaggtgcaggacgatgggactatgaagatcaaggacgaggaacgggatgacaccctgaccatcctgctcaaggccaccctgctggcggtctcgggcgtgtaccctttatccatccctgccacgctgttcgtatggtacttctggcagaagaagaagcaacgcagcggggtcctctgggacacaccgagcccgcccgaggtggagcgggcggtgctcgacgacggcatctaccgcatcatgcagcggggcctgcttgggcgcagccaggtcggcgtgggggttttccaggagaacgttttccacactatgtggcacgtgacccggggggccgtgctgatgtaccagggcaagcgcctcgagccctcctgggccagtgtcaaaaaggacctgattagttacggcggaggttggcggctgcagggcagctggaacacgggggaggaggtccaggtgatcgccgtcgagccgggaaagaatcccaagaacgtgcaaaccgcacccgggaccttcaagacctctgagggcgaggtgggcgcgatcgccctggacttcaagccaggtacgagcggcagccccatagtcaaccgcgaaggaaagattgtaggactgtacggaaacggggtggtcaccacctctggaacgtacgtgagcgctatcgcccaggcgaaagcctcccaggaggggcccctgccggagatcgaggacgaagtgttccggaagcgcaacctcacgatcatggacctgcatccgggcagcggcaagacccggcgctaccttcccgccatcgtacgggaggccatcaagcgcaagcttcgcacactgatcctggcccccacccgcgtggtggcgtccgagatggccgaggcgctcaaaggcatgcccatccgctaccagaccaccgccgtcaagagcgagcacaccggcaaggagatcgtggacctcatgtgccacgcgactttcacgatgcggctattgtcgcccgttcgcgtccccaactacaacatgatcatcatggacgaggcgcatttcaccgacccgagctccattgcggcccggggttacatctcgacccgcgtgggtatgggcgaagccgccgcgatcttcatgacggccacgccgcccggctccgtggaggcgttcccccaaagcaacgccgtcatccaggatgaggagcgtgacatcccggagcgctcatggaacagcgggtatgagtggattaccgacttccccggcaaaacagtgtggttcgtgccgtccattaagagcggcaacgacatcgcgaactgcctgcggaagaacggcaaaagggtcatccaactgtcccgcaagacattcgacacggagtaccagaagaccaagaacaacgactgggactacgtggtgactacagacatcagcgagatgggtgccaacttccgtgccgaccgggtcattgacccccgacggtgcctcaagccggtcatcttgaaagacgggcccgagcgcgtcatcctggcgggccccatgcctgtcacggtggcctctgcggctcagcggagagggcggataggccgcaaccacaacaaggagggcgaccaatacatctacatggggcaaccgctcaataacgacgaggaccacgcccactggaccgaggccaagatgttgctagacaacatcaacacccccgaggggatcataccggccctgttcgaacccgagcgggagaagtccgcggcaattgatggtgagtaccgcctccgcggggaggccaggaagactttcgtcgagctgatgcgccgaggggacctcccggtttggctgtcctataaggtggcctccgagggctttcagtacagcgaccgccggtggtgcttcgacggcgagcgcaacaaccaggtcctggaagagaatatggacgtagagatctggactaaggagggggagcggaagaagctcaggcctcggtggctggacgcccgcacatactcggatcccctggcgctcagggagttcaaagagttcgcagccggccgccggtcagtgtccggggacctgatcctggagatcggcaaattaccacagcacctaacccaacgcgcccaaaatgccctggacaacctggtcatgcttcacaacagcgagcagggtgggcgggcctaccgccacgccatggaggagctgccggacaccatcgagacgctcatgctgctggccctcattgccgtgctgaccggcggggtgactctgttcttcctctccggccggggcttaggcaagacttcaatcggcttgctctgcgtcatggcgtcgagtgtgctgttgtggatggcctccgtggagccccactggatcgccgcaagcatcatcctcgagttcttcctgatggtgttgctcatccccgagcccgaccgccagcggaccccccaggacaaccaattggcgtacgtggtgatcgggctcctcttcatgatcctgacggtcgcggccaacgagatgggtttgttggagaccaccaagaaggacctggggataggccacgtggccgtggagaatcaccaccacgcagccatgcttgacgtcgacctccatcctgcgtccgcctggaccctgtacgccgtggccacgacaatcatcacaccgatgatgcgccacaccatcgagaacaccaccgccaacataagcctgacagcgatcgctaaccaggccgccatcctcatggggttggacaaaggctggccgatctcgaagatggacataggcgtgcccctcctcgcgctggggtgctacagccaggtcaaccccctgaccctcacggcagccgttctgatgctggtggcccactacgccatcattggcccggggttacaggcgaaagccacccgggaggcacagaagcgcacagccgccggcatcatgaagaacccgaccgtcgacggaatcgtggcgatcgacctcgaccccgtggtctacgacgccaagttcgagaagcagcttggccagatcatgctcttaattctgtgcacttcccagatcctcctgatgcgcaccacctgggcgctgtgcgagtctatcaccctcgcaacgggccctcttaccaccctgtgggagggttcccccggtaaattctggaacaccacgatagccgtgagcatggcgaacatctttcgggggagctacctcgccggcgccggcctggccttctccctgatgaagtcccttgggggcggtcgccggggcaccggggcccagggcgagaccctgggcgagaagtggaagcgccaactgaatcaactcagcaagagcgaatttaacacctacaagagatccgggatcatggaggtggaccgcagcgaggccaaggagggccttaaacgcggagaaacgaccaagcacgccgtctcccgtggcaccgccaaactgcggtggtttgtggagcgcaatttggtgaagcctgaggggaaggtcatagacctgggctgtgggcgcggaggatggtcatactattgcgccgggctcaagaaggtgaccgaagtgaaggggtacactaagggtgggcccgggcacgaagagccgatacccatggcgacctatgggtggaatctggtcaagctccactccggcaaggacgttttctttatcccgcccgaaaaatgtgacactctgctgtgcgacattggggaaagttctcccaaccccaccatcgaagagggccgcacgctccgggtgcttaagatggtcgagccgtggctgcgcgggaaccagttctgtatcaaaatcctcaacccctatatgcccagcgttgttgagaccctcgagcagatgcagcggaagcacggggggatgctggtccggaaccctctctcccggaacagtacccacgagatgtactgggtttcctgcgggaccgggaacattgtgagcgccgtcaacatgacgtcccgcatgctgttgaaccggttcacgatggctcaccgtaagcctacctatgagcgcgacgtggacctcggggccggcaccagacacgtggccgtcgagccagaggtggcgaacctggacatcatcgggcaacgcatagagaacatcaagcacgagcacaagagcacatggcactacgacgaggacaacccatacaagacgtgggcgtaccacgggtcctatgaggtgaagcccagcggcagcgcctcgagcatggtcaatggtgtggtcaagcttttaaccaagccgtgggacgtgatccccatggtcacccagatcgccatgaccgacacaacacccttcggccagcaacgggtcttcaaggagaaggttgatacccgcactcccaaggcaaagcggggtaccgcgcagataatggaggtgactgccaagtggctgtggggattcctgtcccggaacaagaagccgcggatctgcacgcgcgaggagttcacccggaaggtccgctcgaacgccgccatcggagcggtgtttgtggacgagaatcagtggaactccgccaaggaagccgtggaggacgagaggttctgggacctcgtgcatcgcgagcgggagttgcacaagcaggggaagtgtgcaacgtgtgtctacaacatgatgggaaagagggagaagaagctgggggagttcggaaaggccaaggggtcccgggctatctggtacatgtggctcggcgcgaggttcctggagttcgaggccctgggttttatgaatgaggaccactggttctcacgggagaacagcctctccggtgtcgagggcgaggggctgcacaagctgggctacatcctccgggacatatctaagatccccgggggcaatatgtacgccgacgacaccgccggctgggacacccggatcaccgaggacgaccttcagaatgaggcgaagatcacggacatcatggagcccgagcacgccctgctcgccaagtccatatttaaactgacctaccagaacaaagtggtgcgcgtccagcggccggcgaagaacgggaccgtgatggacgtgattagtcgccgcgaccagcggggtagtgggcaggtcggcacttacggcctgaacacattcacaaacatggaggcccagctcatccgccagatggaatccgaagggatcttttcccccagcgagctcgaaaccccaaacctagcgggacgagtgctcgactggctcgagaaacacggggtagagcgactgaagcggatggccatcagtggcgatgactgcgtcgtgaagcctatcgacgaccggttcgccaccgctcttacggctctcaacgacatggggaaggtacggaaagacatcccgcagtgggagcccagcaaaggctggaatgactggcaacaggtccccttctgcagtcaccatttccaccagctgataatgaaggacggccgcgagatcgttgtgccctgccggaaccaggacgagctcgtcgggcgcgcgcgggtgtcccaaggtgccgggtggtcactgcgcgagaccgcctgcctgggcaagtcctacgcccagatgtggcagctcatgtactttcaccggcgcgacctgcggctggcggccaacgcgatctgcagcgcggtaccggtcgactgggtgcccacatcacgcaccacgtggagcatccacgctcaccaccagtggatgacgaccgaggacatgctctccgtatggaaccgggtctggatcgaagagaatccctggatggaggacaagacacacatcagctcctggggcgacgtcccctacctgggcaagagagaggaccagtggtgtgggagcctgatcgggctcacggcgcgggccacctgggccaccaacatacaggtggcgattaaccaggtccgccgcctaatcggaaacgagaactacctggactatatgacctccatgaagcgattcaagaacgaatccgatccggagggggccctctggtga

SEQ ID NO: 24216 - RNA, 9879 nt, synthetic construct
  misc_feature 1..9879: note = derived and/or modified CDS sequence (opt11) from DENV-1__FJ410242__SS-prME
  source 1..9879: mol_type = other RNA
tcggtgaccatgctgctcatgctgatgccgaccgcgctggccttccacctcaccacccgggggggggagccgcacatgatcgtgagcaaacaagagcgggggaagagccttctgttcaagactagcgcaggcgtgaacatgtgcaccctcatcgctatggacctgggagagttctgcgaagacaccatgacatacaaatgcccgcgcatcaccgaggctgagcccgacgacgtcgactgctggtgcaacgccaccgacacgtgggtcacctacggtacttgcagccaaaccggcgagcaccggcgggacaagcggagtgtggcgctagctccccacgtgggcttagggttagagacccgcaccgagacctggatgagctcggagggcgcttggaagcagatacagcgggttgagacatgggccctgcgtcatccgggtttcacggttatcgccctcttcctcgcgcatgcaatcggcacctctattacccagaagggtatcatatttatcttgctcatgctggtcaccccctctatggccatgcggtgcgtcggcatcgggagccgcgacttcgtggaggggctgtccggagccacgtgggtggacgtcgtgctcgagcatgggagctgtgtgaccaccatggctaaagacaagcccacgctggacatcgaattgctgaaaacggaagtaactaaccccgcggtgttacggaaactgtgcattgaagccaaaatatccaacaccactacggacagccgttgcccgacccaaggcgaagcgacgttagtggaggagcaggacgccaatttcgtgtgccggcgcacctttgtggaccgcggctgggggaacggatgcgggctgttcggcaaagggtccctgataacgtgcgcgaagttcaagtgcgtgaccaaacttgagggaaagatcgtccagtacgaaaacctgaaatatagcgtgatcgtgaccgtccacaccggggatcagcaccaagtggggaacgaatccaccgagcacggcaccacggcgactatcacgccgcaagcacccagcacggagatccagttgactgactatggagccttaaccttagactgcagcccgcggacaggcttggacttcaacgagatggtcctattgacgatgaaggagaaatcttggctggttcacaagcaatggttcctcgatttgccgctgccatggaccagcggagcgtccactagccaagaaacttggaaccggaaggacctcttagtgacttttaagaccgcccacgcgaagaaacaggaagttgtggtgctgggatcccaggagggcgccatgcacaccgccctcaccggggctactgagatccagaccagtggtacaactacaatctttgcagggcatcttaagtgtcgcctgaagatggacaaactaaccctgaagggcatgtcctacgtcatgtgcacaggcagctttaaattagaaaaggaggtcgcggaaacacagcacggcacggttctcgtccagattaagtatgagggcaccgacgccccctgcaaaattccgttctccacccaagacgaaaagggcgtgacccagaatggacgattaatcacggcgaacccgatcgtgactgacaaggaaaagccggtcaacatcgaggccgagccgcctttcggggagagctacatcgtaatcggcgcgggtgagaaagccctgaaactgtcctggttcaagaaaggaagctccattgggaagatgtttgaggccacggcacgcggggcccggcgcatggcgattctcggagacaccgcatgggatttcgggagcattggcggcgtgtttacatccgttgggaagctggtgcaccaaattttcggcaccgcctacggtgtgctgttcagcggggtctcctggacgatgaagatagggataggcgtgttgctgacctggctggggctcaatagcagatccacgagcctgtccatgacatgcatcgctgtggggctggtgaccctctacctgggcgtgatggtacaagcggacagtgggtgcgtcatcaactggaagggccgggaactgaagtgcgggagcggcatctttgtaacaaatgaggtacacacgtggaccgaacagtacaaattccaggcggactccccaaagcgcctcagcgccgcgatcgggaaggcctgggaagagggggtttgcggcatccgctccaccacacggttagaaaacatcatgtggaaacaaatctctaatgagttaaaccacatcctacttgagaacgacatgaagttcaccgttgtagtgggggacgtggccggcatccttgcgcaggggaagaagatgattcggccgcagcccatggagtacaagtactcgtggaagtcctggggaaaagccaaaattatcggcgccgatgtgcagaacacaacgttcatcatcgacgggcccaacaccccggagtgcagtgacgaccagcgcgcctggaacatctgggaggtcgaggattacggtttcgggatcttcaccacgaacatatggctcaagctccgggacagctatacccaagtgtgcgatcaccgactgatgagtgcggctatcaaggatagcaaggctgtgcatgccgacatgggctactggatcgagtccgaaaagaacgagacctggaaattagcccgtgctagcttcatcgaggttaagacgtgcatctggcccaagtctcatacgctgtggagcaacggtgtcctggagtctgagatgatcatccccaagatctatgggggaccgatcagccaacacaattaccggccgggatacttcacccagacagccgggccctggcaccttgggaagttggagcttgacttcgacctttgcgaaggcaccacggtggttgtcgacgagcactgtggcaaccgggggccctccctacgaaccaccacagtgacgggtaaaatcattcatgagtggtgctgccgctcgtgtaccctcccgcccctccgcttcaagggggaggacggctgttggtatggcatggaaatccgacctgtcaaggaaaaggaagagaatcttgtgaagagcatggtatctgcgggcagcggcgaagtcgactccttctcattaggtctcctgtgcatatccatcatgatcgaggaggtgatgcggagcaggtggtcccgcaagatgctgatgaccggcactctcgcagtattcttcttactgatcatggggcagctcacgtggaatgacctgatccggttgtgcatcatggtcggcgccaacgcgtcggatcggatggggatgggcaccacctaccttgccttgatggcgaccttcaagatgcgtcccatgttcgccgtgggcctcctgtttcggcgcttaacgagcagggaggtgctgctccttaccattgggctaagtctcgtcgcctccgtggagctaccgaacagcctggaggagcttggggatgggctggcgatgggcatcatgatcctgaagctcctgaccgacttccagtcgcaccagctctgggccaccctcctgagcctaaccttcatcaaaaccactttctccctccactatgcctggaagaccatggccatggtactgtcaattgtgtccctcttccccttatgcctcagcactacatcccagaaaactacgtggttgcccgttcttcttggtagtctgggttgcaagcccctcacgatgtttttaatcgcggaaaacaagatctggggccgtaagtcgtggcctttgaacgaggggatcatggctgtcggcatcgtgtccatcctcttgtctagtctgctcaagaatgacgtgcccttggcagggccccttatcgccggcggcatgctcattgcctgctacgtgatctctggctccagcgctgacctgtccttggagaaggccgccgaagtgtcgtgggaagaagaggccgagcactctggcgccagccacaacatcctcgtggaggtccaggacgacgggaccatgaagatcaaggacgaggaacgggacgacaccctaaccatactgctgaaggcgaccctgttagccgtgtctggggtgtaccccctcagcatcccggccacgctgttcgtctggtatttctggcagaagaagaagcagcgctccggggtgctatgggacaccccttctccgcccgaagtggagcgggctgtcctcgacgatgggatctaccgcatcatgcagcgagggctgctggggcgctcccaggtgggcgtgggagtgtttcaggagaacgtcttccacacgatgtggcacgtcacgcggggcgcagtactgatgtatcaggggaaacgcctcgagccgtcttgggcgtccgtgaaaaaagacctgatcagttacggcggcggctggcggctgcaggggagctggaatacgggggaagaggtccaagtcatcgccgtcgaaccgggtaagaaccccaaaaacgtgcagaccgcccccgggaccttcaagacgtcagagggggaggtcggcgccatagctcttgacttcaaaccggggacgtccggctcacccatcgttaaccgagaggggaagatcgtgggcctctatggcaacggggtcgtgacgaccagcggaacctacgtgtccgcgatcgcccaggccaaggcctcacaggaggggcccctgcccgagatcgaggacgaggtgttccgaaagcggaatttaacgatcatggacctgcacccgggctccgggaagacccgccgctacctgcccgcaattgtgagagaggccatcaagcgcaagcttcgcacgctcatcctggccccaacacgcgtagtcgcgagcgagatggccgaagcgctcaagggcatgccgattcgctaccagacgacagccgtgaagagcgaacatacaggcaaggaaatagtggacttgatgtgccacgcgaccttcacaatgcggctcctcagccccgtacgagtacccaactacaatatgatcatcatggacgaagcccacttcacggacccctctagcatcgccgcccggggatatatttccacgcgcgtgggaatgggggaggccgccgccatcttcatgacagccacgccgccgggcagcgtagaagcgttcccccagtccaacgccgtgatacaagacgaggaacgtgacattccagaaaggagttggaactccggatatgagtggatcaccgacttcccggggaaaacggtatggttcgtgcccagcataaagtccggcaacgacatcgccaactgcctacgcaaaaatggcaaacgcgtgattcagcttagccggaaaacatttgacacggagtaccagaagacaaagaataacgactgggactatgtcgtcaccaccgacatctccgagatgggcgccaatttccgcgcggacagagtgatcgatcctcgcagatgcctcaagcccgtgatccttaaagacgggccggagagggtcatactggcgggcccaatgccggtgacagtcgcctcggcagcccagcggcgcggccggataggtcgaaaccacaataaggaaggcgaccaatacatatacatgggtcagccccttaacaatgatgaggatcacgcgcactggacagaggccaagatgttgctggacaacattaataccccggagggcattatcccggcgctcttcgaacccgagcgggagaagtcggccgccatcgatggggaatacagattgcgcggggaagcgcggaaaaccttcgtggagctgatgcgccgcggggatctccccgtttggctctcctacaaggtcgcgagcgagggatttcagtacagtgaccgccggtggtgcttcgacggagagagaaataaccaagtgctggaagagaacatggacgtggagatctggacgaaggagggcgagcggaagaaactcaggcctcgctggctggacgcccgcacctactcggatcccctggccctccgtgaatttaaggagttcgccgcgggccgccgtagtgtctccggagatctgattcttgagattggcaagctcccccagcacctgacccagcgtgcccagaacgcgctggacaacctcgttatgctgcacaattccgaacaaggcgggcgtgcctatcgccatgcgatggaggaactgccggacaccatagagaccctaatgctcttagccctcatagcagttttgaccggcggcgttaccctttttttcctcagcggacgagggctgggcaagacctccatcggcctgctctgcgtgatggcaagctctgtactgctgtggatggcctccgtcgagccgcactggatcgcggcctctatcatcctcgagttttttttaatggttctgctaatccccgagcccgacaggcaacggacacctcaggacaaccagctagcttacgtggttatcgggctccttttcatgatcctgacagtagccgctaatgagatgggcttattagagacgaccaagaaagacctaggtataggccacgtggcagcagagaaccatcaccatgcagccatgctagacgtcgaccttcacccggccagcgcgtggacattgtacgccgttgccacaaccatcattacaccaatgatgcgccacaccatcgagaacactaccgccaatatctcccttacagccattgcgaatcaagccgcaatcctcatggggctcgacaagggctggccaatcagcaaaatggacatcggcgtgcctctcctcgccttagggtgctattcccaagtcaatcccctgaccctcactgctgccgtgttaatgttagtcgcccactacgccattatcgggcccgggctccaggcgaaggcgacgcgggaagctcagaagcgcaccgccgccggaattatgaagaaccccactgtcgatgggatcgttgccatagacctcgacccggtggtgtacgacgcgaagtttgagaagcaactggggcagattatgctgctgatactttgcacgagccagatcctcttgatgcgcaccacctgggcgctgtgcgagtccatcaccctcgctacaggcccactgaccacgctgtgggagggtagtcccggcaagttctggaataccaccatcgcggtgtctatggcgaacatattccgtggctcctacctagccggcgccggcttggccttcagcttgatgaagtccttaggtgggggtcgacggggtaccggcgcccagggagaaaccctgggggagaagtggaagcgccagctgaaccagctgtccaagtccgagttcaatacctacaagcgatccgggatcatggaggtagaccgctccgaagcgaaggagggcttgaagaggggcgagacgaccaagcatgccgtttcgcgaggtactgcgaaactgcggtggttcgtagaacggaacctcgtcaaacccgaggggaaggtcatcgatttggggtgcggccgcggcggttggtcctactactgcgcagggctgaagaaagttacagaggtgaagggatacacaaagggggggccgggccacgaggaacccataccgatggcaacctacggttggaacttggtgaaacttcacagcggcaaggacgtgttcttcataccgcctgagaagtgcgacactctgttgtgcgacatcggggagtcctctccaaacccaaccatcgaggagggccgcacgctccgggttctgaaaatggtcgagccctggcttcgcggaaatcaattctgcatcaagatcctcaacccctatatgccctccgtggttgagaccctggaacagatgcaaaggaagcacggcggaatgctggtccgaaaccccctcagccggaactccacccatgagatgtactgggtgagctgtggaactggtaacatcgtgtccgcggtcaacatgacatcgaggatgctgctcaatcggtttaccatggcccaccgcaagcccacttacgagcgcgacgtggatctcggcgccgggaccaggcacgtggcggtcgagcccgaggtggccaacctggacattatcggccagagaatagaaaatatcaaacacgagcacaagagtacctggcactacgacgaagacaacccctacaagacgtgggcctaccatgggagctacgaggtgaaaccctctggcagtgccagcagtatggtcaatggcgtcgtcaagctcttaaccaagccctgggacgttatcccaatggtgacgcagattgccatgaccgacacaaccccattcggacagcagcgcgtctttaaggaaaaggtggatactcgcacccccaaagcaaaacgaggtactgcccagatcatggaggtgacagcgaagtggttgtggggctttctgagccgcaacaaaaagccacggatctgcactcgcgaggagttcacacggaaggtccgatcaaacgccgccataggcgccgtattcgtggacgaaaaccagtggaatagcgcgaaggaggccgtcgaggacgaacggttttgggacctcgtccaccgagagagggagctgcacaagcaggggaagtgtgccacgtgtgtttataatatgatgggcaagcgcgagaagaagttgggggaatttggcaaagccaaggggtcccgggcgatctggtacatgtggctcggcgcgcggttcctggaatttgaagcccttggcttcatgaacgaagatcactggtttagccgagagaactcccttagtggcgtcgagggcgagggtctgcacaagctgggctacatcctccgggacatttccaagatcccgggggggaacatgtacgcagacgatacagccggctgggatacccggatcacagaggacgacctgcaaaacgaggcaaagatcacagatatcatggaaccggagcacgcgcttcttgctaagagcatatttaagctgacctaccagaacaaggtcgtgcgcgtacagaggcccgccaagaacgggaccgtgatggacgtgatttcccgcagggaccagagaggctcaggtcaagtcggtacatacggcctcaacacgtttaccaacatggaggcgcaactcatccgccagatggaaagtgaggggatattctcgccttccgaactggagacccccaatctggctggccgcgtgctcgactggcttgagaagcacggggtcgaaagactaaagcgtatggcgatcagcggcgacgactgcgtcgtgaagcctatcgacgaccgctttgccaccgccctgacggccctaaacgacatgggaaaagtgcgcaaagacatcccacagtgggagcccagcaagggatggaacgactggcagcaagtccccttctgctcccaccacttccaccaactgatcatgaaagacggccgggagatcgtggttccctgtaggaatcaagatgagcttgtcgggcgagcccgggtgagccagggcgcggggtggagcctgcgagagaccgcctgtttgggcaagagctacgctcagatgtggcagctcatgtactttcaccggagggacctccggctggccgcgaacgcgatctgttccgccgtgccagtcgactgggtgccgaccagccgcaccacgtggtccattcatgcgcaccaccaatggatgacaaccgaggacatgctcagcgtgtggaaccgggtatggattgaagagaacccctggatggaggacaagacccacatctcatcctggggcgacgtgccctacctgggcaagcgcgaagaccagtggtgcggctccttaatcggcctaactgcgagggcgacttgggccactaacatccaggtcgctatcaaccaagttcgccgcttaatcggaaacgagaattatctagactacatgacatctatgaagagattcaagaatgagtccgaccccgagggagccctatggtaa

SEQ ID NO: 24217 - RNA, 9879 nt, synthetic construct
  misc_feature 1..9879: note = derived and/or modified CDS sequence (opt11) from DENV-1__FJ410243__SS-prME
  source 1..9879: mol_type = other RNA
agcgtgaccatgttgttgatgttaatgcccaccgcgctggcgttccacctcaccacccgcggcggggagccgcacatgatcgtttcgaagcaggagcgggggaagtccctgttgtttaaaaccagcgcgggagtgaacatgtgtaccctcatcgcaatggacctgggagagttctgcgaggatacgatgacctacaagtgcccccgcatcaccgaagccgagccggacgacgttgactgctggtgcaacgcaaccgatacgtgggtcacgtacgggacttgcagccagaccggcgagcatcggcgcgacaagcggtcggtggcccttgcgccccacgtgggcctcgggcttgaaacgagaaccgagacatggatgtcgtccgaaggcgcctggaagcaaatacagagggtggagacatgggctctgcgtcatcccgggtttacggttatagctctcttcctggcgcatgccatcggcacctccatcacccagaaggggataatcttcatactactcatgctggtgaccccctccatggctatgcggtgcgtgggtattggcagccgggatttcgtcgaggggctgtccggtgccacatgggttgacgtagtgctcgagcacggctcatgcgttacgaccatggcgaaggacaagcccactctggacatcgaactgctcaagacggaagtcaccaatcccgcagtcctccggaagctgtgcatcgaggccaagatctccaacaccaccacggactctcggtgccccacacagggcgaggccacactcgtggaagagcaagacgcaaactttgtctgccgccgcacctttgtggaccggggctgggggaacggctgcgggctgtttggaaaggggtccttgatcacatgcgcaaagttcaagtgcgtgaccaagctcgagggcaagaccgtccagtacgagaatttaaagtattctgtgatcgtgaccgtccatacaggggaccagcatcaagtggggaacgagtccaccgaacacggcaccaccgctacgatcacgccccaggctcccagcaccgagatccagcttaccgactatggggcgctcaccctagactgcagcccccggactggcctggacttcaacgagatggtactccttaccatgaaggagaaggcctggttagtgcacaagcaatggtttctcgacctgccgctgccctggaccagcggggcctcgacctcccaagagacgtggaatcgaaaggacctcctggtgaccttcaagaccgcgcacgcgaagaagcaggaggtggttgtactgggtagccaagagggcgccatgcacaccgccctcactggggcaacagagatacagacctccggtacgacgaccatctttgcggggcacctgaagtgtcgtctgaaaatggataagctcacccttcgcggaatgtcgtatgtcatgtgcaccggctcctttaaattggagaaggaggtcgctgagactcagcacggcaccgtactcgtccaaatcaagtatgagggaaccgacgctccctgcaaaatcccgttcagcacgcaagacgagaagggcgtgacgcaaaacggtcgcttgatcaccgccaaccccatagtgaccgacaaggagaagcccgtgaacatcgaagcggagccgccctttggggagtcctacatcgtgatcggtgctggcgagaaggctctgaagctgtcatggtttaagaaggggtcctcgatcggcaagatgttcgaggcaaccgcccgcggggctcgtaggatggcaattctcggcgatacagcatgggacttcggatccatcggcggcgtgttcacctccgtcgggaaactggtgcatcagatctttggcacagcctatggggtgctgtttagcggcgtcagctggaccatgaagatcgggatcggcgtgctactgacctggctgggccttaacagtcggagcacatccctgtcaatgacctgcatcgccgtggggttggtcacgctctacttgggcgtgatggtgcaggcggattccggctgcgtcattaactggaagggccgcgaactgaagtgcgggagcggcatctttgtgacgaacgaggtccacacatggaccgagcagtacaagttccaggcggatagcccgaagcgactctcagccgccatcggaaaagcctgggaagaaggggtctgtggcattcgctcggcaaccaggctggagaatatcatgtggaagcagatctccaacgagctgaatcacatcctgttggagaacgacatgaagttcacagtcgttgtgggtgatgtggcaggcatcttagcccaggggaagaagatgatccgcccacagccaatggagtacaagtacagctggaagtcctggggcaaggccaaaataattggagctgatgtgcagaacgccacgttcatcatcgacggcccaaacacgccggaatgccccgacgaccagcgggcttggaacatctgggaggtcgaggactacggattcgggattttcaccactaacatatggctcaagctgcgcgactcctacacccaagtgtgcgatcaccgactgatgtccgccgcaatcaaggatagcaaggcggtgcacgccgatatgggctactggatcgagtccgaaaagaacgagacctggaagctcgcacgcgccagtttcatagaggtaaaaacctgcatctggcccaagtcccacaccctgtggagcaacggcgtcctcgaaagcgagatgatcatccccaaaatctatggcggccctataagccaacataactacaggccggggtatttcacgcaaaccgcgggtccctggcatctcgggaagctggaactggacttcgacctgtgcgagggtaccaccgtagtcgttgacgagcactgcggcaaccgcggtccgtcacttcggacgaccacagtgaccgggaaaattatccacgagtggtgttgtcgaagctgtacgctcccgccgctgcggttcaagggggaggacggctgctggtatgggatggaaatccgccccgtcaaggaaaaggaggagaacctggtgaagtccatggtttccgcgggctccggcgaggtggatagcttcagcctggggttactgtgcatatccatcatgattgaggaggtgatgcgatctcgctggtccaggaagatgttaatgaccggcacccttgccgtgtttttcctgctgattatggggcagctcacttggaacgacctaatccgtctgtgcatcatggtcggcgccaacgccagcgaccgcatgggcatgggcacgacctacctcgcgcttatggcgactttcaagatgaggccgatgtttgccgtggggctcctgttccgacggcttacttctcgcgaagtgctactcttgacgattgggcttagcttagtcgccagtgtggaactgcccaactccctggaagaactcggggacggtttagctatggggataatgatcttaaagctcctgacggacttccagtcccaccaactctgggcaacccttctaagcctgaccttcattaagactaccttctccctccactacgcatggaagaccatggctatggttttgagcatagtgtctctgttccccctctgcctgagcacaacgtcccaaaagactacctggctccccgtactcctgggaagcttaggatgcaagccgttgacaatgttcctgattgccgaaaacaagatctggggccggaaatcctggcccctgaacgaaggaatcatggccgtcgggatcgtgagcatcctcctgtcttctctcctcaagaacgatgtccccctagctgggccgctgattgccggtggcatgctcatcgcctgctacgtcatcagcgggtccagcgcagacttatccttagaaaaggccgctgaagtaagctgggaggaagaagccgagcactccggcgccagccacaacatcctagtggaggtccaggacgacggtcccatgaagattaaggatgaggagcgcgacgacatgctgacaatcctgcttaaagcgaccctgctggccgtgagtggagtttaccccctcagtatcccagcgacccttttcgtctggtatttctggcagaagaagaaacagcggtccggggtcctgtgggacacgcccagcccccccgaagttgaacgcgcggtgctcgacgatggtatatacagaataatgcagcgcggcctgctggggcggtcccaggtgggggtaggcgttttccaggagaacgtgttccacaccatgtggcatgtcacgcgcggagccgtcctgatgtatcagggcaagcggctcgagccaagttgggccagcgtgaagaaggaccttatcagttacggcgggggatggcgcctccagggttcctggaataccggggaagaggtgcaggtcatcgccgtagagcccggcaaaaatccgaagaatgtacagacggcgcccggtaccttcaagacgagcgagggagaggttggcgctattgcacttgactttaaacccgggacctccggcagccccatcgtgaatcgggaggggaagatagttggcctgtacggcaacggggtcgtgacgaccagcggcacgtacgtgtcagccatcgcgcaggcgaaggcctcgcaggaggggcctctgcccgagatagaggacgaagtatttcgaaaacggaacctcactatcatggaccttcatcccggctccggcaagacccgccggtacctgccagcaatagtgcgagaggccatcaagcgcaaactacgtactctgatcttggcccccacgcgcgtagtcgcctccgagatggccgaagcgttaaaaggtatgcccatcaggtaccaaaccaccgcggtgaagtcggagcacacaggtaaggagatcgtagacctgatgtgccacgccactttcaccatgcgcttactctcgcccgtccgagtgccgaactacaacatgatcatcatggacgaggcccactttacagacccgtcctctatagccgcccgcgggtacatatccacccgggtcggcatgggcgaagcggcggcgatatttatgacggcaactccacctggttccatggaggccttcccgcagtccaacgcagttatccaagatgaggagcgcgacattcccgagagaagctggaacagcggctacgaatggatcactgatttccccggaaagacagtgtggttcgtgcccagcatcaaaagtggtaacgacatcgctaactgcctgcggaagaacggtaagcgggtcatccagctgagccggaagacgttcgatacggagtaccaaaagaccaaaaacaatgactgggactatgtggtaaccaccgatatctcagagatgggcgccaacttccgggccgaccgcgtaatagatccgcggcgctgcctcaagcccgtgattcttaaggatgggcctgaacgcgtaattctggccgggcccatgcccgtcaccgtggcgagtgccgcccaaagaagggggcgcattggccgaaatcacaataaagagggggaccagtacatctacatgggacaaccactcaacaatgacgaggaccacgcccactggaccgaggcaaagatgctgctagataacatcaatacccctgaaggcatcatccccgctctcttcgagcccgaacgcgagaagtccgccgccattgacggggagtaccgactgcgaggcgaggcccgcaaaacatttgtcgaactcatgcggcgcggagacctgccagtttggctttcttacaaagtcgcctcagagggcttccaatattccgaccgtcgctggtgcttcgatggcgagcggaacaatcaggtgctggaagagaacatggatgttgaaatctggaccaaggaaggggaacgcaagaaactccggccgaggtggctggatgcgcggacctacagcgaccctctggcgctgcgtgaattcaaggaattcgctgccggcaggaggagtgtatcgggcgacctgatcctcgagatcggtaagttgccgcagcacctgacgcagcgggcgcagaacgcgttggacaacttagtcatactacacaactccgagcaaggcgggcgggcttacaggcacgccatggaggagctgcccgacacgatcgagacgctcatgctgctggccctcatcgcagtcctgactggcggggtgaccctttttttcctctcgggccgcgggctgggcaaaacttccatcggacttttgtgcgtcatggccagctccgtactgttatggatggcctctgtggaaccccactggatcgccgcttccatcatcctcgaattcttcctgatggtactgctcatccccgagccggatcggcagcgcacgccgcaggacaaccagctggcatacgtggtgatcgggctactgttcatgattctgaccgtcgcagccaacgagatgggcttgttagaaaccacaaagaaggacttagggatcggccacgtcgccgtcgagaaccaccaccatgccgcgatgctggacgtggacctgcaccccgcctccgcatggacgctctacgccgtggccacgaccatcatcaccccgatgatgcgccacacgatcgaaaacaccaccgcgaatatctccctgaccgccatcgccaaccaggctgcgatcctcatgggactggacaagggttggccgattagcaagatggatatcggcgtgccactgctcgccctggggtgctactcccaggtgaatccactgacgctcaccgccgccgtgcttatgctggtggcacactacgccatcatcggcccgggcctccaggccaaagccacccgcgaggcccagaagaggaccgccgcgggcatcatgaaaaacccgacggttgacgggatcgtggctattgacctggaccccgttgtttacgataccaagttcgagaagcaacttggccagatcatgcttctgattctgtgcaccagccaaatcctcctgatgaggaccacgtgggccttgtgcgagtccataaccctcgccaccggcccgctgaccacgctctgggaagggtccccgggcaagttctggaacacaaccatcgccgtgtccatggcgaatatctttcgcgggtcgtatctcgcgggtgccggtctggccttttcactgatgaaatcccttgggggggggcggcgcggcactggggcgcagggcgagacgctgggtgagaaatggaaacgacagctaaaccaactcagtaaatcggagttcaacacctacaagcgttccgggatcatggaggtggatcggtccgaagcaaaggaaggcctcaaaaggggagagaccaccaagcacgccgtctctcggggcacggccaagttgaggtggttcgtggagcgcaacctcgtgaagcctgagggcaaagttatcgacttaggctgcggacgcggggggtggtcctattactgtgccgggctgaagaaggtcaccgaggttaagggctacacgaagggcgggccaggccatgaggaacccataccgatggcaacctacgggtggaacttagtcaagcttcactcggggaaggacgttttcttcattccgcctgaaaagtgcgacactctgctgtgcgacatcggggagtccagccccaatccgaccatcgaggaaggccggaccctcagagtacttaagatggttgagccctggctgcgggggaatcagttctgcatcaaaatactcaatccctatatgccgtctgtggtcgagaccctggagcagatgcagcgtaagcacggcggcatgctggttagaaaccctctcagccggaattccacgcacgaaatgtattgggtatcatgtgggaccggaaacatcgtgtccgccgtcaatatgacctcccgaatgctgcttaaccgcttcacaatggcccatcgtaagcccacctatgaacgtgatgtggacctcggggcaggcacgaggcacgtggcggtagagcccgaagtggcgaacctggacatcatcggccaacggattgagaacattaagcatgagcacaaatcgacatggcactacgacgaggacaacccctacaagacatgggcataccacgggagctacgaggtcaaaccatcaggcagcgccagctccatggtcaatggggtggtcaaactgctaaccaagccctgggatgtgatacccatggtgacgcagatcgctatgacagatactactccctttggccagcaacgcgtctttaaagagaaggttgacacgcggaccccaaaggccaagcgcgggaccgcgcagatcatggaggtgacggcaaagtggctgtggggtttcctgagcaggaacaagaaacctcgcatctgcacacgggaagagttcacccgcaaggtcagatctaatgccgcgatcggcgcggtctttgtcgatgagaaccagtggaacagcgctaaggaggccgtcgaggacgagagattctgggacctcgtacacagagagcgtgaactacacaagcaggggaaatgcgcaacctgcgtgtacaatatgatggggaagcgggagaaaaagctgggagagttcggcaaggccaagggctcccgcgcaatctggtacatgtggctcggcgcccggtttcttgagtttgaggccctgggcttcatgaacgaagaccactggttcagtcgcgagaactcactaagcggcgtcgagggagaggggctgcacaagctgggatacatattacgggacatttcaaagatcccaggtggcaacatgtacgccgacgacaccgcgggttgggacacgaggatcaccgaggatgacctgcagaacgaggccaagatcaccgacataatggagccggagcacgccttactcgccaagtccatcttcaagctgacctaccaaaacaaagtggtgagagtccagaggccagctaagaacggaacggtcatggacgttatttcccgccgggatcagaggggaagcggtcaggttggaacctacggtctaaacacctttacaaacatggaggcgcaactcatccgacaaatggagtccgagggtatcttcagcccttccgagctggaaacacccaatctagcgggccgcgtgctcgactggctggagaagcacggcgtggagcgattgaagcgaatggcgatcagcggggatgactgcgtcgtgaaaccgatagacgaccggtttgccaccgccctcacggccctgaatgacatgggtaaggtgcgcaaggacatcccgcaatgggagccatccaagggctggaacgactggcagcaggtccccttctgctcacaccactttcaccagctgatcatgaaggacggccgggagattgtagttccttgccgaaatcaggacgagctcgttgggcgggcgcgcgtgtcccagggcgccgggtggtccctgcgggagaccgcatgcctgggaaagagctatgcacagatgtggcagctcatgtacttccaccgccgggacctgcgcctggcggccaatgcaatctgcagtgccgtgcccgtcgactgggtacccacgagccggacgacctggtctatccacgctcaccaccaatggatgaccacggaggatatgctcagcgtgtggaatcgagtctggatcgaagaaaacccctggatggaggacaaaacccacatctcctcttggggtgacgtgccgtaccttggcaaacgggaggatcaatggtgtggctccctgatcgggctaaccgcgcgcgcgacctgggctacgaacatccaagtggctatcaatcaggtccgtcggctgatcggtaacgagaactaccttgactatatgaccagtatgaaacgcttcaagaacgagatagaccccgagggagcattgtggtga

SEQ ID NO: 24218 - RNA, 9879 nt, synthetic construct
  misc_feature 1..9879: note = derived and/or modified CDS sequence (opt11) from DENV-1__FJ410244__SS-prME
  source 1..9879: mol_type = other RNA
tcggttaccatgctgctcatgttgatgcctaccgctctggccttccacctcacaaccagaggaggcgaaccccacatgatcgtgagcaagcaggagcgcgggaagagcctgcttttcaagacaagcgcgggcgtgaacatgtgtaccctcatcgccatggacctaggcgaattctgcgaagacacaatgacctacaagtgcccgcggatcaccgaggccgagcccgacgacgtagactgttggtgcaacgccaccgatacgtgggtgacgtacggtacctgctcccaaaccggcgagcaccggagagacaaacggtccgtggccctggcgccccatgtgggcctcgggctggagacgcgcactgagacctggatgagctccgagggcgcctggaagcaaatccagcgggtggaaacctgggccctgagacaccccgggttcacggtcatcgcccttttcctggcgcatgccatcggaaccagcatcacacagaaggggatcattttcatcctgctgatgctggtgaccccatccatggctatgcgctgcgtcggcatcggcagccgcgacttcgtggaagggctttccggcgctacgtgggtggacgtcgtgttagagcacggttcgtgcgttaccactatggccaaggacaagcccacgctcgacatcgagttactcaagacggaggtcaccaatcccgcggtgctacggaaattgtgcatcgaggccaagatctccaacaccacgacagatagccgctgcccgacccagggcgaggctaccctcgtggaggagcaggacgccaacttcgtctgccgccgcacatttgtcgaccggggctgggggaacggctgcgggctgtttggcaagggctccctgatcacctgcgccaagttcaagtgcgtcaccaaacttgagggcaagaccgtccagtacgaaaacctgaaatattcggtgatcgtgaccgtgcacacgggcgaccagcaccaggttgggaacgagtccaccgaacacggcaccaccgcgaccatcaccccgcaggcgcccagcactgagatccagctgacagactacggggccctaaccttagactgctcaccacggactgggttagacttcaacgagatggtactcctgactatgaaggagaagtcctggctcgtacacaagcagtggttcctagacctgccgttgccttggacctccggggcgtccacctcccaggaaacttggaatcggaaggacctcctggtgacgttcaagactgcccatgccaaaaaacaagaagtggtggtgctgggctcccaggagggcgccatgcacaccgccctcacgggggccactgaaatacagaccagcggcaccactacgatcttcgctgggcacctgaagtgccgcctgaagatgaacaagttgaccttaaagggcatgtcctatgtcatgtgtacagggagcttcaagctggagaaggaggtagcggagacacagcacggcactgtgctcgtccagatcaagtacgaaggcactgacgccccctgcaagatccctttctccacacaggacgagaagggggttacgcagaatggcaggctgatcaccgctaaccctattgtcaccgacaaggagaagcccgtcaacattgaagccgagccacccttcggtgagtcatacatcgtgatcggcgcaggcgagaaggcactgaagttatcctggtttaagaaggggagctccatcgggaagatgttcgaggccactgctcgcggggcccggcgcatggcgatcctcggtgatacggcctgggattttgggagcatcggaggcgtgttcacctccgtcggtaagctcgtccatcagatctttggaactgcctacggggtactgttctctggcgtctcttggacaatgaagatcggtatcggcgtactcctgacctggctggggttaaacagccgatctacctctctgtctatgacttgtatagcagtgggtctggttactctctacttaggcgttatggtgcaggccgacagcggttgcgtaatcaattggaagggacgggagcttaagtgcggttctggcattttcgtaacgaacgaggtgcacacctggaccgagcagtacaaattccaggccgactccccgaagcgcctgagcgccgccatcggcaaagcctgggaagagggggtctgtgggatccggtcggccacgcgcctggagaacattatgtggaagcagatcagcaatgagctgaaccacatcctcctagagaacgacatgaagttcaccgtggtggtcggggacgtggcgggcatcctggcccaagggaagaagatgatccggccccagcccatggaatataagtactcctggaagtcctggggtaaggccaagattatcggcgccgacgtgcaaaacacgaccttcatcatcgacgggcctaacaccccggagtgccccgacgaccaaagggcgtggaatatttgggaggtcgaggactacggctttgggatcttcaccacaaacatctggctcaaccttcgggactcctacacccaggtttgtgaccacaggctcatgagcgccgccattaaggactccaaggccgttcacgcagacatgggttactggatagagtcggagaagaacgagacctggaagctcgcgcgggcttccttcatcgaggtcaaaacctgcatttggcctaagagccacacgctgtggtccaacggcgtattggagtcggagatgattatccccaaaatctatgggggcccaatctcccagcacaattaccgccccgggtacttcacccagaccgccggcccatggcatctcgggaagctagagcttgactttgatctctgcgagggcaccacggtagtcgtcgacgagcactgcgggaatagagggccgagccttcgcaccaccaccgtgacgggcaaaatcatccacgaatggtgctgccggtcctgcactttgccgcccctgcgtttcaagggagaggacggatgctggtacgggatggagattcggcccgtcaaggaaaaggaggagaacctggtcaaatcaatggtgagcgccggctcgggcgaggtcgactcattctccctggggctactctgcataagcataatgatagaggaggtgatgcgctcaagatggagcagaaaaatgctgatgaccgggacccttgccgtgttctttctactgatcatggggcagctcacgtggaacgacttgatccggctgtgcattatggtcggcgcgaacgccagcgaccgcatggggatgggcaccacctatctcgccctgatggcgacctttaagatgcgccccatgttcgccgtgggcctcctgttcagacgcctgacgagcagggaggtgctactcctgaccattggactgtccctcgtcgcgagcgtggagctgcccaattccctggaagagctcggtgacggcctggccatgggcatcatgatcttaaagttgctgaccgacttccagagccaccaactgtgggccacactcctgtccctgacgtttatcaagaccaccttcagcctccattacgcctggaagaccatggctatggtcctatctatcgtgtcactgttccccctctgcctgtccacgaccagccagaagacaacctggctgcccgtgctattgggctccttaggatgcaagccactcacgatgttcctgatcgccgagaacaagatctggggccgcaaatcttggcccctgaacgaggggatcatggccgtcggcatagtatcgatcttactgtcctcactgctaaagaacgacgtgccgctggccgggccgctgattgccggcgggatgttaatcgcgtgctacgtcatctccgggtcgtccgccgatctttcgcttgagaaggccgccgaggtaagttgggaagaagaggctgagcatagcggcgcgtcccacaatatacttgtggaagtccaggacgacggaaccatgaagattaaagatgaagagagagatgacaccctcactattctgctcaaggctaccctgctggcagtgagcggcgtgtaccccctctccattcccgccacactgttcgtgtggtacttctggcagaagaagaaacagcgctcgggggtcttgtgggacacccccagcccgcccgaggtggagcgagcggtcctcgacgacggaatctaccgcattatgcaacggggcttgctggggcgcagccaagtgggcgtgggtgtcttccaggagaacgtgttccacaccatgtggcacgtaaccaggggcgctgtcttgatgtaccaagggaagcgcctcgagccatcctgggcgtccgtgaagaaagaccttatctcctacggcggcggatggagactgcaagggtcatggaatacgggcgaggaggtacaggtcatcgccgtggagccaggcaagaaccccaagaatgttcagaccgcccccgggaccttcaaaacctcagagggcgaggtcggcgcgatcgcgcttgatttcaaacccggtacctccggcagccccatcgtgaaccgcgaggggaagatcgtaggactgtatggaaacggggtcgtgaccacctccggtacttacgtgagcgccatcgctcaggctaaagcttcccaggagggccccctgccggagatcgaggacgaggtcttccggaaacgcaatttaacgatcatggacctgcatcccggctcggggaagacgcggagatacctccccgccatcgttcgggaggcaatcaagagaaagctccggaccctgatcctggccccgacccgcgtggtggcctcagagatggcggaggccctcaaggggatgccgatccggtaccagacaaccgcagtcaaatctgagcataccggcaaagaaatcgtcgacctgatgtgccacgccacattcacgatgcggttactatcccccgtccgcgtccccaattataacatgatcatcatggacgaggcccactttaccgacccgagctccatcgccgcacgggggtacatcagcacacgagtgggcatgggagaggcggctgccatcttcatgaccgcgacaccccccggttccgttgaggcctttcctcagagcaacgccatcatccaggatgaggagagggacattccagagcgctcctggaacagcgggtacgagtggatcaccgacttccccggcaagaccgtatggttcgtgccctccatcaagagcggcaacgacatcgccaactgcctgcggaaaaacgggaagcgcgttatccaactgtcccggaagacctttgacacggagtatcagaagaccaagaacaacgactgggattacgtggtgactaccgacatctcggagatgggcgcgaacttccgcgccgatcgggtgatcgacccccgccgctgcctgaagcccgtaatcctcaaggacgggcccgaaagggtgatcctggcgggccccatgcccgtcacggtggcctccgccgcgcagcggcgagggcgtataggccgcaaccacaacaaggagggcgaccagtacatctatatggggcagcccctcaacaacgacgaggatcacgcccactggaccgaggccaagatgctgctggacaatatcaatacccccgagggcatcatccccgccctcttcgagcccgagcgtgagaagtccgcggcgatagacggtgagtatcgtctgcgcggcgaggcgcggaagacattcgtcgagctgatgcgccgcggggatctccccgtttggctgtcatacaaggtggcctccgagggcttccagtacagcgaccgccggtggtgcttcgacggagagcgcaataaccaggtcctggaggagaacatggatgtcgaaatctggacgaaggaaggggagaggaagaagctccgcccccgctggctggacgcccgcacatactcagatcccctggccctccgggagttcaaggagttcgcggccggtcgccggtctgtgtctggtgacctcatactggagatcggcaagctcccccagcacctaacccagcgcgcgcagaacgcgcttgacaacctcgtcatgctccacaacagcgagcagggcggcagagcgtaccggcacgccatggaggagctgcctgacaccatcgagaccctcatgctactggcactcatcgcggtgctcaccggcggggtaaccctattcttcctctctggaagagggctcggcaagacctcaatcggcctactctgcgtgatggcctccagcgtgctgttgtggatggcgtccgtggagccacactggatcgcggccagcatcatcctagagtttttcctgatggtcctgctcatccccgagcccgaccgccagcggactccgcaggacaaccagttggcctacgtagtaatcgggctactcttcatgatcttaacggtagccgcgaacgagatgggcctcctcgagaccaccaagaaggatcttgggatcggacacgtggccgtggaaaaccaccatcacgccgccatgttggatgtcgacttgcatcccgcctccgcgtggaccctgtacgccgtagccacaaccatcatcacccccatgatgcgccacactatcgagaatacgaccgccaacatcagcctgaccgccatagcaaaccaggccgccatcctcatgggcctggacaaggggtggccgatctccaagatggacatcggcgtacctctgttggccctagggtgctacagccaggttaaccccctgaccttaacggcggcggtgctgatgctggtggcccactacgccatcatcggccctgggttacaggccaaggcaaccagggaagcccagaagcgcactgccgccggcatcatgaagaatccgacagtcgatgggatcgtggccatcgacctggaccccgtggtctacgacgcaaagtttgagaagcagctgggccagatcatgctcctgattctgtgcacgtcccagatactcctaatgcgaacaacctgggccctgtgcgaatctatcaccttagcaacgggtcccctgaccaccctgtgggaggggtctcccggcaaattctggaatactacgatcgccgtaagcatggccaacatcttccgggggtcctacctcgccggcgccggtctggccttctctctcatgaagagtctcgggggcgggcgtcggggcaccggggcacagggcgagaccctgggagagaagtggaagcgccagctgaaccagctcagtaagagcgagttcaacacctacaagcggtccgggattatggaggtggaccgctccgaggcgaaagaaggcctgaagcgtggagagacgaccaagcacgccgtgtcccgcggcaccgcgaagctccggtggttcgtggaacgaaacctagttaagccggagggtaaggtcatcgacctgggctgtgggcgcgggggctggagctactactgcgccggcctgaagaaggtaaccgaggtgaaggggtacacaaagggtgggcccggacatgaggagcccatccccatggccacctacgggtggaatctagtcaagcttcactccggtaaggacgtgttcttcatcccgcccgagaaatgcgatacccttctgtgcgacatcggtgagagctcccccaaccccaccatcgaggagggccgcacgctccgggtgctgaagatggtcgaaccgtggctgagggggaaccaattctgcatcaaaatcctcaacccctacatgcccagcgtcgttgaaaccctagagcagatgcagcgcaagcacgggggtatgttagttcgcaaccccctctcgcgtaacagtacccacgaaatgtactgggtgtcctgtgggactggtaacattgtgagcgcggtaaacatgacctctaggatgctgttaaatcggttcacgatggcccaccgcaaaccgacgtatgagcgcgacgtggacttaggggccggcacgcggcacgtcgcagtcgagcccgaggtccccaacctggatatcatcggacagcgcatagagaacatcaagcacgagcacaagagcacctggcactacgacgaagacaacccctacaaaacgtgggcgtatcacgggagctatgaggtgaagcctagcggcagcgcgtccagcatggtaaacggggtggttaagctgctcaccaagccctgggacgtgatccccatggtgacccagatcgccatgaccgatacgaccccattcgggcagcagagggtcttcaaggaaaaggtggatacccgcacaccaaaggccaaacgggggacggctcaaatcatggaggtgaccgccaaatggctatggggattcctgtccagaaacaaaaagccccggatctgcacccgcgaagaattcacccggaaagtacgatctaacgcggccatcggagctgttttcgttgacgagaaccaatggaattcagcgaaggaagcggtcgaagatgaacggttctgggacctcgtgcaccgcgaacgggaactgcacaagcaagggaaatgcgcaacgtgcgtgtacaacatgatgggcaagagggagaagaagctgggggagttcggcaaagccaagggcagccgggccatctggtatatgtggcttggtgcgcgcttcttagagttcgaggcgctgggcttcatgaacgaagaccactggttttcccgggagaacagcctctcaggggtcgagggcgagggtttgcacaagttaggatacattctccgggatatcagcaagatccctgggggcaacatgtacgccgacgacaccgccggttgggacacccggatcaccgaggacgacctgcagaatgaggccaagatcacggacataatggagccggagcatgctctgctcgcaaaatccatattcaagttgacctaccagaacaaggtggtgcgcgtccaacggcccgccaagaacgggaccgtgatggacgttatcagcaggcgcgaccagcggggatccgggcaggtcggcacctacggcctgaacacattcaccaacatggaagcccagctaatccgccagatggagagcgaggggatttttagccccagcgaattagagacgcccaacctggccggccgggtgctcgactggttagagaagcacggggtcgagcgactgaagaggatggccataagtggcgacgactgcgtcgtgaagccgatcgacgaccgcttcgcgaccgctttgacggcgctgaacgacatggggaaggtgcggaaggacgtgccccaatgggagccctctaagggatggaacgattggcagcaggtccccttctgcagccaccacttccaccagctgatcatgaaggatggccgtgagatcgtggtcccgtgccgtaaccaggacgagttagtcgggagagcccgggtgtcccagggcgccgggtggtctctgcgcgagaccgcgtgcctgggcaagtcctacgcccagatgtggcaattgatgtactttcatcggcgagatctgcggcttgccgccaacgccatctgcagcgccgtaccggtggattgggtgcccacctcccgcacaacgtggagcatccacgcccaccatcagtggatgaccaccgaggacatgctctccgtctggaaccgggtgtggatcgaagagaacccctggatggaggacaaaacccacatctcgtcctggggcgacgtgccgtatctgggcaagcgcgaggaccagtggtgcggcagcttaattgggcttacggccagagccacttgggcaaccaacatccaggtagccatcaaccaagtgcgccgcctgatcggcaatgagaactacctggactacatgacctccatgaagcggttcaagaacgagagcgaccccgaaggggccctctggtag

SEQ ID NO: 24219 - RNA, 9879 nt, synthetic construct
  misc_feature 1..9879: note = derived and/or modified CDS sequence (opt11) from DENV-1__FJ410245__SS-prME
  source 1..9879: mol_type = other RNA
agcgtcacgatgctgctcatgctgatgcccaccgccctggcattccatctcaccacccgcggcggcgagccccacatgatcgtgagcaagcaagagcggggcaagagccttctgtttaagacttcagccggggtgaacatgtgcaccttaattgccatggacctgggcgaactgtgtgaggacaccatgacctataagtgtccccgtatcacggagaccgagccagatgacgttgactgctggtgcaacgccaccgatacctgggtgacctacgggacctgctctcagacgggcgagcaccggcgcgacaagcggtccgtggcccttgcaccacacgtaggcctggggctggagaccaggaccgagacctggatgagctccgagggggcatggaagcagatccaacgggtcgagacgtgggccctccgccaccccgggttcaccgtgattgcgttattcttggcccacgcgattggcaccagcatcacccaaaaggggatcatcttcatcctcctgatgctggtgaccccctccatggccatgcgttgtgtcggcatcggaagccgcgacttcgtggaagggctctccggcgccacctgggtggacgtagtattggagcacgggagctgcgtgaccaccatggccaaggacaagcctacgctggacatcgagctactgaagaccgaggtcaccaaccccgccgtgctgcggaagctctgtatagaggcgaaaatctccaacaccacaaccgactcccgctgcccgactcagggggaagccaccctggtggaggaacaggatgccaacttcgtctgccggcgcacgtttgtggaccgaggttggggaaacggctgcgggctgtttgggaaagggtccctcatcacgtgcgctaagttcaagtgcgtgaccaagctggagggcaaaatcgtccagtatgagaatctgaaatacagcgtgattgtgactgtccacacgggcgaccagcaccaggtggggaacgagtccaccgagcacggcaccaccgccaccattacgccccaggcgcccaccacggaaatccagctcaccgactacggcgccctgacgctggactgctcaccccgcacaggcctcgacttcaacgagatggtcctgttaaccatgaaggagaaatcgtggttagtgcacaagcagtggttcctggacctgcccctcccctggaccagcggggccagcacgtcccaggagacctggaaccggcaggacctgctggtgaccttcaagaccgcccacgccaagaaacaggaggttgtggtgctcggcagccaggagggcgccatgcacacggccttgaccggggcaaccgagatccagacctccggcacgacaaccatcttcgccggtcacctgaagtgccggctcaaaatggacaaactgaccctgaagggcatgagctacgtcatgtgcacgggatcctttaaactcgagaaggaagtggcagagacccagcacggcaccgtgctggtccaaattaagtacgagggcaccgacgcaccttgcaagatccccttcagcacgcaagatgagaagggggtgacccagaacgggcgtttaatcaccgccaacccgattgtgaccgataaagagaaacccgtcaacattgaggccgagccacccttcggtgagtcctacatcgtgataggcgctggcgagaaggcgctgaagctcagctggttcaagaaggggtccagcatcggaaagatgttcgaagccactgcccgcggcgcccggcgcatggccatcctgggagatacggcgtgggacttcgggagcatcggcggcgtattcacctcagtcgggaagctggtgcatcagatcttcggcaccgcctacggggtactgttctcgggtgttagctggacgatgaagatcgggatcggcgtgctgctcacctggctcggcctgaacagccgaagcacatcgctgagcatgacctgcatagccgtggggctggtcactctgtacctgggcgtgatggtccaggccgactccgggtgcgttatcaactggaagggccgagagctcaagtgcgggagcggaatcttcgtgacaaacgaggtgcatacatggaccgagcagtacaagtttcaagccgatagtccgaagcgcttatccgcggcaataggcaaggcttgggaggagggggtctgcggcatccggagcgccacccgcctggagaacattatgtggaagcagatctccaacgagctcaaccacatcctgctggagaatgacatgaaatttacggtggtagtcggggacgtggccggcatactcgcgcaggggaagaagatgattcggccccagcccatggagtataagtacagctggaagagctgggggaaggctaagatcatcggagcggacgtgcagaacaccacgttcatcatcgacgggccaaacacgccggagtgccccgacgaccagcgggcctggaacatctgggaggttgaggactacggcttcgggatcttcaccaccaacatatggctgaagttgcgggacagctacacccaagtatgcgaccaccgcctcatgtccgcggccatcaaagatagcaaggccgtgcacgccgacatgggctactggatcgaatccgagaagaacgagacctggaagctggcacgggcgagcttcatcgaggtcaagacgtgcatctggcccaagtcccacacgctgtggagcaacggcgtgctcgagtccgagatgatcatccccaagatttacggtggcccgatttcgcagcataattatcgacccggctacttcacccaggccgccggcccctggcacctggggaagctcgagctagacttcgacctgtgcgagggcacaacggtagtggtggacgagcactgcggcaaccgggggcccagtcttagaacaaccacagtgacgggcaaaatcatccacgagtggtgctgccgaagctgcacgctaccaccccttcgtttcaaaggagaggacggctgctggtacgggatggagatccggcctgtcaaggagaaggaggagaacctagtgaagtccatggtgtcagccggcagcggcgaggtcgattccttcagcctcggtctgttatgcatctccattatgatcgaggaggtgatgcgcagtcggtggagccgccggatgctcatgacgggcaccctagccgtgttcttccttttgatcatggggcaactgacgtggaacgacttaatccgcctctgcatcatggttggagctaacgcctccgaccgcatggggatgggcaccacctacttggcacttatggccaccttcaagatgcgcccgatgttcgccgtgggcctcctgtttcgccgtttgacgtcccgcgaagtgttactgctgaccatcgggctcagcctagtcgcgtccgtggagctgcctaactcgctagaggagctgggcgacgggctggccatgggcatcatgatccttaagttactgaccgacttccagagccaccagttgtgggctaccctgctgagcctcacgttcatcaagaccaccttctccctgcattacgcctggaagaccatggcgatggtcctgagcatcgtgtccctcttccccctgtgcctgagcacgacttcccagaagaccacctggctccccgtgctgctgggcagccttgggtgcaagccgttaaccatgttcctgatcgccgaaaacaaaatctggggccgtaggtcctggccccttaacgaggggatcatggccgtcggcatcgtgagcatcctgctgagctccctgctgaagaacgatgtgcccctggccgggccgttgattgcgggcggcatgctgatcgcgtgctatgtcatcagcggctccagcgccgacctgtctctcgaaaaagccgccgaggtgagctgggaggaggaggccgagcactccggggcgagccacaacatcctggttgaagtccaggatgacgggactatgaagattaaggacgaggagcgagacgacaccttgacaatcctgttgaaggccaccctgctcgccgtgtccggcgtgtatccgctgagcatccccgccacgctgtttgtctggtacttctggcagaagaaaaagcagcgctcgggggtgctctgggacaccccctccccgcccgaggtggagcgcgccgtgctggacgacggcatctaccgcattatgcaacggggccttctggggcgcagccaggtgggcgtgggggtcttccaggagaacgtgttccataccatgtggcacgtgacccggggcgcggtcttgatgtaccagggtaagcgcctggagcctagctgggcctccgtgaagaaggatctgatctcatacggaggcgggtggcggcttcagggctcctggaacatcggggaggaagtgcaggtcattgccgtggagcccggcaagaatcccaagaatgttcaaacggcccccggaaccttcaagacccccgagggcgaggtcggcgccatcgcgctggacttcaagcccgggaccagcggctctcccatcgtgaaccgcgaggggaagatcgtaggcctgtacggcaacggagtcgtgacgaccagcggcacctacgtgagcgccatcgctcaggccaaggcgtcacaggaggggccgctccccgagatcgaggacgaggtctttcggaagcgcaacctgaccataatggacctgcaccccggcagtggtaagacgcgtagatacctcccggcgatcgttcgggaggctatcaaaaagaaactgcgcaccctgatcttggcacccacccgcgtggtcgcgtccgagatggcggaggcccttaaaggcatgcccatccggtaccaaaccacggccgtcaagagcgagcacacaggcaaggagatcgttgatctgatgtgccacgccactttcactatgcgcctcttatcccccgttcgggtgccaaattacaacatgattatcatggacgaagcccacttcacggaccctagctccatagcggcccgcggctacatcagcacccgggtgggcatgggggaggccgccgccattttcatgacagcgaccccgcccggctccgtcgaggccttccctcagagcaacgcagtgatccaggacgaggagcgtgacatacccgagaggtcttggaacagcggctatgagtggatcactgactttcccgggaagaccgtctggttcgtcccttcgatcaagagcggcaacgacatcgccaactgtctgcgcaagaacgggaagcgggtcatccagctcagtagaaagaccttcgacaccgagtaccagaaaacgaagaacaacgactgggactacgtggtgaccaccgatatttcggagatgggcgctaacttccgtgccgatcgcgtcatcgaccctcggcgctgcctgaaaccggtgatcctgaaggacgggcccgagcgggtcattctcgcaggccccatgccggtgaccgtggccagcgccgcgcaacgtcggggtagaatcggccggaaccataacaaagagggcgatcagtacatctacatggggcagcccctgaacaacgacgaagaccacgcccactggacggaggccaagatgctgctcgacaacattaacactcccgaggggatcatccctgcactgttcgaaccggagcgcgagaagagcgcggcgatcgacggggagtatcgcctgcgaggcgaggcccgcaagacatttgtggagctcatgcggcgaggggacctccccgtgtggctgtcctacaaggtcgccagcgagggcttccagtacagcgatcgtcgctggtgcttcgacggcgagcggaacaatcaggtgttggaagagaacatggacgtggagatctggactaaggagggggagcgcaagaagctgcggccccggtggctagatgcccggacgtactccgatcccctcgctctgcgcgagtttaaggagttcgcggccgggaggcgcagcgtctcaggggacctgatcctcgagatcggaaagctgccgcagcacttgacccagcgcgcccagaacgcccttgacaatctggtgatgctgcataacagcgagcagggagggcgcgcgtaccggcatgccatggaggagctccccgacaccatcgagaccctgatgctgctcgctctgatcgccgttctgacgggcggggtcaccttattcttcctgtccggtcgcgggctggggaagaccagcatcggcctcctttgcgtgatggcctccagcgtcctgctctggatggcgtcggtcgaaccacactggatcgccgccagcatcatcctggagttcttcctgatggtgctcttgatccctgagccagaccggcagaggaccccgcaggacaatcagttagcgtatgtcgtcatcgggctcctgttcatgatcttgaccgttgccgcgaacgagatgggccttctggagacgaccaagaaggacctggggataggccacgtggccgtcgagaaccaccaccacgccgccatgctcgacgtggacctccaccccgcgtccgcttggaccctgtacgccgtcgccaccacaattatcaccccgatgatgaggcacaccatcgagaacacgacggcaaacatctccctaaccgccatcgcaaaccaggccgccatcctaatggggctggacaagggctggcccatctccaaaatggacatcggtgtccccctcctggccctgggctgctacagccaggttaatcccctcaccctgaccgcagccgtactgatgctcgtggcccactacgccatcatcggcccggggctgcaggccaaggcgacgcgcgaggcccaaaagaggaccgccgctggcatcatgaagaaccctacggtagacggaatcgtggccattgatctggaccccgtcgtgtacgacgcgaagttcgagaagcaattgggccagatcatgctgctgatcctctgcacatcccagatcctgcttatgcggacgacctgggccctctgcgagagcatcaccctggcgaccgggccactgacgacactgtgggagggctccccgggaaagttctggaataccaccatcgccgtgtctatggccaatatttttcgcggaagttacctggcgggcgccggcctggccttctcactcatgaagtccctcgggggcgggcggcgaggaaccggggcccagggcgagacgctgggcgagaagtggaagcggcagctcaaccagttatccaagagcgaattcaacacatacaaacgctccggtatcatggaagtcgaccgtagcgaggcgaaggagggacttaagcgcggggagaccacgaaacacgccgtatccagaggcaccgccaagctccgctggttcgtggagcggaacctggtcaagcccgaggggaaggtgatcgacctgggctgtggccgcgggggctggagctattactgcgccgggctgaagaaagtgactgaggtcaagggctataccaagggcgggcccggccacgaggagcccatcccgatggccacgtacggctggaatctcgttaagctgcactcgggcaaggacgtgttcttcatcccgcccgagaagtgcgacaccctgctctgtgatatcggggagtcatcccccaacccgactatcgaagaaggccggactctgcgcgtgttaaagatggtggagccctggctccggggcaaccagttctgcatcaagatcctgaacccctacatgcccagtgttgtggaaacgctggagcaaatgcagcgcaagcacggcggcatgctcgtgcggaacccgctctccaggaactctacacacgagatgtactgggtgtcctgtgggaccggcaacatcgtcagcgccgtaaacatgacctcgcggatgctgctcaaccgtttcaccatggcgcaccgcaagcccacgtacgaacgggacgttgatcttggggccgggacccgccacgtcgccgtggagccagaggtggccaacctggatatcatcggccaaagaatcgaaaacatcaagcacgagcataagagtacctggcattacgacgaggataatccttacaagacatgggcgtaccacgggtcctacgaggtcaagcctagcggatccgccagcagcatggtgaacggggtagtgaagctcttaacgaagccctgggatgtgatccccatggtcacccagatcgctatgaccgataccacgcccttcggccagcaacgcgtcttcaaagagaaggtggacacacgaaccccaaaggccaaacgcgggaccgcacagatcatggaagtcacggcgaagtggctgtggggcttcctctcccggaacaagaagccccgcatctgcacccgggaagagttcaccagaaaggtgcggtcgaatgccgccatcggcgccgtattcgtcgacgagaaccagtggaactccgcgaaggaggccgtggaggacgaacgcttctgggacctggtgcaccgtgagcgtgagctgcacaaacaggggaagtgcgcgacctgcgtctacaacatgatgggcaaaagagagaagaagctcggggagttcggcaaggccaaggggagccgcgccatctggtatatgtggctcggggcgagattcctagagttcgaggcgctcggcttcatgaatgaggatcactggttctcccgcgagaacagcctgtccggcgtggagggcgaagggctacacaagctcggctacatccttcgggacatcagcaaaataccggggggcaacatgtacgccgacgacacggcaggctgggatacccgcatcaccgaggatgacttgcagaacgaggcccggataaccgacattatggaacccgaacacgcgctcctggcgaagtccatattcaagctgacgtatcaaaacaaagttgtgcgcgtgcaacgccccgccaagaacgggaccgtgatggatgtcatcagccgtcgcgaccagcggggctccggccaggtgggcacctatggcctcaacacctttacgaacatggaggcccagctgatccgccaaatggaaagcgaagggatcttctccccaagcgagctggagacccccaacctcgcagagcgggtgctggactggctggaaaagtacggcgtcgagcgcctaaagcggatggcgatcagtggtgacgactgcgtcgtgaagccaatcgacgaccgcttcgccaccgccctgactgcgctgaacgacatgggtaaggtccggaaggacattccccagtgggagcccagcaagggatggaacgactggcaacaggtccccttctgctcacaccacttccaccagttgatcatgaaggatggccgcgagattgtggtcccgtgccggaaccaggacgagttagtgggccgcgcccgggtgagccaaggggctggctggagcttgcgcgagactgcgtgcctcggtaaatcctacgcccagatgtggcagctgatgtacttccacaggcgcgacctgcggctcgccgcgaacgcgatctgcagcgccgtgcccgtagactggatccccacctcccgcaccacctggtccatccacgcccatcaccaatggatgacgaccgaggacatgctatccgtgtggaaccgggtctggatcgaggaaaatccctggatggaggacaaaacccacattagctcctggggcgacgtgccttacctgggcaagcgcgaggaccagtggtgcggctccctcatcggcctgaccgcccgcgcgacctgggccaccaacatacaggtggcaatcaaccaggtccggcggctgatagggaacgagaactacttggactacatgaccagcatgaagcggttcaagaacgagagtgacccggagggcgcactgtggtga

SEQ ID NO: 24220 - RNA, 9879 nt, synthetic construct
  misc_feature 1..9879: note = derived and/or modified CDS sequence (opt11) from DENV-1__FJ410246__SS-prME
  source 1..9879: mol_type = other RNA
tctgttacgatgctactcatgctcatgcccacagccttggcgtttcacctaactactcgaggaggggaaccccacatgatagtgagcaagcaagagcgagggaaaagtttactgttcaaaacaagcgcgggggtcaacatgtgcacactcatcgcaatggacttgggcgagttctgcgaggacaccatgacgtacaagtgccctcgaatcacagaagccgaacctgacgatgtagattgctggtgcaatgcaacagacacttgggtcacctatggcacgtgcagtcagacaggtgaacatcggcgcgacaagcgcagtgtcgccctggccccgcatgttgggctgggactcgaaaccagaacagaaacctggatgtcaagcgaaggagcatggaagcaaatacagcgggttgaaacctgggcgcttcgacatccggggttcaccgtaatagccctcttccttgcgcacgcaataggaacgtcaattacgcaaaaaggcattatcttcatcctcctgatgctggtaaccccgagcatggcgatgaggtgtgtaggaatcggctcacgagacttcgtagagggcctctcgggcgccacctgggtcgacgtagtactggaacatggaagttgcgtgaccacaatggcgaaagacaagcctacactcgacatagagctcctcaaaacggaggtgacaaatccagcagtgctgaggaagctgtgtatagaggcgaaaataagcaacaccaccaccgacagccggtgcccgacgcagggggaagccacactcgtagaggagcaagatgccaacttcgtatgcaggagaacgttcgtagaccgaggctggggaaacggctgcggcctcttcggaaaaggttccctaattacatgtgctaaatttaaatgtgtgacaaagctagaggggaaaatagtccagtatgaaaacctgaaatattcagtcatagtcaccgtgcacacgggcgatcagcatcaagttggaaacgagagcaccgagcacggcacgacagccactatcacgccccaagccccatccacggagatacaactaactgattacggggcgctaaccttagattgttcaccccgcacaggcttggatttcaatgagatggtccttttgacgatgaaagagaaaagttggttagtacacaaacaatggttcctggacctgccactcccgtggactagcggggcttcgacctcacaggaaacctggaaccgccaggatttactcgtaacctttaagaccgcacatgcgaagaaacaagaagtcgtcgtgctaggaagccaggaaggagctatgcataccgctctcactggcgccaccgagatacaaacgagcgggaccaccacgatattcgcggggcatctgaagtgcagactgaagatggacaaactcacattgaaaggaatgtcctacgtcatgtgcacagggagctttaaactagaaaaggaggtagcagaaacgcagcacggcaccgtcctcgtacaaatcaaatatgaggggacagacgcgccgtgcaaaataccgttcagcacccaagacgagaagggagtgacccagaacggacgcctgataaccgccaatcctatagtgacagacaaggacaaaccggtaaacatcgaagcagagccacccttcggagagtcctacatcgtaataggggccggcgaaaaagccctgaaactaagctggttcaagaaggggagttcgatcggaaagatgttcgaggcgacggcgagaggcgcgagaaggatggccatcctcggcgacacagcctgggacttcggcagcatcggtggtgtctttacctccgtgggaaagctagtgcaccaaatattcggaaccgcctacggggtactcttcagcggtgtctcctggaccatgaaaatcggcatcggggtgctactaacctggctggggctgaacagccggtcaactagcctgagcatgacctgcatagcagtaggcctagtcacactctacctcggggtaatggtccaagctgattcgggctgcgtaatcaattggaaggggcgcgaactgaaatgtggaagcggaatatttgtcacaaacgaggtccacacatggacagaacaatacaaattccaagccgattcgccaaaaagactctcagcagccatcggcaaggcttgggaggagggagtgtgcggcatccggtctgccaccaggttagaaaacataatgtggaagcaaatctcaaacgaactcaaccatatactcttagagaacgatatgaagtttacagtggtggtcggagacgtcgcgggaatcctcgcgcagggaaagaaaatgataagaccgcagccaatggaatacaagtactcctggaaaagctggggaaaagcgaagataataggggcagatgttcaaaacaccactttcataatcgacggccccaatacccccgaatgcccggatgatcaacgggcgtggaatatatgggaagtcgaagattacggatttggaatcttcaccacgaacatatggctcaagctgagagattcttacactcaagtatgcgaccatcgcctcatgagcgccgcgatcaaagactcgaaagccgtacatgcagatatgggctactggatcgagagtgagaaaaacgagacctggaaactggctcgagcttcgttcatagaggtaaaaacctgcatatggccaaagtcccacacgctatggagcaacggcgtcctagagtcagagatgatcattccgaagatatacggcggacccatcagccaacataactataggccgggctacttcacccagaccgccggcccatggcatctgggaaaacttgaattagatttcgacctctgtgaggggacaaccgtcgtagtagacgaacactgcgggaacaggggtcccagcctgcgcacaaccaccgtcaccggaaagataattcatgagtggtgctgtcggagctgcacgctacccccattgcgattcaaaggagaggacggatgttggtatggcatggagatccgaccagtaaaagaaaaggaagaaaacctagttaaaagcatggtatctgcgggaagtggagaagtagatagcttttcgttaggactactgtgtatctcaatcatgacagaagaggtgatgcggagtagatggtctcgtaaaatgctgatgacaggaacgctagcagtgttcttcctcttgataatgggacagctgacgtggaatgatcttatacggctctgcataatggtgggtgctaacgcgagcgaccgaatgggaatgggcaccacctacttagcgttgatggcaacattcaagatgagaccgatgtttgcagtaggccttctcttccggcgtctcacatcaagggaggtgttactactgacgataggcctgagcctcgtagcatcagtcgagttgccaaactcactagaagaactaggggacggactcgccatgggaataatgatcctgaaactactaacagacttccaatcacaccagctgtgggcgactctactgagcctgacgtttatcaaaacgaccttttccctccactatgcgtggaaaacaatggcaatggtcctaagtatcgtctccctatttccactatgcctttcaaccacgtcgcaaaagacaacctggctaccagtcctactagggtcgctaggatgcaaaccactgaccatgttccttatcgccgagaataaaatctggggcagaaaaagctggccattaaacgaaggaataatggcagtcggcatcgtgagcattctactgagcagcctactcaaaaacgacgtgccactagcggggcccctgatagcgggaggaatgctgatcgcatgttacgtaatttcagggtcatccgcggatctctctctggagaaagcagccgaagtcagctgggaggaagaagcggaacactctggcgcttctcacaatatactcgtcgaagttcaagatgatggcactatgaaaattaaggacgaagaacgtgacgacactctgacaatactgctgaaagccacacttctcgcggtttcaggcgtatacccattaagcatcccggcaacactttttgtctggtacttctggcaaaagaagaaacaacgaagcggggtgctatgggacaccccaagcccaccagaagtcgaaagagcagttctggacgacgggatataccgcattatgcaacgaggcctactaggtcggtcgcaggttggtgtaggagttttccaggaaaacgttttccacaccatgtggcacgtcactcggggcgcagtcctaatgtatcaaggcaaaaggctggaaccatcatgggcctccgtaaagaaagaccttatctcctatggaggagggtggaggctgcaaggtagctggaacacaggagaagaagtgcaggtaatcgccgtagaacccgggaaaaacccaaagaacgtacagacagcgcccggaacattcaagacatccgagggggaggttggggcaatcgctctagacttcaagcctgggacaagcgggtcgccaattgtcaatcgcgaagggaagattgttggactatatggtaatggtgtagtaaccacatctgggacgtatgtaagcgcgatcgcacaagcgaaagcgtcgcaagaaggaccgctaccggaaatcgaagacgaggtcttcagaaaaaggaacctgacaatcatggacctgcatccgggctccggaaagacgcgacggtacctacctgctattgtccatgaagcgattaaacgtaagctccgcacgttaatcctagcccctacgcgagtcgtagcctcagaaatggcggaggccctcaaaggcatgcccatccgataccagacgacggccgttaaaagtgaacataccggaaaggaaattgtggacctgatgtgccacgcgactttcaccatgaggctattaagcccggtgagagtgccaaattataacatgatcataatggacgaagcgcacttcacggacccgtccagcatagcggcacgagggtacatatcgacgagagtaggcatgggagaagccgccgcaatattcatgacagcaacgcctcctggatcagtggaagcatttccacagtcaaacgccgtaattcaggacgaggaacgtgacatcccagaacgcagctggaactccggatacgagtggatcaccgacttcccaggcaaaacagtctggtttgtaccaagtatcaagagcggaaacgacatagccaattgcctgaggaaaaacggcaagagggtgatacagctgtcgaggaagacgtttgacacagaataccaaaagaccaaaaacaatgactgggactacgtggtaaccaccgacataagtgagatgggcgccaacttccgggcggaccgcgtcattgacccaaggagatgcctgaagccggtcatcctcaaggatggacccgagcgggtgatcctagctgggccgatgcccgtgaccgtcgcttcggcagcgcagcgccggggccgaataggaagaaatcataacaaggagggcgaccagtatgtttacatgggtcaaccattgaacaacgacgaggaccacgcacactggaccgaagctaagatgctcctcgacaatatcaacacccccgaagggatcataccagctctattcgaaccagaacgagaaaagagtgccgccatcgatggggaatatcgcctccgcggcgaggccagaaaaacatttgttgaattgatgcggcgcggcgatctcccggtatggctcagctacaaggtagcaagcgagggctttcaatattcggaccgcagatggtgttttgacggggagagaaacaaccaagtactcgaagagaacatggacgtagaaatatggacgaaagagggcgagagaaagaaactccggccgagatggctggatgcccggacgtacagcgacccactagcactgagagagttcaaggagttcgcagcaggcaggagatcagtctccggagatctaatacttgaaatcggaaaactaccccaacacttgacgcagagagcgcaaaacgcactcgataaccttgtaatgttacataacagcgagcaagggggacgggcataccgacatgcaatggaagaacttccggatactatcgagacattaatgttgctcgcccttattgcggtcttaactggaggggtcactctattcttcttgtcgggtcgaggattaggtaaaacaagcatcggtcttttatgtgtaatggccagctctgtgctgctctggatggcctcggtggaacctcactggattgcggcgtcaattatactagagttcttcctaatggtgctacttataccggagcctgatagacaaaggacgccccaggataaccaacttgcatatgttgtaatcggacttctattcatgatactcaccgtcgcggccaacgagatgggcctcctcgagacgacaaagaaagacctgggcatcggacatgtagcagtcgaaaaccatcatcacgcggctatgttagatgttgacctccacccagccagcgcatggacgctctatgccgtagcaacaacgattattaccccgatgatgcggcacacgatcgaaaatacaacagcaaacatcagcctcactgccattgcaaaccaggcagcgatactcatgggactggataaaggttggccgatctccaaaatggacatcggcgtccccctcctggcattggggtgctacagccaggttaaccccctaacgctgacagccgcagtactcatgctagtcgcacactacgccatcatcggtccagggctgcaagccaaagccacacgggaggcccagaaacgcactgcagccggaattatgaagaaccccaccgtagatgggattgtcgcaatagacttagatccggtagtctatgacgcgaagttcgaaaaacaactaggccaaatcatgctcctcatcctatgtacgagtcagatattactgatgcgaacgacatgggccctctgcgagtccattactcttgcgacgggacccctgacgacgctatgggaaggatcgcccggcaaattttggaatacaactatcgcggtaagtatggcgaatatctttaggggcagctatcttgccggtgctggcttagcatttagtctaatgaaaagccttgggggcggcagacgaggcacgggcgcacaaggcgaaaccctcggtgaaaaatggaagagacaactgaaccaactcagtaaatcggagttcaacacctacaaacgttccggcattatggaagtggacagatccgaagcgaaggaaggattaaaacgaggggagaccacgaaacatgcagtcagcaggggaacagcgaaactcagatggttcgtagaaaggaacctagtgaaaccggaaggaaaagtaatcgacctggggtgcggcaggggaggctggagctactactgcgcaggtctgaagaaagtaacagaggtaaagggctacactaagggagggccagggcacgaagaaccaatccccatggccacctatggctggaaccttgtgaaactgcactctggtaaagacgtcttcttcattcccccagaaaaatgcgacacacttctgtgcgatattggtgaatcctctccaaacccaacaatagaagagggccgtacactgagagtactcaagatggtggaaccgtggctgcgcggcaatcaattctgcatcaagatcctcaacccatacatgccgtcagtagtggaaacattggaacaaatgcagcggaaacacgggggaatgctagtgcgcaacccactatcacgcaatagtacccatgagatgtactgggtatcctgcggaacaggaaacatcgtaagcgccgtaaacatgacgtcccggatgctgctcaaccggttcacaatggcgcatagaaagccgacatacgagcgcgacgtggatcttggagcaggcacccggcatgtggccgtggagcccgaggtcgcgaacctcgacatcattggacaaagaatagaaaacatcaaacacgaacacaagagcacatggcattacgacgaggacaacccgtataaaacatgggcgtaccatggctcctacgaggttaaaccctccggctccgcgtcttcaatggtgaacggggtagtgaaactcctgacaaagccgtgggatgttatcccgatggtgacacaaatagccatgacggatactacgcccttcggtcaacaaagagtgttcaaggagaaagtagacacaagaacaccaaaagcaaaacgggggacagcacaaataatggaagtcaccgctaagtggctctgggggttcctaagccgaaacaagaaacctcgcatatgcacacgggaagagttcacgcggaaagtgcgaagcaatgcggccataggcgccgtgttcgtcgatgaaaaccaatggaactcggccaaggaggcagtggaggacgagcgcttttgggatctagtccaccgcgaaagagaactgcataagcaagggaagtgcgccacatgcgtatacaatatgatggggaaacgcgagaagaaactcggagagttcggcaaagcaaaaggctcaagagccatatggtacatgtggctcggggcccggttcctggaatttgaggcactaggattcatgaacgaagaccactggttcagtcgcgaaaactcactatcgggggtagaaggcgaagggcttcataaactaggctacatattacgcgacatatcaaaaatacccggaggcaatatgtacgcagatgatacagcggggtgggacacacgcataacagaagacgatttacagaacgaagccaaaataacagatatcatggaaccggagcacgcgctcttggccaaaagtatctttaaacttacataccaaaacaaggtcgtaagagtccaacgcccggcaaagaacgggactgtcatggatgtaatatcgcgcagagatcagagaggatcaggacaggtcggaacgtacggacttaacactttcaccaacatggaagcccaactcataagacagatggaatccgaaggcattttctccccgagcgagttagaaacccctaaccttgcagggcgcgtattggactggctcgaaagacacggcgtagaaaggctaaaaaggatggcaatttcgggagatgattgcgtagttaaaccaatcgacgatagattcgcgaccgcactgactgcccttaacgacatgggcaaggtacgaaaagacatcccgcaatgggaaccgagcaaaggatggaatgactggcaacaagtgcccttctgtagccaccacttccaccaattaattatgaaggacgggagagaaatagtggtgccgtgcaggaatcaagacgagctggtcggacgagcacgggtaagccaaggcgcagggtggtcgttaagagagacggcatgcctgggaaagagctatgctcagatgtggcaattaatgtacttccaccggagggacttaagactcgcagccaatgcgatttgcagtgccgttcccgtagactgggtaccgacatcaaggaccacatggagtatccacgcccaccaccaatggatgactacagaggacatgctttctgtttggaacagagtctggatagaagaaaacccatggatggaagacaaaacacatatttcatcgtggggagatgtcccatacctaggtaaaagagaggaccaatggtgtggatcactcatcggtctaaccgcgagagcaacctgggccacgaacatacaagtggcaataaaccaagtacggaggctcatagggaacgaaaactacttagactatatgacatccatgaaacgcttcaaaaacgagagcgaccccgaaggcgcgctgtggtga

SEQ ID NO: 24221 - RNA, 9879 nt, synthetic construct
  misc_feature 1..9879: note = derived and/or modified CDS sequence (opt11) from DENV-1__FJ410247__SS-prME
  source 1..9879: mol_type = other RNA
tccgtaactatgctgctcatgctgatgcccactgccctggccttccacttgacgacacggggcggggaaccgcacatgatcgtgagcaagcaggagcggggcaagagcctactcttcaagaccagcgcaggggtgaatatgtgcacactcatcgccatggacctgggcgagctgtgcgaagacacaatgacatacaaatgcccccgcatcaccgagaccgagcccgacgacgtcgactgttggtgcaacgcaacggacacctgggtgacctacgggacctgtagccagacaggggagcatcggagggacaagcggtccgtggccctcgcgccccacgtgggcctggggctggaaacccgcacagagacctggatgagctccgaaggcgcgtggaagcaaatacaacgtgttgagacctgggccctgcgccaccctgggttcaccgtgatcgccctgttcctggcccacgcgatcggtacctctatcacccagaaggggataatcttcatcctgttaatgctggtaacgccttccatggccatgcgatgcgtcggcatcggcagccgcgacttcgtggaggggctaagcggcgcgacctgggtggacgtagtcctggagcatgggagctgcgtgaccaccatggccaaggacaagccgacgcttgacatcgagctactgaagactgaagtcactaaccccgccatcctgcgtaagctctgcatcgaggcgaagatctccaacaccacgacagacagtaggtgtccgacccagggcgaggccaccctggtggaagaacaggatgccaacttcgtttgtcggcgcacgttcgtcgaccggggctgggggaatggctgcggtctgttcggaaaggggtccctgatcacgtgcgccaaatttaagtgtgtgaccaagctcgaaggcaagatcgtgcaatacgagaacctgaaatacagcgtcatcgtcaccgtgcacacgggcgaccaacaccaggtcggcaacgagtccactgagcatggcactaccgctacaatcactccccaggcgccgaccacggaaatccagctcaccgactacggggctttgacactggattgctctccgcgcaccggcctcgattttaatgagatggtgctgcttacgatgaaggagaagtcgtggctcgtccacaaacagtggttcctggacctaccgctcccctggaccagtggagcaagcacgtcgcaagagacctggaatcggcaggacctactggtgaccttcaagaccgctcacgccaagaagcaggaagttgttgtgctcggctctcaagagggtgcaatgcacacggcactgactggagccactgagatacagacctccggcacaaccaccatcttcgccgggcatctgaagtgccgcctcaagatggacaagttgacgctgaagggcatgtcctacgtaatgtgtacggggtccttcaaactcgaaaaggaggtcgccgagacccagcacggcactgtgctggtgcagatcaagtacgaggggacggatgcgccgtgcaagatccccttctctactcaagacgaaaagggggtaacccagaacggtcgtctgatcaccgctaacccgatagtgactgacaaagagaaacccgtgaacatcgaggccgagcctcccttcggagaatcctatatcgtcatcggcgccggcgagaaggctctcaaacttagttggtttaagaaaggctccagcatcggcaagatgttcgaggcgacggcccgcggggcaagacgcatggcgatactgggtgacacagcatgggatttcgggtctatcggcggcgtgttcaccagcgttggtaagttggtccatcagatctttgggaccgcctacggggtcctgttcagtggagtgagctggacgatgaagattggtattggcgtactgctgacctggctcggactgaactccagatcaacgtcgctgagtatgacttgcatagccgttgggctcgtgacactgtacctgggcgtcatggtgcaggcagactccgggtgtgtgatcaactggaagggccgggaactcaaatgtgggtcaggcatcttcgtcaccaatgaggtgcacacctggaccgagcagtacaagtttcaagctgactccccgaagcgcctgtccgcagccatcggcaaggcttgggaggaaggtgtgtgcggcatcagaagcgccactcgcttggagaacataatgtggaagcagatctccaacgagctcaatcacattctactggagaatgatatgaagttcactgttgtggtgggcgacgttgcaggtatcctcgcacagggaaagaagatgatacggcctcagcccatggaatacaagtactcatggaagtcctgggggaaagccaagattattggcgccgacgtgcagaatactacgttcattatcgacgggcccaacaccccagaatgccctgatgaccagcgtgcctggaacatctgggaggtggaagactacggctttgggatcttcacgacaaatatctggcttaaacttagagacagctacacccaggtatgtgatcaccgcctcatgtccgcggccatcaaagacagcaaagctgtgcacgcggacatgggctattggatcgagtccgagaagaatgagacgtggaaacttgcccgcgcgtctttcatcgaggttaagacgtgcatttggcccaaatcacacaccctttggagcaacggcgtcctcgagagtgagatgatcatccccaagatttacggcggtccgatcagccagcacaattacagacccgggtacttcacgcaaaccgctggcccatggcatctaggaaagctggagctcgatttcgacttatgcgaggggacgactgtggttgtcgatgagcattgtggaaaccggggtccgtctctgcgcacaacaacggtgacgggcaagattatccacgagtggtgttgcagaagctgtaccctgccacccctgaggttccgcggagaggatggctgctggtacggcatggaaatccgtcccgtgaaggagaaagaagagaacctggtcaagtccatggtctctgctggcagcggtgaggtggacagctttagtcttggcttactctgtatatccataatgatcgaggaggtcatgcggagtcgctggtcccgaaagatgctcatgaccggaaccctggctgtattcttactccttatcatgggacagctgacctggaacgacctcatccgcctgtgcattatggtgggcgcaaacgcgagtgataggatgggtatgggcaccacatatctggccttgatggcaacgtttaagatgcggccgatgttcgccgtcggcctgttattccgccggctaacctcccgcgaagttctgttgttgacaattgggctgtcattagtggcgagtgtcgaattgccaaattcactggaagaactgggtgacggcctcgcgatgggcataatgatcctcaagctgttaaccgattttcagtctcaccagctgtgggcaacgctgctctccttgacattcataaagactaccttctcgctgcactatgcctggaagacgatggccatggtcctctcgattgtcagtttattccctctttgcctcagcaccacatcccaaaagaccacgtggcttcccgttcttctcggcagcttggggtgtaagccgttaaccatgttcttgatagcggagaaccggatctggggccggagatcatggcccttaaatgaggggatcatggctgtgggtatcgtcagcattttgctcagctcactgctgaaaaacgacgtgccattagcgggacccttgatcgccggtggcatgctgatcgcctgttacgtgatcagtgggtcctcagcggacttgtccctcgagaaagccgccgaggtgagctgggaggaggaggccgagcactcgggcgcctcacataatatcctagtagaggttcaagacgacggtaccatgaaaatcaaggatgaagaacgcgacgatacccttaccattttattgaaagctacgttattggccgtatccggcgtatacccgctgagcattccggcaacgttatttgtctggtacttctggcagaagaaaaagcagcggtccggagttctgtgggacactcccagcccgccagaagtggaaagagccgtgttagacgacggtatctaccggataatgcagcgcggcctgctggggcggtcccaggtcggcgtgggggtgttccaagagaacgtattccacaccatgtggcacgtcacgaggggcgctgtgctgatgtaccaggggaagcggctcgagccttcttgggcgtccgtcaagaaagacttaatcagctacggcggtgggtggaggctccagggctcctggaacaccggggaagaggtccaagtcatcgcagtagagcccggcaagaatcccaagaacgtgcagaccaccccgggcacgttcaagacccccgagggcgaggtaggcgcaatcgccctcgacttcaagccaggcacaagcggctcgcccatcgttaaccgggaaggcaagatagtgggcctctacggcaacggtgtcgttaccacgagcgggacatacgtgagcgccatcgcccaggccaaggcctcgcaggaaggaccgctacctgaaatagaggacgaggtgttccgcaaacggaatctgacaatcatggatctacaccccggctcaggtaaaactcgtcggtacttaccagccatcgtccgcgaagcgatcaagcggaagctgcggactctcatcctggccccaaccagggtggtcgcgagtgagatggccgaggctctgaagggcatgcccatacggtaccagaccaccgcggtcaagagcgaacatacgggcaaggagatagtggacctcatgtgtcacgccaccttcaccatgcgcctgctgtcccccgtgcgtgtccctaactataacatgataatcatggacgaggcacacttcacggaccccagctccatcgcggccagagggtacatcagcactcgggtgggcatgggggaggccgccgccatcttcatgaccgccacgccgccgggctccgtagaggcatttccgcagagcaacgcggtcatccaggacgaggagagagatatcccagaacggtcctggaacagtgggtatgaatggatcaccgacttccccggcaagacagtgtggtttgtgccctccataaagagcggcaatgacatagccaactgcctgcgcaagaacgggaagcgggtcattcagctgtcacggaagactttcgacacagagtaccagaagaccaagaataacgactgggactacgtggtgacgactgacatctctgagatgggcgccaatttccgggctgatcgcgtaatagacccgagacgctgccttaagccagtgatcctcaaagacggccccgagcgggtaatcctagcgggtccaatgccggtcacagtcgcctccgccgcacagagacgggggcgcataggccgcaaccataacaaggaaggcgaccagtacatctacatgggtcagccgctgaacaacgacgaggaccacgcccactggaccgaggccaagatgctcttagacaacatcaacacgcccgaaggaatcatccccgcgctgttcgagcccgagcgagagaagtcggcggctatcgacggggagtaccgcctcagaggggaggcccgcaagacctttgtggaactgatgcggcggggtgacttgccggtgtggctctcctacaaggtggcgagcgagggcttccagtacagtgatcggcgctggtgtttcgacggcgagcggaataaccaggtgcttgaagagaacatggatgtggagatatggaccaaggagggcgagagaaagaaattgagaccccgttggctagacgcccgcacatactccgacccactggccctgcgcgagtttaaagagtttgcagcaggccggagatcggtgtccggggacctcatcctggagataggcaaactgccgcagcacctcacgcagagggcacagaacgccctggacaatttggtcatgctacataacagcgagcaaggtggtcgagcctaccggcatgccatggaagagttgcccgacaccatcgagacactcatgctcctagcgctgatcgcggtgctcaccggcggggtgaccttgttctttctctcgggccgggggcttggaaagacaagcatcggcctgctgtgcgtcatggccagtagtgttctactgtggatggcctccgtggaaccacactggatagccgcatctatcatcctcgagttctttctaatggtcctcctgatccccgaaccggaccgccagcgcaccccgcaggacaaccagctcgcctacgtggtaatcgggctgctgttcatgatcctcacagttgccgccaatgagatgggcctgctggagacgactaaaaaggacctcggaattggccacgttgccgtggggaaccatcaccatgctgcgatgctggacgtcgacctacaccccgcctccgcttggacactctacgccgtggccactacaatcataacgccgatgatgcggcacacaatcgagaacaccaccgccaatataagcctaacggcgatcgccaaccaggccgcaatccttatgggcctcgacaagggctggcccatctccaagatggacatcggggtccccctgctggcactgggatgctacagccaggtcaaccccctcaccttaaccgctgcggtcctcatgctggtggcgcattacgccatcatcgggccagggctgcaggccaaagcgaccagagaagcgcaaaagagaacagcggccggcatcatgaagaaccccactgtcgacgggatcgtggccatcgacctggacccggtggtatacgacgccaagttcgagaaacaactggggcagataatgctcctcatattgtgcacaagccagattctgctcatgcggaccacctgggccctgtgcgaaagcataacattagcgaccgggcccctcacgacgctgtgggaaggatcccccgggaagttctggaacacgaccatagcggtgtctatggccaacatcttccgcgggtcctaccttgccggggcagggttggctttcagcctgatgaaatccctgggcggagggcggcgcggaaccggagcccagggcgagacgctcggagagaagtggaagcgtcagcttaaccaactatccaagagcgagttcaatacctataagcgcagcggaattatggaagtagatcggtccgaggcaaaagagggtctcaagcgcggggaaaccaccaagcacgccgtatcccggggcactgcgaagctgcgctggttcgttgagaggaacttagtgaagccagaggggaaggtgatcgacctgggctgtggccgcggcgggtggagttactactgcgccggcctgaagaaggttaccgaggtcaaggggtacaccaagggcggccccgggcacgaggaaccgatcccgatggccacatacggctggaatctagttaaactgcattccgggaaggacgtatttttcatcccgcctgagaaatgcgacaccctgctttgcgatatcggcgagagctcccccaatccgacgatagaagagggcaggacccttcgcgtgctcaagatggtcgagccctggctccgaggcaaccagttctgcatcaagatactgaacccatacatgcccagcgtggtggagacgctcgagcagatgcagcgcaaacacggcgggatgctggttcggaaccctctttctcgcaatagcacgcacgagatgtactgggtgtcctgcggcacaggaaatatcgtgagcgctgtcaacatgacctcccgcatgttgctaaacaggttcaccatggcgcaccgcaagcccacttatgagcgggacgtggacctcggagcgggcacacgacacgtggcggtcgagccggaggtggcgaacctcgacattatcgggcagcgtatcgagaacatcaaacacgagcataagtcgacctggcactacgatgaggacaacccctacaagacatgggcctatcacggctcctatgaagttaagccctcaggttccgcatccagcatggtcaatggtgtcgtcaagttgttgaccaagccatgggacgtgatccccatggtaacgcagatcgcgatgaccgacactactcccttcgggcaacagcgcgtcttcaaggagaaggtagacactcggaccccgaaggccaaacaggggaccgcccagatcatggaggttaccgcgaagtggctctggggcttcctgagccgcaacaagaagccccggatctgcacgagggaggagttcacgcgaaaggtccgcagcaacgcagcaatcggggccgttttcgtggacgagaatcagtggaactcggccaaggaggccgtcgaggacgaacgcttctgggacctggtgcaccgagagcgggagctacacaagcagggaaaatgtgcgacctgcgtatacaacatgatggggaagagggagaaaaagctgggagagttcgggaaagctaaaggttcccgggccatctggtatatgtggctgggcgcccgctttctcgagtttgaggccctgggcttcatgaacgaggaccattggttctcccgggaaaatagtctgtccggagtcgaaggtgagggactccacaagctgggttatatcctgcgagacatcagcaagatccccggcggaaacatgtacgcagatgacaccgccggctgggatacgcggatcacagaagacgacctccagaacgaggcgcgcatcaccgacatcatggaaccggagcatgctctgttagccaagtccatctttaagctcacctaccaaaacaaggtggtgcgagtacagcggcccgcgaaaaacggcaccgtgatggacgtaatcagccgccgcgaccaacgcggctccggccaggtcggcacatatgggctgaacaccttcacgaacatggaagcccagctgatcagacaaatggaaagcgagggaatcttctccccgagcgagcttgagacacccaacctagccgagcgcgtgctggactggctagagaagtatggggtggagcggctgaagcgaatggccatatcgggcgacgactgtgtcgttaaaccgatcgatgaccggttcgcaaccgcgcttaccgcgttaaatgatatgggcaaggttcgcaaggacattccccagtgggaacctagcaagggctggaacgactggcagcaggtccccttttgctcacaccattttcaccaactgatcatgaaggacggccgggagatcgtggtcccctgccgcaaccaagacgagctggtagggagggccagagtgagtcagggcgctggatggtctctccgcgaaaccgcgtgtctgggcaaaagttatgcacagatgtggcagcttatgtacttccacaggagagaccttcgcctggccgctaatgctatctgctcggctgtgccggtcgactggattccgacgagccggactacctggagcattcatgcacatcaccagtggatgacaactgaggacatgctatccgtgtggaacagggtgtggatcgaagagaacccatggatggaggacaaaacccacatcagctcctggggcgatgtgccatacctcggaaagcgcgaggaccagtggtgcgggagcttgattggccttactgcccgcgcaacctgggccactaacatccaagtggctatcaatcaggtgcgccgcctcataggcaacgaaaactacctggactatatgacgtctatgaagcgattcaagaacgaatccgaccccgagggtgcgttatggtga

SEQ ID NO: 24222 - RNA, 9879 nt, synthetic construct
  misc_feature 1..9879: note = derived and/or modified CDS sequence (opt11) from DENV-1__FJ410248__SS-prME
  source 1..9879: mol_type = other RNA
agcgtgaccatgcttctgatgctgatgcccaccgccttagccttccacctcactacacggggtggggagccgcacatgatagtgtcaaagcaggagcggggcaagagcctcctgtttaagacgagcgccggggtgaatatgtgcactctcatcgcaatggacctgggcgaactgtgtgaggataccatgacctacaagtgccctcgaatcaccgaggccgagcccgacgacgtagactgctggtgcaacgccaccgacacgtgggtgacgtacgggacctgcagccagaccggggagcaccggcgggacaagagatccgtagcgctcgcaccccacgtcggcctggggctggagactagaacggaaacctggatgagcagcgaaggcgcctggaaacagatacagcgggtcgaaacctgggcccttcgtcaccccggtttcactgtaattgcccttttcctggcgcacgccatcggtacaagcatcacacagaaggggataatattcatcctcctaatgctggtgaccccctccatggccatgcggtgcgtcggcattggcagccgagacttcgtggaggggctctccggggccacgtgggtggacgtcgtgttagaacacgggagctgcgttaccaccatggccaaagacaagcccacccttgacatcgagctcctgaaaacggaagtcaccaaccccgcggtgctgaggaaactctgcatagaggccaagatctccaacaccaccacggacagccgctgtccgacccagggcgaagcaacactggttgaggagcaggacgcaaacttcgtttgccgtcgcaccttcgtggatcgggggtgggggaacgggtgcgggctgttcgggaaagggtccctcatcacgtgcgccaagttcaagtgcgtgaccaagctggaagggaagatcgtacaatatgagaacctgaaatacagcgtgatcgtgacggtccacaccggcgaccagcaccaggtggggaatgagtccacagagcacggcaccaccgcgaccatcacgccccaagcccccagcacggagatccagctcacagattacggggccctgaccctagactgcagcccccggaccggcttagacttcaacgagatggtcctgctgacgatgaaggagaaaagctggctcgtccacaagcagtggtttctggacctgccactcccctggaccagcggggcctccacaagccaagagacctggaaccggcaagatttgctcgtgacgttcaaaaccgcccacgcgaagaagcaggaggtcgtggtgctcggctcccaggaaggggccatgcacaccgcgctgaccggagccacggagatccagaccagcggcacgacaacgatcttcgccgggcacctgaaatgccgcttgaagatggacaagctgaccctgaagggcatgtcctacgtcatgtgcactgggagcttcaagttggagaaggaggtggcggagacccagcacggcacggtgcttgtacaaataaaatacgagggcacggacgcgccatgtaagatccccttctccacccaggatgaaaaaggagtgacacagaacggccggctgatcactgccaaccctatcgtgacagacaaagagaagcccgtcaacattgaggccgagccgccctttggggagtcttacatcgttattggcgcgggggagaaggccttaaagctctcctggttcaagaaggggtcatccatcggcaaaatgttcgtggccaccgcaagaggggcccggcgcatggcgatcctaggcgacacagcctgggacttcgggagcatcggcggcgtcttcacctccgtggggaagttagtgcaccagatcttcggcaccgcctacggggtcctcttcagtggcgtgtcctggaccatgaagatcggtatcggcgtgctgctgacatggctcggcctgaacagccgatccacgtcgttgtccatgacctgcattgccgtcggactcgtgaccctgtacttaggcgtgatggtccaagccgacagcgggtgcgtgatcaactggaagggccgggagcttaagtgcgggtcaggcatcttcgtgaccaacgaggtccacacgtggaccgagcagtacaagttccaagcggattccccgaaaagactctctgccgcgataggcaaggcctgggaggaaggagtatgcggcatccggtccgcgaccaggctggagaacatcatgtggaagcagatcagcaacgaactcaaccatatcctgctggagaacgacatgaaattcaccgtggtcgtgggggacgtggctggcatcctcgcccaggggaagaagatgatccggccccagcccatggaatacaagtactcgtggaagagttggggaaaggcaaaaattatcggcgccgatgtccagaacaccacgtttatcattgacgggcccaataccccggagtgccccgacgatcaacgagcgtggaatatctgggaggtggaagactacggcttcgggatcttcaccaccaacatctggctaaagctgcgtgactcctacacccaggtctgcgaccacaggttaatgagcgcggccatcaaggactccaaggccgtgcacgccgatatgggctactggatcgagagtgaaaagaacgaaacatggaagctggctcgggcctccttcatcgaggtgaagacctgcatttggcccaagagccacaccctgtggtccaacggcgtattggagagcgaaatgataatccccaaaatttatggcggccctatctcccagcacaactaccgccccgggtactttacacaaaccgccggaccgtggcacctggggaagctggagctcgacttcaacctgtgcgaaggtaccaccgtggtcgtggatgagcactgtggcaaccgggggccgagcttgcgcacgacgacggtcaccggcaagatcatccacgagtggtgctgccggagctgtacgctgccgccactgcgcttcaagggggaggatggctgctggtacgggatggagatccggcccgtaaaggaaaaggaggagaacctggtaaagagcatggtctcggcaggctccggcgaggtggacagcttctccctcgggttgctgtgcattagcatcatgatcgaggaagtgatgaggagccggtggtctcgcaaaatgctcatgacaggcaccctggctgtcttctttttactcatcatggggcagctgacttggaacgacctgatccggctctgcataatggtgggcgcgaacgcatccgacagaatgggaatgggcacgacctacctggcgctgatggccactttcaagatgaggccgatgctcgccgtggggctgttattccgtcgcttgacaagccgggaggtactgctgctcacgatcggactgtccctggtggcgagcgtcgaactccccaactccctggaagagttgggcgacggtctggccatgggcatcatgatcctgaaattactcaccgatttccagagccaccagctgtgggcaaccctgctctcgctgaccttcatcaagacgacctatagcttgcactacgcctggaagacaatggcgatggtgctctcaatcgtgtcgctgtttcccttgtgcctctccaccaccagccagaagacgacctggcttcccgtcctgctaggatccctggggtgcaagcctctcacaatgttcctcatagccgaaaacaaaatctggggccgcaagagctggccactgaacgagggtatcatggccgtcggcatcgtgtccatcctactctccagcctgctgaagaatgacgtccctctcgccgggcctcttatagccggcggcatgctgatcgcctgctacgtgatctccgggagctccgccgacttaagcctagaaaaagccgccgaagtgtcgtgggaggaggaggcagagcacagcggcgcgtcccacaacatacttgtagaggtgcaagacgacgggacaatgaagatcaaagacgaggagcgagacgacaccctgaccatcctgctaaaggcgaccttactggccgtgagcggcgtctaccccctgtcaatacccgcaaccttattcgtgtggtacttttggcaaaagaagaagcagcgcagcggcgtgctgtgggacacgccctctccgcctgaggtcgaacgtgccgtgctggacgacgggatctaccggatcatgcagaggggattgctcgggcgcagccaagtgggcgtgggggtgttccaggagaacgtttttcacaccatgtggcatgtcacccggggcgcagtgctgatgtaccaggggaagcgcctagagcccagttgggccagcgtgaagaaggacctcatcagttatggcggcgggtggcggctgcagggcagttggaacactggagaggaggtacaggtgatcgccgtggagccaggcaagaaccccaagaatgtccagacagcccccgggaccttcaaaacttcggagggcgaggttggcgccatagcgttggactttaagcccggaacaagtggcagccccatcgttaaccgcgaagggaagatcgtggggctctacggcaacggggtggtgacgacatccggcacgtacgtctctgctatcgcgcaggccaaggcttcccaggaggggcccctgccggaaattgaaaacgaggtgttccggaagcgcaatttaaccatcatggacctccaccctggcagcggaaaaacgcgaaggtacctgcccgccattgtccgagaagccatcaagcgaaagctccggacgctcatactcgccccgactcgtgtagtggcctctgagatggctgaggccctcaagggcatgcccatccgctatcagaccaccgctgtcaagagcgagcatactggcaaggagatcgttgacctcatgtgccacgccacattcaccatgcggttactgtcccccgtccgcgtgcccaactacaacatgatcatcatggacgaggcacacttcactgacccgtcctccatagcggcccgggggtatatcagcacccgggtcggcatgggggaggccgcggcaatctttatgaccgcgacgccacccggctcggttgaggcctttccccagtctaatgccgtaatccaggacgaggagcgggatataccagaaaggagttggaacagcgggtacgagtggatcacggacttccccgggaagaccgtctggttcgtgccctccataaagagcggcaacgacatcgccaactgcctccggaagaacgggaagcgtgttatacagctttcccgaaaaacctttgataccgagtaccagaagacgaagaacaacgactgggactacgtggtgaccactgacatctcggaaatgggcgccaacttccgcgctgatcgggtgatcgacccccgacggtgcctgaagcctgtcatcctaaaggacgggcctgaacgcgtgatcctagccggccccatgcctgttaccgttgcctctgccgcgcagcggcgcgggcggatcggccgcaaccacaacaaggagggcgatcaatacatctacatggggcagccgctaaacaacgacgaggatcacgcccactggactgaggccaagatgctactggacaatatcaacacgccagagggcattattccggcgttattcgagcccgagcgggagaagtccgccgccatagacggggagtaccgcctccgcggggaggcccggaagaccttcgtcgagctgatgcgccgcggcgatctcccggtctggctctcttacaaggtggcctccgaaggcttccaatacagcgaccgtcggtggtgcttcgacggagagcgcaacaaccaggtgctggaggagaacatggacgtcgagatttggacaaaggagggggaacggaagaagctgcgcccccgttggttggacgcccgtacgtactccgacccattggccctgcgggagttcaaagagttcgcggctggccgccggtccgtgtccggggacctcatcctggagatcggcaagctcccccaacacctcacccagcgcgcccagaacgcgctcgacaacctggtgatgctccataactccgagcagggtgggcgggcgtaccgacatgctatggaagaactgccggacaccatcgaaaccctgatgctcctggccctaatcgccgtcttaacgggaggggtgaccctgttctttctgtctggccggggtctcggcaagaccagcattggcctactgtgcgttatggcgtccagcgtcctcctatggatggcgagtgtggagccccactggatcgccgcctcgatcatcctggagttcttcctcatggtgctactgatccccgagccggaccgccagcggaccccgcaggacaaccagctcgcctacgtcgtgatcgggctgctctttatgatactcacagtggccgcgaacgagatgggcttacttgagaccaccaagaaggacttagggatcggccacgtggccgtagagaaccaccaccacgcagccatgctggacgtggacctgcaccccgcctccgcgtggaccctttacgccgtcgccacgacaatcatcacccccatgatgaggcatacgatcgagaacacaacggccaacatcagcctgactgcgatcgcgaaccaggcagcgattcttatggggcttgacaaggggtggccgatctccaagatggatataggcgtccccctgctggccttaggttgctacagccaggtgaaccccctgaccctgaccgctgccgtactcatgttggttgcccactacgctatcatcgggcccggcttgcaggccaaggcgacgcgggaagcccaaaagcgcaccgccgccggcatcatgaaaaatccgaccgtggacgggatcgtggccatcgacctcgacccggttgtgtacgacgctaagttcgagaagcagctgggccagataatgcttctcatcctgtgcacctcccaaattctgctgatgcgcacgacctgggccctgtgcgagagtatcaccctggccacaggccccctaacgaccctgtgggaggggtcccccggcaagttctggaacaccaccatcgcagtcagcatggccaacatcttcaggggcagctatctggccggcgccggcctcgccttctccctgatgaagtcactcggaggagggagacgggggacgggtgcccagggcgagaccctcggcgagaaatggaagagacagctgaaccaactgtccaagagcgagttcaatacctacaagcggtccggcattatggaggtggaccgatccgaggctaaggaggggctcaagcgcggggaaaccacgaaacacgccgtatcccgcggcaccgccaagctgcgatggttcgtggagcgcaacctggttaagccggaggggaaggtgatcgaccttggctgcggccgcggagggtggagttactattgcgccgggcttaagaaggtaactgaggtcaaggggtataccaagggcgggcccggccacgaggaacccatacccatggccacgtacggatggaatctggtaaagctccactcggggaaggacgtctttttcatcccgcccgagaagtgcgacacgcttctgtgcgacattggcgagagctcccccaaccctaccatcgaggagggacggaccctgcgggtgctcaaaatggttgagccgtggctccgcgggaaccagttttgcataaagatcctgaacccctacatgcccagcgttgtggagacgctcgagcagatgcagcggaagcatggcggcatgctggtgcggaaccccctgtctcgcaactctacccacgagatgtactgggtatcttgcgggaccggtaacattgtgagcgcggttaacatgaccagtcgtatgctcctgaatagattcacaatggcacaccgcaagccgacgtacgagaaggatgtggacctgggtgcaggcacccgccacgtggcagtggagcccgaggtcgccaacttggacatcatcggccagcgaatagagaacataaagcacgagcacaaatccacctggcactacgacgaggacaacccctacaaaacctgggcctaccacgggagctacgaagttaagcccagcggaagcgcctccagcatggtaaacggggtcgtgaagctgctgactaagccgtgggatgtcattcccatggtgacccaaatagccatgaccgacacaacccccttcggccagcagcgcgtattcaaggagaaggtcgacacccggacccctaaagctaagcgtgggaccgcccagatcatggaagtgacggcgaagtggctctggggctttctgtcccggaataagaagccgcgcatctgcacacgggaggagttcacgcgcaaagtacggagcaacgccgccatcggcgcggtcttcgtcgacgaaaatcaatggaactcggccaaggaagcagtggaagacgagcgcttctgggacttagttcaccgggagcgcgagctccataaacaaggtaagtgtgcgacgtgcgtgtacaacatgatgggtaagcgagagaaaaagctgggtgagttcggcaaggccaagggctcccgcgccatctggtacatgtggttaggcgcgcgctttctggagttcgaggccctgggtttcatgaacgaggaccactggttctcccgcgaaaacagcctttcgggggtggagggcgagggtctccataaattaggctacatcctgcgtgacatcagcaagatccccggagggaacatgtacgccgacgacactgccggctgggacacgcgcataacagaggacgacctccagaacgaagcgaagatcaccgacatcatggagcccgaacacgccctgctggccaaatcaatcttcaaactcacgtaccaaaataaagtagtgagggttcagcgccctgccaagaacgggaccgtcatggacgtgatctcacgccgcgaccagcgcggctccggccaggtgggaacctacggcctgaataccttcacgaacatggaggcccagcttatccggcagatggagtctgagggcatcttctcccccagcgagctcgagaccccgaacctggccggccgagtcctggactggctcgagaagcatggggtcgagcggcttaaacggatggccatctctggcgacgattgtgtggtaaaacccattgatgaccggttcgcgaccgccctgaccgcactcaacgacatggggaaggtgcgcaaggacatcccgcagtgggaacccagcaagggctggaacgactggcagcaggtccccttttgcagccatcatttccaccagctgatcatgaaggacggccgggagatagtcgtaccgtgccggaaccaagacgagctggtagggcgtgccagagtctcccagggcgcaggctggagtttacgggagacggcctgcctgggcaagtcctacgcccagatgtggcagctgatgtatttccaccgccgggacctccgcctggccgcgaacgccatctgtagcgcggtaccggtagattgggtccccacctcccggacgacatggagcatccatgcacaccaccagtggatgacgaccgaggacatgttgtccgtgtggaatcgcgtgtggatcgaggagaacccctggatggaagacaagacccacatcagctcttggggcgatgtcccctatctgggcaagcgggaagaccagtggtgtggcagcctgatcgggttaaccgcccgcgcgacgtgggccaccaacatccaggtggccataaaccaagtgcggcgcttaatcggcaacgagaattatctggactacatgacatcaatgaagcgattcaagaatgagtcggacccggagggggctctatggtga

SEQ ID NO: 24223 - RNA, 9879 nt, synthetic construct
  misc_feature 1..9879: note = derived and/or modified CDS sequence (opt11) from DENV-1__FJ410249__SS-prME
  source 1..9879: mol_type = other RNA
tcggttacgatgctgcttatgctgatgcctaccgccctagccttccacctcacgacccgagggggagagccccacatgatcgtaagcaagcaggagcggggcaagagcctgttgttcaagaccagcgctggggttaacatgtgcaccctcatcgccatggatctgggtgagttctgtgaggacacgatgacctacaagtgcccccggatcactgaggccgagcctgacgacgtggactgctggtgcaacgccaccgacacgtgggtgacatacgggacctgtagccagaccggtgagagacggcgggacaagcgctccgtggccctggcgccccacgtgggcctagggctggagacgcggaccgaaacctggatgagctccgagggcgcctggaagcagatccagagggtcgagacgtgggccctgcggcatcccggattcacggtaatagcactcttcctggcgcatgccatcggcacctcaatcacccagaaagggatcattttcatcctgctcatgcttgtgaccccctccatggccatgaggtgcgtcggcgtcggaagccgggacttcgtggaggggctgtccggggccacgtgggtcgacgtagtgctcgaacacggaagctgtgtcaccaccatggcaaaagacaagccgaccctggacatcgagctgctcaagacggaagtgaccaaccccgcggttctgcgcaagttatgcatcgaggccaagatatccaacaccacaacggatagtaggtgcccgactcagggcgaggccaccctcgtcgaggagcaggacgccaacttcgtgtgccgcagaacctttgtggacagaggctgggggaacggctgcgggctgttcgggaagggttccttaatcacatgcgccaagttcaaatgcgtcaccaagctcgaaggcaagacagtgcagtacgagaatctgaagtacagcgtgatcgtcaccgtgcacacgggcgaccagcaccaggtggggaacgagtcaactgaacacggcactaccgcgaccatcacgccccaggcccccagcaccgagatccagctgaccgactacggcgccttgaccctggattgcagccctcggacgggcttggatttcaatgagatggttttgctgacaatgaaggagaagtcctggctggtgcataagcagtggtttctcgacttgccgctaccctggacctcgggggccagcaccagccaagaaacgtggaaccgcaaggacctcctggtaacgttcaagaccgcccacgcgaagaagcaagaagtggtggtcttaggctcccaggagggcgccatgcacacagccctcacgggggccaccgagatccagacgtccggcacgaccaccatcttcgccgggcacctgaaatgccggctgaagatggataagctaaccctgaaggggatgagctacgttatgtgcaccggcagctttaagctggagaaagaagtggcggaaacgcagcacggaaccgtgcttgtgcagataaagtatgagggcaccgacgccccgtgcaaaatccccttctccacccaggatgagaagggtgttacccagaacggccgcctaatcaccgcgaacccgatcgtcaccgataaagagaagcccgtgaacatagaggccgagccgcccttcggggagagctacatcgtcattggcgcgggagagaaagcactgaagctgtcctggttcaagaaaggatcatccataggcaagatgttcgaggccaccgcacgcggtgcccgccgcatggcgatcctcggagacacggcctgggacttcgggagcatcggcggtgtgttcacctccgtggggaagctggtgcaccagatcttcggcgccgcgtacggggtcctgttcagcggtgtgtcctggactatgaagattgggattggcgttctcctgacctggctgggtctaaacagccggtccacaagcctgtccatgacctgtatcgccgtcgggctggtgacgttataccttggcgtcatggttcaggcggactcgggttgtgtcatcaactggaagggccgcgagctgaagtgcgggagcggcatctttgtgactaacgaggtccacacgtggaccgagcaatataagtttcaggcagactcccctaagcggctcagcgccgcgatcggcaaggcctgggaagagggggtgtgcggcattcgctctgcgacccggctggagaacatcatgtggaagcagatcagcaacgagctcaaccacatcctcctggagaacgacatgaagttcaccgttgtagtcggggacgtggccggaatcctggcacaggggaagaagatgatccgcccccagcccatggagtacaagtacagctggaagtcctgggggaaggccaagatcatcggcgcggacgtccagaacaccacgttcatcatcgatgggcccaacacccctgagtgccctgacgaccagagggcctggaacatatgggaagtcgaggactacggcttcgggatcttcacgaccaacatctggctcaagctgagggactcctacacccaggtgtgcgaccaccgtcttatgagcgccgccatcaaggactccaaggccgttcatgcagatatgggatactggatcgagagcgagaagaacgagacgtggaagctagcccgcgcctccttcatcgaggtgaaaacctgcatctggcccaaaagtcacaccctgtggtccaacggcgtcctggagtcggagatgatcatccccaagatctatgggggcccgatctcgcagcacaactaccgacccgggtacttcacgcagaccgcaggcccctggcacctcgggaagctggagctggacttcgatctctgcgaaggcaccaccgtcgtggtggacgagcactgcggcaaccgcgggccgagcctgcggacgaccactgtcaccgggaagatcatccatgaatggtgctgccgttcctgtacgctgccgcccctgcggttcaaaggtgaggatggctgctggtacgggatggagatccgccccgtgaaggagaaggaggagaacctagtcaagtctatggtaagcgccggctccggcgaggtggacagcttcagcctgggtctcctgtgcatcagcatcatgatcgaggaggtgatgcggtcccgctggagccggaagatgctgatgaccggcaccctagcggtcttcttctttctaatcatggggcagctgacctggaacgatctcatccgcctgtgcatcatggtgggcgcgaacgcctccgaccgcatggggatgggcacgacctatctggccctcatggccacgtttaagatgcggccgatgttcgcggtagggctgctgttccgccggctcaccagccgcgaagtactactgttgacgaccgggctgtccctggtggccagcgtcgagctccccaactccctggaagaactgggcgatgggctcgccatgggcatcatgatcctgaagctgcttaccgactttcagagccaccagctgtgggcgaccctgctctccctgacgttcattaagaccaccttcagcctgcactacgcgtggaagacgatggccatggtgctctccatcgtatcactgttccccctatgcctctcaacgacctcgcagaagaccacctggctgcccgtcctgctcggctccctggggtgtaagccgctcacaatgttcttgattgcggagaacaaaatctggggccgcaaaagctggcccctgaacgaagggatcatggccgtgggtatcgtgagcatcctgctctccagcctgctgaagaacgacgtccccctcgccgggccactaatcgcaggcggcatgttgatcgcttgttatgtgatctccgggagctcggctgacctctcactggaaaaggccgccgaggtgtcctgggaggaggaggcggaacacagcggcgcgtcccataacattttagttgaggtgcaagacgacgggaccatgaagataaaggacgaagaacgcgacgacaccctaaccatcctgctaaaggccaccctcctggccgtgagcggagtctatccgctgtccatccccgcaaccctcttcgtgtggtacttctggcagaagaagaagcagcggtcaggggtgctctgggacacccccagcccgcccgaagtagagcgagcagttctggacgacggcatttaccggatcatgcaacgcggtctcctcgggcggagccaggtgggcgttggggtgttccaggagaacgtattccacaccatgtggcatgtcacccgcggcgctgtgttaatgtaccaggggaaacgactggaaccctcctgggcttcggtgaaaaaggacctcatcagctacggcggcgggtggaggctgcagggcagttggaacacgggggaggaggtccaggtgatcgctgtggagcccggcaagaaccccaaaaacgttcagaccgcccccgggaccttcaaaacctccgagggcgaggtgggcgcgatcgccctcgacttcaagcccgggacgagcggcagtcccatagtgaaccgcgaggggaagatcgtcggcctctacggcaacggggttgtgaccacatcgggcacttacgtcagcgccattgcccaggcgaaggcctcccaggaggggcccctgcccgagatcgaggacgaggtgttccgcaagcggaatctcacaatcatggacttacacccgggcagcgggaagacccgccgttacctgccagccatcgtgcgcgaggccatcaagcggaaactgcggaccctcatcctggctcccactcgcgtggtggcgtcagagatggccgaagcactgaagggtatgcccattcggtaccagacgaccgcggtcaaaagcgagcacaccggcaaggagatcgtcgacctcatgtgccacgccacgttcacgatgcgcctcctgtcccccgtgcgggtacccaactacaacatgatcatcatggatgaagcgcatttcaccgacccgagctctatcgccgcccgcggttacataagcacacgggtcggcatgggggaggcggccgcgatctttatgaccgccacgccgcccggctccgtggaagccttcccccagagcaacgccgtgatccaagacgaggagcgagacatcccggaaagatcctggaacagcgggtatgagtggatcactgacttccccggcaagaccgtctggtttgtgccgtccattaagagcggcaacgacattgcgaactgcctcagaaagaacgggaagcgcgtgatccagctgtcccgcaagaccttcgatacagagtaccagaagaccaagaacaacgactgggattacgtcgtgacaacggacatcagcgagatgggcgccaacttccgggccgaccgcgtgattgatccccggcgctgcctgaagccggtcatcctcaaggacgggcccgagcgggtgatcctagccggtcccatgcccgtcactgtagcctccgccgcccagcgccggggtcgtataggccggaaccataacaaagaaggcgaccagtacatctacatgggccagccactgaacaatgacgaggaccacgcgcactggaccgaggccaagatgttgctggacaatatcaacacccccgagggcattatccctgccctattcgagccggagcgcgagaagtcagcggccattgatggggagtaccgcttacggggcgaggccagaaagaccttcgtggagctgatgcggcgcggggacttgccagtctggctttcttacaaggtggcctccgagggcttccagtatagcgacagacgctggtgcttcgacggcgagcggaacaaccaggtactggaggagaacatggacgtcgagatctggacgaaggagggagagcgtaagaagctacggccccgctggctcgacgcgcggacatactccgaccccttggccctgagagagttcaaagagttcgccgccggcagacgcagcgtgtccggtgatctcatcctggagatcggcaagctgccccagcacctcacccagcgggcccaaaacgcgcttgacaacctggtgatgctccacaacagcgagcagggcgggcgcgcataccggcatgccatggaggagttgccggacaccatcgagacgctgatgctcctggccctgatcgccgtcctcacgggcggggtgacgctgtttttcctctccggacgcgggctcggtaagaccagcatcggcctcctgtgcgttatggcgtcctctgtcctcctgtggatggcctcagttgagccgcattggatcgccgcatccatcatcctggagttctttctcatggtgctgctgatccccgagcccgaccggcagaggaccccgcaagacaaccagctcgcttacgtcgtgatcggtctgctgttcatgatcctcacggtggcggccaacgagatgggcctactggagaccactaagaaggacctagggattggccacgtcgccgtagagaaccaccaccacgccgccatgctggacgtagacctgcaccccgcgtccgcctggaccctctacgccgtggccacgacaatcattacccccatgatgcggcacaccatcgagaacacgactgccaacatcagtcttacagcgattgccaaccaggccgccatcctgatgggtctggacaagggctggccgatctctaagatggacatcggcgtgcccctgctggcgttagggtgctacagccaagttaatcccctgaccctgacggcagcagtcctcatgctggtggcccactacgccataatcggccccgggctgcaggcgaaggccacccgcgaggcccagaagcgtaccgccgccggcatcatgaagaatccgaccgtggacggaattgtcgcgattgacctcgatcctgtggtgtacgacgccaagttcgaaaaacagctgggccaaatcatgttactcatcttatgcacgtcccagatcctgctcatgcggacaacctgggccctatgcgagagcataaccctggccacaggccccctcaccaccctatgggaggggtcccccggcaagttctggaacacgacgattgccgttagcatggcgaacatcttccgcgggtcataccttgccggagccggcctcgccttctccctgatgaagtccttagggggagggcggaggggcaccggggcgcagggcgaaactctcggcgaaaagtggaagcggcagctcaaccagctgtccaagagcgagttcaacacctacaagcgctccgggatcatggaggtggaccggagcgaggccaaggagggcctcaagcgcggggagactaccaaacacgccgtgagtcggggcaccgcaaaacttcgatggttcgtagagcggaatctggtgaagccggagggcaaggtgatcgaccttggctgcggccgaggcggctggagctactactgcgccgggctgaagaaggtcacggaggtgaaaggctacacgaaaggcggccccgggcacgaggaaccaatccccatggcaacctacgggtggaacctggtaaagctgcactcggggaaggacgtcttcttcatcccgcctgagaagtgcgacacgctcctgtgcgacatcggggagagctctcccaatcccaccattgaggagggccggacgctgcgcgtactcaagatggtcgagccttggctccgcggaaatcagttctgcatcaaaatcctgaatccgtacatgccctctgtcgtggagaccttagagcagatgcagcgcaagcacggcgggatgctcgtgcggaaccccctgagccgcaatagcacccacgagatgtactgggtctcctgcgggaccggcaacatcgtgtccgctgtgaacatgacctcccggatgctcctgaaccgcttcacgatggcccaccgcaagccgacctacgagcgagacgtcgatctgggggccggcacccgccacgtggccgtagagccggaagtcgcgaacctcgacataatcggccagcggatcgagaacatcaagcacgaacacaagagcacctggcactacgacgaggacaacccctacaaaacgtgggcctaccacggaagttacgaagtgaaaccctcgggcagcgcatccagcatggtcaacggggtggtgaagctgctgaccaagccgtgggacgtaatccccatggtgactcagattgccatgacagacacgacccccttcggtcagcagcgtgtattcaaggagaaggtcgacacccggaccccgaaggccaagcgcgggacggcgcagatcatggaggtgacggccaagtggctatggggcttcctatctagaaacaagaaaccgcgcatctgcacgcgagaagagtttacccgtaaggtgcggagcaacgccgcaatcggcgcggtcttcgtggatgagaaccagtggaactctgcgaaggaggccgtggaggacgagcgcttctgggacctggtccaccgggagcgcgagctccacaagcaggggaagtgcgccacgtgcgtgtacaacatgatgggcaagcgtgaaaagaaacttggggagttcggcaaggcgaaggggagccgtgcgatctggtacatgtggctgggcgcacggttcctagagttcgaggccctaggcttcatgaacgaagaccattggttctcccgcgagaactccctgtccggggtggagggtgaggggctacacaagttgggctacatcctgcgggatatcagcaagatccccgggggcaacatgtacgccgacgacaccgccgggtgggatacccgcatcaccgaagatgacttgcaaaacgaggcgaagatcacggatatcatggaacctgagcacgccctgctggccaagtccatcttcaagctcacctaccagaacaaggtcgtgagggtgcagcgcccggccaagaacggaaccgtcatggacgtgatcagcagacgagaccagcgcgggtccggccaggttggcacctacggcctaaataccttcaccaatatggaagcccagctgatccgacagatggagagtgaggggatcttctcccccagcgaactcgagaccccgaatcttgccggacgcgtcctggactggctcgagaaacacggggtggagcggcttaaacgcatggccatctccggcgacgactgcgtggtgaaaccgatcgacgaccggttcgccactgccttgacggccctcaatgacatggggaaggtgcgcaaggacgtgccgcagtgggagcccagcaagggctggaatgactggcaacaggtgcccttctgcagccatcacttccatcagctgatcatgaaggacggccgggagatcgtggtgccttgccgcaatcaggacgagctggtaggtcgggcgagagtgtcacagggcgcggggtggagcctcagagagaccgcgtgcctggggaagtcctacgcccagatgtggcagctgatgtacttccatcgacgggacctccgcctggcggccaacgccatctgcagcgccgtaccggtcgactgggtcccaacctcccggaccacgtggagcatccacgcccaccatcagtggatgaccacggaggacatgctgtccgtctggaatcgcgtctggatcgaggaaaacccgtggatggaggacaagacccacataagctcttggggcgatgtaccctacctcggcaagcgggaggaccagtggtgcggcagcctgataggactgacggcgcgcgcgacgtgggccaccaacatccaagtggccatcaaccaggttcgccggctcattggcaacgagaattacctagactacatgaccagcatgaagcgcttcaagaacgagagcgacccggaaggcgccctgtggtga

SEQ ID NO: 24224 - RNA, 9879 nt, synthetic construct
  misc_feature 1..9879: note = derived and/or modified CDS sequence (opt11) from DENV-1__FJ410251__SS-prME
  source 1..9879: mol_type = other RNA
tcggtgaccatgcttctgatgctaatgcctactgcgctggctttccatcttaccaccaggggcggggagccccacatgatcgtgaccaaacaggagcggggcaagagcctcctgttcaagaccagcgccggggtgaacatgtgcaccctcattgccatggatttgggtgagctctgcgaggacaccatgacctacaagtgtccccggatcaccgaggccgagcccgatgacgtggactgctggtgcaacgccactgacacctgggtgacctacggtacctgcagccagacgggcgagcaccggcgcgataagcggagcgtggccctcgcaccccacgtggggctggggctggagaccagaaccgagacctggatgtccagcgagggtgcttggaaacagatacagcgcgtcgagacctgggccctccgccaccccgggttcaccgttatcgccctgtttttggctcacgccattggtacgtccatcacccagaagggaataatcttcatccttctgatgctggtaacgcccagcatggctatgcgatgtgtcggcatcggttcccgtgacttcgtcgaggggctcagcggcgcaacctgggtggatgtcgttctggagcacgggtcctgcgtgaccaccatggccaaggataagcctacgctggatatcgagttattgaagacggaggtcactaacccggcggtgttgcggaagctctgtatcgaggctaaaatcagtaacacaacgaccgactcccggtgccccacccagggcgaggcgaccttgatggaggagcaagacgccaacttcgtgtgccggcgcacgttcgtcgaccgaggctggggaaacggctgtgggctgttcggcaaagggagcctcattacctgtgctaagttcaagtgcgtgaccaagctggaggggaagattgtgcagtacgagaacctgaaatactccgtgatcgtgacggtacacaccggcgaccagcaccaagtcgggaacgagagcaccgagcacggcactactgcgacaatcacgccccaggctcccacttccgagatccagctgaccgactatggggccctcaccttagactgcagcccccgaacgggcctggacttcaacgagatggtcctactgactatgaaggagaagtcctggctcgtccataagcagtggttcctggacctgcccctgccttggacgagcggggccagcacgtcccaggagacgtggaatcggcaggacctgttggttaccttcaagaccgcccacgcgaagaaacaggaggtggtcgtcctcggcagccaggaaggcgccatgcacaccgccctgacgggggccacagagatacagacctccggcacgacgaccattttcgctggccacttaaagtgtcgcctcaagatggacaagctgaccctgaaaggcatgagctacgtgatgtgcaccgggtcattcaagctcgaaaaggaagtagcggagacgcagcacggcaccgtcctggtgcaaatcaagtacgagggcaccgacgccccctgcaagattcccttctcgacccaggacgagaagggggtcacgcagaatgggagactgatcactgcaaatccgatcgtcaccgacaaggagaagcccgtaaacatagaagccgagccgcccttcggggagtcctacatcgtcatcggcgcgggtgggaaagccctgaagctcagctggttcaagaaagggtccagcatcgggaaaatgttcgaggcgaccgcgcggggcgcccggagaatggcaatcctgggggatacggcctgggactttggctccgtgggcggggtattcacatcggttggcaagctggtgcaccagatctttgggaccgcctatggcgtcctgttctccggcgtgtcttggaccatgaagatcggcattggcgttctgctgacgtggctcgggctgaactcccgcagcacctccctgagcatgacctgcatcgccgtgggactcgtcaccctgtacctgggcgtgatggttcaggctgattccggctgcgtaatcaactggaaggggcgggaacttaaatgcggatccggcatcttcgtgacaaatgaagtgcatacctggaccgaacagtataaattccaggcggattctccaaagcggctgtccgccgcaatcgggaaagcatgggaggagggcgtatgcgggatccggagcgcgacccgtctggagaatataatgtggaaacagatctccaacgaactaaaccatatccttctggagaacgacatgaagttcaccgtggtcgtcggcgacgtcgtggggatcctcgctcaaggcaagaagatgatacggccgcaacctatggagcacaaatacagctggaagtcctggggcaaggccaagattatcggggccgatgtgcagaacacgaccttcatcatcgacggccccaatacaccggagtgtcccgacgaccagcgtgcctggaacatctgggaggtggaagactacggattcggtattttcaccacgaacatctggctgaagctgagggattcttacacccaggtttgcgaccaccgtctcatgtccgcggccatcaaagacagcaaggctgtccacgccgatatgggatattggatcgaatccgaaaagaacgagacttggaaacttgccagagcgagctttatagaggtgaagacctgcatctggcccaagtcccacacgctgtggtcaaacggcgtactcgagtcggagatgatcatccccaagatatatggcgggccgatcagccagcacaactatcgccccggatacttcacgcagaccgccgggccctggcacctgggcaagttagagcttgactttgacctttgcgagggtaccacggtcgttgtggacgagcactgcgggaaccgtggcccttcgctgaggaccaccaccgtcaccgggaagatcatccacgagtggtgctgtcggagctgcacattaccgcctctccgcttcaaaggcgaagacgggtgttggtatggcatggagatccggccggtgaaggagaaggaggagaaccttgtgaagtccatggtcagcgccggctcgggggaggtggactccttttctcttgggctgctgtgtatttccataatgatcgaggaggtgatgcgcagccggtggtcccgcaagatgctcatgaccggaaccctagccgtcttcctgctcctgatcatgggccaactgacctggaacgacctcattcgtctctgcatcatggtgggggcaaacgcttcggaccgcatgggcatgggaaccacctacctggccctcatggccacctttaagatgcgcccgatgttcgccgtgggtctcctgttccggagactgacgagtcgggaggttttgctactaaccatcgggctcagtctggtggcctccgtcgaactccctaactcgctggaggagctgggggatgggctggcgatgggtatcatgatcctgaagctcctcaccgacttccagagtcaccagttatgggccaccctgctcagcctgacgttcatcaaaaccactctttcccttcactacgcctggaagaccatggcaatggtgctgagcatcgtgagcctcttcccgctctgtctcagcaccaccagtcagaagaccacgtggctgccggtcctcttggggtccctgggctgtaagcctctcacgatgttcctaatcacagagaacaagatctggggacgtaagtcctggcctctgaacgagggcattatggcggtgggtgttgtctcaattctcctgagctccctgctcaagaacgacgtacccctggccggcccactgatcgcgggcggcatgctgatcgcctgttacgtgatcagcggctcctcggccgatttgtccctggagaaggcggccgaagttagctgggaggaagaagccgagcactcaggggccagccataacatccttgtcgaggtgcaggatgatggcaccatgaaaatcaaggatgaggagagagatgacaccctgaccatactcctcaaggccacgttactggccgtctccggcgtctacccgttaagcatccccgcaaccctgttcgtgtggtacttctggcagaagaagaagcaacgctccggcgtcctgtgggacaccccgagtccacccgaggtggaacgagccgtactagacgacggcatctacaggatcatgcaacgggggctcctcggacggtcgcaagtcggtgtgggcgtgttccaggaaaacgtcttccacaccatgtggcacgtgacgcgcggggccgtgctgatgtaccagggcaagcgcctggagccatcatgggccagcgtcaagaaagatttaatcagttatggagggggctggcggcttcaggggtcgtggaataccggcgaggaggtccaagtgatagcggtagagccgggaaagaacccgaagaatgtgcagaccgcccccggcaccttcaagacgcctgagggcgaggtaggggccatcgccctcgacttcaagcctggcacctccgggtccccaatagtcaaccgcgaaggaaagatcgtgggcctgtacggaaacggtgtggtcactaccagtggaacatatgtttccgcgatcgcgcaggccaaggcctcacaagaaggcccgttaccggagattgaagacgaagtgttccgtaagcgcaaccttacaattatggatctgcaccccggctctggcaagacgcgccgttacttgcccgccatcgtcagggaagccatcaagcgcaagctccggactctgatcttagcccctacccgcgtagtggccagcgagatggcggaggcactcaagggcatgcccattcgctaccaaactacagcagtcaagagcgaacacactgggaaggaaatagtggacttaatgtgccatgccacgtttaccatgcgactgctttccccggtgcgagtcccgaactacaacatgatcatcatggacgaggctcacttcaccgatcccagctcgatcgccgcccggggctacatcagcacccgcgttggaatgggtgaggcggcagctatcttcatgacggcaacaccgcccgggtccgtggaggctttcccgcaaagcaacgcggtaatccaagacgaggagcgggacatccccgagcgttcctggaactccggttacgagtggatcaccgactttcccggcaagactgtctggttcgttccctcgatcaaaagcgggaatgacatcgccaactgtctgagaaagaatggaaagcgcgtcatccagctgtcgcggaaaacgttcgacacagagtaccaaaagaccaagaacaacgactgggattacgtggtaaccacggatattagcgagatgggagccaacttccgcgccgacagagtaatcgatcctaggagatgcctcaagcctgtgatcctgaaggacgggccagagagagtcatcctagcggggcctatgccggtgaccgtggccagtgccgcccagcggcgcggtcggatcggccgcaaccataacaaagagggcgaccagtacatctacatgggccagcctctgaacaacgacgaggaccacgcccactggaccgaggctaaaatgttgcttgacaacattaacacaccagagggtataatccctgccctctttgagccggagcgggagaagagtgccgctatagatggcgagtaccgcctacgtggagaggcccggaagacgttcgtcgagttgatgcgccggggagacctccctgtctggctgtcgtataaagtggcgagcgaaggcttccagtacagcgaccggcggtggtgcttcgacggcgagcgcaacaatcaggtcctggaagagaatatggacgttgagatctggaccaaggagggcgagcgtaaaaagctacgtccgcggtggctggatgcccgcacttattcggacccactggccttacgggagtttaaggaatttgccgccgggcgccggagcgtgtccggcgaccttatccttgagataggcaagctcccccaacacctgacccagcgcgcacagaatgcccttgacaacctggtgatgctgcataattccgagcagggcggacgggcataccgccatgccatggaggagctgccagacacgatcgaaaccctcatgctgttggcgcttatcgctgtgcttaccgggggcgtgaccctgttcttcctatcagggcggggtctgggcaagacctccatcgggctgctctgcgtcatggctagctctgtcctgctgtggatggcctccgtggagcctcactggatagccgcgagcatcatcctcgagttcttcctgatggtcctgctcataccggagccggaccgccaacgtacgccccaagataaccagctggcctatgtggtgatcgggctcctattcatgatcttaacagtcgccgcgaatgagatgggcctgctcgagacgaccaagaaggacctgggcataggacacgtggccgtggagaaccaccatcatgcgacgatgttagacgtggacctccatcccgcctccgcgtggaccctgtatgccgtggccaccaccatcattacgccgatgatgcgccacaccatcgagaatacgacagcgaatataagcctgaccgctatcgccaaccaggccgccatcctcatggggctcgataagggctggccgatctccaaaatggacatcggcgtgccccttctcgcactgggctgctatagccaggtcaaccctctgacacttaccgccgccgtgctgatgctggtggcccactatgcgattatcggaccgggactgcaggcaaaagccacccgcgaggctcagaagcgcacagccgcgggtatcatgaagaaccccacagtcgacggcatcgtggcaatagacctggaccccgtggtctacgacgctaagtttgagaagcagctgggccaaattatgctcctcatcctatgcaccagccagatcttactcatgcgcaccacgtgggccctgtgcgagtcaattaccctggcaaccggccccctgaccacgctatgggagggctcgccggggaagttttggaacaccaccatcgcggtcagcatggccaacatctttcgaggctcctacctcgccggcgccggcctcgccttttccctgatgaagagtctaggcgggggccgccgtggaactggggcgcagggggagacactgggtgagaagtggaaaagacaactgaaccagctgtccaagagcgagttcaacatctacaagagatccggtatcatggaagtggatcgatccgaggccaaggagggactcaagagaggggaaacgacccgccatgccgtcagccgggggactgccaagctgcgctggttcgtagagcggaacctagtcaagcccgaaggaaaggtcatagacctaggctgcgggcgcgggggctggtcgtactactgcgcgggcctgaagaaagtgacggaagtaaaggggtacacgaagggcggacccgggcacgaggagcccatcccgatggccacctacggctggaacctggtcaagctgcattccggaaaagatgtgttcttcactccgcccgaaaagtgcgacacgctgctctgtgatatcggcgagagttcccccaacccgaccatcgaagagggccggactctccgcgtgctcaagatggtggagccctggttgcggggcaatcagttctgtataaaaatcttgaatccatatatgccctcagtcgtggagacgctagagcagatgcagcgtaaacatggcgggatgctggtccggaaccccttatcccgcaacagcacccatgagatgtattgggtctcatgcggcacgggtaacatcgtgagcgccgtcaacatgacctcacggatgctcctcaatcgctttaccatggcccatcgcaagcccacctatgaacgcgacgtagacctaggcgctggaacgagacacgtggcggtcgagcccgaagtggccaacctcgacatcatcgggcagcggatcgagaacattaaacacgagcataagagcacctggcattacgatgaggacaacccgtacaaaacatgggcctaccacggctcgtatgaggtcaagccaagcggttccgcaagcagtatggtgaacggcgtcgtcaagttacttaccaagccctgggacgtgatccccatggtgacgcagattgccatgaccgacaccacccctttcgggcaacagcgcgtgttcaaagaaaaggtggacacacggaccccgaaggcgaagcggggcaccgctcaaatcatggaggtaaccgcccggtggctgtggggctttctgtcccgcaataaaaagccccggatctgcactagagaagagttcacccggaaggtccgctccaacgccgccatcggggcggtgttcgtggacgaaaaccaatggaactccgccaaggaggccgtcgaggacgagcgattctgggacttagtccaaaaagagcgcgaacttcacaaacagggcaagtgtgcgacctgcgtgtacaacatgatggggaagcgggagaagaagctgggcgagttcgggaaggccaagggcagcagggcaatatggtacatgtggctaggcgcccggttcctcgagttcgaggccctggggttcatgaacgaggatcactggttctcccgcgagaactccctctcgggcgtcgagggcgaaggcttgcataaactggggtacatcctccgggatataagcaagataccgggcggcaacatgtacgcggacgataccgcggggtgggacacgcgtatcactgaggacgacctgcaaaacgaagccaagattaccgatataatggaaccggagcacgcacttctcgccacgtcaatcttcaagctgacctaccaaaacaaggtggtgcgggtccagaggcccgcaaagaacggcaccgtgatggacgtgatcagccgccgggaccagcggggaagcggccaggtcggcacctacgggctgaacaccttcaccaacatggaggcgcagctcattaggcagatggagagcgagggtatcttccttccctccgaactggagaccccgaacctcgccgagcgcgtgctggactggctggagaagtacggggtggagcgcttaaagcgcatggccataagcggcgacgactgcgtcgtgaagccgatcgacgatcggttcgccacggcactgaccgcgctgaatgatatggggaaggtgcgtaaggatatcccccagtgggagccctccaagggctggaacgactggcagcaggtccccttctgcagtcatcactttcaccagctcattatgaaagacggccgggagatcgtcgttccatgccgcaaccaggacgagctggtcgggcgagcgcgcgtttcccagggcgcagggtggtccttgcgtgagacggcctgcctgggaaagtcctatgcccagatgtggcagctgatgtacttccaccgccgggaccttagactcgcggccaacgccatatgcagtgccgtgccggtcgattgggtgcctacctcacgcaccacctggtccatccacgcacaccaccaatggatgacgaccgaagacatgttgtcagtgtggaaccgcgtctggatcgaggaaaacccctggatggaggacaagacgcatgtatccagctggggcgacgtcccgtacttggggaaacgggaggaccagtggtgcggctccctgatcgggctgacagcccgcgcgacttgggcctctaacatccaggttgccatcaatcaggtgcgccgattgatcggtaatgagaactacctcgactacatgacctccatgaagcgcttcaagaacgagggggaccccgagggcgcgctgtggtag

SEQ ID NO: 24225 - RNA, 9879 nt, synthetic construct
  misc_feature 1..9879: note = derived and/or modified CDS sequence (opt11) from DENV-1__FJ410252__SS-prME
  source 1..9879: mol_type = other RNA
tcagtaacaatgctgctgatgctgatgcctaccgctctggcctttcacctcaccactcggggaggggaaccccacatgattgtgtccaagcaggaacggggcaagtctctgctgttcaaaacctccgccggggttaacatgtgcacccttatagccatggacctcggcgagttctgcgaagacaccatgacctacaagtgccctcgcatcacggaggccgagcctgatgacgtggactgctggtgtaacgccaccgatacctgggtcacctacgggacctgtagccagaccggtgagcataggcgggacaaacggtcagtggctctggctccccacgtgggccttgggttggagacgcgcactgagacttggatgtcgtccgagggggcctggaagcagatccagcgagtggagacctgggcacttcgccacccgggcttcactgtgatcgcgctctttctggcgcacgccatcgggacaagcatcacccaaaaggggataatcttcatcctcctgatgctggttacaccttccatggccatgcgctgcgtcggcatcggcagccgcgacttcgtcgaggggctgtccggtgccacttgggtggacgtcgtgctcgagcatggaagctgtgtgaccaccatggccaaggacaagcccacgctcgacatcgagttactcaagaccgaggtcaccaaccccgcggtgctgcggaagctgtgcatcgaggccaaaatcagtaacaccaccacagacagccgctgcccgacgcagggcgaagcaacccttgtggaggagcaggatgccaatttcgtctgccgccgtaccctagttgatcgaggctgggggaatggctgcgggctgttcggcaaagggtccctaatcacgtgcgctaaatttaaatgcgtaaccaagttggagggcaagatcgtccagtacgagaacctgaagtacagcgtgatcgtgaccgtccacaccggggaccagcaccaagtgggtaacgagtccacggagcatggcactaccgcgactatcacgccacaggcccccagcaccgagatccagctcaccgactacggggccctgacgctagactgcagcccccggaccggcctcgacttcaatgagatggtcctgctcacgatgaaggagaaatcctggttagtgcacaagcagtggttcctcgacctgccgctcccctggactagcggggcctccacatcgcaggagacctggaaccgccaagacctgctggttacattcaaaacagcgcacgcaaagaagcaggaggtcgtggttctcggctcccaggagggcgcaatgcacactgctttaaccggggccacggagatccaaacttctggtaccaccacgatcttcgccgggcacctaaagtgtcgccttaagatggataagttgacattgaagggcatgtcctacgttatgtgcaccgggagcttcaagctcgaaaaggaagtggccgagactcagcacggcactgttctagtccaaatcaaatatgagggtaccgatgccccttgcaagattcccttcctgacccaggacgagaaaggcgttactcagaacggacggctgatcacggccaatccgatcgtgaccgacaaggagaagcccgtcaacattgaggccgagccgcccttcggcgaatcgtacatcgtgattggcgcgggcgagaaggccctcaagctgagctggttcaaaaagggttcaagcatcggcaagatgtttgaggccaccgctcgcggagctcgaaggatggcgatcctgggggacaccgcctgggacttcgggtccatcggcggggtgtttacgagcgtcgggaagctcgtccatcagatcttcggaaccgcctacggggtattgttctccggcgttagctggaccatgaaaatcgggatcggcgtgcttctcacctggctggggctgaactcccgctcgacctcgctcagcatgacctgcatagcggtagggctggtcaccttgtacctcggcgtgatggtgcaggccgactcagggtgcgtaatcaactggaaaggccgggagctgaagtgcgggagcggcatattcgtaaccaacgaagtccacacgtggaccgaacaatacaagttccaggcggactccccgaaacgcctgtccgccgccatcgggaaagcctgggaggaaggtgtctgcgggatacgtagcgcaacccgacttgagaatatcatgtggaaacagatctccaacgaactgaaccacatcctgctagagaatgacatgaagttcacggtggtcgtcggtgacgtggctggcatcctggcccaggggaagaagatgatccggccccagccaatggagtacaaatacagctggaaatcctggggaaaagccaagatcatcggcgccgacgtgcagaataccacgttcatcatagatggtcccaacaccccagagtgccccgacgaccagcgagcgtggaacatatgggaggtcgaggactacggcttcgggatcttcaccaccaatatatggctaaaactccgggacagctacacccaagtgtgcgactaccgccttatgtccgccgccatcaaggacagcaaggcggtgcacgccgacatgggctactggatcgaaagtgaaaagaacgagacctggaagttagctagggcgagcttcatagaagttaaaacctgcatctggcccaagtcccacaccctgtggagcaacggcgtgctagagtcagagatgatcattccaaagatctacgggggcccgatcagccaacacaactaccgccccgggtacttcacgcagaccgctggcccctggcatctggggaagctcgagttagacttcgacctgtgcgagggcacaaccgtggtcgtagacgagcattgcggaaaccgaggcccgtcgctccgcacgaccaccgtgacgggtaaaattatccacgagtggtgctgccgtagctgtactttgccgccgctgcgcttcaagggggaggacggctgctggtacgggatggagatacgtcccgtcaaggaaaaggaagagaacctcgtgaaatcgatggtgagcgcgggcagtggcgaggtggactccttcagtctgggcctgctctgcatctccatcatgatcgaggaggtaatgaggagccggtggtctagaaagatgctaatgaccggcaccttggccgtgttcttcctcttgatcatgggccagttaacttggaatgacctgatcagactgtgcataatggtcggcgccaatgcctccgatagaatggggatgggcacgacctatctggccctcatggccacctttaagatgagaccgatgttcgctgtgggacttcttttccggcgcctcacctcccgggaggtgctgctgttgactatcgggcttagcctggtggcgtccgtggagctccccaatagtctggaggagctgggcgacgggctagccatgggcatcatgatcctgaagctgctcaccgacttccagtctcatcagctgtgggccactctgctctccctcaccttcatcaagacgacattctccttacactacgcttggaagacgatggcgatggtcttatcgatcgtttccctgttcccactatgcctcagcaccacttcccagaagaccacctggttacccgtgcttctcggatcactggggtgcaagccgcttaccatgtttttgatagcggagaacaagatctggggccggaaatcgtggcccctgaacgagggtattatggcggtcggcatcgtaagcatcctgctcagctcccttctgaagaatgatgtgcccctcgcagggcccctgattgccggcggcatgttgattgcgtgctatgttataagcgggtctagcgcggacctctccctggaaaaggcggccgaggtgtcatgggaggaggaggcagaacactccggcgcctcccacaacatcctggtagaagtccaggacgacgggactatgaagatcaaggatgaggaaagagacgataccctcactatcctgcttaaggccaccctcctggccgtttctggagtgtatcctctcagcatccccgccaccctctttgtctggtacttctggcaaaagaagaagcagagatccggggtgctctgggacacgccctcgccgcccgaggtggagcgggccgttttagatgatgggatttaccgcataatgcagcggggtttattggggcgctcccaggtgggtgtgggagtcttccaagagaacgtgttccacacaatgtggcacgtcacgcggggcgcggtcttgatgtaccaaggcaagcgtctggagcccagctgggcgtccgttaagaaggacctcatcagttacggcggcgggtggcggctgcaggggtcctggaacactggggaagaggtgcaggtcatcgccgtggagcccggcaaaaatcccaagaacgtgcagacggcaccagggacgttcaaaacctcggagggcgaggtcggcgccatcgcactggatttcaagccagggacctccggcagccccatagtgaatcgcgagggaaagattgtgggcctctacggcaacggggtcgtgaccacaagcggcacctacgtgtccgccatagcccaagccaaagcgagccaggagggacccctgcctgagattgaggacgaggttttccggaagcgcaacctgaccatcatggacttgcaccccggctccgggaagacacggcgctacctgcccgccatagtgcgtgaagccatcaagcgcaagctccggaccctcatcctcgccccgacccgcgtggtggcctcagaaatggcggaggccttgaagggcatgcccatccgctaccagactacggccgtgaagtccgaacacactggcaaagagatcgtggacctaatgtgccatgccacctttaccatgcgcctgctgagccccgtcagagtgcccaactataatatgatcataatggacgaagcccatttcacggacccgtcaagtatcgcggctagagggtacatctccacccgtgtgggcatgggggaggccgccgccatctttatgaccgcgacgccacccgggagcgtcgaggcctttccccagtccaacgccgtgatccaggacgaggagcgggacatcccggagcgctcatggaactccgggtacgagtggatcactgactttcccggtaagaccgtctggttcgttccgtcgatcaagtccggcaacgacatcgccaattgccttcggaagaatgggaagcgcgtgatccaactgtcaaggaagaccttcgacacggagtatcagaagaccaagaataacgactgggactacgtggttaccaccgacatctctgagatgggggccaacttccgcgctgaccgggtgatcgacccgagaaggtgtcttaagccggtcatactcaaagacgggcccgagcgcgtcatcctggccggccctatgccagtaacggtagccagcgccgcccagcggcgcgggcggatcggccgtaaccacaacaaagagggcgatcagtacatctacatggggcagcctttgaacaacgacgaagaccatgcccactggacggaggccaagatgctcctggacaatatcaacacgcccgagggcattatcccagccctgtttgaacccgagcgggaaaagtccgccgcgatcgacggtgagtaccgattgaggggcgaggcccggaagaccttcgtggaactgatgagaaggggagacctgccagtctggctcagctacaaggtcgccagcgagggcttccagtactccgaccgccgatggtgtttcgacggcgaacgcaacaaccaggtgctcgaggagaacatggacgtagagatttggaccaaggagggtgagcggaagaagctgcggccacggtggctcgacgcgcgcacgtacagcgatcctctggccctgcgagagtttaaggagttcgctgccggtagacggtctgtcagcggcgatctcatcctcgaaattggtaagctgccccagcacctcacacaacgcgcacagaatgccctggataatctggtgatgttacacaactcggagcagggtgggcgtgcgtatcgccacgccatggaggagttaccggacacaatagaaacactgatgctacttgccctaattgcggttctcacgggtggggtcacactcttctttcttagcggacgggggctcggcaaaacctccatcggcttactctgcgtaatggcatcatccgtcttactgtggatggcaagcgtcgagcctcattggatcgccgcctctatcatcctggagttcttcttaatggtcttactcatccccgagccagaccgccagaggaccccgcaggataaccagctcgcatacgtggttatcgggctgttgttcatgattcttaccgtggcggccaacgagatgggcctgctggagaccaccaagaaggacctcggaataggccacgtcgccgtcgaaaaccaccaccatgccgccatgctggatgtggatcttcatcccgcgtcagcgtggacactctacgctgtggctacgactataatcacccctatgatgaggcacaccatcgagaataccacggccaacatctccttaaccgcgatcgcgaaccaggcggccatcctgatggggctggacaagggctggcccatcagcaagatggacatcggcgtccccctgctggccctcgggtgctactcccaggtgaaccccttgaccctgacagcggccgtgctaatgttagtcgcccactacgccatcatcggacccgggctgcaagccaaggcaacgcgcgaggcccagaagcgcacagctgctggcattatgaagaaccccaccgtggacgggatcgtggccatcgacttggatccagtcgtgtatgacgcgaagttcgaaaagcagttaggccagatcatgctacttattctgtgcacctcccagattctgctcatgcgaacgacctgggccctgtgcgagagtatcaccttagctacggggcccctcacgaccctctgggaggggagccccggcaagttctggaacaccaccatagccgtgagtatggcaaacatcttcagagggtcttacctcgcgggtgccggcctcgcgttctccctgatgaagtccctcgggggcgggcgacgggggacgggagcccaaggggagaccctcggcgagaagtggaaaagacaactgaatcagctgtctaagagtgagttcaacacctataaacgaagcggaatcatggaggtcgacagatccgaggcgaaggaaggcttaaagcgcggcgagaccacgaagcacgcagtgagccgcggcacggcaaagttgcggtggtttgtggagcgcaatctggtgaagccggaggggaaggtaatcgacctaggctgcggccgcggcgggtggtcatattactgcgcggggctcaagaaagtgacggaagtcaaagggtacaccaagggtgggcctggacacgaagaaccgatccccatggccacgtacggctggaacctggtgaagctccacagcggaaaggacgtgtttttcatcccacccgagaagtgcgataccctcctgtgcgacatcggggagagcagccccaaccccacaatcgaggaagggcgcacactgcgggtcctcaaaatggtggagccatggctgagggggaatcagttctgcatcaaaatcctcaacccctacatgccctccgtcgtcgaaacgttagagcagatgcagcggaagcatggtggcatgctagtgcgtaatcccctgagccggaactccacccacgagatgtactgggtgagctgtgggactgggaacatagtctccgcggtgaacatgaccagccgcatgctactaaatagattcacaatggcccatcgcaagccaacgtacgagcgcgatgtggacctgggagccggcacacggcacgtggccgttgagcccgaggttgcgaacctggacatcatcggccaacgcatcgagaacatcaagcacgaacacaaatctacctggcactatgacgaggacaacccctacaagacctgggcgtaccacgggagctacgaggttaaaccctccggttcagcctcctccatggtgaatggggtcgtgaagctgcttacgaagccgtgggacgtgattcctatggtcactcaaatagccatgacggacactacgccgttcggccagcagcgagtgttcaaggagaaagtcgacactcgcacccccaaggccaaacgggggaccgcccagatcatggaggtcacggcgaagtggctctggggctttcttagtcgaaataagaagccgcggatctgtacacgagaggagttcacacggaaggtacgctccaacgccgccatcggggccgtcttcgtcgacgagaaccagtggaacagcgcgaaggaggccgtggaagacgagcggttctgggatctggttcacagggaacgggaactccataaacaggggaagtgcgcgacctgcgtctacaacatgatggggaagcgggaaaagaagctgggggagttcggcaaggctaagggatcccgggccatctggtacatgtggttgggcgcgaggttcctagagtttgaggccctgggcttcatgaacgaggaccattggttctcgcgggagaactccctctctggggtggagggcgagggactccacaagctgggctacatcttacgggacatctccaagatccccgggggcaatatgtacgccgacgacacggcgggctgggacacccgaatcaccgaggacgatcttcagaacgaagccaagatcaccgacattatggaaccagagcatgcgctgctggccaagagcatcttcaagctcacgtaccagaacaaggtggtccgcgtgcagcgcccggccaagaatgggaccgttatggacgtaatcagtcgccgagaccaacggggctcgggccaggtgggcacctacgggctgaacaccttcacgaacatggaggcacagctgatccgccagatggagtccgaggggatattcagtccgagtgagctcgagaccccaaaccttgcgggccgggtgctggactggctcgagaagcacggggttgagaggctgaagcggatggccatctctggtgacgactgtgtcgtcaagcccatcgatgaccgcttcgcaaccgccttgaccgcattgaacgacatgggtaaggtccggaaggatatcccacagtgggagccctccaaaggctggaacgactggcagcaggtacccttttgcagccaccatttccaccagctgatcatgaaggacggtcgggagatcgtggtcccttgcagaaaccaggacgagctggtagggagggcgcgggtctctcaaggcgcaggctggtccctccgcgagaccgcctgccttggcaagtcctacgcgcaaatgtggcagctgatgtacttccaccggagggacctccgcctcgccgcgaacgccatctgttccgccgttccggtggactgggtgcccaccagcaggaccacctggtcgatccacgcacaccaccaatggatgactacggaggatatgttaagcgtctggaaccgggtgtggatagaagagaatccctggatggaagacaaaacccacatctctagctggggagacgtgccctacctcgggaaacgggaagaccagtggtgcggttctctgataggtcttactgcacgcgcaacgtgggccaccaacattcaagtcgctataaaccaagtacgccgcctcatcggtaatgagaactatctggactacatgacgagcatgaagcggtttaagaacgaatccgacccggaaggagcactgtggtga

SEQ ID NO: 24226 - RNA, 9879 nt, synthetic construct
  misc_feature 1..9879: note = derived and/or modified CDS sequence (opt11) from DENV-1__FJ461331__SS-prME
  source 1..9879: mol_type = other RNA
tctgtcaccatgctgctcatgctgatgcctactgccctggcattccacctcaccaccagggggggggagccccatatgattgtgagcaagcaagagcggggtaagtctctgctgtttaagactagcgccggggtgaacatgtgcactctaatcgcgatggacttgggggagttatgtgaggacacgatgacatacaagtgtccgcgtattactgaggcggagcccgacgacgtggactgctggtgcaacgccaccgatacgtgggtgacctatgggacctgctcccaaaccggcgaacatcggcgcgacaaacggtccgtggccctcgctccccacgtgggactggggctggagacgcgtaccgaaacatggatgtcaagcgaaggcgcctggaaacagatccagcgagtcgagacctgggcgttacggcaccctgggtttacggtcatcgccctatttctggcgcacgcaataggcacaagtatcacccagaaggggataatattcattctcctgatgctggtgacaccctcaatggcgatgagatgcgtcggtatcggctccagggattttgttgaggggctctcaggtgccacgtgggtggatgtcgtgctggaacatgggagctgtgtgacgactatggccaaagataaacccaccctggacatcgagctcctgaagacggaggtgacaaacccagcggtgctgcggaaactgtgtatcgaagccaagatatcaaatacaacaacggatagccgttgcccgacacagggtgaggccacccttgtggaggagcaggacgcaaacttcgtctgccgtcgcacctttgtggaccggggttgggggaacggctgcggtctgttcggcaaggggtcgcttatcacgtgcgccaagtttaagtgcgttaccaagctggaggggaaaattgtgcagtacgagaacctgaaatacagcgtaatagtgaccgttcacaccggcgaccagcatcaggtggggaacgagtcgacggagcatgggaccacggcgaccatcaccccgcaggcaccaacgacggagatacaactcactgactatggggccctgaccctggactgcagcccccgaacgggtctcgacttcaatgagatggtcctgttaaccatgaaagagaagtcctggcttgtgcacaagcagtggttcctcgacctgcccctgccctggacgagcggggcctcaacgtcccaggagacatggaatcggcaagacctcttggttacattcaagaccgcgcatgcgaagaagcaagaggtcgttgtgctgggtagccaggagggcgcaatgcatactgctctcacgggggccaccgaaatccagacctccggaaccacgacgatcttcgccgggcaccttaagtgccgcctgaagatggataagttgaccctgaagggcatgtcgtacgtcatgtgcaccgggtcctttaagctagagaaggaggtggcagagacgcagcacggcaccgtgctggtccaaatcaagtacgagggtaccgatgccccctgcaagatccccttctcgacacaggacgagaagggggtgacccaaaatggccggctcatcaccgccaacccgattgttaccgacaaggaaaagcccgtgaatatagaggctgaaccccccttcggggagagttacatcgtgattggagcgggagagaaggcacttaaactcagctggttcaagaaaggcagcagcatcgggaaaatgttcgaggctaccgcccggggtgcccggcggatggcgattttgggcgacaccgcttgggacttcgggtccatcggcggtgtgttcacgagcgtcgggaagctaatccaccagatctttggcaccgcctacggggttctcttctccggggtgagttggaccatgaaaatcggtatcggcgtcctgttgacatggttaggcctgaactcccgcagcacgtccttgagcatgacatgcatagccgtaggacttgttaccttgtacctcggagtcatggtccaggctgactccgggtgcgtgataaactggaaggggcgggagctcaagtgcgggagcggcattttcgtgactaacgaggtgcatacctggactgagcagtataagttccaggcggacagcccgaagcgtctgtcggctgcgatcgggaaggcgtgggaggaaggggtgtgcggcatcaggagtgccaccaggctcgagaatattatgtggaagcagatctcgaacgaactgaaccatatcctcctggaaaacgacatgaagctcactgtggtggttggcgacgtcgccggcatcctgggtcaaggcaaaaagatgatacgtccccagcccatggagtacaagtacagctggaagtcctggggcaaggccaagatcatcggagccgatgcccagaataccacatttatcatcgacggccccaacaccccggagtgccccgatgaccagcgcgcgtggaacatatgggaggtggaggactacgggttcggtattttcacaactaacatatggctgaagttacgggacagctacacgcaggtgtgcgaccacaggcttatgtccgcagccataaaggatagcaaggcagtacacgcggacatgggctactggatcgagtccgagaagaacgagacctggaaattggcgcgcgcctccttcatagaggtgaagacctgcatctggccgaagtcccatacgctctggagcaatggggtgctggagtccgagatgatcatccccaagatctacggaggtcccatcagccagcataactaccgccccggctactttacccaaaccgccggcccctggcacctgggcaagttagagctggacttcgacctgtgcgagggaacgaccgtagtagtggacgagcactgcggaaaccgcggcccgtccctccgcacaaccaccgtcacggggaagatcattcacgagtggtgttgccggagttgcacgctgccgcccttacgcttccgcggtgaggacggatgctggtacggtatggagatacgacccgtgaaggagaaggaggagaacctcgtgaaatctatggtgagcgcgggctctggagaggtggacagtttctcgctcggcctcctctgcatctcgatcatgatcgaggaggtcatgcgcagccgctggtcacgaaagatgctgatgacggggaccctggcagtctttttcctcctaatcatgggtcagctgacgtggaacgacctcatacgcctgtgtatcatggtgggggcaaacgcattcgaccgcatgggcatgggcacaacttacctggcccttatggcaacattcaagatgaggccgatgttcgcagttgggttgctgttccgcagactaacgagcagagaggttctgttgctcactattggcctgtccctggtggctagcgtggaactcccaaactccttagaggagctgggggacggtctcgccatgggcattatgatcctcaagctgctcacggacttccagtcgcaccaattatgggccacgctgctctccttaacgttcatcaagaccaccttcagcctacactacgcgtggaagactatggctatggtcctgtccattgtatccttattccccctgtgcctctcaacgaccagccagaagaccacctggctgccggtcctgctcgggtccttaggctgcaaaccgcttacgatgttcctgattgcagagaacaaaatctggggtcggaaatcctggcccctgaacgagggcatcatggcggtgggaatcgtgtccatcctgctcagcagccttttgaaaaacgacgtcccgttagccgggcccttaatcgccggcgggatgctcatcgcatgctacgtgatctctggcagttctgcggacctgagcctggagaaagccgcggaagtgtcctgggaagaggaggccgaacacagcggggcgtctcacaacatactggttgaggttcaggacgacggcactatgaagattaaggatgaagagagggatgacaccctcacgatactgctgaaggccactctgctggccgtaagcggggtctacccgctgtcaatccccgccaccctcttcgtgtggtacttctggcagaaaaagaagcaacggtcgggcgtactttgggacacgccatcgccccccgtcgtggaaagggccgtgctggacgacgggatataccgtatcatgcagcgcgggctcctcggccgtagtcaggtcggggtgggggtgttccaggagaacgtcttccacaccatgtggcacgttacacggggagcagtcctgatgtaccagggcaagcggctggagcccagttgggccagcgtcaagaaggacctcatctcctacggtggcggctggcgcctgcggggcagctggaacactggagaagaagtacaggtgatcgccgtcgagccgggtaaaaatcccaaaaacgtgcagaccgccccaggtacctttaaaacgcccgagggcgaggtgggggccatcgcgctagacttcaagcccgggacaagcgggtcccccatcgtcaatcgagaggggaaaattgttggcctctacgggaacggggtggtcaccacgtccgggacctacgtaagcgcaatcgcccaggccaaggcgagtcaggaaggcccgctacccgagatcgaagacgaggtatttcggaaacgtaacctgactatcatggacctacaccccgggtccggcaagacgagacgctacctgcccgctattgtccgggaagcgatcaagcgcaagctgcgcacgctaatactggctccgacccgggtggtggccagcgagatggcggaggctttaaagggcatgcctatccgataccaaacgaccgccgtcaagtctgagcacactggtaaggagatcgtggacctcatgtgccacgctacattcacgatgcgcctactgagccccgtgcgagtcccaaactacaacatgatcatcatggatgaggcccacttcacagacccatcctctatcgcggcgcgggggtacatctccacccgcgtggggatgggtgaagccgcggccatcttcatgaccgcgacgccgcccggtagcgtggaagcttttccgcaatccaacgccgtcatccaagacgaagagcgggatatcccggagcgctcgtggaactccggacacgaatggatcaccgatttccccggcaaaaccgtgtggttcgtgcccagcattaaatccgggaacgatatcgccaactgtttgcggaaaaacggcaaacgcgtcatacagttatcaagaaagaccttcgatacggagtatcagaagaccaagaataacgactgggattacgtggttaccaccgacatcagcgagatgggggcgaatttccgtgcggacagggtcatagacccgcggcgttgcctcaaacccgtcatactcaaggacggcccggagcgtgtgatactggccgggccaatgcccgtcactgtggccagcgccgcacagaggcggggcaggatcgggagaaaccacaataaagagggggaccagtacatctacatgggccagcccctaaacaacgatgaggaccacgcgcactggaccgaggccaagatgttactggacaacataaatacccccgaggggataatcccagcacttttcgaaccggagcgcgagaaaagtgccgcggtggacggtgagtaccgactccgcggggaggctcgcaagacgtttgtggagctcatgcggcgtggagacctgcccgtgtggctcagttacaaggtagcttcagagggattccagtacagcgatcgccggtggtgcttcgacggggagcgcaacaatcaggtgctcgaagaaaacatggacgtggaaatctggacgaaagagggcgagcggaagaagctgcgcccccggtggctcgacgcccgaacgtactctgaccccctggccctgcgggagtttaaggagttcgcggccggtcgccggtccgttagcggagacctcattctggagataggtaagcttccgcagcaccttacccaacgagcccagaatgccctggacaacttggtgatgcttcacaactcagagcagggcgggcgtgcctatcgccacgccatggaagagcttccagacaccatcgaaacgctgatgctactggccctaatagccgtgttaactgggggagttaccctgttcttcctcagcggtcgaggactgggcaagacctctatcggtctgctctgcgtaatggctagctccgtgctgctgtggatggcgagcgtcgagccgcactggatcgccgcctccatcatcctggaattctttctcatggtattgctgatacccgagccggaccgccagcggacgccccaagacaaccagctggcctatgtggtgatcgggctgctctttatgatcctcactgttgcagccaacgaaatgggtctgttggagacaaccaagaaggacctcggcataggacacgtggcggtcgagaaccaccaccatgcggccatgctggacgttgacctgcaccctgccagcgcgtggaccctctatgcggtggcaaccacaatcatcactccgatgatgcgccataccatcgagaacacgacggccaacatctccctcaccgccatagcgaaccaggccgccatcttaatgggcctcgacaagggctggcccataagtaaaatggatataggggtacccctcctagccctcggctgctatagtcaggtgaaccccctgaccctgacggcggctgttcttatgctggtcgcccattatgctatcatagggccgggcttacaagcgaaggcgacgcgcgaggcccagaagcggaccgccgccgggatcatgaaaaacccaaccgttgatgggatcgtggccatcgacctcgacccggttgtgtacgacgcgaagttcgaaaagcagctgggccagataatgctgctgattctgtgcacgagccagatcctgttaatgcgcacaacctgggccctttgtgagagtatcactttagcaacgggtccgctcactaccttgtgggaggggtccccggggaaattctggaacaccacgatcgctgtgtccatggccaacatcttccgtggctcgtatctggcgggtgccggcctcgcattctccctgatgaaatcactgggagggggaagacgggggacaggagcccagggcgaaactttaggggagaagtggaagcgccagctgaaccagctctcaaagagcgagtttaacacatataaaagatcgggaatcatggaagtcgacaggagcgaggcgaaggaggggctcaagcggggagagacgacaaagcacgcagtgagccgcggcaccgcaaagcttcgttggttcgttgagcgcaacctggtaaagcccgaaggcaaagttatagatttaggctgcgggcgaggcggttggagctactactgtgccggcttgaagaaggtgacagaggtaaaaggctacacgaagggggggcccggtcacgaggagcccatcccgatggctacctacggctggaaccttgttaagctgcacagcgggaaagacgtatttttcatcccgcccgaaaagtgcgacactttgctgtgcgacataggtgagtccagtcctaacccgactatcgaagaaggacgcacactgcgggtactcaaaatggttgagccgtggctgcgcggcaatcaattctgcatcaagatcctgaacccctatatgccttccgtcgttgagaccctcgagcagatgcagcggaagcacggggggatgctggttcggaacccgttaagccgcaacagcacgcacgagatgtactgggtgagctgcggtacggggaacatcgtctctgcggtgaatatgacctcacgcatgcttcttaaccgctttaccatggcacatcgaaagcccacctatgaacgcgacgtggacctgggcacaggaacgcggcacgttgccgtggaaccggaggtcgccaacctagacataatcggccagagaatcgagaacatcaagcacgagcacaagagtacatggcactatgacgaagacaacccgtacaagacttgggcctatcacgggagctacgaagtcaagccctccggaagtgcgagttccatggtcaacggcgtcgtcaaattgctcactaaaccctgggacgtgatccccatggttacccagatcgccatgacggacacaacccccttcgggcagcaacgggtctttaaggaaaaggtcgacaccaggacgccgaaggccaagaggggcacagcccaaatcatggaggtcactgcccgctggctgtggggcttcctgagccggaacaagaaaccccgcatctgtacccgggaggagttcacaagaaaggtgcggtccaacgctgccatcggcgccgtgttcgtcgatgaaaaccagtggaacagcgccaaagaggcggtggaagatgagcgattctgggatctggtgcaccgggagcgcgagctacacaaacagggaaaatgcgcgacctgcgtatacaacatgatgggtaaacgtgagaagaaactgggtgaattcgggaaggccaagggctccagagcgatctggtatatgtggctgggcgcgcggttccttgagttcgaggcgttagggttcatgaatgaagatcactggtttagccgcgaaaactctttaagcggcgttgaaggggagggactccacaagctgggttacatcttgagggacatctcgaagatccccgggggcaatatgtacgccgacgataccgccgggtgggacaccaggatcacagaggacgatctccagaacgaggccaagataaccgacatcatggagcccgagcatgcattactggctaaggccatcttcaagctcacttaccagaacaaggtggtgcgcgtgcaacgtccggccaagaacggcaccgtgatggatgttatcagcagacgggatcaacgcgggtcgggccaggtaggcacatacgggttaaacaccttcaccaatatggaggcccagctgattcggcagatggagagtgaaggaattttctcacccagcgagttagagactcccaatctggccgaacgagcattagactggctcgaaaagtacggggtagagaggctgaagaggatggccatttccggcgacgattgcgtcgtgaaacccatcgacgatcgcttcgccacagccctaaccgccttgaacgacatgggaaaggtccgcaaggatatcccccagtgggagccaagcaagggctggaacgactggcagcaggtaccattttgctcccatcatttccatcagctgataatgaaggacggccgcgagatcgtggtgccgtgccgcaaccaagacgagctagttgggcgtgcgcgagtgtctcagggcgcggggtggtccctccgcgagactgcctgtctggggaagagctacgcccagatgtggcagctgatgtacttccaccgcagggacctaagactagcagccaacgccatctgtagcgccgttcccgtagattgggtgcccacctccaggacgacctggtctattcatgctcaccaccagtggatgaccaccgaggacatgctgtccgtctggaaccgtgtctggatcgaggagaatccctggatggaggacaagacgcacataagctcctgggaggacgtgccgtacctaggtaagcgcgaggatcaatggtgcggcagcttaatcggtctaaccgcgcgggcaacctgggccaccaatatacaagtggccatcaaccaagtcaggcggctcatcgggaacgagaactacctggactacatgacgtccatgaaacgctttaagaatgagagcgatcccgagggcgccctgtggtag

SEQ ID NO: 24227 - RNA, 9879 nt, synthetic construct
  misc_feature 1..9879: note = derived and/or modified CDS sequence (opt11) from DENV-1__FJ410256__SS-prME
  source 1..9879: mol_type = other RNA
tctgtgaccatgctgctcatgctgatgcccaccgccctggccttccacctcaccacgcggggcggggagccccacatgatcgtgagcaagcaggagcggggcaaaagcctactgttcaagactagcgcgggggtgaacatgtgtaccctaatcgccatggacctgggagagttttgcgaggacaccatgacctacaaatgcccccggatcaccgaagcggaacccgatgacgtggactgctggtgcaacgccaccgacacatgggtgacatacggcacatgttcgcagaccggggagcaccgccgcgataagcggagcgttgccctggcgccccacgtgggcctgggactggagacgcgcaccgagacctggatgagctccgagggcgcctggaaacagattcagaaggtcgagacgtgggcactgagacaccccgggttcacggtgatagccctcttcttggcacatgctataggtacctcaatcacacagaaagggattattttcatcctgctcatgttggtgactccctccatggcgatgcgctgcgtcggcatcggttcccgggacttcgtggaagggctgtccggcgccacgtgggtagacgtcgttctcgagcacgggtcgtgcgtgacgactatggccaaggacaagcccacgctcgacatcgagctgctcaaaactgaagttaccaaccccgcggtactgcgcaagctgtgcatcgaggccaaaatctcaaataccaccactgacagccggtgtcccacccaaggcgaggccacactcgtggaagagcaggacaccaacttcgtctgccgccggacgttcgttgatcgcggctggggtaacggctgcgggttatttggcaaggggtccctgatcacgtgcgccaagttcaagtgcgtgaccaagctcgaaggcaagatcgtccaatacgagaacctgaagtatagcgttatcgtgactgtccacacgggcgaccagcaccaggtgggtaacgagtcgacggaacatgggaccaccgccaccattactccgcaggcaccctctaccgagatccagttgaccgactacggggccctcaccctggactgcagcccccggaccggcctggatttcaacgagatggtactcctgaccatgaaggagaagtcctggctcgtccacaagcaatggttcctcgatcttccgctaccctggaccagcggcgcgtccactagccaggagacgtggaaccgcaaggacctcctggtgacattcaaaaccgcccatgcgaagaagcaggaagtcgtggtgctcggctcccaggaaggcgcgatgcacactgcgttgacgggcgccactgagatccagaccagcggtacaactacgatcttcgccgggcacttaaagtgccggctgaagatggacaagctcacgctgaaggggatgtcctacgtcatgtgcaccggaagcttcaagctggagaaggaggtggccgaaacgcagcatggcaccgttctcgttcagatcaaatacgagggcaccgacgcgccctgcaaaatcccattctccacacaggatgagaaaggcgtgacgcagaacggcaggctgatcacggctaacccgattgtcacagataaagagaagcccgtgaatatcgaggctgagccccccttcggggagagctacatcgtgatcggcgcaggcgagaaggcgctgaagctgtcctggttcaagaagggtagctccatcggcaagatgttcgaggccaccgcgcgcggagcccgccggatggccatcctcggcgacacggcgtgggacttcgggagcatcggcggcgtgttcacctcggtcgggaagctggtgcaccagatcttcggcacagcctacggggtgctgttctccggagtgtcctggaccatgaagatcgggatcggcgtactcctgacgtggctgggtctcaactcccgctccacaagcctgtccatgacctgcatcgccgtggggctggtcaccctctacctgggagtaatggtgcaggccgacagcgggtgtgtcattaactggaagggacgagagctgaagtgcgggagcggcatcttcgtcacgaacgaggtgcacacctggaccgagcagtacaagttccaggcagacagcccgaagcggctaagcgctgccataggaaaggcctgggaagagggagtctgcggaattaggagcaccacgcgtctggagaacatcatgtggaaacagatcagcaacgagctgaaccacatcctcctcgagaacgatatgaagttcacggtggtggtcggagatgtagctggcatcctggcccaggggaagaaaatgatccgaccccagcccatggaatacaagtattcctggaagtcgtggggcaaagcgaagatcatcggcgccgacgtgcagaatacaaccttcataattgacgggcctaataccccggagtgtcccgacgaccagcgggcctggaacatatgggaggtggaggactacggctttggaatcttcacaacgaacatctggcttaaactgcgcgactcctacacccaagtgtgtgaccaccgacttatgagcgccgcgatcaaggacagcaaggctgtgcacgccgacatgggctactggattgagagcgagaagaacgagacctggaagctcgctcgcgcctccttcatcgaggtcaagacatgtatctggcccaagagccacaccttatggtccaacggcgtgctggagagcgagatgatcatccccaagatctacggaggaccgatctcccagcataactaccgacccgggtatttcacccagaccgccggcccctggcacttggggaagctggagctagacttcgacttgtgcgagggcactaccgtggtcgtggacgagcactgcggaaaccgcgggccgagcttgcggaccaccaccgtgaccggcaagatcatccatgaatggtgctgtagatcctgcaccttaccgcccctccggttcaagggtgaggacggctgctggtatgggatggagatacgccccgtcaaggagaaggaggagaatctggtcaagtcaatggtgagtgccggctccggtgaggtagacagtttctccctaggtttgttatgcatctcaataatgattgaggaggtgatgagatcccgctggagccgcaagatgttaatgaccggcacgctggcggtgtttttcctgttgatcatgggtcagctcacttggaatgatctcattcgcctgtgtatcatggtcggcgcgaacgcctcggaccgcatggggatgggcaccacctacctcgcgctaatggccacgttcaagatgcgccccatgttcgccgtgggactactgttcagacgcctgaccagccgcgaggtgctgctcctgactattggactgtccctcgtcgccagtgtggagctgcccaactcgctcgaggagctcggcgacggactggccatgggaatcatgatactgaagctcctgacggacttccagtcgcaccagttgtgggcgacgctcttgagtctgaccttcatcaagaccaccttcagcctgcactacgcctggaagacgatggccatggtcctgtccatcgtgtcgctgttccccttgtgcctgtccaccaccagccagaagaccacgtggctacccgtgctcctaggctccctgggatgtaagccgctaacaatgttcctgatcgccgagaacaaaatatggggccgcaagagctggcccctgaacgaagggatcatggcagttggcatcgtgagcatcctcctgtcctcgctgctcaagaacgacgtgcctttagccgggcccttaatcgccggcggtatgctgattgcctgttatgtcatctccggtagcagtgctgatctcagcctggagaaggcggctgaagtctcctgggaggaagaggccgagcacagcggcgcctcccacaacatcctcgtggaggtccaggatgacgggaccatgaagataaaggatgaagagcgagacgacaccctgaccatccttctcaaggcgacgctgctggcggtgagtggagtgtacccgttatcgattcccgccactttatttgtctggtatttctggcaaaagaagaagcagcggagcggtgtcctctgggacacccccagtccacccgaggtggagcgcgcagtcctcgacgacggcatctaccggatcatgcaacgcggcctactggggcgaagccaggtgggcgtgggggtcttccaggagaacgtattccacaccatgtggcacgtgacgaggggcgccgtcctgatgtaccaaggtaagcggctcgagccgtcctgggccagcgtaaagaaagatctgatctcctacggcggtgggtggcgcctgcagggaagctggaacaccggcgaggaggtgcaggtcatcgcggtggagccaggcaagaaccccaagaatgtgcagaccgcccctgggacgttcaagacgtctgagggcgaggtcggtgccatcgcactcgacttcaagcccggtaccagcggcagccccatcgtgaaccgggaggggaagatcgtgggcctttatggaaacggggtcgtaacgaccagtggcacctacgttagcgccatcgcgcaagccaaagcctcccaggaagggcccctgccagagatagaagacgaggtctttcggaaaagaaacctcaccattatggacctccaccccggcagcgggaagaccaggcggtacctacctgccatcgttcgcgaggcgattaagcggaaactccgcactctgatcctggcgccgactcgggtggtcgcctccgagatggccgaggccctcaaaggcatgcccatcaggtaccagaccaccgcggtcaaaagcgagcacaccggcaaggagatcgtggacctgatgtgccacgcaactttcaccatgcgactgctatcccccgtccgtgtgcccaactacaacatgatcatcatggatgaggcccatttcaccgacccgtcgtccatagccgccagaggctacataagcacccgggtcggcatgggggaggcggccgctatctttatgacggccacgccgcccggctccgtcgaggcctttccccagtcaaacgcggttatccaggacgaagagcgcgacatcccggagcggtcctggaacagtgggtacgagtggatcaccgacttccccggtaagaccgtgtggttcgtcccctctatcaagtctggtaacgacatcgccaattgcctgaggaagaacgggaagcgggtgatacaactatcgcgaaagacgttcgacacggagtaccagaagacaaagaacaacgactgggactacgtggtcaccacggacatctctgagatgggggccaatttccgggccgaccgggtgatcgatccccggcgctgtctcaagccggtgattctgaaagacgggcccgagcgtgtcattctggcggggcctatgcccgtgactgtcgcttccgcagcgcagcgtcgggggcgcataggacggaatcacaacaaagagggggaccagtacatttacatggggcaaccgctcaacaacgacgaggaccatgcccattggacggaggcgaagatgctgcttgacaatataaacacccccgagggtatcatccccgccctcttcgagccagagcgcgagaagtcggcagcgatcgacggggaataccggctgcgcggcgaagcccgtaagacgttcgtggaacttatgcgtcggggagacctcccggtttggctcagctacaaggttgcgtcggaaggcttccagtacagcgatcggcgctggtgcttcgacggcgagcggaataaccaggtgctggaggagaacatggacgttgagatctggaccaaggagggtgaacgcaagaagttgcggcctcgatggttagatgcccggacctactccgacccattggcgctccgcgagttcaaggagttcgccgcgggcagaaggtcggtctccggggacctgatcctggagatcggcaagctaccccagcacctgactcagcgggcgcagaacgcgttggacaacttggtgatgctacacaattcggagcagggcgggagagcctaccggcatgcaatggaggaattaccagacacgatagagaccctcatgctgcttgcgctcatagccgtactgacaggcggggtgacgctgttcttcctctccggccgcggactgggcaagaccagcatcggcttgctctgcgtggtggctagcagtgtcctgctgtggatggcgtccgtggaaccccactggattgccgccagcatcatcctcgagtttttcctgatggtgctcctcatccccgagcccgataggcagcgcacgccacaagataaccagctggcgtacgtcgtgatcgggctgctcttcatgatcctgaccgtggccgccaacgagatggggctcctcgaaactacaaagaaggacctagggatcggccacgtcgccgcggagaaccaccaccacgccgccatgctggatgtggatctccaccccgcttccgcctggacgttgtatgctgtggccaccacgatcatcaccccgatgatgcgtcacacgatcgagaacaccaccgccaacattagcctgaccgccatcgccaatcaggcggccatcctcatgggtctggacaagggctggccgatctcaaagatggacatcggcgtgcccttactagcactggggtgctattctcaggtgaatcccctgacgctgactgccgcggtgttgatgctggtcgcccattacgcaatcatcggccccgggctgcaggccaaggccactcgcgaggcgcaaaagcggaccgccgccggtatcatgaagaacccaaccgtggacgggatcgtggcgatagacctggaccccgtcgtgtacgacgccaaattcgagaagcagctgggccagatcatgctcctgatcctatgtacttcccaaatcctcctgatgcgaaccacctgggcgttgtgcgagagcatcacgctggcaaccggccccctgaccaccctgtgggaggggtcccctggtaagttctggaacacgaccatagccgtaagcatggccaatatcttccgcgggagctacttggccggcgcgggcctggcattttccttaatgaagtccctcgggggcggaaggcgcggcaccggggcccagggcgaaacccttggcgagaagtggaagaggcagctgaaccagctcagcaagtccgaatttaacacgtataagcgctcaggaattatggaagtcgaccggagcgaggccaaggagggcctgaagcgcggtgagaccacgaagcacgcggtgtcccggggcaccgccaaacttcgatggtttgtggaaagaaacctcgtcaagccggaggggaaggtgatcgatctgggctgtggacgcgggggctggagctactactgcgccgggctgaagaaggtgacggaggttaaggggtacaccaagggcgggccgggccacgaggagccgatccccatggccacgtatgggtggaacctggtgaagctccactccggcaaggacgtgttcttcatcccgccagaaaaatgtgacaccctgctctgtgatatcggggagagctcccccaaccccacgatcgaggaggggcggaccctccgggtcctgaagatggtggaaccgtggctacgtgggaaccagttctgtatcaagatcctcaacccatacatgccctcagtagtggagaccctggagcagatgcagcggaagcacggcggcatgctggtgcggaaccccctcagccgaaacagcacccacgagatgtactgggtctcttgcgggaccgggaacatcgtcagcgcggtgaacatgacgtcccggatgctgctaaaccgcttcaccatggcgcaccggaagccgacctacgagcgcgacgtcgaccttggggccggcacccgccacgtcgccgtcgagcccgaggtagccaatctagacatcatcggtcagcggattgagaatattaaacacgaacataaaagcacgtggcattacgacgaggacaacccctacaaaacttgggcctaccacggctcctacgaagtaaagccgagcggaagcgcgtcatccatggtgaacggggtcgtgaaacttctcacaaagccgtgggatgtgataccaatggtcacacagatcgccatgacggacaccaccccgttcgggcagcaacgcgtattcaaggagaaggtggacacccggacgccaaaggccaagcgagggaccgcgcagatcatggaggtcacggccaagtggctttggggtttcctgagcaggaataaaaaaccgcgcatttgtacccgcgaggagttcacgaggaaggtgcggtctaacgcagccatcggggcggtgttcgtcgacgagaaccaatggaacagtgcaaaggaggcggttgaagacgaacgcttctgggacttggtacatcgtgagcgagaactgcacaaacaggggaagtgcgcgacctgcgtgtacaacatgatggggaaacgtgaaaagaaactgggggagttcggcaaggccaaggggagccgagccatctggtacatgtggctcggcgcacggttcctggaattcgaggcactgggcttcatgaacgaggaccactggttttcccgcgagaacagcctctccggggtagagggcgaggggctgcacaaactgggctacatcctccgcgacatctcgaagatccccgggggcaacatgtacgccgacgataccgccggctgggatacccgcataacggaggacgaccttcagaacgaggccaagattacagacataatggagcccgaacatgccctgctcgctaagagtatatttaagctgacctaccagaacaaggttgtccgggtgcagagaccggccaagaacggtaccgtgatggatgtaatcagccggcgcgaccagcgcggtagtggccaggtgggcacgtacggcctgaacaccttcactaacatggaggcacagctcatccgtcagatggagagcgaggggatattctctccatccgagctggagacccccaacctggcaggccgggtgttggactggctggagaagcacggtgccgagcggctgaagcgcatggctatctccggcgacgactgcgtcgtgaaacccatcgacgaccggttcgccacggccctcaccgccctgaacgacatggggaaggtgcgcaaggacatcccgcaatgggaacccagcaaggggtggaatgactggcaacaggtccccttttgttcgcaccattttcatcagttaattatgaaggacgggcgggagatcgtggtgccctgccgcaaccaagatgagctcgtcgggagggctcgcgtctcccagggcgccgggtggagcctccgggagaccgcctgcctgggcaagtcatacgcccaaatgtggcagctcatgtacttccaccgccgggacctccgcctcgccgcaaacgccatctgcagcgccgtcccggttgattgggtccccacctcccgcaccacttggagcatccacgcccaccaccaatggatgacgacggaggacatgctgtccgtttggaaccgtgtctggatcgaggaaaacccctggatggaggacaagacgcacatcagctcctggggcgacgtgccctacctgggtaagcgggaggatcagtggtgcggcagcctgattgggctcaccgctcgcgccacttgggccacaaacatccaggtggcaatcaaccaggtccggcgcttgatcggcaacgagaactacctggactacatgacttccatgaaacgttttaagaacgaaagcgacccggagggggccctctggtga

SEQ ID NO: 24228 - RNA, 9879 nt, synthetic construct
  misc_feature 1..9879: note = derived and/or modified CDS sequence (opt11) from DENV-1__FJ410257__SS-prME
  source 1..9879: mol_type = other RNA
agcgtgacgatgctgctcatgctgatgcccacggccctggccttccacctcacaaccaggggcggggagccccatatgattgttagcaagcaggagcggggcaagagcctgttattcaagacaagcgcgggcgtgaacatgtgcacccttatcgccatggacctcggcgagctgtgcgaggatacaatgacctacaaatgcccccgtataaccgaggccgagcctgacgacgtggactgctggtgcaacgccacggacacctgggtgacctacgggacttgcagccagactggcgagcacagacgcgacaagcggtccgtggccctcgcgccccacgtaggccttgggctcgagacgcgcacagagacatggatgagctctgagggcgcctggaagcagatccagcgtgtcgagacctgggccctccgccaccccgggtttacggttatcgccctgtttctggcgcacgccatcgggacgagcataacccagaaggggattatcttcatcctcctgatgttagtgaccccctccatggccatgcggtgcgttggtatcggcagccgcgacttcgtcgaggggctttccggcgcgacgtgggtggacgtcgtgctcgagcatgggagctgtgtgaccaccatggccaaagacaagcccaccctggacatcgagttattaaagacggaggtcacaaatccggcagtgctacgtaagctctgcattgaggctaaaatatccaacaccaccaccgacagccgctgcccgacccaaggcgaggcaacattagtggaagaacaggacgcaaatttcgtctgccggcgcaccttcgtagaccggggctggggtaacgggtgcggtctgttcggcaaggggtccctcattacctgcgctaagttcaagtgcgtgaccaagctggaggggaagattgtccagtatgagaacctgaaatatagcgtgatcgtcaccgttcacaccggcgaccaacaccaagtgggaaatgaatccacggagcatgggaccaccgcgactatcactccccaggcacccactaccgagatccagctcaccgactacggggcgttaacactggactgctcgcctcgcacgggactggacttcaacgaaatggtcttactgaccatgaaggaaaagtcctggctcgtgcacaaacagtggtttctggatctgccgcttccgtggacctcgggggccagtacctcacaggagacatggaacaggcaggacctgctggtgacgttcaagaccgcccacgcgaagaagcaagaggtcgtggtgctcggtagccaggagggcgcaatgcacaccgccctgaccggcgccactgagatccagacctccggcacaactaccatcttcgccggccacctgaagtgccgcctcaaaatggataagctgaccctgaaaggcatgagctacgtcatgtgtaccgggtccttcaagctcgagaaggaggtggcggagactcagcacggcaccgtgctggtccagatcaaatacgagggcaccgacgccccttgcaagatcccgttcaccacgcaggacgaaaagggcgtaactcagaacggccggctgatcaccgccaacccgatcgtgaccgacaaggagaaacccgtgaacatcgaggcagagcctcccttcggggagagctacatcgtgatcggcgcgggcgagaaggccctgaaactgtcctggttcaagaagggaagctccatcggcaagatgttcgaggccacggcccgcggagctcggcgcatggcaatcttgggcgacacagcttgggacttcgggagcatcggcggcgtcttcacctccgtcgggaagctggtgcaccagatcttcggcaccgcttatggcgtgctgtttagcggcgtctcctggactatgaagattgggatcggcgtgctgctgacctggctagggttaaacagcaggtcaaccagcttgagtatgacctgtatcgctgtggggcttgtcacgctgtacctaggcgttatggtccaggccgactctgggtgcgtcatcaactggaagggacgcgagctcaagtgcgggtccggcattttcgtgaccaacgaggttcacacgtggaccgagcaatacaaattccaagcggactccccgaagcgcctgtcggctgccatcggcaaagcctgggaggaaggagtctgcgggattcgctccgccactcgcctggagaacatcatgtggaagcagatttcgaacgagctcaaccacatcctgctggagaacgacatgaagctcactgtggtggtcggggacgtggcgggcatcctggggcaaggcaagaagatgattaggcctcagcccatggagtataagtactcctggaagtcctggggcaaagcaaagatcatcggggccgacgcgcagaacaccacctttatcattgacggccccaacaccccggagtgccccgacgaccagcgagcgtggaatatctgggaggtggaggattatgggttcggaatcttcacgacaaacatctggctaaaacttcgggacagctatacacaggtctgcgatcaccgcctgatgagcgccgccataaaggactcaaaggccgtgcacgcggatatggggtactggatcgaaagcgagaagaacgagacctggaagctcgcgcgggcgtcctttatagaagtgaagacgtgtatctggccaaagagccacaccctctggtctaacggggtactggagagtgagatgatcatacccaagatctacggcggacctatcagtcagcacaactaccgcccgggctactttacacagaccgccgggccctggcacctgggcaagttggaactagactttgacttatgcgagggcactaccgtggtggtcgatgagcactgcgggaacagaggaccgtcgttgcgcaccaccaccgtgactgggaagatcatccacgagtggtgttgccgctcctgcactctgccacccctgcgctttaggggcgaggacgggtgttggtacggcatggagatccggcccgtaaaagagaaggaggagaatctcgtcaagagcatggtgtccgccgggtcgggagaggtggacagcttctcgctgggtctgctctgcatcagcatcatgatcgaggaggtcatgcggtcacgctggtctcggaagatgctgatgaccgggacgttagccgtgttcttcctgttgatcatgggccagctgacgtggaacgacctcatacgcctgtgcattatggtgggcgcgaatgcctccgaccgaatgggcatgggcaccacctacctggccctcatggccacgttcaagatgaggccgatgttcgccgtcgggctgctgttccgccggctcaccagccgcgaggtgctactgctgaccatcggactgtccctggtggcaagcgtagagctccccaactcgctggaggagcttggtgacggcctcgccatgggcatcatgatcttaaagctgctcaccgacttccagagccatcagttgtgggctacactgctctccctgacgtttatcaagaccaccttcagcctgcactacgcatggaagacgatggcaatggtgttgtcgatcgtctccctgtttcctctgtgtctctccaccacctcacagaagaccacgtggctgccagtgcttctcgggtccctgggctgcaagccgcttacaatgttcctcatcgccgaaaacaagatctgggggcgcaagagctggcccctgaacgagggcatcatggcggtggggatagtctccatactgctcagcagtctcctcaagaatgacgtgcccctagccggccccctgatcgcgggcgggatgctgatcgcgtgctacgtgatctctggtagttccgccgacctctctctggagaaggctgccgaggtctcctgggaagaggaagccgagcacagcggggcttcacataacattctggtggaggtccaagatgacggcaccatgaagatcaaagatgaagaacgcgacgacaccttaaccatcttgttaaaggccacgctcctggcggtcagcggggtgtacccgctttcaatacctgccaccctctttgtgtggtacttctggcagaagaaaaagcagcgctcaggcgtactgtgggataccccttcgcctcctgaggtagagcgtgccgttctggacgacggtatctacagaatcatgcagcgtgggctgctcggccggagccaggtcggggtgggcgtgtttcaggagaacgtcttccacacaatgtggcatgtgactagaggggcggtgctgatgtaccagggtaaacggctggagccctcctgggcgtctgtcaagaaagacctgatctcctacggcgggggttggcgcctgagggggagctggaacaccggtgaggaggtccaagtgatcgccgtcgagcctgggaaaaaccccaagaacgtgcagaccgctcctggcacttttaagactcccgaaggcgaggtgggggccattgctctggatttcaagcctggaacctccgggtctcccatcgtcaaccgcgagggcaagatcgtggggctctacgggaacggagtggtcaccaccagtggtacgtacgtgagcgccatcgcacaggctaaggcgtctcaggagggccccctgcccgagatagaggatgaggtgtttcgtaagcgcaatctgaccattatggacctccaccccgggtccggtaagacccgccgctacctgccggctatcgtacgggaggctattaagcgcaagctgcgaaccctgatcctggcccccacccgggtggtggctagcgaaatggcggaggctctgaagggcatgccaatccgttaccagaccaccgcggtgaagtccgagcacactgggaaggagatagtggacctcatgtgccacgctacgtttaccatgcggttactgtcgcccgtgcgcgtgcctaactacaacatgattattatggacgaggcccacttcaccgatccctcctccattgcggctcggggctacatatccacacgcgtgggaatgggcgaggccgccgcaatttttatgacggcgactccacccggaagcgttgaggccttcccgcaatccaacgcagtcatccaggatgaggagcgggacatccccgagcgcagctggaacagtggctatgaatggataaccgatttcagcggcaagaccgtctggttcgttccctccatcaagagcggcaacgacatcgcgaactgcctccggaagaatggcaagcgcgtgattcagctctcacggaagacgttcgataccgagtaccagaagaccaaaaacaatgactgggattacgtggtgaccacagatatcagcgagatgggggcaaacttccgagctgatcgtgtcatcgaccctcgacgttgccttaagccggttattcttaaggatggtcccgagcgggtgatcctggccgggcccatgcccgtgaccgttgcctccgccgcgcagcgcaggggacggatcggccgcaactataacaaggaaggggaccagtacatctatatgggccagccgctgaacaacgacgaggaccacgcccactggaccgaggcgaaaatgttacttgacaacatcaacacccccgaagggataatccccgcgctgttcgagcccgagcgcgagaagtccgccgcggtcgacggagagtatcggctccgcggcgaggcacggaagacatttgtagaactgatgcgccggggtgatctgccggtttggctgtcctataaagtcgcctcagagggtttccagtacagcgaccgccggtggtgcttcgacggggagcgcaacaaccaggtgctggaagagaacatggacgtggagatctggaccaaggagggcgaccggaagaagctgcgcccgaggtggcttgacgcccgcacctacagcgaccccctggccttgcgagagctcaaggagttcgcggccgggcgccggagcgtatccggcgatttaatcctagagatcggcaaactcccccagcacctgacccagcgcgcccagaacgcactggataacctcgtgatgctgcacaacagcgagcagggcgggcgggcgtatcgccacgccatggaggaactgccagatacgattgagacactaatgctgctggcactcattgccgtgcttaccgggggcgtcactctgttctttctttccgggcggggcctgggaaagacgagcatcggtctgctatgcgtgatggcctcttccgtgctgttatggatggcgtccgtcgagcctcactggatcgcggccagcatcatactggagttcttcctgatggtgctgctcattcccgagcccgatcgccagcggactccgcaggacaaccaattggcctatgttgtcatcggtctcctctttatgatcctgaccgtggccgcaaacgaaatgggacttctcgagactaccaagaaggacctgggaatcggtcacgtggccgtcgagaaccaccaccacgctgccatgctggacgtggacctccaccccgcctccgcgtggaccctgtacgccgtcgccaccaccattattacacccatgatgcggcacacgatagagaacaccacggccaacatcagcctgacagccatcgcaaaccaggccgccatcttgatgggtctggacaagggctggcccatatccaagatggacataggggtccctctgctagccctgggctgctatagccaggtgaaccccctgacgctaaccgccgccgtgctgatgctggttgcccattacgcaatcatcggacccggcttgcaagccaaggcgacccgcgaggcccaaaagcggaccgcggcagggatcatgaagaatccgacggtggacggcatagtggctattgacttggaccccgtcgtgtacgacgcgaagttcgaaaaacagctgggtcaaatcatgctcctgatcctgtgcaccagtcagatcctccttatgcgcactacctgggccttgtgcgagagcatcacactagccaccggaccacttacgaccctctgggagggctctcccgggaaattctggaatacgacaatcgccgtgagcatggcgaatatcttccgaggctcctacctcgcgggcgctgggctggcctttagcctgatgaagtctctgggcgggggacgccgggggactggtgcccagggagagactctgggcgagaagtggaaacgccagctgaaccagctctccaagagcgagttcaatacctacaaaagatccggcatcatggaggtcgaccgcagcgaggcgaaggaaggcctgaagcggggagagaccacaaagcacgcagtgtcacgtgggaccgccaagctacggtggttcgttgagcgcaatttggttaagccggaagggaaggtcatcgacttgggctgtggacggggcggctggtcttactactgcgcaggcctgaaaaaggtgacggaagtcaaaggatacacaaagggaggccctgggcacgaggagcccatccctatggccacctacggctggaacctagtgaagctgcactctgggaaggacgtgtttttcatcccgcccgagaaatgcgacactttgctgtgcgatatcggcgaaagctcccccaaccccacgatcgaggagggtcgcacactgcgggtcctgaagatggtggagccatggctgcgcggcaaccagttctgcatcaagattctcaacccttatatgccaagtgtggtggaaaccctggagcagatgcagagaaaacacggagggatgctggtgcgcaaccccctctccagaaacagcactcacgaaatgtactgggtgtcctgtggcaccgggaatattgtcagtgcggtgaatatgacgagccgcatgctgctcaaccgcttcaccatggctcacaggaagccgacctacgagcgcgacgtggatctgggcaccggcacgcggcacgtcgcggtggaacccgaagtggccaacctggacataatcgggcagcgcatcgagaacatcaagcacgagcacaagagcacctggcattacgatgaggacaatccctacaagacgtgggcctaccacggcagttacgaggtaaagccctccgggtccgcgtccagcatggtgaatggcgtggtgaagctgctcacaaagccgtgggatgttatccctatggtcacgcagatcgccatgacggacactacccccttcgggcagcaacgggtattcaaggagaaggttgacacgcgcacccccaaggccaagcgaggcacagcccagattatggaggtcacggcccgctggctatggggcttcctgtcccgtaacaagaagccgcggatctgtactcgggaggagttcacccgcaaggtgcggagcaacgcggccattggggcagtgtttgtagacgagaaccagtggaacagtgccaaggaggcggtggaagacgagcgcttctgggacctcgtgcaccgggagcgagagctgcataagcagggaaagtgtgcgacttgcgtctacaacatgatggggaagcgggagaagaagctgggcgagttcggaaaggctaagggctcccgagccatttggtacatgtggctcggagcgcggttcctggagttcgaggcgctgggttttatgaacgaggaccactggttctcccgggagaactccctctccggagtggagggggagggcctgcataagttaggttacatcttgcgggacataagcaaaataccaggcggcaatatgtacgccgatgacaccgccgggtgggacacccgcattaccgaagatgatctgcaaaacgaggccaagatcacggacatcatggaacccgagcacgcgctgctcgcgaaagccatcttcaagctgacctaccagaacaaagtggtccgagtacagcgcccggccaagaacggaacagtgatggatgtgatctcccgccgggatcagcgcgggagcggccaggttggcacctacgggctgaacaccttcactaacatggaggcccagctcatacgacaaatggagtctgagggcatcttcagcccgtccgagctggagacgcccaacctggcagagcgcgcgctcgactggctagagaagtacggggtggagcgactgaagcgaatggccataagcggcgacgactgcgtcgtgaagccaatcgacgatcgcttcgcaacagccttaacagccctgaacgacatggggaaggtgcgcaaggacatcccgcagtgggagccctccaaaggctggaacgactggcagcaggtccccttctgctcgcaccacttccatcagctgatcatgaaggatggccgggagatcgtcgtgccctgtcgcaaccaggacgaactcgtcgggcgggcgcgcgtgtcccagggcgccggttggtcactgcgggagaccgcctgtcttggaaagagctacgcccagatgtggcagctgatgtacttccaccggagagacctgcgcctagcggcgaacgccatctgctccgccgtgccagtagactgggtgccaacgagccggacaacctggtccattcacgcccaccatcagtggatgaccacggaggacatgctcagcgtgtggaatagggtctggatcgaggagaacccctggatggaggacaagacccatatctccagctgggaggacgtgccctacctgggtaagcgcgaggaccaatggtgcggctcactgatcggtcttaccgcgcgggccacctgggctaccaatatccaagtggccataaatcaggtccgccggctaattgggaacgaaaactacctggactatatgaccagtatgaagcgcttcaagaacgagagtgacccggagggcgccctctggtga

SEQ ID NO: 24229 - RNA, 9879 nt, synthetic construct
  misc_feature 1..9879: note = derived and/or modified CDS sequence (opt11) from DENV-1__FJ461332__SS-prME
  source 1..9879: mol_type = other RNA
tccgtaacgatgttactaatgctaatgccaaccgcactagctttccacctcaccactcgaggaggagaaccacacatgatagtctcaaagcaagagcgaggaaagtcgctgctatttaaaacatctgcgggagtaaacatgtgtaccctcatcgccatggatctgggggaactctgcgaggacacgatgacctataagtgtccgcgcataacggaggctgagccagatgacgtagattgttggtgtaacgcgacggacacatgggtcacatacggaacttgttctcaaaccggcgagcaccgacgggacaagcgcagcgttgcgctcgcaccacacgtcggactcggactagagacacgaactgagacgtggatgtcaagcgaaggcgcctggaagcaaatacaaagggtggagacctgggccctgcgacatccgggctttacagtcattgcactatttctggctcacgccataggaaccagcatcacccaaaaagggataatattcattctactgatgttagtgaccccaagcatggctatgaggtgtgttggcatcggaagcagggacttcgtcgaaggtctctccggcgccacctgggtcgacgtagtgttagagcacgggtcgtgtgttacgacaatggccaaagataagccgacccttgacatagaactactcaaaacagaggtaacgaaccccgccgtattgcggaaactatgtatagaggcgaaaatttccaacacaacaacggactcacgctgtcccacccaaggggaagcaaccctcgtcgaagaacaagacgcgaacttcgtgtgccgaaggacattcgtggaccgaggatggggaaacggatgcggactgttcggcaagggcagccttatcacatgcgccaaattcaaatgcgtaacgaaactcgaaggaaagatagtacaatatgaaaacttgaaatatagcgtgatagtaacagtacacactggcgaccagcaccaagtaggcaatgaatcaactgaacacggcacgacagccaccatcactccgcaagcacccacaaccgaaatccaactgacggactacggcgcactcacgctcgactgcagtccccgtacgggactcgacttcaacgaaatggtactgctgacaatgaaagaaaagtcatggctcgtccacaaacaatggtttctggatctaccgctcccttggaccagcggagcgagcacgagccaagaaacctggaataggcaggacctattggtcacattcaagacagcacacgccaagaaacaagaggtagtcgtactcggatcacaagaaggcgcgatgcacacagcactcaccggtgccacggagatacagacaagcggcaccacaactatatttgccggccacctgaaatgtcgtctaaaaatggacaagctcacccttaagggaatgtcgtatgtgatgtgcacaggcagcttcaaactcgagaaggaggtggccgaaacccaacacggaaccgtgctagttcaaataaaatatgagggcacggacgcaccatgtaagataccattcagtacacaggatgagaaaggagttactcagaacgggcgacttatcacggccaatccaatcgtaacggacaaggaaaaacctgtcaacatcgaagcagagccaccgttcggagagtcatatatagtcataggggcgggtgaaaaagcacttaaactgagctggttcaagaaaggttcctcgataggaaaaatgtttgaggcaacggcccggggtgcccgccggatggcgatattaggggacaccgcttgggactttggctcaatcggaggcgtattcacgtccgtgggaaaactaattcaccaaatattcgggactgcatacggcgttctattctcgggagtcagttggacaatgaagataggcataggggtgttactcacctggctcggcttaaactcccggagcacatccctgagtatgacatgcatcgcagtaggcctagtcacgctgtaccttggcgtcatggtccaggccgactccggctgcgtaattaactggaaaggaagggaactaaaatgcggaagcggaatcttcgtaaccaatgaggtccacacatggaccgaacaatacaaattccaggcagactcaccaaaaaggctcagcgccgctataggaaaagcgtgggaggaaggcgtgtgcggtattcgaagcgcaacacgactagagaatataatgtggaaacaaatatcgaacgaactcaaccacatcttgctggagaacgacatgaagctgacggtcgtcgtaggagatgtcgccgggatcctgggtcagggcaagaaaatgatacgaccccaaccgatggaatacaaatacagctggaaaagttggggtaaggccaaaataataggagcagacgcccagaatacgactttcataatagacggacctaataccccggaatgccccgacgaccaaagagcatggaatatctgggaagttgaagattacggctttggcatctttactacaaacatctggctcaaactcagagatagctacacgcaagtctgcgaccacaggctgatgtcggccgcgatcaaggactccaaggcggtccatgcggacatgggctactggatagagagcgagaaaaacgagacatggaaactggcacgagcatcgttcatcgaagtcaaaacctgtatttggcctaagtcacataccctatggagtaacggcgtactagaaagcgaaatgatcatccctaagatctacggtggccctataagccaacataattatcgtccaggctacttcactcaaacggccggaccatggcacctaggaaagctagaattggactttgacctatgcgaagggaccaccgttgtggttgacgaacactgcggaaatcgcggaccatcgctgagaacaaccactgtcacgggcaaaataatccacgagtggtgctgccgcagctgcacgctaccaccacttagattcagaggcgaagacggttgctggtacggcatggaaatacgacccgtcaaggaaaaagaggagaatctggtcaagtcaatggtgtcagcagggtcaggggaagtagacagcttcagcctcggactgctgtgtatcagcatcatgatagaggaggtcatgcgctcccgatggtcccgcaagatgcttatgacgggaacgttggcagtgttcttcctactgataatgggacaacttacatggaacgacctcatccgactgtgtataatggtgggggccaacgcattcgaccggatgggaatgggcaccacttatctggcactgatggcgaccttcaaaatgcgaccgatgttcgctgtcggactactcttccgacggctaactagccgcgaagttctgctcctcaccattggcctatccctcgtcgcatcggtcgaactcccaaacagtcttgaggaacttggagatggattggcaatggggatcatgattcttaaattgttgacggatttccagagccatcaactatgggccaccctcctctcgctaacgttcataaagacgaccttctccctccactacgcttggaaaacaatggccatggtcctcagcatcgtgagtctgttccccctctgcctaagcacgacgagccagaaaacaacatggttgcccgtactcctcgggtcactcgggtgtaagcccttgaccatgttcctcatagcggagaacaagatctggggtcgaaaaagctggccactaaacgaggggataatggccgtgggaatcgtaagtatattgctatcctccctgctaaagaatgacgtacccctcgcggggcccctaatcgccgggggaatgctcatcgcatgctatgtcatatcgggatccagtgccgacctatcgctcgaaaaagccgcggaagtatcgtgggaagaggaggccgagcacagtggagccagccacaacatcctagttgaagttcaagacgacgggaccatgaaaataaaagacgaggaacgagacgacacgctaacaatacttctaaaagccacactgctagctgttagcggggtatacccgttgagcatcccagcgaccctgtttgtctggtacttctggcagaaaaagaaacaacggtcaggggtgctgtgggataccccaagtcctcccgtagtcgaacgtgcagtgctcgacgatggcatataccgaataatgcaaagagggttgctcggaaggtcacaggtgggagtgggcgtattccaagagaacgtattccacaccatgtggcacgtcacaagaggagctgtgctaatgtaccaggggaaacgacttgaacccagctgggcttcggtgaagaaagacttaataagctatggtggaggttggagactccgcggaagttggaacacgggggaagaggtacaagtcatcgccgtcgagccgggcaaaaacccgaagaatgtacaaactgccccggggacatttaaaacaccagagggagaagtcggtgccatcgctctagatttcaaaccaggcaccagtggctcgccgatcgtaaaccgtgaaggcaaaatcgtcggactttacgggaacggcgttgtgactacgtcaggcacctatgtcagcgcaatagcccaggcaaaagcaagccaagaagggcccctccccgaaattgaagacgaggtgtttaggaagcgcaacctcaccatcatggacctacatcccggatccggtaaaacacgccgatacctacccgccatcgtacgcgaagcaataaagcgaaaactccgaactttaattctagcacccacgagagttgtggcctccgaaatggccgaggccctgaaaggaatgcccatacggtaccaaaccacagcggtgaagtcagaacacacgggaaaagaaatcgtagacttaatgtgccacgccacgttcacaatgcggcttctgtctccagtgagagtgccaaattacaacatgataataatggatgaagcccactttacagacccatcaagcatcgccgcacgtggctatatctcgacaagggtaggaatgggtgaggccgcggcaatatttatgaccgcaacaccaccgggctcagtcgaagccttcccacagagcaacgcggtgattcaagatgaagaaagggacatccccgaaaggtcatggaactcgggccacgaatggattactgactttcccggtaaaacagtttggtttgtgccctccatcaagtcgggaaacgatatcgcaaattgtctacgcaaaaacggtaaacgggtaatacaactatcaagaaagacattcgacaccgagtaccaaaagaccaaaaacaacgactgggattatgttgtgacaacagacatatcagaaatgggcgcgaacttcagagccgaccgggtgatagaccctcggcggtgcttgaagcctgtaatacttaaagacggaccagaacgcgtgatactagctggaccgatgcccgtcaccgtggccagcgcagcccagcgtcgcgggcgcataggtagaaaccacaacaaagagggcgatcaatacatctacatgggtcagccgttaaacaacgacgaagaccatgcgcactggacggaagcaaagatgctgttggacaacataaacacgccagaaggcatcattccggcacttttcgaaccggaacgcgagaagtcagccgcagtcgacggcgaataccgattgaggggtgaggcccgcaagaccttcgtagagttgatgaggagaggggacctgccagtatggctctcctataaagtagcttcggaaggatttcaatactcggaccggagatggtgcttcgacggggagcgaaataatcaggtcctggaagagaacatggacgtcgaaatctggactaaggagggcgaacgaaagaagctacggccgcgttggctagacgcacgaacgtacagcgaccccctagccctcagagaatttaaggagttcgcggcggggaggagaagcgtatccggcgacttaatcctcgaaataggaaaactaccacaacatttaacgcagagagcgcaaaacgcgctcgacaacctcgtaatgctgcataactcagaacaagggggtcgcgcctacaggcatgcaatggaggaactaccagacacaatcgaaactttaatgctgttggccctaatcgctgtgctaaccggcggtgtaacgctattcttcttgagcggcagaggactcggaaagacaagcattggtctactgtgcgttatggcctcctcggtgctactctggatggcgtcagtagaaccccattggatcgcggcaagtataatactggagttcttcctcatggtcctcctgatcccagaacccgataggcaacgaacacctcaagacaaccaacttgcctatgtagtgataggcctattattcatgatcttgacagttgccgcaaatgagatgggcctactcgagaccaccaagaaagacctcggcattggccacgtcgccgtcgagaaccaccatcacgcagcaatgctagacgtcgacctccacccggcatcagcatggacactttacgccgtcgctacaacaatcatcacaccgatgatgcgacatacaatcgagaacacgaccgccaacataagcctaacagcgatcgccaaccaagcggcaatactgatggggttggacaaaggctggcccatctcaaagatggatataggcgtgccgttactcgccttgggatgctatagtcaagtcaaccccctaaccctcacagctgccgtattgatgttggtagctcactacgcaataatagggccaggacttcaggcaaaagccacacgagaagcccagaagcgaaccgcagcaggaataatgaagaaccccactgtcgatggaatagtagcgatcgacctggacccggtagtctacgacgtcaaattcgaaaaacagctcgggcagatcatgcttctgatactctgcacatcccagatacttctaatgcgcactacatgggctctttgcgaaagcatcacactcgccaccggaccactaaccaccttatgggaaggatcgcccgggaaattctggaacacaacgatcgcagttagcatggctaacatcttccgaggctcctacctagcgggggcggggctggccttcagcctcatgaaatcactgggaggagggcgccgaggaacaggcgcacaaggggagacattaggcgaaaaatggaagcggcagctaaaccaactatcgaagagtgagtttaacacctacaaaagaagcggaatcatggaagtagacaggagtgaagccaaggaaggactcaaacgcggagaaacaactaaacacgcggttagtagaggaactgcaaaacttcgatggttcgtagagcgcaatttggtaaagccagagggaaaagtaatagatctgggatgcggcagaggcgggtggtcatactactgcgctgggctcaagaaagtgacagaagtaaaaggctacacgaaagggggtccgggccacgaggaaccaatccctatggcaacttatggttggaaccttgtaaaactccacagcggaaaggatgtgttcttcataccacccgaaaaatgcgatacattattatgtgacataggagaaagctcgcctaatccgacaatcgaggaaggaaggaccctgcgcgtgcttaaaatggtagagccatggcttcggggtaaccaattctgtatcaaaatcttaaatccgtacatgccgtccgtggtcgaaacccttgaacagatgcagaggaagcacgggggtatgctcgttcgtaacccactatcacggaactcaacgcacgaaatgtattgggtctcctgcgggacaggaaacatcgtaagcgcagtcaatatgacaagcaggatgctcctcaaccgcttcacgatggcccatagaaaaccgacgtatgagcgcgacgtcgatctgggaactgggaccaggcacgtcgcagttgaaccggaagtagccaacctcgacatcattggtcagcggatcgaaaacataaagcatgaacataaaagcacatggcactacgatgaagacaatccatacaaaacatgggcctaccatgggtcctacgaggtaaaaccgagcggaagcgcatcaagcatggtaaatggggttgtaaaactcctcaccaagccatgggatgtgattccaatggtaacacagatcgctatgacggacactacgcctttcgggcaacaaagggtattcaaggagaaagtagacacaaggacccccaaggcaaagcgaggaacggcgcaaatcatggaagtaacggcacgatggttatggggattcctgagccgcaacaagaaaccgaggatatgtacacgcgaggagttcacacgaaaagtgcgaagcaacgcagcgataggcgcagtattcgtagacgaaaaccagtggaactcggctaaggaggcggtggaagacgaacggttctgggacctagtccacagagagagggaactacacaagcagggtaagtgcgcaacatgcgtatacaacatgatgggaaagagagagaaaaagttaggagaatttggaaaggccaaagggagcagagccatatggtacatgtggctcggtgcaagattccttgagttcgaggcgctcggattcatgaacgaagaccactggtttagtcgggagaactcgctcagcggggttgagggggaaggtctgcacaaactcggatacatactacgggacatctccaagatcccagggggaaacatgtatgcggacgacaccgccggttgggacacgagaataacggaagacgatctccaaaacgaagcaaagatcacagatatcatggaacccgaacatgccctactcgccaaagccatattcaagttaacttaccaaaacaaagttgtcagagtccagagacctgccaaaaatgggactgtcatggacgtaattagtcgaagagaccaacgaggatctgggcaggttggcacgtatggactcaacaccttcacgaacatggaagcacaactcatccgtcaaatggaatcggaagggatcttcagcccaagcgagctcgagacgccaaacctcgccgagcgtgcgctggattggctggagaaatacggggtagaacgcctcaaacgcatggccatcagcggggacgattgtgtagtgaaacccatagacgaccgcttcgccacggccctgacagcgctgaacgacatgggaaaagttcgaaaggacataccacagtgggaaccatccaagggttggaacgactggcagcaagtgccattctgctctcatcactttcaccaactcataatgaaggatggcagggagatagtcgtcccctgcaggaaccaagacgagctagtaggtcgggcacgagtatcacaaggcgcaggctggtctctcagagagaccgcctgtctcggaaagtcgtacgcccaaatgtggcagctaatgtacttccatagaagagacctcaggttggcagccaatgcaatttgtagcgcagtaccagttgactgggtgcccaccagccgaacgacatggtcaatacacgcgcatcatcaatggatgacaactgaggacatgctaagcgtatggaaccgagtatggattgaggagaatccatggatggaagacaagacccacatatcgtcttgggaggatgtcccctacttgggaaaaagggaagaccaatggtgtgggtcactaatcgggctcaccgcgcgagccacctgggccaccaacatacaggtggccataaaccaggtccgcaggctaatcggaaacgaaaactacctcgattacatgacatcaatgaagcgctttaaaaatgaatcggatccagagggagctctctggtag

SEQ ID NO: 24230 - RNA, 9879 nt, synthetic construct
  misc_feature 1..9879: note = derived and/or modified CDS sequence (opt11) from DENV-1__FJ461333__SS-prME
  source 1..9879: mol_type = other RNA
agtgtgacgatgctgctcatgctaatgcccaccgccttagccttccacctcactacccggggcggggagccccacatggtcgtgtctaagcaagagcgggggaaaagcctgctgtttaaaaccagcgcgggggtgaacatgtgcacgctcattgccatggacctgggcgagctctgcgaggacacaatgacctataagtgcccacggatcaccgaggccgagcctgatgacgtggactgttggtgcaacgccaccgatacctgggtgacctacgggacctgcagccagacaggcgagcaccggcgggacaagcgatcggtggccctcgcgcctcacgtcggactcgggctggagacgcgcacagaaacctggatgagttccgagggcgcctggaaacagatccagcgggttgagacctgggccctacgccaccccgggttcacagttattgccctgtttctggcccacgcgatcgggacctcgatcacccagaaagggatcatcttcattctcttgatgctggtcaccccctccatggccatgaggtgcgtggggatcgggagcagggacttcgtggaggggctctccggagccacctgggtcgacgtggtactggagcatgggtcctgcgtcaccaccatggcgaaagataagcccaccttggacattgagctcctgaagacagaggtgacaaaccccgcgatcctgcggaagctctgtattgaggcaaagatctccaacaccactacagatagccgctgcccgacccaaggcgaggccaccctggtggaggagcaagacgccaacttcgtctgccggcgcaccttcgtagatcggggctgggggaacggctgtgggctgttcgggaaaggctccttaataacctgcgccaagttcaagtgtgtcaccaaattagagggcaagatcgttcagtatgagaatctgaagtacagcgtgatcgttaccgtccacacaggggaccaacaccaggtggggaatgagtccacggaacatggcaccacggctacgatcacgccccaagcccccacgacggagatccagctaaccgactatggcgctctgactctcgactgcagccctcgcacgggcctcgacttcaacgagatggtcctgctgaccatgaaagaaaagtcctggctcgtacacaagcagtggttcttagacctcccactcccctggacaagcggggccagcacaagccaggagacgtggaatcggcaggacctgctggtgaccttcaagacggctcacgcaaagaagcaggaggtggtcgtgctgggcagccaagaaggcgccatgcacaccgccctgacgggggctaccgagattcagaccagtggcaccactaccatcttcgctgggcacctgaagtgccgccttaaaatggacaaactgacccttaagggcatgagctatgtcatgtgcaccgggagtttcaagctcgaaaaagaggtggccgagacgcagcatggcaccgtgctggtccaaattaagtacgagggcaccgacgcgccctgcaagatccccttttcgacgcaagacgaaaagggggtgacccaaaacgggcgtctgattacagccaacccgatcgtgacagataaggagaagcccgtcaacatcgaggccgaaccgcccttcggggagagttacattgtgatcggggcaggcgagaaggccctgaagttaagttggttcaagaagggttcctcaattgggaagatgttcgaagcaaccgcccgcggggcccggcgcatggctatcctgggggacaccgcctgggacttcgggtccattggcggcgtgttcacgtccgtggggaaacttgtccaccaaatattcgggaccgcctacggtgtcctgttctcgggcgtaagctggaccatgaaaattggactgggcgtcctgcttacgtggctaggactgaactcccgttccacctccctctctatgacctgcattgctgtggggctggtcaccctgtatctaggggtcatggtgcaagccgacagcggttgcgtaatcaactggaagggccgggaactgaaatgcgggagcggcatcttcgtaacgaacgaggtccacacctggaccgagcagtataagttccaggcagacagcccgaagcgactgtccgccgccataggcaaggcttgggaggagggagtttgtggcatacgaagcgcgacccggctcgagaacgttatgtggaagcagatctccaacgagctgaatcacattctgttggagaacgacatgaagtttaccgtggtggtgggggacgtggcgggcatcctggctcagggtaagaaaatgatccgtccacagccaatggagcacaaatacagctggaagtcctggggcaaagcgaaaatcatcggcgcagacgttcagaataccaccttcataatagacgggcccaacaccccggaatgtccagacgaccaaagggcgtggaatatttgggaagtcgaggattacggattcggtatcttcaccacgaatatctggctaaaattaagggacagctatactcaagtatgcgaccaccggctgatgtccgcggcaatcaaggacagcaaagccgtccacgccgacatgggctactggatcgaatccgagaaaaacgaaacctggaaactggcgcgggccagcttcatcgaagttaagacctgcatctggcccaagtcccacacgttgtggagcaacggagtgctggaatccgagatgatcattcccaagatttacgggggacctatcagccagcacaactaccggcccgggtacttcacccagactgccggcccctggcaccttggtaagctcgagcttgacttcgacctttgtgagggcaccaccgtcgtggtggacgagcactgcggcaaccggggaccgtccctgcgtaccaccactgttacgggcaagataatccacgagtggtgctgccggagttgcaccctgccacccctgcgcttccgcggggaggacggttgctggtacggtatggaaatccgccccgtgaaagaaaaggaagagaatttggtgaagagtatggtctctgccgggagcggggaggtggacagtttttcattgggactgctctgcatttccatcatgatagaggaggtcatgcggagccgatggtcccgaaagatgctgatgaccggcacccttgccgtcttcctactactgatcatgggacagctgacgtggaacgatctgatccgtctctgcatcatggtcggcgcgaacgcgagcgaccgcatggggatgggcaccacctacctcgccttgatggccacgttcaaaatgcggcccatgttcgccgtgggcttactgttccgacgtctgacgtctcgcgaagtcttgctcctgaccatcggcctgagcctcgtagcgtcagtcgagctgccgaacagcttggaagaactcggcgacggtctggccatgggcatcatgatactgaagctcttaactgatttccagtcccaccaactctgggccactctcctgagcctcacgttcatcaaaaccactttctcacttcactacgcctggaagactatggcgatggtcctgagcatcgtctcccttttccccctctgcttatcgacaaccagccagaaaaccacctggttgcccgtcctcctgggtagcctgggatgcaagccattaacgatgtttctaatcgccgagaacaagatctggggaaggcgctcctggcccctgaatgaggggatcatggccgtgggtatcgtcagcatcctcctgagctcactattgaagaacgacgtccccttggccgggcccctgatcgcgggaggcatgctcatcgcttgctacgtgatatcgggatccagtgccgacctgagcctcgagaaggccgccgaggtgagctgggaagaggaggccgagcactccggcgcaagccataacatcctcgtagaggtccaggacgatgggacaatgaaaatcaaggacgaggagagagacgacaccctgactatcctgctcaaggctaccctgctggccgtatccggcgtctacccgttaagcatccccgccacgctattcgtgtggtacttctggcagaagaagaaacagcgctccggggtgctgtgggacaccccctcgccgcccgaggtcgagcgggccgtgctggacgacggcatatatcgcatcatgcagcggggccttcttgggcgctcacaagtgggagtaggtgtgttccaggagaatgtgttccacaccatgtggcatgttacgcggggcgcggtgctgatgtatcaagggaagagactggagcctagctgggcctccgtcaaaaaggaccttatcagctacggcggaggttggcgcctgcagggatcttggaacacgggcgaggaggtacaggtgattgccgtggagcctggcaagaaccccaagaacgtccagacagcccccgggactttcaagacccccgaaggcgaggtgggcgctatcgctctcgacttcaagcccgggacaagtggctcccccatcgtgaaccgcgaggggaagatcgtaggcttgtacggtaacggggtggtaactaccagcgggacctacgtcagcgccatagcccaggccaaagcctcccaagagggaccgctgcccgagatcgaggacgaggtgttccgaaagcgcaatctcaccatcatggacctccatcccggctctggaaagaccaggcgctacctgccggccatcgtgcgggaggccatcaagagaaagctccggacactgatcctggcccccaccagggttgtggccagcgagatggcggaggccttaaagggtatgccaattcgctaccagacgaccgcagtaaagagcgagcatacaggaaaggaaatcgtagacctgatgtgtcatgccacctttacgatgcggctgctttcccccgtacgcgtaccgaactacaacatgatcatcatggacgaagcccacttcaccgaccccagctcgatcgcggcacggggatacatctccacccgcgtaggaatgggggaggccgccgccatctttatgaccgcgacgccgcccggctccgtggaagccttcccgcagagcaacgcagtgatccaagacgaggaaagagacatccccgagcgctcctggaacagcgggtacgagtggatcaccgacttccccggtaaaaccgtttggtttgtgccctccatcaagagcggcaacgacatcgccaactgcctgaggaagaacgggaagcgcgtgattcagctgagtcgaaagaccttcgacacggagtaccaaaagaccaagaataacgactgggattacgtagtcaccactgatatcagcgagatgggagcgaacttccgcgctgacagagtgatcgatccgagacgttgcctcaaacctgtcatcctgaaagacgggccagaacgggtgatcctggccggccccatgccggtcacggtagcaagcgccgcgcaacggcgcgggcggataggccgcaatcataacaaagagggggatcagtacatctacatgggtcagccactcaacaacgacgaggaccacgcccactggactgaagccaagatgcttttggacaacatcaatacccccgagggcattattcccgcccttttcgagcctgagcgcgaaaagtctgctgcgatcgatggagagtaccggcttcggggcgaggcccggaagaccttcgtggagttgatgcgccgcggcgacctgcccgtctggctgtcatataaggtggccagtgagggcttccaatatagcgaccggcggtggtgctttgacggtgagcgaaacaaccaagttctggaagaaaatatggacgtcgagatctggaccaaggaaggggagcggaaaaagttacgccctcgatggttagatgcccgcacctactccgaccccctggccctccgagagttcaaggagttcgctgcgggccgccgtagtgtttccggggatctgatcttagaaatcggcaagctgccgcagcatttaacccagagggctcagaacgccttggacaacttggtcatgctacacaacagcgagcagggcggccgtgcgtaccgccatgcaatggaggagctacccgacactatcgagacgttgatgctgttagccctcatagccgtcctgacaggtggagtaaccctgttctttttgtccggtcgtgggctgggcaaaacctctatcggcctgctctgcgtgatggcctcgagtgtcctgttgtggatggcttcggtggagcctcattggatcgcggcatccataatcctcgagttcttcctaatggtgctgctcatccccgagcctgaccgccagcggacgcctcaggacaatcagctggcctatgtcgtgatcgggcttctcttcatgatcctaactgtcgccgcgaacgagatgggcttactcgaaacgaccaagaaagatttagggatcggccacgcggccgtcgggaaccatcatcacgccgccatgctagatgtcgatctacaccccgcgtcagcctggaccctgtatgccgtggccaccacaattatcaccccgatgatgcgccacacaatcgagaacacgaccgccaatatcagccttaccgcgattgccaaccaggctgccatcctcatgggcctggacaagggctggcccatctctaagatggacatcggcgttcccctgctcgcgctgggctgttatagccaagtgaacccgctgacgctgacggcggcagtgctgatgctggtcgcccactacgcgatcatcgggccgggcctccaggcgaaagccacccgcgaagcccagaagcggaccgccgccgggatcatgaaaaatcccaccgtggacggcatcgtcgcgatcgatctggacccggttgtctatgacgccaagttcgagaagcaactgggccagatcatgctcctgatcctgtgcacgtctcagattctcctgatgcgcacgacctgggctttatgcgagagcattaccctcgcgacggggcccctcacaaccctatgggagggatccccgggcaagttctggaacaccaccatagccgtgagcatggcgaatatttttaggggctcctatctcgccggcgccggcctggccttcagcctgatgaagtcactcggcgggggcaggcgggggactggcgcgcagggcgagaccctgggggagaagtggaagcgccagctgaaccagttgtccaagtcggagttcaacacgtacaagcggtccggcattatggaagtcgaccgcagcgaggccaaggaggggctgaaacggggcgagacgacaaagcacgccgtgagtcgcgggaccgcaaagctgcgctggttcgtggagcgcaacctggtgaagcccgagggcaaggtaatcgacctaggctgcggtagaggagggtggtcgtactactgcgccggcttaaagaaggtgacagaggtaaaggggtatacaaagggaggcccggggcatgaggagcctataccgatggcgacctacggatggaacctggtgaagctccattccggtaaggacgtatttttcataccgcccgagaagtgcgatactttattgtgcgacatcggcgagtctagccccaacccgactatcgaggaagggcgcacgctccgggtcctgaagatggtggaaccctggctgcgcggcaaccagttctgcatcaagatactgaatccctacatgccgtctgtagtcgaaacacttgagcagatgcaaaggaagcatggagggatgctcgtcagaaatcccttgtcaagaaattcaacccatgagatgtactgggtgtcctgtggcaccgggaacatagtcagcgctgtgaacatgacctcccggatgttactgaacagattcacgatggcccatcggaagcctacttacgagcgcgatgtcgatctcggcgctggtacccgtcacgtcgccgtggaacccgaggtggcgaacctggacatcatcgggcagcggatcgagaacattaagcacgagcacaagtcgacctggcattacgacgaagacaacccctataagacgtgggcgtaccacggctcctacgaggtcaagccttcggggtccgccagcagtatggtgaacggcgtcgtgaagctattgaccaagccctgggacgtaattccgatggtcacccagatcgccatgaccgatacaacgcccttcgggcagcagcgggtgttcaaggaaaaagtagacacccgcactccgaaggctaagcgcggtacggctcaaatcatggaggtgacagccaaatggctgtggggcttcctgagccgaaacaagaagccgcgaatatgcacccgcgaagagttcaccaggaaggtgcggagtaacgccgccatcggggcagtcttcgtcgacgaaaaccaatggaactctgccaaggaggccgttgaggatgagcggttctgggacctcgtgcaccgcgagcgcgagttacacaagcaggggaaatgtgcaacttgcgtatacaacatgatggggaagcgggagaagaagctgggagagttcgggaaggccaagggcagccgggcaatctggtacatgtggcttggcgcccgcttcctggagttcgaggccctggggttcatgaacgaagaccactggttttcccgagagaacagcctctccggggtagagggggagggcctgcataagctgggatacatcctacgagacatcagcaagatccccggtggcaacatgtacgccgacgacaccgccgggtgggacacccggataaccgaggacgatctgcagaacgaggcgcgtatcacggacattatggagccggaacacgcgctgctagccaagtccatattcaagctgacctatcaaaacaaagtggtcagagtgcagagacccgccaaaaacggaactgtgatggatgtcatcagccgacgagaccagcgcgggtccggccaagtgggcacatacgggctgaatacgttcacgaacatggaggcacagctaatccggcaaatggagagcgaaggcatcttctcgcccagcgagctcgagacccccaacctggctgagcgcgtgttggattggcttgagaagtacggggttgagcggctgaagcgcatggcaatatcaggcgatgactgcgtggtcaagccgatagacgatcggttcgccacagccttgacggccctgaatgacatgggtaaggttcgcaaggacattccccaatgggagccgagtaagggctggaacgactggcagcaggtccctttctgctcccatcacttccaccagctaattatgaaggacggccgggagatcgtggtaccgtgtcgaaaccaggacgagttagtgggccgggcgcgcgtaagccagggtgccgggtggagtttacgggaaaccgcctgcctaggcaagtcctacgcccagatgtggcagctcatgtacttccacagaagggaccttcggttagcggccaatgctatatgctcggccgtacccgtggattggataccaacttcccggaccacgtggagcatccacgcacaccaccagtggatgacaacagaggacatgcttagtgtgtggaaccgcgtctggatcgaggagaacccctggatggaggacaaaacccatatcagcagttggggcgacgtcccgtacctggggaagcgcgaagatcagtggtgcggcagtttaatcggactcacggcgcgcgctacctgggccacgaatgttcaggtggctattaaccaggtccgccggctgatcggcaatgagaactacttagattacatgacctccatgaaacgattcaagaacgaatcagacccggagggggccctgtggtga

SEQ ID NO: 24231 - RNA, 9879 nt, synthetic construct
  misc_feature 1..9879: note = derived and/or modified CDS sequence (opt11) from DENV-1__FJ410262__SS-prME
  source 1..9879: mol_type = other RNA
tctgtgactatgctcctaatgctgatgcccaccgccttagcctttcacctcacgacccgcgggggagagccccacatgatcgttagcaaacaggagcgcggaaaaagcctgctgttcaaaacaagcgcgggggtgaacatgtgcaccctcatcgctatggatctgggtgagttctgcgaggatacgatgacctacaagtgtccccgcattacagaggcggagcccgatgacgtggactgctggtgcaacgccacggacacctgggtgacctacggtacttgcagccagaccggcgagcatcggcgagataagcggtccgtcgccctggcgccccacgttgggctcgggctcgaaacgcgcactgagacctggatgtcgtccgagggcgcttggaagcagatccagcgtgtggaaacttgggccctccgccatccagggttcacggtcatcgccctcttccttgcgcatgccataggcaccagcatcacccaaaaggggatcattttcatactactcatgctggttacccccagtatggcgatgcggtgcgtcggcattggcagccgcgacttcgttgaggggctatccggggccacttgggtagatgtcgtcttggagcacgggagctgcgtgaccaccatggctaaagacaaacccactctagacatcgagctactcaagacggaggtcaccaacccagcggtgttaaggaaattatgcatcgaagctaagatctccaacacgaccacggacagccgatgcccgacccagggcgaggcaacccttgtggaggagcaggacgccaacttcgtctgccgacgcacattcgtggaccggggttgggggaacggatgcgggctgttcgggaaggggtccctaataacgtgcgccaagttcaagtgcgtcactaaactcgagggcaagaccgtccagtacgaaaacctgaaatacagtgtcatcgtgacggtccacactggggatcagcaccaggtggggaacgagtccactgaacacggtactacggcaaccatcactccccaggctccgtcaaccgagatacagctaaccgactacggggccctcacactggattgcagccccagaacgggcctggactttaatgagatggtgctcctgactatgaaggaaaaatcctggctcgttcataagcagtggtttttggacttaccgctgccatggacctccggcgcaagcaccagtcaggagacgtggaaccggaaggatcttctggtaacgttcaaaacagctcacgcaaagaagcaagaggtcgtcgtgctgggctcccaggagggcgccatgcacacggctctcacgggggccaccgaaatccagaccagcggcaccacgaccatcttcgccggccatcttaagtgtcgcctgaagatggacaagctcaccctgaaaggcatgtcctacgtcatgtgcactgggtcattcaagcttgaaaaggaggtggcagagacacagcacggcaccgtgcttgtccagataaagtacgaaggaaccgacgccccctgcaagatccctttctccacccaagacgagaagggggtgacacaaaacgggcggttaattaccgccaacccgatcgtgactgacaaagagaagcccgtgaacattgaggccgagccacccttcggggagtcctacatcgtgatcggagcgggtgagaaggcgttaaaactgagctggttcaagaaggggagctctatcggcaagatgtttgaggccaccgcacgcggggccaggcgcatggcgattctcggtgacacggcctgggactttgggtcaataggcggggtgttcacctccgtcggtaagctggtgcaccagattttcgggacagcatacggggttttgttctcaggcgtctcctggacgatgaagatcggtatcggcgtcctcctcacttggctgggcctcaacagccgctccaccagcttatccatgacctgcatagctgtgggccttgtcaccctctacctgggcgtgatggtgcaagccgattctgggtgcgttatcaactggaaaggccgtgagctgaagtgcggaagcggcatcttcgtgacgaacgaagtgcacacctggaccgagcagtacaagttccaagcggactcccccaagcgcttaagcgcagccattggcaaggcctgggaggagggggtctgcggcatccggagtgctacccgccttgagaacatcatgtggaagcagatcagcaacgagctgaaccacatcttactggaaaatgacatgaagttcaccgtggtagtcggggacgtcgccggcatccttgcccaggggaagaagatgatacggccccagcccatggagtacaagtactcctggaagtcctggggcaaggcgaagatcattggcgctgacgtgcagaatacaacattcataatagacgggccaaacaccccggagtgccccgacgatcagcgcgcctggaacatctgggaggtggaggactacggcttcgggatcttcacaacaaacatctggctcaaactgcgggacagctacacacaagtatgcgaccaccgattgatgtctgccgccattaaagactccaaggccgtacacgccgacatgggttattggatcgagagcgagaagaatgagacctggaagctcgcacgggcctccttcatcgaggtcaagacctgcatatggcctaagtctcacacgttatggtccaatggcgttctggagagcgagatgatcatcccgaagatttacggcggtcccatatcccagcacaactatcgccccgggtacttcacccagaccgccggcccctggcaccttgggaagctggaactggacttcggcctctgcgaaggcacgacggttgttgtggacgagcattgcgggaaccgaggcccgagcctgcgcaccaccaccgtgacgggtaagatcatacacgagtggtgttgccggtcctgcaccctgccgccgctgaggttcaagggcgaggacgggtgttggtacggcatggagatccgtcccgtgaaggagaaggaggagaatttggtcaaatcgatggttagcgctgggtccggggaggtcgacagcttctcccttgggctgctttgcatcagcatcatgatcgaggaagtaatgcgcagtcggtggagccgcaagatgctgatgactgggacgctcgccgtgtttttcctgctgatcatggggcagctcacgtggaatgacctgattcggctctgcatcatggtcggggcgaacgcctccgatcgaatgggcatgggcacaacctacctggccctgatggccaccttcaaaatgcgcccaatgttcgcggtggggctcctgttccgccgcctgactagtcgggaggttctgctcctgaccatcggcctatctctcgtcgcaagcgtggagctgcctaacagtttggaggagctcggggacggtctggcgatgggcatcatgatcctgaagttactgaccgacttccagagccatcagctgtgggccaccctactgtccctgacgttcatcaagaccaccttcagcctccattacgcctggaagaccatggctatggtcctctccatcgtgtcattgtttcccctctgcttatcgacgactagccaaaagactacctggctcccggtgctcctgggctcgctgggttgcaaaccgctcaccatgttcctgatcgccgaaaacaagatctgggggcgtaagtcttggccactgaacgagggcatcatggccgtcggtatcgtgtcaattcttctgtccagcctgttaaagaacgacgtgcccctggccgggcccctgatcgccggcgggatgctcatcgcgtgttatgttatctctggaagcagcgccgacctatcgctggaaaaggccgccgaggtctcctgggaagaggaggcagagcacagcggggcgtcccataacattctcgttgaagtgcaggacgacggcaccatgaagatcaaggacgaggagcgggacgacacccttaccatcctgctcaaggccaccctgctagccgtctcgggggtatacccgttatcgattcccgccacccttttcgtctggtacttctggcaaaagaagaaacagcgtagcggcgtgctgtgggacactcccagtccgcccgaggtggagcgggcagtcctcgacgatggcatctaccgcattatgcaacgggggctgttgggccgttcacaggtgggagtgggcgtcttccaagagaacgtgttccatacaatgtggcacgtgacacgtggggcggtcctgatgtaccagggcaagcgcctcgagcctagttgggccagcgtgaaaaaggacctgatttcctacggcggtggttggaggctccaggggtcctggaacacgggcgaggaggtccaggtgatcgccgttgagcccggtaagaacccaaagaacgtacagacagcaccgggcacctttaagacctccgagggcgaggtaggggccatcgcgctcgatttcaaaccaggcacgagcgggtccccaatcgtgaatcgcgagggcaaaatcgtcggcctatacgggaatggcgtcgtgaccaccagtgggacctacgtgtcagccatagcccaagcgaaggcgtctcaggagggccccctgccggaaatcgaggatgaggtcttccgaaagcgtaacttaacgatcatggacctgcatcccggaagcgggaagacccggagatatctgccagccatcgtgcgggaggccatcaagcgcaagctccgaacactgatcttagcgccgactagagtggttgcctcagagatggccgaggccctcaagggcatgcccatacgctaccagacgaccgccgtcaagagcgagcacacaggaaaagagatcgtggacctaatgtgccatgccactttcacgatgcgcctgctttctcctgtccgcgttcccaactacaacatgataataatggacgaggcccacttcaccgatccgagctctatagcggccagaggctacattagcacccgtgtcgggatgggcgaagctgccgccatctttatgacagcaacgccgcccgggtccgtcgaggccttcccccagtcaaatgcagtgatccaggacgaagagcgggacatcccggagcgatcgtggaacagtggctacgagtggatcaccgacttccccggcaagacagtgtggtttgtcccatccatcaagagcgggaacgacatcgccaattgtctgcgtaaaaacgggaagcgcgtgatacaactttcgcggaagacctttgacacggaataccagaaaacgaagaacaacgattgggattacgtggtcactaccgacataagcgagatgggggcgaactttcgtgccgaccgggtgatagaccccagacgctgcctcaagccggtgatcctgaaggacgggcccgagcgggtcatcctggccgggcccatgccagtgacggttgcctccgccgcacaacggcgcggccggataggccgcaaccacaacaaggagggagaccagtacatctacatgggccagccgctcaacaatgatgaggatcacgcccactggaccgaagcaaagatgcttctggacaacataaacacccccgaggggatcatccccgcgctctttgaacccgagcgggagaagtcggcggcaatcgacggagaatacaggcttcggggggaggcccgcaagacctttgtggaactgatgcgccgcggggacctccccgtatggctaagctacaaagtcgcctcggagggcttccagtacagcgaccgccgttggtgctttgacggggagaggaataatcaggttctggaggaaaacatggatgtagagatctggacgaaggaaggcgagcggaaaaagctacgcccgcggtggctggacgcccgcacctactccgacccactagcgttacgagaattcaaggaattcgcggcagggcgccgtagcgtctccggcgacctgatactggagatcggcaagctcccccagcatctgacccagcgcgcccagaacgcccttgacaatctcgtgatgttgcacaactcagagcaaggcggtcgggcgtatcgtcacgcgatggaggagctgccggacaccatcgagacgttgatgttactcgccctcatcgccgtactgaccgggggcgttaccctgtttttcctatccgggcggggcctgggcaaaacgagcatcggtctgctctgcgtgatggcgtccagcgtccttctgtggatggccagtgtcgaaccgcactggatcgctgcctcgattatcctcgaattctttctgatggttttgctcatccccgagcccgaccgtcagcggaccccccaagacaaccaactagcctacgtggtcatcggcctcctctttatgatattgacggtcgccgctaatgagatgggcctgctcgaaaccaccaagaaagacctgggaatagggcacgtagcagttgagaaccaccaccacgccgccatgctggatgtggacctacaccccgcctccgcgtggaccctttacgccgtggctacgacaatcataacccccatgatgcgtcataccatcgagaacactacggctaacatcagcttgacggctatcgcgaaccaagccgcgatcctcatgggcctggacaaaggctggccgatctccaagatggacatcggggtccctctgttggccctgggctgttacagtcaggtgaaccccctgaccctcacggcagccgtattgatgctggtcgctcactatgctatcatcggccccggtctccaggccaaggcgacccgggaggcccagaagagaacggccgccggcataatgaagaacccgaccgttgacggcatcgtcgccatagacttagatcccgtggtgtacgatgcgaagttcgagaagcagctgggccagatcatgctcctgatcctgtgtacctcacagatcctactcatgcgcaccacttgggcgctgtgcgagagcatcaccctcgccaccgggccacttacgaccctgtgggagggctcgccagggaagttctggaacactacgatcgccgtaagcatggccaatatcttccggggtagctacctcgctggcgcagggctggcgttcagcctgatgaagtccctcggcgggggtcgcagaggaaccggcgcccagggagaaaccctgggggagaaatggaagcggcagctaaaccagctatccaagagcgagttcaacacatataagcggtccggcatcatggaggtagaccgcagcgaggcgaaggaaggactgaagcggggcgagactaccaagcacgccgtgtctcgaggtaccgccaagctgcggtggttcgtcgagcgaaacctcgtcaagccagagggcaaggtgatcgacctgggctgcgggcggggcggctggtcttactactgcgccggactgaagaaggtgacagaagttaagggatacactaagggcggccccgggcatgaggagcccatccctatggctacgtatggctggaacctggtaaagctccactccggcaaggacgtgttcttcatcccgccagagaagtgcgatacccttctgtgcgatatcggcgagagctccccaaacccaacgatcgaggagggaaggactctgcgtgtactaaagatggtcgagccgtggctgcgcgggaaccagttttgtataaaaattttaaacccctacatgccgagcgttgtcgagaccttagagcagatgcagcggaagcacggcgggatgctggtgcgcaaccccctctccagaaatagcacccacgagatgtactgggtgagttgcggcaccggcaacatcgtcagcgccgttaacatgacgagtcgcatgctgttaaaccggttcactatggcccaccgcaagccgacatacgaacgcgacgtcgacctcggcgcaggcacccggcacgtcgccgtggagcccgaagtcgcaaaccttgacatcattgggcagcgcatcgagaacatcaaacacgagcacaagtcaacttggcactacgacgaggacaacccctacaagacgtgggcgtaccatggctcctacgaggtcaagccctccgggtccgcctccagcatggttaatggggtcgttaaactgctgacgaaaccatgggacgttatccctatggttacacagatcgccatgacggatacgacccccttcgggcaacagcgtgtcttcaaggagaaggtcgacactaggacccccaaggcgaaacggggcacggctcaaatcatggaggttacagcgaagtggctatggggcttcctctcccgcaacaagaagccgcgcatctgcaccagagaggagttcacccggaaggttcgctcaaacgccgcaataggtgccgtattcgtcgacgagaaccagtggaactccgcgaaggaggccgtagaggacgagagattctgggatctggtgcaccgcgaacgcgagctgcacaaacagggcaagtgtgccacatgcgtatataacatgatgggcaagcgcgaaaagaaactgggcgagttcggtaaggccaagggctcgcgggccatatggtatatgtggctcggggcgcggttcttggagttcgaggctctggggtttatgaacgaggaccactggttctcccgggagaacagcctctctggtgtcgagggggaaggtctccacaagctggggtacatcctgcgcgacatatcaaaaataccaggcggcaatatgtacgccgacgacaccgccgggtgggacacccggatcaccgaagacgacctgcagaacgaagccaagatcaccgacatcatggagcccgagcatgcgctgctcgccaagtcaatattcaagctaacctaccaaaacaaggttgtccgcgtgcagcggcccgcgaagaatggcactgtaatggatgttatcagcaggcgggaccagcgagggagtggccaggtgggcacctatggtcttaacacgttcaccaacatggaggcccaactaatcagacaaatggagagcgaaggcattttctctccatctgaactggagacccccaacctggccggccgagtgctcgactggctggagaaacacggcgtcgaacgcctgaaacggatggccatttccggggacgactgcgtggtaaaacccatcgacgatcgcttcgctacggccctcaccgctttgaacgatatgggaaaggtcaggaaggacatcccgcaatgggaaccgtcaaagggctggaacgactggcaacaggtgccattttgcagccatcacttccaccagctgatcatgaaggacgggcgcgagatcgtggttccgtgccggaaccaagacgagctcgtgggacgtgcccgggtctcacagggggctggctggagcctgagggaaaccgcctgcctggggaagtcctacgcccagatgtggcagctcatgtacttccaccggcgcgacctgcgcctggctgcgaatgctatctgtagcgcggtcccagtggactgggtccccacctcacgcaccacgtggtctatccacgcccaccaccagtggatgaccaccgaggacatgctaagcgtctggaacagagtatggatcgaagagaatccctggatggaggataagacccatatcagctcctggggcgatgtcccctacctgggaaagagggaggaccagtggtgtgggtcactgatcggcttaacagccagggcgacctgggccaccaacatacaggtagccatcaaccaggtaaggcgtctgatagggaacgagaactacctggactacatgacttcgatgaaacggttcaagaacgagagcgatccggagggagccctctggtga

SEQ ID NO: 24232 - RNA, 9879 nt, synthetic construct
  misc_feature 1..9879: note = derived and/or modified CDS sequence (opt11) from DENV-1__FJ410263__SS-prME
  source 1..9879: mol_type = other RNA
agcgtgaccatgctgctcatgctgatgccgaccgccttggccttccatctaaccactcggggcggagagccacacatgatcgtaagcaagcaagagcgtgggaagagcctattatttaaaaccagcgccggtgtcaacatgtgtacactcatcgcaatggaccttggcgagctgtgcgaagatatcatgacctacaagtgcccgcgcatcacagagacagagcccgacgacgtggactgctggtgcaacgccaccgacacctgggtgacctacggtacttgctctcagaccggagagcacagacgcgacaaacggagcgtcgcccttgcgcctcacgtcggcctggggctggaaacccggactgagacctggatgtcgtctgaaggcgcctggaagcagatccaacgggtcgagacctgggccttgcgccaccccggtttcacggtgattgccttgttcttagcccatgcgataggtaccagcatcacccaaaaggggatcatattcatcctcctgatgctggtgaccccatccatggccatgcgctgcgtcggcatcggctcacgcgactttgttgagggtctcagcggagcgacgtgggtggacgtcgttctggagcacggcagctgcgtgaccactatggccaaggacaagcccacgctggacattgaactcctgaagacagaagtcaccaaccccgccgtattgcggaaattgtgcatcgaggcaaagatctccaacaccactactgatagccggtgcccgacccagggcgaggcaacgctggttgaggaacaggacgctaactttgtttgccggcggacattcgtggaccggggctgggggaacggctgtggtctgtttggcaaagggagcctcatcacgtgcgccaagttcaagtgtgtgactaagctggagggtaagatcgtccaatatgaaaatctgaagtacagcgtgatcgtcaccgtccataccggcgaccagcatcaagtgggaaacgagtccacggaacacggcaccaccgccaccatcacgccccaggctcccacgacggagatccagttaaccgactatggggcgctaaccctggactgcagcccccggacaggccttgacttcaacgaaatggtcctgctgaccatgaaagagaaatcctggttagtgcacaagcaatggttcctggacctgcctctcccctggaccagcggggccagtacgtcccaggagacgtggaaccggcaggacctcttggtgacctttaagacggcacacgccaaaaaacaagaggtcgtggtgttaggctcgcaggagggcgctatgcacacagcactgactggtgcaaccgaaatccagacctcaggcacaaccacaatattcgccggacacctgaaatgccgcctaaagatggataagctgaccctaaagggcatgagctacgtcatgtgcactgggtccttcaagctcgagaaagaggttgccgaaacgcagcacggaacagtgctcgtgcagatcaagtacgagggcactgacgccccctgcaagataccctttagcacccaagatgagaagggggtaacacagaacggccggctgatcactgcgaacccgatcgttaccgacaaggagaagcccgtcaatatcgaagccgaaccgccgttcggagagtcctatatcgttatcggcgccggtgaaaaagcgttgaagttgtcttggttcaagaaagggagctcaatcggcaagatgttcgaggcaaccgcccgcggtgcacggcgcatggccatcctgggggacactgcgtgggacttcggttccataggcggcgtattcacatccgtgggcaagctggttcatcaaatctttggtaccgcctacggggttctgttttccggtgtgtcatggacaatgaagatcggaattggcgtactgctgacgtggctcggcctgaatagtcgcagcactagcctgagcatgacttgcatcgcggtcgggttggttacgctgtatctgggcgtgatggtgcaggccgactccggatgcgtcatcaactggaagggcagagagctcaagtgcgggagcggaatattcgtgactaacgaagtgcatacgtggactgaacagtacaagttccaagccgacagtccgaagcgcctgtcggcggccatagggaaagcctgggaggagggggtctgcggcattcgaagcgccacacgtctggaaaatatcatgtggaaacagatatctaacgaattgaaccatatcctcctggagaacgacatgaagttcaccgtggtagttggggacgtcgccggaatcctcgcgcaaggaaagaagatgatccgaccccaacccatggagtacaaatacagctggaagtcctggggcaaggccaagatcatcggggccgacgttcagaacacaacgtttattatagacgggcctaacacacccgagtgccccgacgaccagcgcgcctggaacatctgggaggtggaggactacggattcgggattttcaccacgaatatttggctgaaactgcgggactcgtacacgcaggtgtgcgatcatcgcctaatgtcggcggccataaaggacagcaaggccgtgcacgccgacatggggtactggatcgagtccgagaaaaacgagacctggaagctggcccgggcaagcttcatagaggtcaagacctgtatttggcccaagagccacacgctgtggtcgaacggcgtgctcgaatctgagatgataataccaaagatctatggaggcccgatcagccagcacaactatagacccgggtactttacccaggccgctggcccctggcatctggggaagctggagttagactttgatctgtgtgaggggaccaccgtcgtggtggacgagcactgcggcaaccgtgggccgtcccttcgcacgactaccgtcaccgggaaaatcattcatgagtggtgttgccggagctgtacgttgccacccctccggttccgcggggaggacggctgctggtatggcatggagatcaggcccgtaaaggagaaggaggagaaccttgtgaagtccatggtgagcgctggcagcggtgaggtagactccttctccttgggtctactgtgcatctcaatcatgatcgaagaggtcatgcgaagccgctggtcccgccgcatgctcatgaccggcaccctggccgtgttcttcctgctcatcatggggcagctgacctggaacgacctgatcaggctttgcatcatggtcggggcgaacgcaagcgatcgcatgggcatgggaacgacgtacctggccctgatggcgacctttaaaatgaggccgatgttcgccgtcggcctcttgttccggcgcctgacctcccgggaagtgctcctcctgacgatcggcctctccttggtcgcgtccgtggaattgcccaattcattagaggagctgggcgatggacttgccatgggcatcatgattcttaaactgctgactgacttccagtcccaccagctgtgggctaccctactgagcctcacatttatcaaaacaaccttttccctccactacgcctggaagaccatggcaatggtcctgagtatcgtgtccctctttcccttgtgcttgtcaaccacgtcccagaagaccacgtggctccccgtcttactggggagcctcgggtgcaagccgctgaccatgttcctcatcgccgaaaacaagatatggggacgcaggtcctggccgttaaacgaggggatcatggccgtaggaattgtgagcatactgctaagctctctccttaaaaatgacgtgcctctggccgggcccctcatagctgggggcatgctgatcgcgtgctacgtcataagcgggtccagtgccgacctgtccctcgagaaggccgcagaggtaagctgggaggaggaggcagagcactccggcgcaagccacaatatcttagtcgaagtccaggatgacggaacgatgaaaatcaaagacgaggagcgcgacgacactctgaccatcctgctgaaggctaccttgctcgccgtatctggggtgtatccgctgagcatcccagccaccctgttcgtttggtatttctggcagaagaagaagcaacggtccggggtgttatgggacacccccagcccccccgaggtggagcgcgccgtgctggacgacggcatatatcggataatgcagagaggcctcctgggtcggagccaagtgggagttggtgtattccaggagaacgtctttcacaccatgtggcatgtgacgcgcggagccgtccttatgtatcagggtaaacgtctagaacccagttgggcatctgtgaagaaggaccttatcagttatggtggggggtggcgtctccaaggaagttggaacaccggggaggaggtacaggttatcgcagtggagcctggtaaaaaccccaagaacgtgcagacggccccggggaccttcaagactcccgagggagaggtgggtgccatcgcgctggacttcaagccggggactagcggctcacccatcgtgaatcgggaggggaagattgtgggcctgtacggaaacggggttgtaacaacgagcggcacctacgtgtcggccatcgcgcaggccaaagcaagtcaggagggccccctcccagagatagaggacgaggtattccgcaagagaaacctgaccatcatggacttacaccccggcagcgggaagacgcggagatacctccccgcgatcgtgcgcgaggccatcaagcgcaaactgaggactctgatcttggcccccacccgcgtcgtagcctccgaaatggcggaggcgctgaagggcatgccaatccggtaccagaccaccgccgtcaagagcgagcacactggcaaagagatagtggacctgatgtgccacgcaaccttcaccatgaggctactcagtccagtccgggtgccaaactataacatgatcattatggacgaggcccacttcacggaccccagctcgatagcggcccgagggtacatctcgacccgggttggcatgggtgaggccgccgccatcttcatgaccgctacaccgcctggctccgtcgaggcattcccccagagcaacgccgtgatccaggacgaagagcgcgacattcccgaacggagctggaactcagggtatgagtggattacagacttccccggtaaaaccgtgtggttcgttccctccataaaaagtggtaacgacatcgccaactgcctgcggaaaaatggaaaacgggtgatccagctaagtcggaagacattcgacaccgaataccaaaagacgaagaacaatgactgggactacgtggtcaccaccgacatcagcgagatgggcgcgaactttcgggccgaccgcgtaatcgacccgcggcgctgcttaaaacccgtgatcctgaaggacgggcccgagcgggtcatcctcgccggccccatgccagtaaccgtcgccagtgccgcacagcgacgggggcggatcggacgcaaccataacaaggaaggtgaccagtacatctacatgggtcagcccctgaacaacgatgaagaccacgcgcactggacggaggctaagatgctcttggacaatatcaacacccccgaaggcatcatacccgctcttttcgaaccggagcgggagaagtccgccgcgatcgacggtgagtatcggctgcgcggcgaggcccgcaaaacctttgtggaactcatgaggcgcggagacctgcccgtgtggctgtcctacaaggtcgctagcgagggcttccaatactcggatcggcgctggtgcttcgatggcgaacggaacaaccaggtcctcgaggagaacatggacgtggaaatatggaccaaagagggagagcgcaagaagctgcggccccgctggctggacgcgaggacatactccgaccccctcgccctgcgcgagttcaaggaattcgcggccggccgaagaagcgtaagtggggacctgattctcgagatcggtaaactgccccaacatctgacccagagggcccagaacgccctcgacaatctggtgatgttacacaactcagaacaaggcggacgagcgtatcggcatgccatggaggagctccccgataccatcgaaactctcatgctgcttgcccttatcgccgtgcttacgggcggggtaacacttttcttcctgtccggtcgcggactgggtaagacgagcatcgggctactgtgcgtgatggcctccagtgtgctactttggatggcctccgtcgaaccccactggatcgccgccagcatcatactggagttcttcctaatggtactcttgatcccagagcccgatcgccaacgcacgccccaggacaaccagctggcctacgtagttattgggctcttgttcatgatccttaccgtggccgcaaatgagatgggtctcctagagactactaagaaagacctgggaataggccatgtcgccgtagaaaaccaccaccatgccgctatgctggatgtggacctccatcctgcttcggcgtggactctttacgccgtagccaccacgatcatcaccccgatgatgcgacataccatcgaaaacaccacggctaacatttctctcaccgccatcgcgaaccaggccgccatcctgatggggctggacaagggctggccgatctccaagatggacattggtgtcccgttgctggccctgggctgttacagccaggtgaaccccttgactctaaccgccgccgtgctgatgctcgtcgcccactacgctatcataggcccggggctgcaggccaaggcgacgcgcgaggcccaaaaacggaccgccgctggcatcatgaaaaaccccaccgtggacgggatcgtggctatagacctggaccccgtagtgtacgacgcgaaattcgaaaagcagctgggacagattatgcttctgatcctctgcacgtcccaaatcctactgatgaggacgacctgggctctctgcgaaagtatcacgctggcaactggccccctgacaaccctctgggaggggtccccgggcaaattctggaatacaaccatcgccgttagcatggcgaacatcttccgcgggagctatctagccggcgccggcctggctttctctctcatgaaatccctcgggggcggcaggcgcggaacgggtgcgcaaggcgagaccctgggtgagaaatggaagaggcagttaaaccagctgagtaaaagcgagttcaacacctacaagcgctccggtatcatggaggtagacaggagcgaggccaaggaaggattaaaacgcggagagacaacgaagcacgccgtttcccgaggcaccgccaagctccgctggttcgttgagaggaacctggtcaaacccgagggtaaggtgatagacctggggtgcggccgaggtggatggtcttactactgtgccggacttaagaaggtgaccgaggtcaaggggtacaccaagggcgggcccggccatgaggagcccatccctatggcgacgtacgggtggaacctagtgaagctgcacagtggaaaagacgtgttcttcatcccgcccgagaagtgcgacacactgctctgcgacatcggggagagctcccccaacccaaccatagaggagggccgaacactgcgggtcctgaagatggtggaaccctggctccggggtaaccagttctgcatcaagatccttaacccgtacatgccctctgtggtcgagacattagagcagatgcagcgcaagcacggcggcatgttagtgcgtaatcccctgtcccgcaatagcacccacgagatgtactgggtgtcttgtgggaccggaaacatcgtcagcgcggtgaacatgacgtcccgcatgctgctcaatcggttcacgatggcccatcgcaagcccacgtacgagcgggacgtagatttaggagcgggcactcgccacgtcgccgtagaacccgaggtagcaaacctggacataattggccagcggatcgagaacatcaagcacgagcacaagagcacctggcactacgacgaggacaacccctataagacctgggcatatcacggttcctacgaggtcaagccttcgggctccgccagcagcatggtgaacggtgtggtcaagctcctgaccaagccctgggatgtgattcccatggtcacccagatagcaatgactgataccacaccgttcgggcagcaacgtgtgttcaaagaaaaggtggacactcggacccccaaggccaagcgcgggaccgcccaaataatggaagtcaccgcgaagtggttgtggggtttcctctcgagaaacaaaaagccccgtatctgcacgcgtgaggaattcacccggaaagtgcggagcaatgcagccattggcgccgtgtttgtcgacgagaaccagtggaattccgcaaaggaggccgtggaggacgaacgcttttgggaccttgtgcatcgggagagggagctgcacaagcaggggaagtgcgcgacatgcgtgtacaatatgatgggcaagcgggagaagaagcttggggaatttggcaaggcgaaaggcagccgcgccatctggtatatgtggctgggcgctcggttcctagagttcgaggccctcggtttcatgaacgaggatcattggtttagccgcgaaaattctctcagcggtgttgagggcgaggggctgcacaagttaggctacattcttagagacatctcgaaaatccccggcggaaacatgtatgccgacgacacggcaggctgggacacccgcatcacggaagacgacctacagaatgaggcgcgtatcaccgacattatggaaccggagcacgcgctcctggctaagtccatcttcaagctgacgtaccagaacaaggtggtacgtgttcagcgccccgccaagaatggtacggtgatggacgtgatcagccggcgcgaccaaaggggctccggccaggtggggacctacggcctaaataccttcacgaacatggaggcccagctgatccgccagatggagtcagagggcatcttctcccccagcgaattggaaacccccaatctcgcagaacgtgttctggactggctggagaagtacggggtcgaacgcctgaaacggatggcgatctcgggggacgactgcgtagtgaagccgatcgacgaccgctttgcaacagctctgacggcactgaacgacatgggtaaagtacggaaggacatcccccagtgggaaccctctaaggggtggaacgactggcaacaagtccccttttgctcccaccacttccatcagctgatcatgaaggacggtcgcgagatcgtggtcccgtgtcggaaccaggacgaactggtgggccgcgcccgggtgagccaaggtgcaggatggtcgttgcgcgagacggcgtgcctcgggaagtcttacgcccaaatgtggcagctgatgtacttccaccggcgcgacctgcggctcgccgcaaacgcaatatgtagcgctgtccccgtggattggatccccacctcacgcaccacctggagcatccacgcccaccaccagtggatgacgaccgaggacatgttgtccgtctggaatcgcgtctggatcgaagaaaacccatggatggaggacaaaactcacatcagctcctggggcgacgtgccttacctggggaagagagaggaccagtggtgcggcagcctcatcggcttgacggcccgggcgacgtgggccaccaacatacaggtcgccataaaccaggtcagacgcctcatcgggaacgagaactacctcgattacatgacctccatgaaacggtttaagaacgagtcggaccccgaaggcgcactgtggtag

SEQ ID NO: 24233 - RNA, 9879 nt, synthetic construct
  misc_feature 1..9879: note = derived and/or modified CDS sequence (opt11) from DENV-1__FJ410264__SS-prME
  source 1..9879: mol_type = other RNA
agtgttaccatgctgctcatgttgatgccaactgccttagccttccacctaaccacccggggcggggagccccacatgatcgtgaccaagcaggaacggggcaaaagcttgctgttcaaaacctctgccggggtgaatatgtgcacgctcatcgcaatggacctgggagagctgtgcgaggacaccatgacctataagtgccccagaatcaccgaagccgagcccgacgacgtggactgctggtgcaacgccacggacacctgggttacctacgggacctgttctcaaacgggggaacacaggcgcgacaagcggagcgtggccctcgctccccacgtgggcctggggctggagacccgcaccgagacatggatgtctagtgagggcgcgtggaagcagatccaacgggtcgagacgtgggccctccgccaccccgggttcaccgtgatcgccctgttcctcgcgcacgccataggcaccagcatcacacagaaggggatcattttcatcctactgatgctggtgacgccctctatggccatgaggtgcgtcggcatcggctccagggacttcgtggaaggtttgagcggtgcgacctgggtggatgtagtgctggagcatgggtcttgtgtgaccaccatggccaaggacaagcctacgttagacatcgagctcctgaagaccgaggtcaccaaccccgcggtgctgcggaagctttgcatcgaggccaagatttctaacaccacgaccgactcccgctgccctacccaaggagaggcaaccctgatggaggaacaggatgccaacttcgtgtgccggcgtacctttgtcgaccggggctggggtaacggctgcggtctgttcggcaaggggagtcttatcacatgcgccaagtttaagtgcgtgacgaagctcgaaggcaagattgtgcagtatgagaacctgaagtactccgtcatagtgaccgtgcacacgggcgatcagcaccaggtcgggaacgagagcaccgagcatgggaccaccgccaccatcacgccccaggcccccaccagtgagatccaactcaccgattacggcgccctgacgctcgactgcagcccccggacgggcctcgatttcaacgagatggtgctgctgaccatgaaagagaagtcctggctcgtgcacaaacagtggttcctggatctgccgctaccttggaccagcggggcgagcacgagtcaggagacgtggaaccgccaggacctgctggtgaccttcaaaaccgcccatgctaagaagcaggaggtggtcgtgctcggcagccaggagggtgccatgcacactgccctgacgggggccaccgagatccagaccagtggcaccacgaccatattcgccgggcacttaaaatgccgactcaagatggacaagttaaccctcaagggcatgtcttacgtgatgtgtaccggcagtttcaagttggagaaggaggtcgccgagacgcagcacggcaccgtcttggtgcagatcaagtacgagggcaccgatgccccctgcaaaatcccgttctccacccaggacgagaagggggtcatccagaacggccggctgatcacggccaatccgatcgtgaccgacaaggagaagcccgtgaacatcgaggcggaaccgcccttcggagagtcctacatcgtaataggcgcaggcgagaaggcgctgaagctctcatggttcaagaaggggtcctctataggcaagatgttcgaggccaccgcccgaggggcccggcgcatggctatcctgggcgacacggcctgggacttcgggagtgttggcggtgtattcacgagcgtcgggaagcttgtgcaccagattttcggcaccgcctacggggtcctgttctccggggtaagctggaccatgaagattgggatcggcgttctgctgacctggctcggcctcaactcacgaagcacgtccctgtcaatgacatgcatcgccgtggggctcgtcaccctttacctcggcgtgatggtccaggccgattccgggtgcgtcatcaactggaagggccgggagctcaagtgtgggagcggcatctttgtgaccaacgaggtgcacacgtggaccgaacagtacaagttccaggcggacagcccgaagcgcctatccgccgccatcgggaaggcttgggaggagggtgtatgcggcatccggagcgccactcgcttggagaatatcatgtggaagcagatatccaacgagctcaaccatatcctcctggagaacgacatgaagttcaccgtggtggtcggggacgtcgtgggcatcctcgcgcaggggaagaaaatgatccggcctcagcccatggagcacaaatacagctggaagtcctggggcaaggccaagatcatcggcgccgatgtccagaacaccacgttcatcatcgacgggcccaacaccccggagtgtccggacgaccagagggcatggaacatctgggaggtggaggattacggctttgggatcttcaccaccaacatctggctcaagctgcgagactcctacacccaagtgtgcgaccaccgcctcatgtccgcggcgatcaaggacagcaaggccgtccatgccgatatgggctactggatcgaatcagagaagaacgagacctggaagttagcccgggcgtcctttattgaagtgaagacatgcatttggcccaagtcccataccctgtggagcaacggcgtgttagagtccgagatgatcatccccaaaatctacgggggtccgataagccagcacaattatcgccccgggtactttacgcagaccgccggcccctggcacttggggaaactggagctcgatttcgacctgtgcgagggcaccaccgtagtggtggacgagcactgcggcaatcgagggccgtccctgcgcacgaccaccgtcaccggtaaaatcatccacgagtggtgctgccggtcatgcaccctgccacccctccgctttaagggggaggacggctgctggtacgggatggaaatccggcccgtgaaagagaaggaggaaaatctggtgaagtcaatggtcagcgccggcagcggcgaggtagacagtttcagcctgggtcttctttgcatctccataatgattgaggaagtgatgcgcagccggtggtcccgaaaaatgctaatgaccgggacgctggccgtcttcctgctactgatcatggggcagctgacctggaacgacctcatccggctgtgtatcatggtaggtgcaaatgcgagcgaccgcatggggatggggacgacctacctggcgctcatggcaaccttcaagatgaggccgatgttcgcggtggggctgctgttccggcgcctgacttcccgtgaggtcctgcttctcacaatcgggctgagcctcgttgcctccgtcgagctccccaatagcctagaggagctgggcgacgggctcgctatgggcatcatgatcctgaagctgctcaccgacttccaatcccatcaactgtgggccaccctgctcagcttaaccttcatcaagacgaccctgtctcttcactatgcatggaagaccatggccatggtactgtcgattgtgtcactattccccctctgcctgagcaccacgtcccagaagaccacctggctgcccgtcttactgggcagcctgggttgcaagccgctcacgatgttcctcatcactgagaacaagatctggggacgcaagtcttggcccctgaacgaagggatcatggcggtgggcgtggtcagcatcctcctttcatccctgctcaagaacgacgtgccactggccggtcccctgatcgccggcggcatgctcatcgcctgctacgttatcagcgggtccagcgcagacctgtccctcgagaaggcggccgaggtcagctgggaagaggaagctgagcactcgggcgccagccataacattctcgtagaggtgcaggacgacgggactatgaagatcaaggacgaggagcgggacgacaccctgaccattctgctaaaggccaccctactggcggtctcgggcgtgtacccgctaagcatacccgccactttatttgtctggtatttctggcagaagaagaagcaacgctccggggtcctgtgggacaccccctccccgcccgaggtggaacgggccgtgctggacgacggtatctaccgcatcatgcaacggggcctcctgggccgttcccaagtcggtgtgggggtgttccaggagaatgtcttccacacgatgtggcacgtgacccggggcgccgtactgatgtaccaggggaagcgcctagagcccagctgggcctccgtcaagaaggacctgatcagctatggcggcgggtggcggcttcagggctcttggaatacgggggaggaggtccaggtgattgcggtcgagcccggcaagaatcccaagaacgtgcagaccgcccccgggaccttcaagacccccgagggcgaggtcggcgccatcgccctcgacttcaaacctggtacgagcggctcccccatcgtcaaccgggaggggaagattgtgggcttatatggcaacggggtggtaacgaccagcggcacctatgtgagcgctatcgcccaggcaaaggcctcccaggaggggccgctgccggaaattgaggacgaggtgttccggaagcgcaacctcacgatcatggacctgcacccgggcagcgggaagacccggcgctacctaccggccatcgtccgggaggcaataaagcgcaaactcaggactctgatcctggcccccacccgcgtggtggcctccgagatggccgaagccctcaagggcatgcccatccgctatcagactaccgcggtaaagtcggagcacaccggcaaggagatcgtggacctgatgtgccacgctacattcacaatgcggctgctcagtcccgtgagggtcccgaactacaacatgatcataatggacgaggcccacttcaccgaccccagctccatcgccgcccgggggtacatctccacccgcgtgggcatgggggaggcagccgccatattcatgaccgccacgccgcccggctccgtggaggccttcccgcagagcaatgcggtcatccaggacgaggagcgggacatccccgagcgcagttggaactcagggtacgagtggatcacagacttccccgggaagaccgtttggttcgtgccgtccataaagagcggcaacgacatcgccaactgcctccggaagaacgggaagcgcgtcatccagctgtcgcggaagaccttcgacactgagtaccagaagaccaagaataacgactgggattacgtggtgaccaccgacatcagcgagatgggggccaatttccgcgcggaccgggtcatcgatccgcggcggtgcctcaagcccgtgatcctgaaggacgggcccgagcgcgtgatactggcgggcccaatgccggtgacggtggcctccgccgcacagcggcgtgggcggatcggccgcaaccacaacaaggagggcgaccagtacatttacatggggcagcccttaaacaatgacgaggaccacgcgcactggacagaggcgaagatgctgctggacaacatcaatacacccgagggcatcatccctgcccttttcgaaccggagcgggagaagtccgccgccatcgacggtgaataccgccttcgcggcgaggcccgtaagaccttcgtagagctgatgcgccgaggggacctccccgtgtggctctcctacaaggtagcgagcgagggattccagtactctgacagacggtggtgctttgacggcgagcgcaacaaccaagtcctggaagagaacatggacgtcgagatctggacgaaggagggggagcggaagaaactccgcccccggtggctggatgcccgcacctactccgaccccctggcactccgggagttcaaggagtttgccgccggccgcagaagcgtctccggggacctgatccttgagatcggcaagctccctcagcacctgacgcaacgcgcgcaaaacgccctagacaacctcgtcatgttgcataactcggagcagggcgggcgggcgtaccgccacgccatggaggagctacccgacacaatcgagacgctcatgctgctagcgctaatcgccgtgctgaccggaggggtgacgctgttctttctctccggccgcgggctgggaaaaaccagcatcgggcttctctgcgtcatggcgtccagcgtgcttctctggatggcctccgtggaacctcactggatcgcggccagcatcatcctcgagtttttccttatggtattgctaattcccgagccggaccgccagcggacgccccaggacaaccaactggcctacgtggtgatcggtctgttgttcatgatcctgacggtcgccgccaacgagatgggccttctcgagaccaccaagaaggacctgggtataggacacgtggccgtcgagaaccaccaccacgctaccatgctggacgtagacctccaccccgcttcggcctggacactgtacgctgtggccaccaccatcatcacacctatgatgagacacacgatcgaaaacacgaccgcgaacatcagcctaaccgctatagcaaaccaggccgctatcctcatggggctggacaagggctggcccatctccaagatggacatcggcgtgcccttactcgcgctggggtgctattcgcaggtcaatcccctgacgttgaccgccgccgtactgatgctggtggcgcactatgcgatcataggcccggggctccaggccaaggccaccagagaggcccagaagcgcaccgccgcgggcatcatgaagaatcccacggtggacgggatcgttgctatcgacctggaccccgtcgtctatgacgcaaagttcgagaaacaactgggccagatcatgctcctgatcctgtgcacctcccaaatcctcttgatgcgcacgacctgggccttatgtgagagcatcacgcttgccacgggccccctgaccacgctttgggagggttcccctggcaagttctggaacacgaccatcgcggtgagcatggccaacatattccgggggtcctacctcgccggcgccggcctcgcattctcgcttatgaagtcccttgggggcggtcgccggggcaccggggcccaaggggagaccctgggcgagaagtggaagcgtcagctgaatcagctatccaagtccgaattcaacatctacaaacggtccgggatcatggaagtggatagaagcgaggccaaagaaggcctgaagcgcggggagacgactcgccatgcagtctcccggggcaccgccaagctgcgctggtttgtcgagcgaaatctggttaagccagaggggaaggtcatcgatctcggttgcggccgggggggatggtcttactactgtgcggggctgaagaaggtgaccgaggtgaaggggtacacgaagggcggccccggccacgaggagcccataccgatggcaacctacggttggaacctggtcaagctccacagtggtaaggacgtgtttttcactccccccgaaaagtgcgacaccctcctctgcgacatcggggagagctcgcccaaccctacgatcgaggagggccggaccctccgcgtgctgaagatggtcgagccttggctgagggggaaccaattctgcatcaagattctcaacccctatatgcccagcgtggtggaaactctggaacaaatgcaacgcaagcacggcggcatgctcgtacggaaccctctctccagaaacagcacccacgaaatgtactgggtttcatgcgggactggcaacatagtgagcgccgtcaacatgacatcacggatgctgctgaatcgctttaccatggcccaccgcaaacccacctacgaaagggacgtggacctcggggctggcacccgccacgtcgcggtcgagcccgaggtggcgaacctggacatcatcggccaacggatcgagaacatcaagcacgaacacaaaagcacgtggcactacgacgaggacaacccttacaagacctgggcctatcacggttcctacgaggtcaagccgagcgggtccgccagcagcatggtaaacggggtggtcaagttattgaccaagccctgggacgttattcccatggtaacccaaatcgccatgacagacaccacccccttcggccagcagcgggtcttcaaggagaaggtggacacgcggacgcctaaagcgaagcgcgggacggcccagatcatggaagtgaccgctcggtggctgtggggcttcctgtctcgcaacaagaagccccggatctgcacccgcgaggagttcactcgaaaggtccgcagcaacgctgctatcggtgctgtattcgtggacgagaaccagtggaactccgcaaaggaagccgtcgaggacgagcgcttctgggacctcgtgcagaaagagcgcgaactgcacaagcaggggaagtgcgcgacctgcgtgtacaatatgatgggtaagcgagagaaaaaactgggagagttcggcaaggcaaaggggagccgcgctatctggtacatgtggctaggcgcccggttcctggagttcgaggcactgggcttcatgaacgaggaccactggttctcccgcgagaacagcctctccggggtcgagggagagggccttcacaaattgggctatatcctccgggacatcagcaagataccgggagggaacatgtacgccgacgacaccgcgggctgggacacccgcatcacggaggatgatctgcagaacgaggcaaagatcaccgacatcatggagcccgaacatgcactgctcgccacgtcaatctttaagctgacctaccaaaacaaggtggtgcgggtccagcgcccggccaagaacgggacggtgatggacgtgattagccgccgggaccagcgcggctccgggcaggttggtacatatggcctgaatacattcacaaacatggaggcgcagctcatcaggcagatggagagcgaggggatctttcttccatccgagcttgagacccccaacctcgccgagcgcgtgctggactggctagagaaatatggtgtggagcggctcaagagaatggccattagcggtgacgactgcgtcgtcaagccgatcgacgaccggttcgccacagccctaactgcgctgaacgacatgggcaaggtgcgcaaggacatcccccagtgggaaccatccaaggggtggaacgattggcagcaggtccctttctgcagccaccatttccaccagttgatcatgaaagacggccgtgagatcgtggtgccgtgccgaaaccaggacgagctggttggtcgagctcgcgtgtctcagggggcgggctggagcttacgggagaccgcctgcctcggcaagagctacgctcagatgtggcagttaatgtacttccacaggcgggacctgcgcctcgcggccaacgccatctgctccgccgtacccgtcgattgggtgcccacgagccgaaccacctggagcatccacgcgcaccaccagtggatgaccacggaggacatgctgagcgtgtggaaccgcgtctggatcgaggaaaatccctggatggaggacaagacccacgtgtccagctggggcgatgtgccgtacctggggaagcgggaggaccaatggtgcggctccctcatcggcctaaccgcccgcgccacatgggccagcaacatacaggttgcgatcaaccaggttagacgcctgatcgggaacgagaattacctcgactacatgacctccatgaagaggttcaaaaacgaaggagaccccgagggcgcactgtggtga

SEQ ID NO: 24234 - RNA, 9879 nt, synthetic construct
  misc_feature 1..9879: note = derived and/or modified CDS sequence (opt11) from DENV-1__FJ410265__SS-prME
  source 1..9879: mol_type = other RNA
agcgtgaccatgctgctcatgttaatgcctaccgccctagccttccacctcaccacacggggtggggagccccatatgatcgtgagcaaacaggagcgtggcaagagcttattattcaaaaccagcgccggggtgaacatgtgcaccttgatcgccatggatctgggcgagctgtgcgaggataccatgacatataagtgtccacgcatcacagagaccgagcccgacgacgtggactgctggtgcaacgcgacggacacctgggtcacctatgggacctgcagccagacgggcgagcatcggcgcgacaagcggtccgtggccctcgcgcctcatgtgggcctcgggctggagacccgcaccgaaacttggatgagctccgaaggcgcatggaagcaaattcagcgggtcgagacgtgggccctcagacaccccgggtttactgtgatcgccctcttcctggcccacgcgattggcaccagcatcacccagaaggggatcatcttcattctcttaatgttagttaccccctccatggccatgcgctgcgtcggcatcggcagccgggactttgtggaggggctctccggagccacctgggtggatgtcgtgctggaacacggtagttgcgtgaccaccatggcgaaggacaagcccacgctggacatcgagctcttgaagacggaggttaccaaccccgccgtgctgcggaagctctgtatcgaggcgaagatctcgaacactactaccgactcccgctgtccgacccaaggagaggccaccctggtagaggagcaggacgccaactttgtctgccgacgcacgttcgtggaccggggatgggggaacggctgcgggctgttcggcaaagggtccctcatcacgtgcgcgaagttcaaatgcgttacaaagctggaggggaagatcgtacaatacgagaacctcaagtacagtgtgatcgtgacagtccacacgggcgaccagcaccaggtggggaacgagtccaccgagcacggcaccacagccaccattacgccccaagcccccaccaccgagatccagctcacagactacggggccctgacgctagactgtagcccacgcaccggccttgacttcaacgagatggtcctgctgaccatgaaggagaagtcctggttggtccacaagcagtggttcctggatctgcctctcccctggaccagcggggccagcacgtcccaggaaacatggaaccggcaggacctgttggttactttcaaaaccgcccacgccaagaagcaggaggtagtggtgctcggctcgcaggaaggcgcgatgcacacggccctcaccggtgcgaccgagatacagacgtccggcacgaccaccatatttgcagggcacctgaagtgccgtctcaagatggacaagctgaccctgaaaggcatgagctacgtcatgtgcacggggtccttcaagctcgagaaggaggtggcagagacccagcatgggaccgtgctggtccaaataaagtatgagggcaccgacgcgccctgcaagatcccgttctcaacgcaggacgagaaaggggttacccagaacggtcggctgatcaccgccaaccccatcgtgacagacaaggaaaagcccgtcaacatcgaggcagagccaccattcggcgagtcctacatcgtgatcggcgccggcgagaaggccctgaagctcagctggttcaaaaaggggtcgagcatcggcaagatgttcgaggccacggcccgcggggcgcggcgcatggctatcctaggcgacaccgcgtgggatttcggctccataggcggcgtgttcacaagcgtcggaaagttggtgcaccagatatttggaaccgcctatggggtgctcttctccggcgtctcctggacgatgaagatcggaatcggcgtgttgttgacctggctcggcctgaactcccgtagcacctcactgagcatgacatgcatcgccgtgggtctcgtgaccctgtacctgggcgtgatggtgcaggctgactccgggtgcgtgatcaactggaagggccgggagctcaagtgcgggagcggcattttcgtgaccaacgaagtccacacctggaccgagcagtacaaattccaggccgatagcccaaagcgcctgtccgcggccatcggcaaggcttgggaggagggggtttgcggtattcggagcgccacccgtttggagaacatcatgtggaagcagatctccaacgagctcaatcacatcctgctagagaacgatatgaagttcacggtggtggtcggggacgtagccggcattctagcgcaaggcaagaagatgatccggccccagcccatggagtataaatacagctggaagagctggggtaaggcaaagattatcggagccgacgtgcagaacactaccttcatcatcgatgggcccaacaccccggagtgccccgacgatcaacgcgcctggaatatctgggaagtcgaagattacggattcgggatctttacaacgaacatttggctgaaactgcgggacagctacacacaggtgtgtgaccaccgcctcatgtctgcggccatcaaggacagcaaggctgttcatgccgatatgggctactggatcgaaagcgagaagaacgaaacatggaagctagcccgggcgagtttcatcgaggtcaagacgtgcatctggcctaaatcacacaccttgtggagcaacggcgtcctcgagtccgagatgatcattcccaagatatacggcggtccgattagtcaacataattaccgccccgggtatttcacccaagccgccggcccctggcatctggggaagctagaactcgacttcgatctgtgcgagggcaccacggtggtagtggacgagcactgtgggaatagaggaccgtccctgcgcacgaccacagtgacgggcaaaatcatccatgagtggtgttgccggagttgcactctgccccccctccgcttccgcggtgaggacggctgctggtacgggatggagattagacctgttaaggagaaagaagagaatctggttaaatccatggtgtccgccggcagcggagaagtcgatagcttctctctcgggctcctgtgtaccagtataatgatcgaagaggtgatgcgcagccgctggtcccgaaggatgttaatgaccgggacgttggccgtcttcttcctactaatcatggggcagcttacttggaacgacctgatccgcctctgcataatggtaggcgctaacgccagcgacaggatggggatggggacaacatacctggcgctgatggccacgttcaaaatgcgcccgatgttcgccgtgggcctcctgttccggcgcctgacctcccgcgaggtgctcctgcttaccatcgggctatcgctggttgcgtccgtggagctgcccaacagccttgaggagctaggcgatgggctggccatgggcatcatgattctaaagctcttgaccgacttccagtcccatcagctttgggcgacactgttaagtttgacgttcattaagaccaccttttccctgcattacgcctggaagactatggcgatggtgctgagtatcgtgtccctctttccgctgtgtttaagcaccacctcccagaagaccacgtggctccccgtcctgctggggagcctcgggtgcaagccgctgaccatgttcctgatcgccgagaacaagatttggggacgccggagttggcccctcaacgaggggattatggccgtcggcatcgtgagcatcctgctgtctagtctcctgaagaacgacgtccccctcgccggtcccctcatagccggcggcatgctgatcgcgtgttacgtcatctcagggtcaagcgctgacctgtctctcgagaaggccgccgaggtgtcatgggaagaggaagccgaacactccggcgccagccacaacatactagtggaagtccaggacgacggaaccatgaagatcaaggatgaggagcgcgacgacactctgaccattctcctgaaggccacgctgctcgctgtgtccggcgtgtacccgctgagcatccccgctaccctgtttgtgtggtacttctggcagaaaaagaagcagaggtccggtgtgctctgggacacacccagccctccggaggtggaacgcgccgtacttgacgatggcatttacaggatcatgcagcggggcctgttaggacggtcccaggtgggcgtgggggtattccaggagaacgtgttccacaccatgtggcacgtgacgcgtggtgcggtcttgatgtaccaggggaagcggctggagccctcctgggcgagtgtgaagaaggacctgatcagctacggaggcggttggcgcctccagggcagctggaacaccggcgaggaagtgcaggtcatcgccgttgaacccggcaagaaccccaagaacgtgcaaaccgccccggggaccttcaagactcccgagggtgaggtgggcgctattgctctggacttcaaacccgggacaagtggctcccccatcgtgaaccgggaggggaagattgtgggcctgtacggtaacggagtcgtgaccaccagcggcacgtacgtgagcgcaatagcacaggccaaggcgtcccaggaggggccgctcccggagatcgaggacgaggtctttcgcaagaggaacctgaccatcatggatctgcacccgggctcggggaagacccgccgctacttgccggctatcgtgagggaggccatcaagcgcaaactgcggactctgatcttagcacccactagggtggtcgcatccgaaatggcggaggccttaaaaggaatgcccatccgataccagaccaccgcggtcaaatcagaacacacaggcaaggagattgtggacctgatgtgccacgcaacgttcaccatgaggttactgtcccctgtgagggtgccaaactacaacatgattatcatggacgaggctcacttcaccgaccccagctccatagcggcccggggctacatcagcacccgtgtgggcatgggggaggccgccgcgatcttcatgacggcgactccgcccggctccgtcgaagccttcccgcagtcaaatgcagtcatccaggacgaggagcgcgacatcccagagcggtcctggaacagcgggtacgagtggataaccgatttccccggcaaaacagtgtggttcgtcccctcgatcaagagcggcaacgacatcgccaactgcctgcgcaaaaacgggaagcgggtgatccagctctctaggaagacgtttgacaccgagtaccagaagaccaagaataatgactgggactacgtagtcaccacggacatcagcgaaatgggcgcaaatttccgggccgaccgcgtgatcgacccgcggcgatgcctgaagcccgtgatcctgaaagatggtccggagcgggttatcttggccggccctatgcccgtgaccgtcgcctccgcggcgcagcgccggggcagaatcggtcggaatcacaacaaggagggcgaccagtacatctacatggggcaacccctgaacaacgacgaggatcacgcacactggaccgaggccaagatgctgctagacaacattaacacccccgagggcatcattccagccctgtttgaaccggagcgggagaagtccgcagcgatcgacggggagtatagactgaggggagaggcacgcaagacattcgtggagctcatgcggagaggggacctgcccgtgtggctgtcctacaaggtcgccagcgaaggcttccagtactcggaccgccgctggtgcttcgacggcgagcggaacaaccaggtgctcgaagagaacatggatgtggagatctggactaaggagggcgagcgcaaaaaattgcggccccgatggctggacgcgcggacctactccgatcccttggctctccgcgagttcaaggaattcgccgccggcaggcgatctgtctccggtgatctgatcctcgagatcggcaagctgccgcagcatctgacccagcgggcgcaaaacgccttagataacctggtgatgcttcacaactcagaacagggtgggcgcgcgtacaggcacgccatggaggaactccccgacacgatagagaccctgatgctcctcgccctgatagccgttctgaccggcggggtcaccctcttcttcctgtccgggcggggactgggcaagacaagcatcggcctcctgtgcgtgatggcctccagcgtactgttgtggatggcgtctgtcgagccccactggatcgccgcctctatcatcctggaatttttcctgatggtgctcctgatccccgagccggaccggcagcgcacgccccaagataaccagctggcctacgtggtgatcgggctccttttcatgatattaactgtagccgccaacgaaatgggcctcctagagaccaccaagaaggatctggggatcggccacgtcgccgtcgagaatcaccatcatgccgccatgctcgacgtggatctgcaccccgcctctgcgtggacgctgtacgccgtggccacaaccatcataaccccgatgatgcggcacacgatcgaaaacactaccgccaacattagcctcaccgccatcgcgaatcaggccgccatcttgatggggctggataaggggtggcccatctccaagatggacatcggcgtccccctcctggcattagggtgctacagccaggtgaatcccttaacgctgaccgcggcagtactgatgctagtcgcccactatgccattatcggcccgggtctgcaggccaaggctacccgggaggcccagaagcgtaccgccgctggcatcatgaagaaccccacggtggatggaatcgtggctatcgacctggaccctgtcgtgtacgacgcgaagttcgagaaacagctcggccagattatgttactgattctgtgcaccagccaaatcctgctaatgcggacaacctgggccctatgcgagtcaatcacgctggctactggccccttaaccacgctctgggaggggtcgccgggaaaattctggaacaccaccatcgccgtcagcatggcaaacatctttagagggtcctacctggcgggcgccggcctggccttcagtttgatgaagtccctcggaggcgggaggcggggaaccggcgcccagggcgagacactaggcgagaagtggaaacggcagttaaaccagctgtcgaagagcgagtttaacacctacaagcgctccgggatcatggaagtagaccgatcagaagcaaaggagggcctgaagcgcggggagacaaccaagcacgccgtttcccggggcactgccaagctccgctggtttgtggagcggaacctggtcaagccagagggtaaggtgatcgatctgggctgcggccgcgggggctggtcgtactactgcgctggacttaagaaggtgaccgaggtcaaaggttacacgaagggcggaccgggccacgaggagccaatccccatggccacctacgggtggaacctcgtgaaattacactccggcaaggacgtcttcttcatcccgcccgagaagtgcgacaccttactctgcgacatcggggaatcctcgcccaatccaaccatcgaggagggccggactcttcgcgtcctgaagatggttgagccctggctccgggggaatcaattctgcatcaagatattaaacccctacatgccgagcgtggtggagaccctggaacagatgcagcgcaagcacggtggaatgctcgtgcggaacccgctaagtcgcaactccacccatgagatgtactgggtgtcctgtggaactggcaacattgttagcgcggtgaatatgacgtcccgcatgctgctcaaccgtttcaccatggcgcaccggaagcccacctacgaacgggacgtggacctaggcgccgggacccgccacgtagccgtggagcctgaggttgccaacttagacatcatcggacagcggatcgagaacatcaagcatgagcacaagagcacgtggcactatgacgaggacaacccctacaagacttgggcctaccacgggtcctatgaggtcaaaccgagcggctccgcgtcaagcatggtgaacggggtcgtgaagctgttgaccaagccatgggacgtgataccgatggttacccagatagccatgacagataccaccccgtttggccaacagcgcgtattcaaagagaaggtggatacccggacgccgaaggctaagagagggaccgcccagatcatggaggtcaccgccaagtggttatggggctttctctcccggaacaagaagccccgcatctgcacccgagaggagttcactcgcaaggtgcggagcaacgccgccatcggagccgtgttcgttgacgagaatcagtggaactccgcgaaggaggccgttgaagacgagcgcttctgggatttagtacaccgggagcgtgagctgcacaagcaggggaagtgcgcgacctgcgtctacaacatgatgggcaaacgggagaagaaactcggggagttcggcaaggcgaaggggtcgcgcgccatctggtacatgtggctcggagcgcggttcctggagttcgaggcgttaggcttcatgaacgaggaccactggttctcgagagagaacagcctgtccggggtcgaaggcgagggtctccacaagctcggctacatcttgcgggatatcagcaaaatccccgggggcaacatgtacgcggacgacacagccggctgggatacccggataactgaggacgacctgcagaacgaggccaagattaccgacatcatggagccggagcacgcgctcctagctaagtccatattcaagcttacctaccaaaacaaggtggtccgcgtgcagcggcctgccaagaatgggaccgtgatggatgtcatcagccgccgggaccagcgcggctcgggccaggtggggacctacggcctcaacaccttcaccaacatggaagcccagctgatccggcagatggagagcgaagggatcttctcccccagcgagcttgagacgccgaacctcgcggagcgcgcgctggactggctggagaagtacggcgtggagcggctcaagcgtatggccatctccggtgacgattgcgtcgtgaaaccgatcgacgaccgtttcgcaacggccctgaccgccctgaacgatatggggaaagtccgcaaggatatcccccagtgggagcccagcaagggttggaacgactggcagcaagtacctttctgctcccaccacttccaccagctcattatgaaggacggccgggagatcgtggtgccgtgcagaaaccaagatgagctggtggggcgggcacgcgttagccagggagccggatggagcctgagagagaccgcctgcctcgggaagtcctacgcccagatgtggcagctgatgtacttccatcgccgggacctacgcctcgcggccaatgcaatctgttcagccgtccccgtcgactggatccccacatcccgaacaacctggagcattcacgctcaccatcagtggatgaccacagaggacatgctttccgtttggaaccgcgtgtggatcgaagagaatccctggatggaagacaaaacgcacatcagctcctggggcgatgtcccgtacctagggaagcgcgaggaccagtggtgcggcagcctcatcggcctgaccgcgcgggctacctgggcaaccaatatccaggtggccataaaccaagtgcgccggctgatcgggaacgagaattatctcgactacatgacctccatgaaacgctttaagaacgagagcgaccccgaaggcgcactgtggtga

SEQ ID NO: 24235 - RNA, 9879 nt, synthetic construct
  misc_feature 1..9879: note = derived and/or modified CDS sequence (opt11) from DENV-1__FJ461336__SS-prME
  source 1..9879: mol_type = other RNA
agcgttaccatgctgctcatgctcatgcctacagcactggccttccacttgaccacccggggtggggagcctcacatgatcgtgagcaaacaagagcgggggaagagcctgctgttcaagaccagcgccggggtgaacatgtgcacgttgattgccatggacctgggagagctgtgcgaggacaccatgacctacaaatgtccccgcataaccgaaaccgagcccgacgacgtggactgctggtgcaacgcgacagacacgtgggtgacctacggtacctgttcacaaacgggtgagcaccggcgcgacaagcggtccgtagccctcgctcctcatgtgggactgggactggaaacgcgcaccgagacctggatgagctctgagggcgcgtggaagcaaatccagagggtcgagacgtgggcgctccgccaccccgggttcaccgtgatagccctctttctggcacacgcaattggcaccagcatcacccagaaggggatcatcttcatcctcctgatgctggtgacgcccagcatggctatgcgctgcgtcggcatcggcaaccgcgatttcgtggaggggctatcaggcgccacctgggttgacgtcgtgctggagcacggatcctgcgtgactaccatggccaaggataagccgacgctggatatcgagctcctcaagaccgaggtcacaaaccccgccgtgcttcgtaagttgtgcatcgaggcgaagatctctaacaccactaccgactcccgctgcccgactcagggcgaggccaccctcgtggaggaacaggacgccaactttgtttgccggcgcacgtttgtggaccggggttggggaaacggctgcgggctgtttggcaaggggtccctcatcacgtgcgccaagttcaagtgcgtgacaaagctcgagggaaagatcgtccagtacgagaacctaaagtattccgtgatcgtgactgttcatacgggcgaccaacaccaagttgggaacgagtctacagagcacggcaccaccgctaccatcacgccgcaggcgcccaccacagaaatccagctcactgactacggggcactgacgctggactgtagcccccggaccggcctggacttcaacgagatggtgctgctgaccatgaaggagaaatcctggctcgtgcacaagcagtggttcctggacctccccctcccttggacctccggggcctccaccagccaggagacctggaaccggcaggacctgctggtgaccttcaagaccgcccacgccaagaagcaggaggtcgtagtgctcggctcacaagagggtgcgatgcacactgccctgaccggcgccaccgagatccaaaccagcggcacgacaacaatcttcgccggacacctgaagtgccgcctcaagatggacaagctgaccctgaagggtatgtcttacgttatgtgtacggggtctttcaaactcgaaaaggaagtggcggagacccagcatggcacagttctggtccagatcaagtacgagggaaccgacgcaccctgcaaaatccccttttccacgcaggacgagaaaggggtgacccagaacggccggctcatcactgccaacccgatcgtgactgacaaggagaaaccagtaaacatcgaggccgagccgcccttcggggaatcgtacatcgtgattggcgccggagagaaagccctgaagctatcctggttcaagaagggaagttcgatcggcaaaatgttcgaggcgacggcccggggggccagacgcatggctatcctgggcgacaccgcatgggacttcggaagcatcggcggagtgctgacctccgtcgggaagttagtgcaccagatcttcggcacggcctatggggtgttattctccggcgtctcctggaccatgaagatcgggatcggcgtgttgctcacctggctgggcctgaacagccgcagcaccagcctctcaatgacttgcatcgccgtggggctagtcaccctgtatttaggggtgatggtgcaggcagactccgggtgcgtcatcaactggaagggccgggagctgaagtgcggctccggcatcttcgtgaccaacgaagtgcacacatggaccgagcaatacaagttccaggctgacagccctaagcgactgagcgcggccattggcaaggcttgggaggaaggagtctgcggcatccggtccgctacccgcttagagaacatcatgtggaagcagatcagcaacgagctgaaccacatcctgctcgagaacgacatgaagttcaccgtggtggtgggcgatgtcgccggcatcctggcgcaggggaagaagatgatccggccacagcccatggagtacaagtactcctggaagtcctggggcaaggccaaaatcatcggcgccgacgtacagaataccaccttcataatcgacggtcccaacaccccggagtgccccgacgaccagcgcgcctggaatatttgggaggtcgaggactacggcttcgggattttcacgactaacatttggttaaagctccgggattcctatacacaggtgtgcgatcatcgcctgatgagcgcagcaatcaaggactccaaggctgtgcacgcagacatgggctattggatcgagagcgaaaagaatgaaacctggaagttagcccgggcgtccttcatcgaagtgaagacgtgcatctggcccaagagccacaccttatggtccaatggcgtgctggagagcgagatgatcattcccaagatctacggggggccgatttcccagcacaactaccgccctggttacttcacccaaaccgcggggccctggcacctggggaagctcgagctggatttcgacctctgcgagggcaccaccgtggtcgtggacgaacactgcgggaaccggggtcctagcctccgtaccacaacagtgaccggtaagatcatccacgaatggtgctgccgctcctgcacgctgccgccgctgcgcttcaggggggaggacggctgctggtatgggatggagatccgccccgttaaggagaaggaagagaacctagtcaagtctatggtgtccgcaggcagcggggaggtagactctttctcgttagggctgctctgcatcagcattatgatcgaggaggtgatgaggtctcgctggagccggaagatgttaatgaccggcacactggccgtgttcttcttgctgatcatgggccagctgacctggaacgacctcatccgcctttgtattatggtcggcgccaacgcgtccgaccgcatggggatgggcaccacctacctggccctcatggcaaccttcaagatgcggccgatgtttgctgtggggttactgttccgccggctcacttcgcgcgaagttctgctgttgaccatcgggttgtccctggtcgccagtgtggagctccctaactccctggaggaactgggcgacgggctcgcgatgggcataatgatcctgaagctattaaccgacttccagagccaccagctgtgggctacgttactctccttaacgttcatcaagaccaccttcagcctgcactacgcctggaagacgatggccatggtcctatccatcgtgagcttattcccactgtgcctcagtaccaccagccagaagaccacgtggctgcccgtgctactcgggtccctggggtgcaagccgctaaccatgttcctcatcgcggagaacaagatctggggccggcggagctggcccctgaatgaggggataatggctgtcggtatcgtgtccatcctgctctccagcctactgaaaaacgacgtcccgctcgccgggcccctgatcgccggcggcatgctgatagcatgctatgttatctccgggagctccgcagacttaagcctggaaaaggccgccgaagtgtcctgggaagaggaggccgagcactcgggggcctcccacaacatcctggtggaagtccaagacgacggaaccatgaagatcaaggatgaggaacgggacgacaccttgaccattctgctcaaggcgacgctcctggccgtcagcggcgtgtacccgttgtccattcccgccacacttttcgtctggtatttctggcagaaaaagaagcaacgcagcggtgtgctatgggacaccccgagcccgcccgaggtgggccgggccgtgttagacgatggaatataccgcattatgcagcgggggctgctcggacgctcgcaggtcggggtgggcgtattccaagagaacgtgttccacactatgtggcatgtgacgcgcggggctgtcctgatgtaccagggcaaacgcctggagccctcctgggccagcgtcaagaaagatctaatctcgtacggcggcggctggcggctacaagggtcgtggaacaccggcgaggaggtgcaggtcatcgccgtggagcccgggaagaatcccaagaacgtgcagaccgcccccggtacctttaagacgcccgagggcgaagtcggtgcaatagccctggactttaagcccggcacctccgggagccccatcgtgaatcgcgagggcaagatcgtgggcttgtacgggaacggtgtcgtgaccacctccgggacgtacgtgtctgcgatcgcccaggccaaagctagccaggagggcccactgccagagattgaggatgaagtattccggaagcgcaaccttaccataatggacctccaccccgggtctggcaaaacccggcgctacctgcccgcgatcgtgcgggaagcaatcaagcgtaagctgcgcaccttgatcctggctcccacgcgggtagtcgcctccgagatggccgaagcgctaaagggcatgcctatacgataccagaccaccgcagtgaaatccgagcacactgggaaggaaatcgtggatctcatgtgccacgctacgttcaccatgcggctgctaagcccagtccgcgtccctaactataacatgatcattatggacgaggcccactttacggacccctccagcatagccgcccggggctacatatccacccgcgtggggatgggggaggccgctgccatctttatgacggcaacaccacccggtagcgtcgaggcgttcccgcagtccaatgctgtgatccaggacgaagagcgcgacatccccgaacggagttggaactcaggctacgagtggattaccgatttcccaggcaaaacggtgtggttcgtcccatcgatcaagtcaggtaacgacattgcaaactgcctcaggaagaacggcaagcgcgtgattcagctgtctcggaagactttcgacaccgagtaccaaaagaccaagaacaacgactgggactacgtcgtcacaacggacatctccgagatgggcgctaatttccgcgctgatcgggtgatcgacccgcgtagatgcttaaaacccgtgatcctcaaggacggcccagagcgcgttatcctggccgggcccatgccagtcaccgtagcctcggccgcacagcggcgcggacggatcggccgcaaccataacaaggagggggaccagtacatctatatgggccagcctctgaacaatgacgaggaccacgcgcactggactgaggccaaaatgctcctggataacatcaatacacccgaagggattatacccgcgttgtttgagccggagcgcgagaagagtgccgccatcgacggagagtaccggctccgcggggaggccaggaagacgttcgtggagctaatgcgccggggcgacctgcccgtgtggctctcatataaggtggcctccgaaggattccagtactcagacagacggtggtgctttgacggggagcgcaacaaccaggtgttggaggagaacatggacgtggagatatggaccaaggagggcgagcggaagaaactacgaccgagatggctagacgcccgtacctactccgatcccctggccctgcgagagttcaaggagttcgctgcagggcgccggtccgtcagcggggacctcatcttagagatcgggaagctgccgcagcacctcacccagcgcgcacagaacgccctcgacaacctggttatgctccacaacagtgagcagggcgggcgggcctaccgccacgcgatggaagaactgcccgacacgatcgagactctgatgctcctggcgctgatcgccgtgctaaccggtggcgttaccttgttcttcctcagcgggaggggcctcggcaagacgagtattggactgctgtgcgtgatggcgagctccgtgctcctgtggatggcctctgtcgagccccactggattgcggcgagtatcatactagagttcttcctcatggtgctgctgatccccgagccggaccgccagaggacgccccaggacaaccagttagcctacgtggtcataggcctgctgttcatgatactgaccgtggccgcgaacgagatgggactgctggagaccaccaagaaggacctcggcatcggacatgtggctgttgagaaccaccaccacgcggccatgcttgacgtggaccttcaccctgccagcgcctggacgctctatgcagtggccaccaccatcatcactccaatgatgcgccatacgatcgagaacaccacagccaacatctccctgaccgccatagccaaccaggcggcaatcctcatggggctcgacaaaggctggccgatcagcaagatggacatcggggttcctctactggccctcggctgttactcccaggtgaaccccctgacgttgaccgccgcggtgctcatgctagtggcccactacgccataatcgggccggggctacaagcgaaagccacgagagaagcgcagaagcggaccgccgccggaatcatgaaaaaccccacggtggacggcattgtagccatcgacctcgaccccgtcgtgtatgacgccaaattcgagaagcagctgggccagatcatgctgctcatcctgtgtacctctcagatcctgctcatgcgtaccacctgggccctgtgcgagtccatcaccctggccactgggcccctcaccaccctatgggaggggagcccggggaaattctggaacacgaccatagccgtgtccatggccaacatcttccggggcagttacctggccggcgcgggtctcgccttctccctgatgaagtccctgggtgggggccgacggggtaccggcgcccaaggagagaccctcggggaaaagtggaaacgccagctgaaccagctgagcaagtccgagttcaacacgtacaagagaagcggaattatggaggtcgaccgctccgaggcaaaggaggggctcaaaagaggcgagaccaccaagcacgcggtgtcgcgcgggaccgcgaaactgcggtggttcgtggagcgcaacctggtcaaaccagagggcaaggtaatagacctgggctgtgggcggggcgggtggtcctattactgtgccggtctcaagaaggtgacggaggtcaaggggtacaccaagggcggacccggccacgaggagcccatcccaatggccacctacggctggaacctggttaaactgcatagcgggaaggacgtgttctttatcccgcccgagaagtgcgacaccctcctctgcgacatcggcgagtccagccccaacccgacaatcgaggaggggcgtaccctgcgggtcctcaagatggtggagccctggctccgcggcaaccagttctgcatcaagatacttaacccctacatgccctccgtagtggagaccctcgagcagatgcagcggaagcacggcgggatgttggtacgcaacccgctgagtcgaaactccacccacgagatgtactgggtgagctgcggcaccgggaacatcgtttccgccgtgaatatgacgtcgaggatgttgttaaaccgcttcacaatggctcaccggaagcccacctacgagcgcgacgtggacctgggcgccggaacgcggcacgtggccgttgagcctgaggtggctaatctcgacatcatcgggcagcgcattgagaacatcaagcacgagcacaagtccacttggcactacgacgaggacaacccctacaagacctgggcgtaccacggcagctatgaagtcaaaccctccgggagcgcaagtagcatggtgaatggcgtagtgaagctgctgaccaagccctgggacgtgataccaatggtcacacagatagccatgacggacactacccctttcgggcagcagcgggtcttcaaggaaaaggtggacaccaggacgcccaaggccaaacggggcaccgcccagatcatggaggtgaccgccaagtggctctggggcttcctgtctcggaacaagaagccccgcatctgcactcgtgaggaattcacgcggaaggtgcgctccaacgcggccataggggccgtgtttgtcgacgagaaccaatggaacagcgccaaggaggcggtagaggacgagcggttctgggatctggtgcaccgcgagcgcgaacttcataagcagggaaagtgcgcaacttgcgtctacaacatgatgggtaagcgtgagaagaagctgggagagttcgggaaagctaaaggctcccgggccatttggtacatgtggctgggtgcccgcttccttgagttcgaggcgctgggtttcatgaatgaggaccattggttcagccgggagaactccctgagtggtgtggagggggagggtttacacaagctggggtacatcctgcgagacatctccaacataccaggcgggaacatgtacgccgacgacaccgcggggtgggacacccggattacggaagacgatctccagaatgaggcccgcatcaccgacatcatggagcctgagcacgccctgctagccaagtcaatcttcaaactgacctaccagaacaaggtggtccgcgtgcagcggccagccaagaacggcacggtaatggacgtaatctcccgccgggaccaacgcgggagcggccaggtgggtacatacgggctgaacaccttcaccaacatggaggcccagctaatcaggcagatggaatccgagggcatctttagcccgtccgaattggagacacccaacctggccgagcgcgtgctggactggctcgagaagtacggggtggagcggctgaagcgcatggccatcagcggagacgactgcgtggtcaagccgatagatgacagattcgcgacggcccttactgccctgaacgacatggggaaggtccggaaggacatcccgcagtgggagccttcaaagggctggaacgattggcagcaggtaccattctgcagccaccactttcaccagctaatcatgaaggatggcagagagatcgttgtcccgtgccgcaaccaggacgaactggtggggcgggcccgcgtgtcccagggcgccgggtggagcctcagggaaaccgcgtgcctgggcaaaagttacgcccagatgtggcagctgatgtatttccaccgacgggatttaaggctggccgccaacgccatctgctccgcggtgcccgtcgactggattcctacgtcacggacaacctggtccatccacgcccaccaccagtggatgaccaccgaagacatgctgagcgtgtggaaccgcgtctggatcgaggagaacccttggatggaggacaagacacacatctccagctggggggatgttccttacctgggcaagcgcgaggaccagtggtgtggttcccttatcgggctgaccgcccgggccacgtgggcgactaatatccaagtggccatcaaccaagtccgccggctaataggcaacgagaactacctcgactacatgacctccatgaagcgcttcaagaacgagtccgacccagagggggccttatggtag

SEQ ID NO: 24236 - RNA, 9879 nt, synthetic construct
  misc_feature 1..9879: note = derived and/or modified CDS sequence (opt11) from DENV-1__FJ410266__SS-prME
  source 1..9879: mol_type = other RNA
agcgtaaccatgctgctcatgctgatgcccaccgccctggcattccacctcaccacccgcggcggggagccccacatgatagtaacgaagcaggagagaggcaagagcctgttattcaagacctctgccggggtgaacatgtgcacgctaatcgccatggacctgggtgaattatgcgaagacactatgacctacaagtgcccacggatcaccgaggccgagcccgacgacgtggactgttggtgcaacgccactgacacatgggtgacttatgggacctgcagccaaacgggcgagcatagaagagacaaacggagcgtggcgctcgcgccccatgtgggcctgggcctggagactcggacagagacgtggatgtcctctgagggcgcctggaagcagatccagagggtcgaaacctgggccctccgtcacccgggctttaccgtgatcgccctgttcctggcgcacgccatcggcacctccatcacgcagaagggtattatcttcattctcctgatgctggtgacgcccagcatggccatgcggtgcgtcggcattggctcccgcgactttgtggaggggctcagcggcgctacctgggttgacgtagtgctggagcacgggtcgtgcgtgaccaccatggccaaggacaagcccacgcttgatatcgagctcctgaaaactgaggtcacaaaccccgcggtactgcgaaagctctgcatcgaggctaagatttcaaacacgaccaccgattcccgctgtcccactcagggcgaggccacgctgatggaggagcaggacgccaattttgtctgccggcgcacgttcgtcgaccggggctgggggaacggctgcgggcttttcggcaaaggcagtctcataacgtgcgcgaagttcaaatgcgtgacaaagcttgagggcaagatcgtgcaatatgagaaccttaagtattccgtcatcgtgaccgttcatacaggcgaccagcaccaggtcgggaacgaaagcaccgagcacgggactaccgcaaccataacgccacaggcccccacttccgagatacagctcaccgactacggggccctgacactagactgcagcccccgcacaggcctcgacttcaacgagatggtactgctgacgatgaaggagaagtcctggctcgtccacaagcagtggttcctggacctgcctctcccttggacaagcggggcgagcacctcccaagagacgtggaatcggcaggacctgctggttaccttcaagactgcccacgcgaaaaagcaggaagtggtcgtactgggctcgcaggagggcgccatgcacaccgccctgacaggcgcaaccgagattcagacttccggcacgacgaccatcttcgcgggccatctcaagtgcagactgaagatggacaagctgaccctgaagggaatgagctatgtgatgtgcaccgggtccttcaagctcgagaaagaagtcgcggagacgcaacacgggaccgtgcttgtacagatcaagtacgaaggcaccgacgccccgtgcaaaatcccgttcagcacccaggacgagaagggggtgacgcagaacggcaggcttatcacagcgaaccctatcgtgacagacaaggagaagcctgtgaacattgaggcggagccgcccttcggcgagagttacatcgttatcggcgcgggagaaaaggccctgaaactcagctggttcaagaaagggtccagcattgggaagatgttcgaggccaccgcccgcggggcgcggcgcatggccatcctcggggacacggcctgggatttcgggtccatagggggcgtcttcaccagcgttgggaaactggtccatcagatattcggtaccgcctacggggtgttattctccggtgtgtcttggaccatgaagatcgggataggcgtattgttgacatggttaggcctgaacagccgcagcacgtccctgagcatgacctgcatcgcggtggggctcgtgaccctttatttgggtgtcatggtgcaggccgattccgggtgcgtcatcaactggaagggtcgcgagttgaagtgtgggtccggcatcttcgtcactaatgaggtgcacacttggacagagcagtacaaattccaggcggacagtccgaaacgcttaagcgccgccatcggcaaagcctgggaggaaggggtgtgcggcattcggtcggcaacccgcttggagaatatcatgtggaagcagatttccaacgagctcaaccacatcctgctggagaacgatatgaagttcacagtcgtggtgggggacgtcgtaggcatcctcgcgcaggggaagaagatgatcaggccccagcccatggagcacaagtacagctggaagtcctgggggaaagccaagatcatcggcgcggatgttcagaacacgaccttcattatcgacgggcctaataccccggagtgcccggacgaccagcgcgcctggaacatctgggaagtcgaggactatggtttcggaatatttaccacgaacatatggctgaagctgagagacagttacacgcaggtgtgcgaccaccgcctcatgtcggccgccatcaaggacagcaaggccgtgcatgccgacatgggttattggatagagtccgaaaagaatgagacttggaagctggcccgggcgtcgtttatcgaggtcaagacctgcatctggcctaagtcccataccctatggagcaacggtgtgctcgagtcggagatgatcatccccaagatctacgggggtccgataagccagcacaactaccgccccgggtatttcacccagaccgctgggccctggcacttggggaaactggaactcgacttcgacttatgcgaagggaccaccgtggtcgtagacgaacactgcggaaaccgggggccgtccctgcgcaccactacggttacaggcaagatcattcatgaatggtgctgtcggagctgcacgttaccccccttgcgcttcaaaggggaggatggatgctggtacgggatggagatccggcccgtaaaagaaaaagaggagaatctggtgaaatccatggtgagcgctggcagtggagaggtcgactccttcagcctcgggctcctgtgcatttccatcatgatcgaggaagtgatgcgaagtcggtggtccaagaagatgctaatgaccggtaccctggcggtgttcttgctcctgatcatggggcagctaacgtggaacgacctgatccgcttatgcatcatggtaggtgccaacgcgagcgataggatggggatgggcacaacctacctggccttaatcgctactttcaagatgcgcccaatgtttgccgtgggactgctgtttaggcggctcacctcccgcgaggtcctgcttctcaccatcgggctgagcctggtcgccagcgtggaactccccaacagtctggaggaactcggcgacgggcttgcgatgggcatcatgatcctgaagctgctcaccgactttcagtcgcatcaactgtgggccaccctgctcagtttcacgttcatcaagaccacgttatccctgcactacgcatggaagaccatggccatggtcctcagcattgtgtccctgttccccctgtgcctcagcacgacgtcccagaagactacgtggctgcctgtgctgctcggcagcctggggtgtaaaccgctgaccatgttcctcatcgccgagaacaagatatggggccggaagtcctggcccctcaacgagggaataatggcggtcggcgtggtgagcatcctgctctcatccctgcttaaaaatgacgtcccattggccggacccctgattgccggcggtatgctgatcgcttgctacgtcatcagcggttcaagcgcagacctctcactggagaaggccgcggaagtcagctgggaggaggaggcggagcactccggagccagccacaacatcctggtcgaggtgcaggacgatgggaccatgaaaatcaaggacgaggaacgcgacgacaccctaaccatactgctgaaggcgaccctcctggcggtgtccggcgtttacccgctaagcatccccgccactctctttgtttggcatttctggcagaagaagaagcagcggagcggagtgctgtgggacacccctagcccgcccgaggtcgagcgggccgtgctcgacgacgggatctatcgcatcatgcagcgcggtctgttaggtcggtcccaggtcggcgtaggtgttttccaagagaacgtgttccacacaatgtggcacgtcacgcgcggcgccgtgttaatgtaccagggaaaacggctggagccgagctgggcgtcggttaaaaaggatctcattagctacggcggcgggtggcgtctgcagggctcctggaacacgggggaagaggtccaggtaatcgctgtggagcccggcaaaaaccccaagaacgtccagactgcgcccggaaccttcaagactcccgagggcgaagtgggcgcaatcgccctggactttaagcccggaacgtcggggtccccgattgtgaatcgggaggggaagattgtggggctttacggtaatggggttgttaccacgagcggcacgtacgtcagcgcgatcgcacaagccaaagccagtcaggaaggtccgttgcccgagatcgaggacgaggtgtttcgtaagcggaacctgacgatcatggacctccaccccggaagcgggaagacccgccggtacctgccggctatcgtgcgcgaggccatcaaacggaagctgcgcaccctcatcctggctcccacacgggtcgtggccagtgaaatggccgaggcgctgaaaggcatgcccatacgctaccagacaacagccgtcaagagcgagcacaccggcaaagagatcgtcgacctcatgtgccacgccacctttactatgcggctgctgtctcccgtgagagtgcctaattacaacatgatcatcatggacgaagcgcacttcaccgaccccagctctattgccgcgcgggggtacattagcacacgggtcggcatgggggaagcagccgctatcttcatgaccgccacgccaccaggtagcgtggaagcgttcccgcagagcaacgctgtgatccaggacgaagagcgcgacatccccgagaggagttggaacagcggctacgagtggataaccgacttccccggcaagaccgtgtggttcgttccctccatcaaatctgggaacgatatcgccaactgcctcaggaagaacgggaagcgggtcatccagctgtcaaggaagaccttcgacacggagtatcagaagactaagaataacgactgggactacgtcgtgaccaccgacatatctgaaatgggcgctaacttccgggcggaccgggtcatcgacccacggcgctgcctgaagcccgtcatcctcaaggacgggcccgaacgggtgattctggccggcccaatgccagttactgtcgcctccgccgcccaacgccgagggcgaatcggcagaaaccacaacaaggagggcgaccaatatatctacatgggtcagcccctgaacaacgatgaggatcatgcgcactggacggaggccaaaatgctcctggacaacatcaacacaccggaaggcattatccccgccctgttcgagccggagcgcgagaagtccgccgcgatcgacggagagtaccggctccgcggggaggcgagaaagaccttcgtggaacttatgcggcgcggggatctgcccgtttggctctcctacaaggtggcgtctgagggttttcagtacagcgaccggcgatggtgcttcgacggcgagcggaacaaccaggtgttggaagagaacatggatgtcgagatctggacgaaggagggggaaagaaagaagttacggccccggtggctcgacgcccggacctactccgaccctttggccttgcgcgagttcaaggagttcgccgccggccggcgctctgtgtccggggacctcatactggagattgggaagctgccccagcacctaacccagagggcccaaaacgccctggataatctagtgatgctgcacaacagcgagcagggcgggcgcgcctacaggcatgctatggaggagctaccagataccatcgaaacgctgatgctcctagccctgattgccgtcctcaccggaggagttacgctgtttttcctgagtggacgcgggctcggtaagaccagcatcggccttctgtgcgttatggcttccagcgtactcctctggatggcctccgtggaaccccactggatcgcggccagcattatcctggagttctttctcatggtactgttaatcccagaaccggaccgacaacgcacgccccaagataaccaactcgcctacgtcgtgatcggactgctctttatgatcttgacggttgccgccaacgagatgggcctgctggaaaccaccaagaaggacttggggatcggccacgtagcggtggagaaccaccatcacgccaccatgttggacgtcgatctgcacccggcctcggcgtggacgctatacgccgtcgcgaccaccatcatcaccccgatgatgcggcacaccattgagaacaccacagccaacattagcctgaccgccatcgccaaccaagctgcgattctgatggggctcgacaagggttggccgatcagtaaaatggacatcggcgtccctctgctggccctcgggtgctattcccaggtgaaccccttaacgctcacagccgccgtccttatgctggttgcgcactatgctatcatcggcccagggcttcaggcgaaagccacccgcgaggcgcagaagaggaccgcggccggcattatgaagaaccccacggtagacggcatcgtcgccatcgacctcgacccggtagtctacgacgccaagtttgagaagcagttaggccagatcatgctgcttatcctgtgcacaagccaaattttgctcatgcgcaccacctgggccctgtgcgagagcatcacgctggccaccggccccctgacgaccttgtgggaggggtccccgggcaagttttggaacaccacgatcgctgtttcgatggccaacatcttcaggggatcctacctggctggtgcaggactagcgttctcgctcatgaaaagcctcggtggcgggcggcgcggaacgggggcccagggcgagaccctcggcgagaaatggaagcgccagctgaaccagctgtctaagtctgaattcaacacctacaagcgctccggcatcatggaggttgaccggagcgaggccaaagagggcctgaagcgcggcgagaccacccggcacgcagtgtcccgcggcaccgcgaagctacggtggttcgtcgagcgaaacctggtgaaacccgagggaaaggtgattgaccttgggtgcggacgaggcgggtggagctactattgcgccggattgaagaaggtcaccgaggtgaaagggtacacaaagggaggacccgggcacgaggagcccatcccgatggccacctacgggtggaatctggtgaagctgcacagtggcaaggacgttttcttcacgccgccggaaaagtgcgacacgctcctatgcgacataggggagagctccccaaatccgaccatagaggaggggcgcactctgcgggtgcttaagatggtggagccgtggctgcgcgggaaccagttctgtatcaagatcctcaacccatacatgcccagcgtcgtggagaccctagagcaaatgcagcggaagcacgggggcatgcttgtgcgcaacccgcttagccggaacagcactcacgagatgtactgggtctcatgcgggacgggcaacatcgtctcggccgtgaatatgacctcccgtatgctcctgaacagattcacgatggctcaccgcaagcccacatatgagcgtgacgtcgacttaggggcgggcacacggcacgtggcagtcgagcccgaagtagctaatctcgacatcattggccagcgcatagaaaatatcaaacacgagcacaagtcaacttggcactatgacgaggacaacccctacaagacgtgggcctatcacgggtcctacgaagtgaagccgagcggctccgcctcaagcatggtcaacggagttgttaagcttctgacgaagccctgggacgtcatccccatggtcacgcagatcgcgatgaccgataccactccgtttggccagcagcgggtgttcaaggagaaggtagacacgcgcaccccgaaggcgaagcgggggacagcccagattatggaagtgaccgccaaatggctctggggcttcctcagccgtaataagaagccccggatctgcactagggaggaattcacacgtaaggtgcgaagcaacgctgcgattggagcggtcttcgtggacgaaaatcaatggaacagtgccaaggaagccgtggaggacgagcgcttttgggacctggtccagaaagagcgcgagctccataagcaggggaagtgcgcgacttgcgtgtacaacatgatgggcaagcgggaaaagaagttgggggagttcggcaaagctaaggggtctcgggccatttggtacatgtggctgggggcccgattcctcgagttcgaggccctgggctttatgaatgaggaccactggttctcccgcgaaaacagcctgtccggggtagagggggaggggctccacaagctggggtacatcctccgcgacatcagcaaaatcccgggggggaacatgtacgcggacgacaccgccggatgggacacgcggatcaccgaggacgatttgcagaacgaggccaagatcaccgacatcatggaaccggagcacgccctcttggctacctcgatattcaagctcacgtatcagaacaaagtagtacgtgtgcagcgcccagctaagaatggaaccgtcatggacgtaattagccggagggaccagcggggctccggccaagtgggcacctatgggctgaacacattcacgaatatggaggcgcagctgattcggcagatggagagcgaaggtatcttcttgcccggcgagctggagacccccaacttggccgagcgcgtcctcgactggctcgagaagtacggggtggagcggctaaagcgtatggccatcagcggcgacgactgcgtcgtgaagccgatcgacgacagattcgccacagcgcttaccgcccttaacgacatgggaaaggtgcggaaggacatccctcagtgggagcccagcaaggggtggaacgattggcagcaagtccccttttgttcccaccacttccaccagctgataatgaaggacggccgggagatagttgtgccgtgcagaaatcaggatgagctcgtagggcgtgcccgggtctcccaaggcgcggggtggtccctgcgggaaacggcctgtctaggcaagtcatacgcgcagatgtggcaactcatgtacttccaccgccgggaccttaggctcgccgcaaacgccatctgtagcgcggtgcctgtagactgggtccccaccagtcggaccacctggtcaatccacgcgcaccatcagtggatgacgaccgaggacatgctctccgtgtggaatcgcgtgtggatcgaggagaacccctggatggaggataagacccatgtcagctcctggggcgacgtaccgtacttaggcaagcgagaggaccagtggtgcggatcgttgatcgggctcacggcccgcgcgacttgggcgagcaacattcaagtggcgatcaaccaggtccggcgcttaatcggcaacgagaactaccttgattacatgacctctatgaagcggttcaagaacgagggggaccccgagggcgctctgtggtga

SEQ ID NO: 24237 - RNA, 9879 nt, synthetic construct
  misc_feature 1..9879: note = derived and/or modified CDS sequence (opt11) from DENV-1__FJ410269__SS-prME
  source 1..9879: mol_type = other RNA
agcgtgacgatgctattaatgttgatgcccacagccctcgccttccatctcaccacccggggcggtgagccacacatgatcgtcacaaagcaagagcgagggaaatccttgctgtttaagacctcagctggggtgaacatgtgcacccttatcgccatggacttgggcgagctgtgcgaagacaccatgacctacaagtgcccccggatcacagaagccgagcccgatgacgtggactgctggtgcaatgccaccgacacctgggtcacctacgggacatgctctcagacgggcgagcaccggcgcgacaagaggagcgttgcgctggcgcctcacgttggcctggggttggagacacgcacggagacttggatgtccagcgagggcgcctggaaacagatacaacgggtggagacgtgggccctccgacacccgggttttacagtgatcgccctattcctggcccacgccataggcacctccatcacacagaaggggattattttcatcctcttaatgctggtgactcccagcatggccatgcggtgtgtaggcatcggctctcgtgacttcgtggaggggctaagcggcgccacctgggtagatgtcgtgttagaacacggctcatgcgtgacgaccatggccaaggacaagcctacgctggacatcgagttgttgaagaccgaggtcacaaaccccgcggtgctgcggaagctctgcatcgaggctaagatctccaatacaacgaccgactcccgctgccccacccagggggaggccacactgatggaagaacaggacgctaacttcgtatgccggcggactttcgtcgatcggggctggggaaacgggtgcgggttgttcggcaaagggagcctcatcacgtgcgctaagttcaagtgcgtgaccaaactggaggggaagatcgtacagtacgaaaatttaaagtactccgtcattgtgaccgtgcacacgggcgaccagcaccaagtaggcaatgagagcacggaacatgggaccaccgcaaccataacgccccaagctcccacctccgagatccagctaacagactacggcgccctgaccctggactgcagcccccgcacgggtttggacttcaatgaaatggtccttctgaccatgaaagagaagtcctggctcgtccataagcagtggtttcttgaccttccgctcccttggacgagtggggcctcaacctcgcaagagacctggaaccggcaagacttgctggttaccttcaaaactgctcacgccaagaagcaggaggtggtagtgttaggttcgcaggaaggagctatgcacaccgcacttaccggggcgaccgagatccagacatccggcaccacgacaatattcgccgggcacttgaaatgccgcctcaaaatggacaagctaaccctgaagggcatgagctacgtcatgtgcaccgggtccttcaagctcgagaaagaggtcgcggagacgcagcatggcaccgtgctagtgcagatcaagtacgagggcaccgacgccccctgcaagatccccttctctacccaagacgagaagggggtcatccagaacggcagactgatcacggccaacccgatagtaaccgacaaggagaagcccgtgaatatagaggctgaaccgccctttggggagtcctacatcgtcatcggcgtcggcgaaaaagcgttaaagctcagctggttcaagaaagggtccagcataggcaagatgttcgaggccaccgcacggggcgcccggcgcatggcgatcctgggagataccgcgtgggactttgggtccattggtggcgtgttcacctcagtcggtaagctggtgcaccaaatctttggcaccgcctacggcgtactgttctccggcgtgtcgtggaccatgaaaatcgggatcggcgttctcctgacctggctcggcttgaactcccgcagcacgtccctgagcatgacctgtatcgccgtgggcctcgtcaccttgtatctgggcgtgatggtgcaggcagactccgggtgcgtcatcaactggaagggccgggagctcaaatgcgggagcgggatcttcgtgaccaacgaagtgcacacttggactgaacaatacaagttccaggccgacagcccgaaacgactttccgctgcaatcggaaaagcctgggaggagggcgtctgcggcattcggtccgtcacccggctggagaatatcatgtggaaacagatttccaacgagctcaaccatatcctgctggagaacgacatgaagttcaccgttgtggtgggcgacgtggtcggcatcctcgcccagggcaaaaagatgatccggccgcagcccatggagcacaagtacagctggaagtcctgggggaaggccaaaatcatcggcgcggacgtgcagaacaccacgttcatcatagacgggcccaacaccccggagtgccctgacgatcagcgcgcttggaacatttgggaggtggaggactacggcttcgggatctttaccaccaatatctggctgaagctgcgggactcgtacacgcaggcctgcgaccaccgcctgatgtccgccgctatcaaggacagcaaagccgtccatgccgacatgggttactggatagaatccgagaagaacgagacctggaagctggccagggcaagtttcatcgaagtgaaaacctgtatctggcccaagtcccacactctgtggtctaatggcgtgctagaatccgaaatggtcatacccaaaatttacgggggccccatctcgcaacataactaccgccccgggtacttcacgcaaaccgctggcccatggcatctggggaaactagagctcgacttcgacttgtgcgagggcaccaccgtggtggtcgatgagcactgcggcaaccgggggccatccctgcgcacgaccaccgtgaccggtaagattatacacgagtggtgctgccgcagttgcacgttgccgccactccgcttcaaaggggaggatggttgttggtacgggatggaaataagacccgttaaggagaaggaagagaacctggtcaagtccatggtgtcggcaggctccggcgaagtagactccttctccctcgggctcctatgcatatccatcatgatcgaggaggtcatgcgctcccggtggagccggaagatgctcatgaccgggacgctggccgtgtttctgctcctgataatgggccagctgacctggaacgacttgatccgactgtgcatcatggtaggcgccaacgcctcagaccgaatggggatgggaacgacatatcttgcgttaatggctacattcaagatgcgcccgatgttcgctgtcggacttctgttccgccgcctgacctccagggaggtgttattactcacgatcgggctgagtctggtcgcctccgtggagatccccaattctctcgaggagctgggcgatggcctggccatgggcatcatgatcctcaaactgttgaccgacttccagtcccaccaactatgggcgaccctgctgagcctgactttcattaagacgaccctgtccctgcattacgcctggaagacaatggccatggtgctcagcatcgtttcattattccccctgtgtctctccaccacgtcccagaaaaccacctggttgcccgtgcttctcggttcgctggggtgcaaaccgctgaccatgttcctcattgcagagaacaagatctggggccgcaagtcctggccactgaacgagggtatcatggcggtgggggtcgtgagcatcttacttagctccctgttgaagaacgacgtgcccctcgccgggcccctgatcgcaggcggcatgttaatcgcgtgctacgtgatctccgggtccagcgcggacctcagcctagaaaaagccgcagaggttagctgggaggaagaggctgagcactccggagccagtcacaacatcctggtcgaggtccaggacgacggcaccatgaaaattaaagacgaggagcgcgacgacactctcaccatcctgctcaaggccaccctactggctgtttccggcgtgtacccgctgagcatccccgccaccctcttcgtatggtacttctggcagaaaaagaaacagcgctccggcgttctatgggacacaccaagcccgcccgaggtggagcgggccgtcctggacgacggaatctaccgcattatgcagaggggcctgctcggccgctcccaggtgggcgtgggagttttccaagagaacgtgtttcacaccatgtggcatgtcacccgcggcgccgtcctgatgtatcaggggaagcgtttagagcccagctgggcctccgtaaagaaagacttaatcagctacggaggagggtggcgactacaaggcagctggaacacaggggaggaggtacaagtcatagcggtggagccgggtaagaaccccaagaatgtgcaaacagcacccgggacattcaagacacctgagggcgaggtcggcgccatcgccctggacttcaaacccgggacctcgggctcccccatagtgaaccgcgaagggaagatcgtcggtctctacggcaacggggtggtgacgaccagtggcacctatgtgagcgcaatcgctcaggctaaggccagccaggaggggccgctgcccgagatcgaggacgaggtcttccggaagcgtaacctgaccatcatggatctccaccccggcagcgggaagacgcggcgctacctgccggccatagttcgcgaggcgatcaaacgcaagctacggacgctcatcctggcccccacgcgcgtggtcgccagtgaaatggccgaagccctgaaggggatgcctatccgctaccaaaccacggcggtcaagagcgagcataccggaaaagaaatcgtggacctgatgtgccacgccaccttcaccatgcggctgctgtcccccgtccgcgtgccgaattacaatatgataatcatggatgaggcccactttacggacccttcttccatcgccgcacgagggtatatcagcacccgagtgggcatgggtgaggcggcagccatcttcatgaccgccacaccgcccggctccgtcgaggccttcccgcagtccaacgcggtgatccaggacgaagaacgtgacatccctgagcgctcctggaacagcggttatgagtggatcacggacttcccaggcaagacggtgtggttcgtgccctccattaaatcaggcaatgatatagccaattgcctccggaagaacgggaagcgagtgatccagctgtcccggaaaaccttcgataccgagtaccagaagacgaagaataacgactgggactacgtggtaacgaccgacatcagcgagatgggcgccaattttcgagccgaccgggtgatcgacccgcgccggtgcctgaagcccgtcatcttgaaagacggccccgagcgggtgatattagcgggccccatgccggttaccgtagcctccgcagcacagcggcgggggcggatcggccggaaccacaacaaggagggcgaccagtacatttacatgggtcagcccctgaacaacgacgaggaccacgcccactggacagaggccaagatgcttttagacaacataaatacccccgagggcatcatccccgccctgttcgagccggagagagagaagtccgcagccatcgatggggagtaccgcctccgcggcgaggcccggaaaacctttgtggagctgatgcgccgcggggacctgccggtgtggctctcctacaaagtcgctagcgaaggattccagtactcagaccgacggtggtgtttcgacggcgagaggaacaaccaagttctggaggagaacatggatgtggagatctggaccaaagagggggagcggaagaagttacgcccacggtggctcgacgcccgtacctactcggaccccttagccctgcgagagttcaaggagttcgctgccggaagaagaagcgtctccggagacctcatcctggagatcggcaagctcccgcaacacctcacccagcgcgctcagaacgccctggacaacctggtgatgctccacaacagcgagcagggcggacgggcttaccgtcacgcaatggaggagctgcccgacaccatcgagacattaatgctcctagcgttaatagctgtgctcacaggaggggtgacgctgttcttcctctccggccggggactcggcaaaacctcgatcggattactgtgcgtgatggccagttctgtgctgctgtggatggcgtccgtcgaaccccactggatcgccgcgagtatcatccttgagttcttcctaatggtgttactgataccagagccggaccgccagagaacgccccaggataatcagcttgcctacgttgtaattgggctactgttcatgatactaaccgtagccgccaatgagatgggtctgctcgagacgaccaagaaagacttggggatcggccatgtggccgtggagaatcaccaccacgcgacgatgctggacgtggacctgcaccccgcctccgcctggacactctatgctgtggccactaccatcattaccccaatgatgcgccacacaatcgagaacacgaccgcgaacatcagcctgaccgccatcgcaaaccaggccgccatactgatgggcctcgataaaggctggcctatttccaagatggatataggcgtcccattactggcactcgggtgctattctcaggtaaaccccctcacccttacggcggccgtgctcatgctggtcgcccactacgcgattatcggtccgggtctgcaagccaaggccacccgagaagcccagaagcgcaccgccgcgggaatcatgaagaacccgacagttgacggtatcgttgccatagacctcgaccccgtcgtgtacgacgctaagttcgagaagcagctaggccagatcatgctgctcatcctatgcacgtcccagatcttactcatgcgcaccacctgggccttatgcgaaagcataacactggccacgggaccccttaccaccctgtgggaggggtccccgggcaagttctggaacaccacgatcgcggtgtctatggccaatatattccggggttcctacttagctggcgccggcctcgccttcagcttaatgaagtccctcggcggcgggcgacgggggaccggggcgcagggtgagaccctcggagaaaaatggaaacgccaactgaatcaactgtccaagagtgaatttaacatctacaagaggtctgggatcatggaggtagaccgcagtgaggcaaaagagggcctcaagagaggggagactacgcgccatgccgtgtcccggggcaccgcaaagctgcgctggttcgtggagagaaacctcgtcaaacccgagggcaaggtgatcgacctaggatgtggccgcgggggctggtcatactactgcgcagggttgaaaaaggtcaccgaagtcaagggctacaccaagggtgggcccggtcacgaggagccgatccccatggccacttacgggtggaacctggttaagctgcactccggtaaggacgtattcttcactcccccggagaagtgcgacaccctactgtgcgacattggggagagctcgccgaatcccactatagaagagggtcggacgctgagagtcttgaagatggtggaaccctggctgcgcgggaaccaattttgcatcaagatcctgaacccctacatgcccagcgtggtcgagaccttggagcaaatgcagcgcaaacacggcggcatgctggtgcggaatccgctgtcccgtaatagcacccacgaaatgtactgggtctcctgtgggaccggcaacatagttagtgccgtgaacatgacctcgaggatgctcttaaatagattcacgatggcccaccgcaagcccacctacgagcgggacgtggatctgggtgccgggactcgccacgtcgctgtggagccggaggtggccaacctagatatcatcggccaacggatcgaaaacataaagcacgagcataaatctacttggcattacgacgaggacaacccctacaaaacgtgggcttaccatgggagctacgaggttaagccatcaggctccgcgagctctatggtaaacggggtcgtgaagttactgaccaaaccctgggatgtgatccccatggtcacccagatagccatgaccgacacgacccccttcggtcagcagcgcgtgttcaaggagaaggttgacacgcggaccccgaaggcgaagcgcggcacggcccagatcatggaagtaacggcccggtggctctggggcttcctttctcgcaacaagaaaccccgcatctgcactcgcgaggagttcacgagaaaagtgcgctcaaacgccgcaattggtgctgtcttcgtcgatgaaaatcagtggaacagcgccaaggaagccgtggaagacgagcggttctgggatctggtgcagaaagagcgcgaactccataaacagggaaagtgcgctacgtgcgtatacaacatgatgggcaagcgggagaagaagctgggcgagttcggcaaggcgaaagggagccgcgctatttggtacatgtggctgggtgcccggttcttggagttcgaggccctgggcttcatgaacgaggaccactggttctcccgcgaaaacagcctgtccggggttgagggagaggggctccacaagctgggctacattttacgagatataagcaagatccccgggggcaacatgtacgccgacgacaccgcgggttgggacacccgcatcacggaggatgacctccaaaacgaggccaaaatcacggacataatggagccggagcatgccctactcgctacttccatcttcaagttaacgtaccagaataaggttgtccgggttcagcgccccgccaagaacgggaccgtcatggacgtcatcagccgccgggaccagcgcggctccggacaagtgggcacgtacggccttaacaccttcaccaacatggaggcgcaacttatccggcagatggagtcggagggaatcttcctcccaagcgagctggagacccccaatctggctgagcgcgtgctcgattggctcgaaaaacacggcgtagagcggctgaagcgtatggccatctcgggggacgactgcgtcgtgaaaccgattgacgacaggtttgcgacagccctcaccgccctgaacgacatgggcaaggtcaggaaggacatcccacagtgggagccctcaaaaggctggaatgattggcagcaggtacccttctgcagccaccactttcaccagctgattatgaaggacgggcgggagatagttgtcccgtgccgcaaccaggacgagctcgtgggccgggcccgcgtttcccaaggtgcaggctggagcctgcgggaaacggcctgcttaggcaagtcatacgcccagatgtggcagctcatgtacttccaccgcagagacctgcgccttgctgctaacgccatctgctccgccgtccccgtggactgggtgcccacttctcggacgacctggtcaatccatgcgcatcaccagtggatgaccactgaggacatgctcagcgtgtggaaccgcgtttggatcgaagagaacccctggatggaggataagacccatgtgtccagctggggtgacgtcccctacctgggtaagcgggaggaccagtggtgcggctcgctgataggcctcacagcccgcgccacctgggccagcaacatccaggtggcgatcaatcaggtgagacggctgatcggaaacgaaaattacctggactacatgacgtcgatgaagcgcttcaagaacgaaggtgaccccgagggggcactatggtga

SEQ ID NO: 24238 - RNA, 9879 nt, synthetic construct
  misc_feature 1..9879: note = derived and/or modified CDS sequence (opt11) from DENV-1__FJ410273__SS-prME
  source 1..9879: mol_type = other RNA
agcgtgaccatgctcttgatgctgatgcccactgctttagccttccatctcactacacgcggaggggaaccccacatgatcgtgtcaaagcaagagcggggcaaatcgctcctatttaagacctctgccggagtgaacatgtgtacgctcatcgccatggacctgggcgagctctgcgaggacacgatgacctacaagtgcccccgaatcacagaggctgagccagatgacgtggactgttggtgcaacgccacagacacgtgggtgacctacggcacctgttctcagaccggtgagcaccggcgcgacaagcggtccgtggccctcgcgccccacgtcgggctgggactcgaaacgcgcaccgagacctggatgtcgtccgagggcgcatggaagcagatccagcgagtcgaaacctgggccctacgccaccctggtttcacggtgatcgccctgttcttagcgcacgccataggcacgtctataacgcagaaaggtatcatcttcatcctcctgatgctggttacgccctccatggcgatgcggtgcgtcggcataggctctcgcgacttcgtggaaggtctctccggcgccacgtgggtggatgtcgtgctggagcacggcagttgcgtgaccaccatggcgaaggacaagccaaccctggatatcgagctcctgaagacggaggtcaccaatcctgcagtgctgagaaagctctgtatcgaggccaagatttccaacaccaccacggacagccgctgcccgacccaaggtgaggctaccctagtggaggagcaggatgcgaacttcgtctgccggcgtacctttgtggaccggggctggggaaatgggtgcggcctattcggcaagggatccctaattacgtgcgccaagttcaagtgcgtgacaaagctggagggcaagatcgtccagtacgagaacttgaagtacagcgtgatagtcactgtgcacaccggagaccagcaccaagtgggaaacgaatccactgagcacggtactaccgcgaccatcacgccccaggcccccagcacggagatccagctcaccgactatggggccctgaccctggactgcagcccccggaccggacttgactttaacgagatggtcctgctgacgatgaaggagaaatcctggctagtccacaaacagtggtttctggacctgccgctgccctggacaagcggggcctccactagccaggaaacctggaacaggcaagacctgcttgtgacgtttaagaccgcccacgcgaagaagcaggaggtggtggtccttggctcccaagaaggcgctatgcataccgccctcaccggggcgaccgagatccagaccagcggaaccaccacaatattcgccggccacttgaagtgccgcctcaagatggacaaactgacgttgaagggtatgtcctacgtcatgtgtaccgggtcttttaagctggagaaggaggtcgccgagacccagcacggcacagttttagtccaaatcaagtatgagggcaccgacgccccgtgtaagattcccttttccacccaggacgagaagggggtgacccagaacggccggcttatcacggcaaacccgatcgtgacggacaaggagaagcctgtaaatatcgaggccgagccccccttcggtgagtcgtacatagtgatcggcgccggagagaaggcgctgaaactcagctggttcaagaaggggagctccatcggtaagatgttcgttgccaccgcccgtggtgcacggcgcatggcaatactgggcgacacggcttgggacttcgggtcaatcggcggcgtttttacgtccgttgggaaattagtgcatcagatcttcggcaccgcatacggggtcctctttagcggcgtatcctggacgatgaagatcggtatcggggtactgctaacctggctcgggttgaactcacgctccaccagcctgtccatgacctgcatagccgttgggcttgtgacactgtatctgggcgttatggtccaggcagatagcggctgcgttatcaactggaaggggcgggagctcaagtgcgggagcggcatcttcgtcaccaacgaggtacacacctggactgagcaatacaagtttcaggccgattccccgaaacgcttaagtgccgctatcggcaaggcctgggaggaaggggtgtgcggcatccggtcagccacccgcctcgagaacatcatgtggaaacagatcagcaatgagctcaaccatatcctgctggaaaacgacatgaaatttactgtggtcgtcggggacgtggcgggcatcttgacccaagggaaaaaaatgatacgcccccagcccatggagtacaagtactcgtggaagtcctgggggaaggccaagatcatcggtgccgatgtgcagaacacgacattcattatcgatgggccaaacaccccggagtgccccgacgatcagcgcgcctggaacatttgggaggtggaggactacggtttcgggatcttcaccaccaacatatggctgaagctgcgggactcctacacgcaggtgtgcgatcacagactaatgagcgcagcgataaaggactccaaagccgtccacgcagacatgggctactggatagagtcggagaagaacgagacatggaagctggcccgcgcgagtttcatcgaggtgaagacctgcatatggcccaaaagccatacgctgtggtccaacggcgtgctcgagagcgaaatgatcatccccaaaatctatgggggccctatctcccagcacaactaccggcctgggtacttcacccagaccgccggcccatggcacctaggtaagctggagctcgactttaacctgtgcgaaggcacgaccgtcgttgtggacgagcactgcgggaaccggggcccatctctacgcacaacaaccgtcacgggcaagatcatccacgagtggtgctgccggtcatgcactctgccgcctctccgcttcaagggggaggacggctgttggtacgggatggagataaggcccgtgaaggagaaggaggagaatctggtcaagtctatggtcagcgctggcagcggcgaggtggatagcttctcgctcgggcttttgtgcattagcataatgatcgaagaggttatgcgctctcggtggagccgcaagatgctcatgaccggcaccttagcagtgttcttcctgctcatcatggggcagctgacgtggaacgatctgattcggctctgcattatggttggcgccaacgcgtccgaccggatggggatgggcactacctacctggccctgatggccacctttaaaatgaggcccatgctcgcagtcggcttactgttcagacgcctcacgtcgcgggaggtcttactcctcaccattgggctgtccctggtcgcctcagtagagctccccaacagtctggaggagctcggcgatggtctggcgatgggcatcatgatactaaaactgctcaccgacttccagagccaccagctgtgggcaaccctgctctcccttactttcataaaaaccacgtatagtctgcactacgcctggaagactatggccatggtgctctccatcgtctcactgttccccttatgtctctcaacgaccagccagaagaccacctggctgcccgtgctgttgggctcactggggtgcaagccgctgacgatgttcctcatcgcggagaacaagatctggggacgcaaaagctggcctctcaatgaaggcatcatggccgtgggcatcgtctctatcctgctctccagccttctgaagaacgacgttcccctcgccgggcccctgatcgccggcggcatgctgatcgcatgctatgtcatatccgggagctccgcggacttgtctcttgagaaggccgccgaggtttcttgggaagaggaggccgagcacagcggcgcctcacacaacatattggtcgaagtgcaggatgatggtaccatgaagatcaaggacgaggagcgggacgacaccctcaccattctgctgaaggcgaccttgttggccgtgagcggggtctacccgctgtcaatccctgccaccctgttcgtttggtacttttggcagaagaagaaacagaggtcaggtgtgctgtgggacaccccatctccacctgaggtcgagcgagcggtgctggacgatggtatctaccgtatcatgcagcggggccttctcgggaggagccaggtgggcgtaggggtgttccaagagaatgtgttccacaccatgtggcacgtcacccggggcgccgtgctgatgtaccaagggaagcgcctggagccgtcctgggcgagcgtgaagaaggacctcatttcatacggaggcgggtggcggctgcagggttcgtggaacaccggggaggaggtccaggtgatcgccgtggaacctggcaagaaccctaagaacgtccagaccgctcccgggacattcaagacctccgaaggcgaggtcggcgcgatcgccctggactttaagcccgggacgtctggcagccccattgtgaaccgcgaggggaagattgtcggtctctatggcaatggggtggtgaccacctcaggcacctatgtcagcgcgatcgctcaggccaaggccagccaggaagggcctctgcccgagatagagaatgaagtgttccgtaagcgcaacctgactatcatggacctccaccccggcagcgggaagacccggcgctacctgccagctatcgtacgggaggccatcaagcgcaagctgcggactctcatcctggccccgactcgcgtcgtggcctccgaaatggccgaggccctgaaaggcatgccaatccgctaccaaacgaccgccgtcaaatccgagcacaccggcaaggaaatagtcgaccttatgtgccatgccacctttactatgaggctgctgtcccccgtgcgcgtgcccaactataatatgataatcatggatgaagcccacttcaccgacccgagttccatagctgcccggggatacatcagcacgcgcgtcggaatgggtgaggccgctgccatttttatgaccgctacgccgcccggctccgtggaggcattcccacaaagcaacgccgtgatccaggacgaggagcgggatatcccggagcgctcctggaactcggggtacgagtggatcacagacttccccgggaaaacagtctggtttgttccctccatcaaatcaggcaacgacatcgccaactgtctccggaagaacgggaagcgtgtgattcagctgtcgcggaagacattcgatacggagtaccagaagacgaagaataacgattgggactatgtcgtaaccacagacatcagcgagatgggcgccaatttccgcgcggatcgggtgattgacccccgacgctgcctgaaacccgttatcctgaaggacggaccggagcgcgtgattctggccggccccatgccagtcactgtggcctccgccgcccagcggcgcggccggatcggcaggaaccacaataaggagggagaccagtacatctacatggggcagccgctgaacaatgacgaggaccacgcgcactggaccgaggccaagatgctcctggacaacatcaatacccccgagggcatcatccccgccctgttcgagcccgagcgggagaaatccgccgccatcgatggggagtataggcttcgaggcgaagcgcgtaagaccttcgttgagctgatgcgccgtggagacctacccgtctggttgagctataaggtcgcctctgaggggttccagtattctgacagacggtggtgctttgacggcgagcgtaataaccaggtgctggaagagaacatggacgtcgagatatggacgaaagagggggagcggaagaagctgcgtccgcggtggctcgacgcccgcacctattccgaccctctagccctgagagagttcaaggagttcgccgccggacgccggtcggtctccggagacctaatcttggaaatcggtaagctgccgcagcacctgacccagcgcgcccagaacgccctggacaacctggtcatgctccacaacagcgaacaaggcggccgggcctaccgccacgcgatggaggaactaccagacacgatcgagactctcatgctcctggccctgattgccgtgctcaccggcggggtcactctgtttttcctgtcgggccgggggcttggcaagacatcgatcggactgctctgtgtgatggcctccagcgtcctcctgtggatggcctcggttgagccgcactggattgcggcatcaatcattctggagttctttctcatggtgctccttatccccgagcccgaccgccagcggaccccccaagacaaccagttggcttacgttgtgatcgggctactgtttatgatcctcacggtcgccgcgaatgagatgggcctgctggaaactaccaagaaggacctcggaattggtcacgtcgcggtggaaaatcaccaccacgccgcgatgctggacgttgacctccacccagcctccgcctggaccctctacgctgtcgcgaccaccatcatcacccccatgatgaggcacaccatcgaaaacacgaccgccaacataagcctgaccgcgatcgccaaccaagcggccattctgatggggctcgacaagggatggccgatctccaaaatggacatcggcgtgccactgctggccctcgggtgctacagccaggttaaccccttaacacttacagctgctgtcctcatgctggttgcacactacgccatcatcggtcctgggctgcaggccaaagccacacgggaggcgcagaaacgcaccgcggccggtatcatgaagaaccccaccgtggacggtatcgtcgcgatcgaccttgatcccgtcgtatacgacgcgaagttcgaaaagcagttaggtcagataatgttactcatcctttgcacgtcgcaaatccttctcatgcgcaccacgtgggcgctgtgcgagtcaataaccctggccacaggcccccttaccactctatgggaggggtcccccgggaagttttggaacaccacgatagccgtctctatggccaacatcttccgagggagctacctggccggcgcgggtctcgccttttccctgatgaagtctctcggaggcgggcgccgcgggaccggtgcccagggcgaaaccctcggggagaaatggaagagacagttgaatcagctatccaagtccgaattcaacacctacaagaggagcgggatcatggaagtggatcgcagcgaagccaaggagggcttaaagcgtggtgagaccaccaagcacgcggtttcccgtgggaccgccaaactgcgttggttcgtagaaagaaacctggttaaaccggaggggaaggttatcgatctgggttgcggccgcggcggatggagctactactgcgccggcctaaagaaagtcacagaagtaaagggatacacgaaagggggtcccgggcacgaggagcccatccccatggccacatatggatggaatctggtgaagctacatagcggcaaagacgtcttcttcataccaccagaaaagtgcgacacactcctctgcgacatcggggagtcatccccgaaccccacaatcgaggagggccgcacgctgagggtgctaaagatggttgaaccgtggttgagggggaaccagttctgcataaagatcctaaacccatacatgccctcggtagtggaaaccctcgagcagatgcagcggaagcatggcggcatgctggtgcgcaaccccctgtcccggaactcaacacacgagatgtactgggtctcctgcggtaccggcaatattgtgagtgccgtgaacatgacatcccgtatgctcctaaatcgcttcacgatggcgcatcgaaaacctacctacgagcgcgacgtcgatctgggggccggcactcggcacgtggccgtggagcccgaggtagccaacttagacatcatcggtcagaggattgagaatataaagcacgagcacaagtctacgtggcactacgacgaggacaacccctacaagacgtgggcctatcacggatcatacgaggtgaagcccagcgggagcgcgtcctctatggtaaacggggtggttaagctcttgaccaaaccgtgggacgtcatccccatggtgacccagatcgccatgaccgacaccactcccttcggccagcagagggtgttcaaggagaaggtcgatacccgcaccccgaaagccaaacggggcaccgcccagataatggaggtgaccgcgaagtggctctggggcttcctgtcgaggaacaagaagccgcggatctgcaccagagaggagttcaccagaaaggtacgcagcaacgcggcgatcggcgcggtctttgtggacgaaaatcaatggaattccgctaaggaggcggtggaggacgaacggttctgggacctggtccaccgcgagcgtgaactccacaagcaggggaaatgcgccacgtgtgtgtacaacatgatgggcaagcgcgagaagaaacttggtgagttcggcaaggcgaagggaagccgggccatctggtacatgtggctgggcgcgagattcctcgaattcgaagcgctgggcttcatgaacgaggaccactggttttcccgggagaactccctctcgggtgtcgagggtgaggggctccataagctaggatatattttgcgcgacatctccaagataccagggggaaacatgtacgccgacgacaccgcgggctgggatacccggatcaccgaagacgacctacaaaatgaggccaaaattacggacatcatggaacccgagcatgccctgttagccaagtccatatttaaactgacctatcaaaacaaagttgtaagagttcagcggcctgcaaagaatggtacagtcatggacgtgatcagcaggcgcgatcagcggggctctggccaggtgggcacctacgggttaaacacgttcactaacatggaggcccagctcatcaggcagatggaaagcgaggggattttctccccgtcggaactcgagacccccaacctggccggccgggtcctggattggctagagaagcacggggttgagcgcctgaagcggatggctatctccggcgacgattgcgtggtcaagcccatcgatgaccgcttcgcgaccgccttgacggccctaaacgacatggggaaagttcggaaagacatcccgcagtgggaacccagtaaaggctggaacgactggcagcaagtcccattctgcagccaccacttccaccagctgatcatgaaggacggccgcgagatagtcgtgccgtgccggaaccaggacgaactcgtcgggcgcgcgcgggtctcccagggcgcagggtggtccctccgcgagaccgcgtgcctgggcaaaagttacgcccagatgtggcaactgatgtacttccatcgccgcgacctccggttagcagccaacgccatctgtagcgccgtgccggtggactgggtccccacttctcggacgacatggagcatccatgcccatcaccagtggatgaccaccgaggacatgctgagtgtttggaaccgggtttggatcgaagaaaacccctggatggaggataaaactcacatcagctcctggggagacgtcccctacttaggcaagcgcgaggaccagtggtgcggcagcctgatcggactgactgcccgggccacctgggccaccaacattcaggttgctatcaaccaggtgcgacgcctcatcggcaacgagaactacctggactacatgacctccatgaaaagattcaagaacgagagcgatccagagggggcgctgtggtaa

SEQ ID NO: 24239 - RNA, 9879 nt, synthetic construct
  misc_feature 1..9879: note = derived and/or modified CDS sequence (opt11) from DENV-1__FJ410276__SS-prME
  source 1..9879: mol_type = other RNA
agcgtcactatgttcctcatgctaatgcccaccgcgctggccttccatctgacgacccggggcggggagcctcacatgatcgtgtcaaagcaggagcggggcaagtcattactgttcaaaacctcagctggggtgaacatgtgcacgcttatcgctatggacctcggcgagctgtgcgaggatacgatgacctataaatgcccccgcattacagagaccgaaccagacgacgtggattgctggtgcaacgccactgacacctgggtcacctacggaacctgtagccagacgggcgaacaccgtagggataagagatccgtcgccttagcgcctcatgtgggattggggttggaaacccgcaccgagacctggatgtcatccgaaggcgcgtggaagcagatccagagggtggagacctgggccctgaggcatcccggcttcaccgtcattgccctattcctggcccacgcgatcggcaccagtattacacaaaaggggatcatattcatactgctcatgctggtgacgccgtcaatggccatgcgttgcgtcggaatcggcagccgtgatttcgtcgaggggttatccggcgccacctgggtcgatgtcgtcctcgagcacgggagttgcgtgaccaccatggccaaagacaagcccacgttggacatcgagctgttgaaaaccgaagtaactaacccagccgtgctccgcaaactgtgcatcgaggccaagatctccaacacgacaaccgacagccgctgcccgacccagggcgaagccaccttggtggaggagcaggacgccaacttcgtctgcaggcgcacgttcgttgaccgaggatggggcaacggctgcggactgtttggcaaggggtccctgatcacctgcgccaagttcaagtgcgtgactaagctcgaggggaagatcgtccagtacgagaacctgaagtacagcgtgatagtgaccgttcacacgggcgaccagcaccaagtgggcaatgagtccacggagcacggcaccaccgcgaccataacgccgcaggcgccaacgactgaaatccagctgacggactacggtgccctgactctggactgcagccctcgtacaggactggacttcaacgagatggtgctcttaaccatgaaggaaaaatcgtggcttgtgcacaaacagtggttccttgacctgccgctgccctggacaagcggtgcctctacatcccaggagacctggaaccgccaggacctcctggtgaccttcaagaccgcccacgccaagaagcaagaggtcgtggttctgggtagccaagagggcgcgatgcacacggccttaaccggcgccacagagatccagacctcgggcactaccaccatatttgccgggcacctgaagtgccgcctgaagatggacaagctaaccttgaagggcatgagctacgtcatgtgcaccggttcattcaagttggagaaggaactcgccgagacccaacatggcaccgtgctagtgcaaatcaaatatgagggcacagacgccccgtgcaagatccctttcttgacccaggacgagaagggggtgacccaaaacggtaggcttattactgccaaccccatcgtcaccgacaaggagaagcccgtcaacatagaggccgagcctcccttcggggagagctacatagtgatcggcgccggcgagaaagccttgaaattatcttggttcaagaaggggagcagcatagggaagatgttcgaggccacggctcgaggggcccggcgcatggccattctgggcgacacagcgtgggactttggatctatcgggggcgtgttcacctctgtggggaagctcgtccatcagatctttggcaccgcttacggggtactgtttagtggagtgtcctggacgatgaagattgggatcggcgtcctgctcacgtggctgggcctgaatagccgctccacctccctctccatgacctgtatcgcagttggcctagtgacgttgtacttaggcgtcatggtgcaggccgatagcggatgcgtaattaactggaaaggtcgggagctgaaatgcgggtccggcatttttgtcaccaacgaggtgcacacctggactgagcagtacaagttccaggccgacagccccaagcgcctatccgcggctatcggcaaggcctgggaggagggggtatgcgggatccggagtgcgacgcgactagagaacatcatgtggaaacaaatatcgaacgagctgaaccatatattgctcgagaacgacatgaagtttactgtcgtggtgggtgacgtcgccggcatactggcgcaaggtaaaaaaatgatcaggcctcaacctatggagtacaagtactcgtggaagagctggggcaaagccaaaattatcggcgccgatgtacaaaataccactttcattattgacggtcccaacactcccgaatgccccgacgaccagagggcctggaacatatgggaagtggaagattacggcttcgggatcttcacaacgaacatctggttaaagctccgggactcatacacccaggtgtgcgaccaccgcctgatgagcgcagccatcaaggattccaaggcagtgcacgccgacatgggctactggattgagagtgagaagaacgagacctggaagttggcccgggcgtcgtttatagaagtcaagacgtgcatatggcctaaaagccacactttatggtctaacggtgtcctcgagagcgagatgatcatccccaagatctacggcggaccgatctcccagcataactacagaccgggatacttcacccagaccgcgggcccatggcatcttgggaagctggagttagacttcgatctgtgtgagggaacgaccgtggtcgtcgacgagcactgcgggaaccgtggaccatcattgcgcaccacaacagtgacggggaagataatccacgagtggtgctgccggtcgtgtacattaccgcccctgcgcttccgcggggaggacggctgctggtacgggatggaaatacggcccgtgaaggagaaggaggaaaacctcgttaaaagcatggtatccgcgggaagcggcgaggtcgattcattctccctggggctgctctgcatcagcatcatgatcgaggaagtcatgcgctcccgctggtctcggaagatgttaatgaccggaacgctagctgtcttcttccttctcattatggggcagctgacctggaacgatctaatcaggctgtgcatcatggtgggtgccaacgcctccgaccgcatgggcatgggcactacctatctggctctcatggcaactttcaaaatgcggccgatgttcgccgttggcctgctgttcagacggttaacaagtcgggaagtactgcttctcaccataggactgtccctggtggcgagtgtcgagttaccgaactccctagaggagctgggcgacgggctcgcaatgggcatcatgatactgaagctactaactgacttccagagccatcaattatgggcaacgctactctctctgacgtttatcaagaccaccttctcattgcattacgcctggaagaccatggccatggtgctctccatagtcagccttttcccgctctgcttatccaccaccagccagaagaccacgtggctacccgttttgctcgggtccctggggtgcaagccactgaccatgttcctcatcgctgagaacaaaatctgggggcgacgcagctggcccctgaacgaggggatcatggccgtgggcatagtctccatcctactaagcagcctgctgaagaacgatgtacccctcgccggacccctgatcgccggcggcatgctgatagcctgttatgtgattagtgggtcatccgcagacctatctctggaaaaggccgcagaggtgtcctgggaggaagaggccgagcatagcggcgcatcccacaacatcctggtcgaggtacaggacgacgggaccatgaagattaaggacgaggagagggacgacaccctcaccatcctgttgaaggccactctcctggccgtcagcggggtgtacccgctgtccattccagccactctcttcgtgtggtacttctggcaaaagaaaaagcagcgcagcggggtcctctgggacacaccaagcccacccgaggttgagcgtgccgtgctggacgacggcatctaccgcatcatgcagcggggcctgcttggcaggagccaggttggtgtcggtgtattccaggaaaacgtattccacaccatgtggcacgtgacgcggggcgccgtgctgatgtaccaggggaagcggctggaaccctcctgggcgagcgtcaaaaaggatctcatctcctatggtggcggctggcggctgcagggctcttggaacaccggggaggaagttcaggtcatcgccgtcgagcccggcaagaacccgaagaacgtacaaaccgcgccaggtacgtttaagacgccggagggcgaggtgggcgccatagccctggatttcaagccgggaacgtccggctcgcccattgtcaaccgcgagggcaagatcgttgggctatacggcaacggggtggtaacaacctccggcacgtatgtgagcgccattgcccaggctcgagccagccaggaggggccattaccggaaatcgaggacgaggtgttcaggaaacgtaacctgacaatcatggaccttcatcccggctctggcaagacgcgccggtacctcccggccatagtccgcgaggcgatcaaacgcaagctccggaccctcatcttggccccgacgcgcgtagtggccagcgagatggccgaggcgctaaaaggtatgcccattcggtaccaaaccacggcggtcaagtcagagcacaccggcaaggagattgtagacctcatgtgccatgccacattcaccatgcgcctgctgagcccggtgcgggtcccaaattacaatatgatcatcatggacgaggcccacttcaccgacccatcctcaattgcagcgcgcggatacatatccacgcgggtcggcatgggggaggccgcggccatcttcatgaccgccaccccgcccggcagtgtggaggcgttcccacagtccaacgccgttatacaggatgaggagagggacatcccggagcgtagttggaacagcggatacgagtggatcaccgacttcccaggcaagacagtgtggtttgtgccctcgattaagtccggcaatgatatcgcgaactgcctccgcaagaacggcaaaagagtcatccagctgagccgaaaaacgttcgataccgagtaccagaaaaccaagaacaacgactgggactacgttgtgacaacagacatctccgagatgggcgcaaacttccgggccgatcgagtcatcgacccgcggcgctgcctgaagcccgtaatcctcaaggacgggcccgagagagttatcctggccggccccatgccggtcactgtggcatccgccgcacaacgacgggggcgcatcgggcgcaaccacaacaaggaaggcgaccagtatatctatatggggcaacccctgaacaacgacgaagaccatgcgcactggactgaggccaaaatgctcctggacaatatcaacacccctgagggcatcatccccgccctgttcgagcctgagcgggagaagtccgccgccatcgacggggagtaccgactccggggtgaggcccgcaagacatttgtcgagttgatgcggcgaggtgatctgccagtatggctcagctacaaagtggcctccgagggctttcagtactcagaccggcggtggtgcttcgacggcgagcggaataaccaggtgctggaggagaacatggacgttgagatttggaccaaggagggggagcgcaagaagttgcggcctcgctggctcgacgcccggacttacagcgacccactggccctgcgagagttcaaggagtttgccgcgggccggaggtccgtgtccggggatctcatcctggagataggtaagctaccccagcacctgacccagcgtgcccaaaacgcccttgacaacctggttatgctacataacagcgagcagggtggtcgcgcctaccggcacgcgatggaagaactgccggacacgattgaaacgctgatgctcttagcgcttatagccgtgctcaccgggggggttacactgtttttcctgagcggtcgcggtctgggcaaaacctccatagggctgttatgcgtcatggccagctcggtcttgctttggatggccagcgttgagcctcactggatcgcggcctccatcatcctggagttcttccttatggtcctgcttatccccgagccggaccggcagcgcacgccgcaggacaaccagctcgcatacgtagtgatcgggttattatttatgattctcactgtcgccgcgaacgagatgggcctgctggagacaaccaaaaaggacctcggcataggtcacgtggcggtggagaaccaccaccacgccgccatgctagacgtagacctgcacccggcatcagcctggacgctatacgcagtagccaccaccatcatcacgccgatgatgcgccacacgatagagaatacgacggccaatatttccctgaccgccatcgcaaaccaggcggcgattttaatggggctcgacaaaggctggcccatcagcaaaatggatatcggagtgccattgctggccctcgggtgctactcacaggttaaccccttgacgctgacggccgcggtgcttatgcttgttgcccactatgcaatcatcggcccggggctgcaagccaaggccacacgggaggcgcagaaacgtaccgcagctggcatcatgaaaaatcccacggtcgacgggatcgtggccattgacctggaccccgtggtatacgacgccaaattcgaaaagcagctggggcagataatgctgctcatcctgtgcaccagccagatcctgctcatgagaaccacctgggcactgtgcgaatccatcacgctggcaaccggccccctcacgaccttgtgggaagggtcaccaggtaagttctggaatacgactatcgccgtgtccatggccaacatctttagaggtagctacctggccggcgccggcctcgcattctccctaatgaaatccctcgggggcgggcggcggggaacaggggcgcagggggagaccctcggggaaaagtggaagcggcagctgaaccagctaagcaagtccgaattcaacacgtataagcgcagcgggattatggaggtcgacaggagcgaggcaaaggagggactcaagcgaggggagacgacgaagcacgcagtcagccggggcaccgccaagctccgctggttcgtggagcggaacttagtgaagcccgaggggaaggttatcgatttaggctgtggccgagggggctggagctactactgtgccgggctgaaaaaagtgacggaggtgaaaggttacacgaagggcgggcctgggcatgaagaacccatccccatggccacctacgggtggaatctggtgaagctgcactcaggcaaggatgtgttcttcattccacccgagaagtgtgacaccctcctgtgcgacatcggtgaatccagccccaatccgacgatagaggaaggcagaaccctgcgagtgcttaaaatggtcgagccctggctacgggggaaccagttctgcatcaagatcctgaacccctacatgccctccgtggtggagaccctcgaacagatgcaacgcaaacacggcgggatgcttgtccggaaccctctcagtcgcaactccacccacgagatgtactgggttagctgcgggactggcaatatcgtgtccgcggtcaacatgacaagccgcatgctactgaacaggttcaccatggcccaccgcaaacctacatacgagcgtgacgtggacttgggtgccggaacccgccacgtggccgtagagccagaggtggccaacctcgacatcatcggtcagcggatcgaaaatatcaaacatgagcacaagtcaacgtggcactacgacgaggataatccctacaaaacctgggcctaccacggttcgtacgaggtgaagccctccgggagcgcgtccagcatggtcaacggggtggttaagctcctgactaagccctgggacgtgatccccatggtgacacaaatcgccatgacggacaccacgcccttcgggcaacagcgcgttttcaaggagaaagtggacacacggacgccgaaggccaagagagggacggcgcaaatcatggaagtaaccgccaagtggttgtggggattcctgagccggaacaagaagccacgcatttgtacccgggaagagtttactcgcaaagtccgatccaacgcggccataggcgcggtattcgtcgacgagaaccagtggaacagcgccaaggaggcagtcgaggacgagcgcttctgggacctggtgcatcgagagcgagagctacacaagcagggcaagtgcgcgacctgcgtgtacaacatgatgggaaagcgggagaaaaaactgggggagttcggtaaggccaaggggtcgcgcgccatctggtatatgtggttgggcgcccggtttctcgaattcgaggcgctgggcttcatgaacgaggaccactggttctctcgcgagaactccctatctggggttgagggcgaggggctccacaaactgggatacatactgcgggacatctccaagatacccgggggcaacatgtacgccgacgacactgccggatgggacacccgcattacggaggacgacctccagaacgaggcccgcataacagatatcatggaaccggagcacgcactactcgcgaagagcatcttcaagctcacctaccagaacaaagtggtgcgggtgcagcgccccgccaagaacggcaccgttatggatgtgatcagccggcgcgatcaaaggggcagcgggcaagtcgggacgtacgggttaaacacctttacaaacatggaagctcaattaatccgtcagatggagtccgagggtatctttagcccctccgagctagagacgcccaatctggctgagcgcgtactggactggctcgagaagtacggcgtggagcgactgaagcggatggcaataagcggcgatgactgcgtcgttaagccgatcgacgaccggtttgcgacggccctaaccgctctcaacgacatggggaaggtacggaaagatataccccaatgggagccatccaagggttggaatgactggcagcaggtcccattctgctcccaccacttccaccagttgatcatgaaagacggacgggaaatcgtggtcccatgccggaaccaagacgagctggtaggccgcgcccgggtctcgcagggggccggctggtcgcttagagaaaccgcttgtctgggcaagagctacgcccagatgtggcagctaatgtacttccaccggcgtgacctgcgtttggccgcaaatgcgatatgttctgccgtcccagtcgattggatacctaccagcagaacaacctggagtatccatgcgcatcatcagtggatgaccacagaggatatgctgagcgtctggaaccgcgtttggatcgaggaaaacccctggatggaggacaagacgcacatttccagctggggcgatgtcccgtacctcgggaagcgggaggaccagtggtgcggcagcctgatcggcctgaccgccagggccacttgggcgaccaatatacaagtggccattaaccaggtgcgacgcctcatcggtaatgagaactacctggactacatgaccagcatgaagaggttcaagaacgagagcgatcctgagggggccctgtggtga

SEQ ID NO: 24240 - RNA, 9879 nt, synthetic construct
  misc_feature 1..9879: note = derived and/or modified CDS sequence (opt11) from DENV-1__FJ410278__SS-prME
  source 1..9879: mol_type = other RNA
agcgtgaccatgctgctcatgctgatgcccaccgccttagccttccatctcaccacccgtggcggcgagccccacatgatcgtgagcaagcaagagcgggggaagagcctgctgtttaaaacttccgccggcgtcaacatgtgcaccctcatcgccatggaccttggcgagctgtgcgaggataccatgacctacaagtgcccccggatcactgagacggagcccgatgacgtggactgctggtgcaacgccacggacacctgggtcacgtacggaacttgcagccagacgggcgagcaccggcgagacaagagatccgtggcacttgccccccacgtgggcctcgggctggagacccgcacagagacctggatgtcctccgagggcgcgtggaagcagatccagcgggtcgagacgtgggccttgaggcaccccgggttcactgtaatcgccctgttcctggctcacgccatcggcaccagcatcacccagaaggggataatcttcatcctcctgatgctggtgacgccctccatggccatgcggtgcgtcggaatcggcagccgcgacttcgtggaagggctctccggcgccacctgggtggacgtcgtgctagaacacgggagctgcgtcaccaccatggccaaagacaagcccacgctggacatcgagttactgaagaccgaggtcaccaatcccgcggtactgagaaagctctgcatcgaggcgaaaatctcaaacaccacgaccgacagccgctgccctacccagggcgaggccaccctagtggaggagcaggacgccaactttgtttgccggcgtaccttcgtggaccgaggctgggggaacggctgcggactgttcggaaaggggagcctcatcacgtgcgccaagttcaaatgcgtgaccaagctggagggcaagatcgtccagtatgaaaacctgaagtacagcgtgatcgttaccgtccacacgggagaccagcaccaagtggggaacgagtccaccgagcacggcaccaccgccaccatcactcctcaagcgcccactaccgagatccagctcaccgactacggggccctgacgcttgactgcagcccccgcaccggtctcgacttcaacgaaatggtcctgctgaccatgaaggagaagtcgtggctcgtgcacaagcagtggttcctggaccttccccttccctggaccagcggggccagcacgtcccaggagacctggaaccggcaggacctgctagtgaccttcaagaccgcccacgcaaagaagcaggaggtcgtggtgcttggcagccaggagggcgcgatgcacacggccctgaccggggcaaccgagatccaaacctcgggcacgactaccatcttcgccggtcacctgaagtgccgcctcaagatggacaaactgactctgaagggcatgagctacgtcatgtgcactggatccttcaagctcgagaaggaggtggccgagacccagcacggcaccgtgctggtccagatcaaatatgagggcaccgacgcgccgtgcaagatccccttctctacgcaggatgagaagggggtgacgcagaacggccggctgatcaccgccaaccccatcgttaccgacaaggagaagcccgttaacattgaggccgagccgccgttcggagagtcatacatcgtgattggcgctggcgagaaagcgctgaagctcagctggttcaagaaggggagcagcatcggcaagatgtttgaggccacggcccggggggcccggcgcatggccatactgggcgacaccgcgtgggacttcgggtccatcggaggcgtgttcaccagcgtcggtaagctggttcaccagatcttcggcaccgcttacggtgtccttttcagcggcgtctcttggacgatgaagatcgggatcggcgtgctgctgacgtggctcggcctgaactcccgcagcacctcgctgagcatgacctgcatcgctgtgggcctcatcaccctgtacctaggagtcatggtgcaagccgactcggggtgcgtgattaactggaagggccgggagctcaaatgcgggagcggcattttcgtcactaacgaggtgcacacctggaccgaacagtacaagttccaagccgacagcccgaagaggctgagcgcggccatcggcaaggcctgggaggaaggggtttgcggcatacggagcgccacccgcctggagaacatcatgtggaaacaaatctccaacgagctcaaccacatcctactggaaaacgacatgaagttcacggtcgtggtgggggacgtcgctggcatcctcgcgcaagggaaaaagatgatccggccccagcccatggagtacaagtacagctggaaatcctggggcaaagccaaaatcatcggcgccgacgtgcagaacaccaccttcataatcgacgggcccaacaccccggagtgccccgacgaccagagggcctggaacatctgggaagtggaggactacggtttcgggatttttacgaccaacatctggctgaagttacgggacagctacacccaggtctgcgaccaccgcctcatgtccgcggccatcaaggacagcaaggccgtgcacgccgacatgggctactggatcgagtccgagaagaacgagacctggaagctggcccgtgcaagctttatcgaggtgaagacgtgcatctggcccaagtcccacaccctgtggagcaacggcgtcctcgagtccgagatgatcatccctaagatatacgggggcccgatcagccagcacaactaccgcccagggtactttacgcaggcggcgggcccctggcacctggggaagctggagctcgacttcgatttgtgcgagggcaccaccgtggtggtcgacgagcactgcggcaaccggggaccgtcccttcgcaccacaaccgtgacgggcaagatcattcacgagtggtgctgccggagctgcaccctgccgcccctccgctttcgcggggaggacggctgctggtacgggatggagatccgccccgtgaaggagaaggaggagaacctggtcaagtccatggtgtcggccggcagcggcgaggtggattcgttctcgctcgggctgctgtgcatctccatcatgatcgaggaggtcatgcggagccggtggtcccggcgcatgctcatgaccggcaccctggccgtgttcttcctgctcataatggggcagttgacgtggaacgacctgatccgcctctgcataatggtgggcgcgaatgcgtccgaccggatggggatgggaaccacctacctggccctgatggccacattcaagatgcgcccgatgttcgccgtcggcctcctgtttaggcgccttacttcccgcgaggtgctcctgctgacgatcgggctcagcttggtggcttccgtcgagctgccaaactcactcgaggagctgggcgatgggctggccatgggcatcatgatcctcaagctgctaaccgacttccagtcccaccagctctgggccaccctgttgagcctcacgttcatcaagaccaccttctccctccactacgcctggaagaccatggccatggtgcttagcatcgtctccctcttccccctatgtctgagcacgacttcccaaaagaccacctggctcccggtgttactgggcagcctcgggtgtaagcctctgacgatgttcctgattgccgagaacaaaatctggggccgcagatcctggcccctcaacgagggcatcatggccgtgggcatagtcagcatcctgctgagctccctcctgaagaacgacgtgcccctggccggacccctcatcgccggcggcatgctgatcgcgtgctatgtgatcagcggttctagcgccgacctgtccctcgaaaaggccgccgaggttagctgggaggaggaggccgagcattccggcgcgagccacaacatcctggtggaggtgcaggacgacgggaccatgaagatcaaggacgaggaacgcgacgacaccctgaccatcctcctaaaggcaaccctgcttgccgtctcgggcgtgtacccgctgagcatcccggccacgctgttcgtgtggtacttctggcaacgcaagaaacagcgctccggggtcctctgggacacccccagcccgccagaagtggaacgggcagtgctggacgacggcatctatcggatcatgcagcggggcttgctgggacgctcccaggtaggcgtgggggtgtttcaggagaatgtgttccacaccatgtggcacgttactcggggagcggtgctcatgtaccaggggaagcgcctggagcccagctgggcctccgtcaagaaggacctcataagctacggcggcgggtggcggctccagggctcctggaacacgggggaggaggtccaggtgatcgcagtcgagcccggcaagaaccccaagaacgtgcagaccgcccccgggaccttcaagaccccggaaggcgaggtcggagccatcgcgctggacttcaagcccggaaccagcggctctcccatagtcaaccgcgagggaaagatcgtgggcctgtacggcaacggcgtggtcaccacctcaggcacatacgtcagcgccatcgcccaggccaaggcgtcccaggagggtcccctccccgagatcgaagacgaggtgtttcggaagcgcaatctgacaatcatggacctgcaccccggctcagggaagacccggagatacctcccggccatcgtccgcgaagccattaagcggaagctgcgcaccctgatccttgcccccacccgggtggtggcgtccgagatggcggaggccctgaagggcatgcccatccgctaccagacgaccgccgtcaagagcgagcacaccggcaaggagatcgtggacctgatgtgccacgccactttcacgatgcggctcctgtcccccgtccgcgtccccaactacaacatgatcatcatggacgaggcccacttcaccgaccccagttccattgccgcgcgggggtacatatctacccgcgtgggcatgggggaggccgccgccatcttcatgaccgccactccgcccggctccgtggaggccttcccgcagtcaaacgccgtcatccaggacgaagagcgcgacatccccgagcgatcctggaacagcgggtacgagtggatcaccgatttccccgggaaaaccgtgtggtttgtaccctccattaagagcggcaacgacatcgccaattgcctgcgcaagaatggtaagcgcgtcatccagctctcccggaagaccttcgacaccgagtatcagaagaccaagaacaacgactgggattacgtggtgaccaccgacattagcgagatgggagctaacttccgtgcagaccgggtcatcgacccgcgccggtgcctgaagcccgttatcctgaaagatgggcccgagcgtgtgattctagctgggcccatgccggtaacggtggcctccgccgcgcaacggcgcgggcgcatcggccggaaccacaataaggagggcgatcaatatatctacatggggcagcccttgaacaacgacgaggaccacgcccactggaccgaggccaagatgctgctcgacaacatcaacacccccgagggcatcatccccgccctgttcgagccggagcgcgaaaagtccgccgcgatcgacggggagtaccggctgcgcggcgaggcccggaagaccttcgtcgagctcatgcgtcgcggggacctgcccgtatggctctcttacaaggtggcctcggagggctttcagtacagcgaccgccggtggtgcttcgacggggagcgaaacaaccaagtactcgaggagaacatggatgtggaaatctggacgaaggagggggaacggaaaaagttgcgccccagatggctggacgcccgcacctactccgatcccctcgccctaagggaattcaaggagttcgcggccggacgccggagcgtgtccggggacctgatcctcgagatcggcaagctaccacagcacctgacccaacgtgcccagaacgccctcgacaacctggtcatgctgcacaacagcgagcaaggcggtcgggcgtaccgccacgccatggaggagctccccgacacgatcgagacgctgatgctactcgccctgatcgccgtgttaaccggcggtgtgaccctcttcttcctctccggccggggcctgggcaagaccagcatcgggctcctgtgcgttatggccagtagcgtgttattatggatggcgtcggtggagccccactggatcgccgccagcatcatcctggagttcttcttaatggtcctcctgatccccgagcctgacaggcagcgcacgccccaggataaccagttggcctacgtggtgatcgggctcctgttcatgatcctgacggtcgccgctaacgagatgggcctcctggagaccaccaagaaagacctgggcatcggccacgtggccgtggaaaaccatcaccacgccgccatgctcgacgtcgacttgcaccccgccagtgcgtggaccctgtatgccgtcgcaacgaccatcatcaccccgatgatgcgacataccattgagaataccaccgccaacatcagcctcaccgccatcgcgaaccaggcagccatcctaatggggctggacaagggttggcccatctccaagatggacataggagtcccactcctggccctagggtgctactcgcaggtgaaccccctcaccctgacggccgccgtgctgatgctcgttgctcactacgcaatcatcggaccgggactgcaggccaaggcgacccgcgaggcccagaagcgaaccgctgccggcatcatgaagaatcccaccgtcgacgggatcgtggccatagacctggaccccgtggtctacgacgcgaagtttgagaagcagctcggccagatcatgctgctcatcctctgcacatcccagatcctgctaatgcgcaccacttgggccctctgcgaaagcatcaccctggctactggccccctgaccaccctctgggaggggtccccgggcaagttctggaataccacaatcgccgtcagcatggcaaacatcttccggggatcctatctggcgggtgcgggcctggcattcagcctaatgaagtccctcggcggcgggcgccgggggaccggggcccagggcgaaactctgggcgagaagtggaagcgccagctcaaccagctatccaagagcgagttcaacacctataagcggtctgggatcatggaagtggaccgcagcgaagcgaaggagggcctgaagcgcggggagacgaccaagcacgcagtatcccgcggcaccgccaagctccggtggttcgtggagcgaaacctggtaaagcccgaggggaaagttatagacctgggctgcggccgcgggggctggagctactactgtgccggtctgaaaaaggtgaccgaggtgaagggctacacgaagggcggccccggccacgaggagcccattccgatggccacttacgggtggaacctcgtcaagctgcacagcggcaaggacgtattcttcatcccgcccgaaaagtgtgacaccctgctctgtgacatcggggagagcagtcccaacccgaccatcgaggagggccgcacgctgcgggttctgaagatggtcgagccctggctccgcgggaatcagttctgcatcaagatcctgaacccctacatgcccagcgtggtggagaccctggagcagatgcagcggaaacacggcggcatgctcgtccgtaacccgctgtcacgcaactctacccatgagatgtactgggtgtcatgcgggacgggcaacatcgtgagcgcggtgaacatgacctcccggatgctgctcaaccgcttcaccatggcccaccggaagcccacctacgagcgcgacgtggatctcggggcaggcacgcggcacgtggccgtagagcccgaggtggccaacctggacattattggccagcggatcgagaacatcaagcatgagcacaagagcacctggcactacgacgaagacaacccctacaagacatgggcgtaccacgggtcctacgaggtgaagccgagcggctctgcctcgagcatggtcaacggggtagtcaagctcctgaccaagccctgggacgtgatacccatggtgacccagatcgccatgaccgacacgacccccttcggccagcagcgggtgttcaaggagaaggtggacacccgcaccccgaaggccaagcgggggaccgcccagatcatggaggtgaccgcgaagtggctgtggggcttcctgtccaggaacaagaagccccggatctgtacccgcgaggagttcacccggaaggtccgctctaacgccgccatcggcgccgtgttcgtggacgagaaccagtggaattcggcgaaggaggccgttgaggacgagcggttctgggacctggtgcaccgcgagcgggagctccataagcagggaaagtgcgctacgtgcgtgtacaacatgatgggcaagcgcgagaagaagctcggggagttcggcaaggcaaaggggagccgcgccatctggtacatgtggctgggtgcccgtttcttagagttcgaggccctcggcttcatgaacgaggaccactggttttcccgggagaattcgctcagtggcgtcgaaggcgaggggctgcacaagctcggatacatcttgcgcgacatcagcaagatacccgggggcaacatgtacgctgacgacaccgccggctgggatacccgcatcaccgaggacgacctgcagaacgaggcccggattacggacatcatggagccggagcacgcgcttttggccaagtccatctttaagctgacctaccagaacaaggtcgtgagagtccagcggcccgccaagaacgggaccgtgatggatgtgatcagcaggagggaccagcgcggcagcgggcaggtcggcacctacggcctcaacacgttcaccaacatggaggcccagctgatccggcagatggagtctgaggggatcttctcccccagcgagctggagacccccaacctcgccgagcgcgtgctggactggctggagaagtacggtgtggagcggctcaagcgcatggcgatctctggggacgactgcgtcgtgaagccgatcgacgaccggtttgccacggcactgacggccctgaacgacatgggcaaggttcggaaggacatcccccaatgggagccctcgaaggggtggaacgactggcagcaggtccccttctgctcccaccatttccaccagctcatcatgaaggacggccgggagatagtggtgccgtgccgcaaccaagacgagctggtgggccgcgcccgcgtgagccagggggcgggctggagcttacgggagaccgcctgccttgggaagtcctatgctcagatgtggcagctgatgtacttccatcgccgggacctgcgcttagccgctaacgccatctgttcggctgtgcctgtcgattggatcccgacatcccgcaccacgtggtccatccacgcccaccaccagtggatgaccaccgaggacatgctgtccgtgtggaaccgggtgtggattgaggagaatccctggatggaggacaagacccacatcagctcgtggggcgacgtgccgtacctggggaagcgcgaggaccagtggtgtggcagccttattggcctgacggcccgggctacctgggccactaacatccaggtggcaatcaaccaggtgcgccgcctgatcgggaacgagaactacctcgactacatgacctccatgaagcgcttcaagaacgagagcgaccccgagggcgccctgtggtga

SEQ ID NO: 24241 - RNA, 9879 nt, synthetic construct
  misc_feature 1..9879: note = derived and/or modified CDS sequence (opt11) from DENV-1__FJ410279__SS-prME
  source 1..9879: mol_type = other RNA
agcgtgaccatgttactcatgctgatgccgaccgctctggcctttcacctcaccaccagaggcggggagccccacatgatcgtgagcaagcaagagcggggcaagagcctgctgttcaagactagcgctggggtgaacatgtgtacattaatcgccatggacctgggggagttttgcgaggacacgatgacctacaaatgcccccggatcaccgaggccgagcccgacgatgtggactgctggtgcaacgccacagacacgtgggtgacatacgggacctgttcccagaccggcgagcaccggagggataagcgatccgttgctctagcgccccacgtcggcctcggactggaaacgaggacggagacttggatgtcttcggagggcgcctggaagcagattcagcgggtggagacatgggccttgcgccaccccgggttcacagtgatcgccctctttctcgcgcacgccataggcaccagcatcacccagaaggggataatcttcattctgctgatgctggtgaccccctccatggccatgagatgcgtaggcatcggctcacgcgacttcgtggaggggctgtccggcgctacgtgggtggatgtcgtgctcgagcacgggagctgtgtgaccaccatggcgaaggacaagccgaccttggacatcgaactgcttaaaacggaggtcaccaacccagctgtactgcgaaagctgtgcatagaggccaagatatccaacacgacgacggatagccgctgcccgacacagggcgaagcgaccctcgtcgaggagcaggatgccaacttcgtctgccggcgtacattcgtggaccggggttgggggaacggatgcgggctgttcggcaaggggtccttgatcacgtgcgcaaagtttaagtgcgtgaccaagctcgagggcaaaatcgtccagtatgagaacctgaaatatagcgtgatcgttacagtccacactggagaccagcatcaggtggggaacgaatctactgagcacggcaccactgcgactatcactccacaggcccccagcacggagatccagctgaccgactacggggccctcaccctagactgcagcccccgtaccggcctggattttaacgagatggtcctcctcacaatgaaggaaaagtcatggctggtgcataagcagtggttcctcgacctgccgctgccctggacctctggggcctccaccagccaggagacctggaaccggcaggacctcctagtgacgtttaaaaccgcccatgcgaagaagcaggaggtcgtcgtgctgggttcccaggagggcgccatgcacaccgcccttacaggggccacggagatacagacctctggcacgactacgatcttcgccgggcacctaaagtgcaggctgaagatggacaagctcaccctgaaaggcatgtcctacgtaatgtgcaccgggagcttcaaacttgagaaggaggtggcggagacccagcacggcacggtcctcgtccaaatcaagtacgaaggcaccgacgcgccctgcaagattcccttctccactcaggacgaaaagggggtgacacagaacggccgcctgataaccgccaaccctattgttaccgacaaggagaagcccgtcaacatcgaggcggagccgcccttcggggagagctacatcgtgatcggcgcgggcgaaaaggccctgaagctgtcctggttcaagaaggggagctccatcggtaaaatgttcgaggccaccgcccgcggcgcccgtcgcatggccatcttaggcgacaccgcatgggacttcgggtccattggtggcgtgttcacttccgtggggaagctggtacaccaaatattcggcaccgcctacggggtgttattcagcggcgtctcctggaccatgaagatcggtatcggcgtgctcctgacgtggctgggcctcaatagccgctccacgagcctttcaatgacatgtatcgctgtggggttagtcaccctctacctcggcgtgatggtgcaggccgacagcggctgcgtcatcaactggaagggaagggagctgaagtgcgggtcgggcatcttcgtgaccaacgaggtgcacacgtggaccgagcagtacaagttccaggccgatagtccgaagcgccttagcgccgccatcggaaaggcctgggaggaaggggtctgcgggatccggtccgcgacccgcctagagaacattatgtggaagcaaattagcaacgagctgaaccacatcctccttgagaacgacatgaagtttaccgtggtggtcggggatgtggcaggcatcctggctcaggggaagaagatgataagaccccagccgatggaatacaagtatagttggaagtcctggggcaaggccaagatcatcggggccgatgtacagaataccacgttcatcatcgacgggcccaacaccccagagtgtcccgacgaccagcgggcgtggaacatctgggaagtcgaggattacggcttcggcatcttcaccaccaacatctggctcaaactgcgggactcatacacacaggtgtgcgaccaccgcttgatgagtgccgccatcaaggactccaaggccgtgcatgctgacatgggctattggatcgagtcagaaaagaacgagacctggaaacttgctagagctagcttcatagaagtcaaaacctgtatctggcccaaaagccacacgctgtggtccaatggcgtgctcgagagcgagatgatcattcccaagatctacgggggcccgatctcccagcacaattaccgccccgggtattttacccagaccgctggcccctggcacttagggaagctggagctcgacttcgacctctgcgagggcaccaccgttgtcgttgacgagcactgcggcaaccgggggccctctctacggacgaccaccgttacgggcaagatcattcatgagtggtgctgccggtcctgcacgctgccgcccctgcgtttcaagggagaggatggctgctggtacggtatggagattcggcccgtcaaggagaaggaggagaacctggtcaagagcatggttagcgcgggctcaggtgaggtcgacagcttctccctggggctcttgtgtataagcatcatgatcgaggaggtgatgcgatctagatggagccgcaaaatgctgatgaccggcaccctcgccgttttctttctgctgattatggggcagcttacctggaacgacctaatccggctgtgcatcatggttggggcgaacgcatcggaccgcatggggatgggcacgacgtacctcgcactgatggctaccttcaaaatgcgcccgatgttcgccgtgggacttctgtttcggcgtttaacctcccgtgaagtgctgctcttgacgatcggtctgtccctcgtcgcgagcgtcgagttgccgaactcccttgaggaactcggcgatgggctggccatgggcatcatgatcctgaagctgttgaccgacttccaaagccaccagctgtgggccaccctgctgtccctgaccttcatcaagacgaccttctccctccattacgcgtggaagaccatggcgatggtcctatccatcgttagcttattcccactatgcctttcaacgacttcgcaaaagacaacttggctgcccgtgctactgggctccctggggtgcaagcctctcaccatgtttctgattgccgagaacaagatctggggcaggaaaagctggcccctgaacgagggcatcatggccgtcggcatcgtcagtattttattgtccagcctgctcaaaaacgacgtgcctctggccggacccctgatcgctggcggcatgctcatcgcatgttacgtcatctccggaagctccgcagacctatctctggagaaagccgccgaggtttcttgggaggaggaggccgagcacagcggggcgtcccacaacatcctcgtggaggtacaggacgacgggacgatgaagatcaaggacgaagaacgggacgacacgctaactatcctgctcaaggccacgctgctggccgtaagcggagtatacccgctctccatccccgcgaccctgttcctgtggtacttctggcagaaaaagaagcagagaagcggcgtactctgggacacgcccagcccgcccgaggtggaacgggccgtgcttgacgatggcatataccgcatcatgcagcggggcctgctggggcgatcccaggtcggcgtgggggtctttcaagagaacgtgttccacaccatgtggcacgtgacccgaggcgcggtcctcatgtaccagggaaagcggctggagccctcctgggccagcgtcaagaaggacctgatatcctacggcggagggtggcgactccagggcagctggaacacaggcgaggaggtccaggtgatagctgtcgagcccgggaaaaatcccaagaatgtccagacggcccccgggaccttcaagacttccgagggcgaggtcggcgccatcgcgctagacttcaagccagggacaagcgggtctcccatcgttaaccgcgagggcaaaatagttggcctgtacggaaacggggtcgtcacgacctccgggacctatgtgagcgccatcgcccaggccaaagcgtcccaggaagggcctctcccggagatagaggacgaggttttccggaaacgtaacctaaccattatggacctgcaccccggcagcggtaagacacggaggtacctgcccgcaatcgtccgggaggcaatcaagcgcaagctgcgcaccctgatcctggcaccgaccagagttgttgcttcggagatggcggaagccctgaagggcatgcctatacgctaccagaccacggccgtcaagtctgagcacaccggcaaggagatcgtggacctcatgtgccacgcaaccttcacaatgcggctcctctcccccgtaagggtgcccaactacaacatgataatcatggacgaggcccacttcaccgatccgagctcgattgcggcccggggttacatctctacccgggttggtatgggggaggccgccgccatcttcatgaccgccacgccgccgggctccgttgaggcgttcccgcagagcaacgccgtcattcaagacgaggagcgggacatcccggaacgctcatggaacagcgggtacgagtggatcacggacttccccggcaaaaccgtgtggtttgtacccagtataaagtccggcaatgatatcgccaactgcttgcggaagaacggaaagcgcgttatccagctctcccggaagaccttcgacactgagtaccagaagacgaagaacaacgattgggactatgtggtaaccaccgacatatccgagatgggcgcgaactttcgcgccgaccgggtcatcgacccccgacgctgcttgaagccggtgatccttaaggatgggccggagcgcgttatcctcgccggtcccatgcctgtcaccgtggcttccgccgcgcagcggcgcgggaggatcgggcgcaaccacaacaaagagggcgaccagtacatttatatgggccagcctctgaacaacgacgaggaccatgcccactggacggaggccaaaatgctgctcgacaacatcaataccccggaggggataatccccgcactgttcgaaccagagcgggagaaatcggccgcgatcgatggtgagtaccggttacgcggcgaggctcggaagacctttgtggagctcatgagacgcggggatcttccggtgtggctcagctacaaggtggcctccgagggcttccaatacagcgaccgccggtggtgcttcgatggcgagcgcaacaaccaggtcctcgaggagaacatggacgtggagatctggaccaaagagggtgagcgcaagaagttacgccccagatggttagacgcgcgggtgtactccgaccccctcgccctacgggagttcaaggagttcgccgccggccgacggagcgtatccggggacctgatcctagagataggcaagctcccccaacacctgacgcagcgcgcccaaaacgccctcgacaacctggtgatgttacacaacagcgagcagggtggacgtgcgtaccgacacgctatggaggagctcccagacaccatcgagaccctgatgctattggccttgatcgctgtgctaaccggtggggttactctcttcttcctgtcgggccgggggctgggcaagacgagcatcggcctcctatgcgtgatggcctccagcgtgctgctgtggatggcttccgtcgaaccccactggatcgcggctagcatcatcctggagttcttcttgatggtgctcctgatacccgagcctgacagacagcggaccccacaggacaatcagcttgcctacgtggtgatcgggctccttttcatgatcctgaccgtggccgcgaatgagatgggtctcctggaaaccacgaagaaagacttagggatcggccacgtggccgtcgagaaccaccaccatgccgccatgctagatgtggatctgcaccctgcctccgcgtggacgctatacgccgtagccaccaccatcatcacaccgatgatgcgccacaccattgaaaacaccaccgccaacatcagcctaaccgccatcgcgaaccaggccgccatcttaatgggcctggacaagggctggcccataagtaagatggacataggtgtccccctcctggccctggggtgttactctcaggtgaaccctctcacactgactgcggcggtactgatgctcgtcgcgcactacgccatcatcggccccgggttgcaggcgaaggccacccgggaggcccagaaacgcaccgccgccggcatcatgaaaaatccgaccgtggacgggatcgttgccatcgacctggaccctgtggtatatgacgcgaagttcgagaagcaactgggccagatcatgctgctcatcctctgcacctcgcagatcctgctgatgagaaccacatgggccttatgcgagagcatcaccctggcaacgggcccgctgaccactctctgggaggggtcccccggcaagttctggaacaccaccatcgccgttagcatggccaatatcttccggggtagctacctcgccggcgctggactggcattctccctcatgaagtccctcggaggagggcgcagggggaccggggcccaaggagaaacgctcggcgagaaatggaagcgccagttaaaccagctgtcgaagtccgagttcaacacgtacaagcggtccgggattatggaggtcgacaggagcgaagcgaaggagggcctgaagagaggggagaccaccaagcacgctgtgtcacgcggcaccgcaaagctccgctggttcgtggaacgcaacctagtcaagccggaggggaaagtgatcgacctgggctgcgggcgcggcgggtggagttattactgcgccgggttaaagaaggtgaccgaggtcaaggggtacacgaagggcgggcccggccacgaggagccaatccccatggcaacctacgggtggaaccttgtgaaactgcactccggcaaagacgtgttcttcatcccgcccgagaagtgtgacacactgctctgtgacatcggggagagctctcccaaccccaccatcgaggagggtcgcaccctgagggtcctgaagatggtggagccgtggctccgcgggaaccaattttgcattaagatcctgaacccctacatgccctcagtggtcgagaccttagagcagatgcagcggaagcacggcgggatgctcgtgcgcaacccactgtcccggaatagcactcacgaaatgtactgggtgtcctgcggcaccggcaacatcgttagcgcggtgaacatgacctcacgcatgctgcttaatcggtttacgatggcccaccgcaaaccaacctacgagagagatgtggacctgggggcaggaacgcggcatgtcgccgtggagccagaggtggccaatttagacatcatcgggcaacgcatcgagaacatcaagcacgagcataagagcacttggcactacgacgaggacaacccttacaagacctgggcgtatcacgggtcctatgaggtcaaaccctcgggcagcgcctcctcaatggttaatggggtcgtgaagctcttgaccaaaccgtgggacgtgatccccatggtcactcagatagcgatgacggacaccacccctttcggccagcaacgggtgttcaaggagaaggtagacacgaggacccccaaggcaaagcgggggacggcccagattatggaggtcaccgccaagtggctgtggggtttcctctcccgcaataagaagccgcgaatatgcacccgcgaggagttcacacggaaggtacgcagcaacgccgcaattggcgccgttttcgtcgacgagaaccagtggaactccgcgaaggaggcagtggaggacgagcgcttctgggacctggtgcaccgcgagcgagagctccacaagcaggggaagtgcgcaacctgcgtctataacatgatgggcaagcgcgagaagaagctaggggagttcggcaaggccaaggggagccgggccatctggtacatgtggctgggtgcgcgcttcctggagttcgaggcgctcgggttcatgaacgaggaccactggttctctcgcgaaaacagcctgtccggcgtggagggcgaggggcttcacaagctcggctacatcctgagagacatcagtaagatcccaggtggcaatatgtacgccgatgacaccgccggctgggatacacggatcactgaggacgacttgcaaaacgaggccaagattaccgacattatggaacccgagcacgctctcctggccaagagcattttcaagctgacctaccaaaacaaggtggtccgcgtgcagcggccggccaagaacgggaccgtgatggacgtcatcagccgcagggatcagcggggctccggccaagtcggcacctacggcctcaacacttttaccaatatggaggcgcagctcatccgccagatggaaagcgagggtatcttctccccgagcgagttggagacgcccaacctcgccggccgggtgctggattggctagagaagcacggtgtcgagcggctcaagcggatggcgatctccggcgacgactgcgtggtgaagccaattgacgatcgcttcgccactgccctgaccgccctgaatgacatgggcaaagtacggaaggacatcccgcagtgggaacctagcaagggctggaacgactggcagcaggtccccttctgcagccaccacttccatcagctcatcatgaaggacggcagagagatcgtcgtcccctgcagaaaccaagacgagctggtggggcgcgcccgggtgagccagggcgcgggttggagcctgcgggaaacagcatgtctcggcaagtcctacgcgcagatgtggcaactgatgtatttccaccggagagacttgaggctcgccgcgaacgccatatgctcggcggtcccggtggactgggtgccaacatcccgcacaacctggagcatacatgctcaccaccaatggatgaccacggaggacatgctgtctgtttggaatcgggtgtggatagaagagaacccctggatggaggacaagacccacatctcgtcctggggcgacgtgccatacctaggcaaacgcgaggaccaatggtgcggctcacttatcggattgaccgcccgggcgacatgggccacgaatatccaggtcgccatcaaccaggtgcgccgcctgatcggaaatgagaattacctcgactatatgacctccatgaagaggttcaagaacgaaagcgatccggagggggccctgtggtga

SEQ ID NO: 24242 - RNA, 9879 nt, synthetic construct
  misc_feature 1..9879: note = derived and/or modified CDS sequence (opt11) from DENV-1__FJ410283__SS-prME
  source 1..9879: mol_type = other RNA
agcgtgacaatgctactaatgctaatgccaaccgccctggccttccacttgacgacccggggcggggagcctcacatgatcgtgagcaagcaggagcgggggaagagcctgctcttcaagaccagcgcaggggttaacatgtgtactttgattgccatggacttaggcgagttatgcgaggacaccatgacgtataagtgccccagaatcaccgagactgagcccgacgacgtggattgctggtgcaacgccactgatacttgggtgacctacgggacatgcagccagacgggcgagcatcggcgggacaaacgatccgtagcactcgcgccccacgtgggcctggggctggagacacgcacagagacgtggatgagctccgagggggcctggaagcagatccagcgggttgagacgtgggctttgcggcacccagggttcaccgtaatcgccctcttcctggcccatgcgatcggcacaagcatcacccagaaaggcattatcttcatcctgctgatgctggtgactccaagcatggccatgagatgtgtcgggattggcagccgcgacttcgtggaagggctctccggggccacgtgggtggacgtcgtgctagagcacgggtcgtgcgttacgaccatggccaaggacaagcccacgctggacatcgaactcctaaagaccgaggtcactaaccccgccgtgctccggaagctttgcatcgaggcgaagatctccaacaccacgaccgatagcaggtgccctacacagggcgaggccactctggtcgaggagcaggacgctaacttcgtctgccggcgcacgtttgtcgaccgtggctggggaaacggctgcggtctcttcggcaaggggtccctcatcacgtgcgccaagttcaagtgcgtgacgaagctggagggcaaaatcgtccaatacgagaaccttaaatactcagtgatcgtgacggtccacacgggcgaccagcaccaggtgggtaatgaatctacggagcacggcactaccgccaccatcacgccccaagcgccaaccacggagatacagctcaccgactacggggcgctgacgttagactgctcccctcgaaccggcctcgacttcaatgagatggtgctgttaaccatgaaggagaagtcctggctcgtccataagcagtggtttcttgacctgcccctaccctggacctcaggtgccagcacgagtcaggagacctggaacaggcaagatctactggttaccttcaagaccgctcacgccaagaagcaggaagtcgtggtgttgggaagtcaggagggcgccatgcacacggccctgactggcgctaccgagatccagaccagtggtaccaccacaatcttcgccggacacctgaaatgccgcctcaaaatggacaagctgaccctgaagggcatgagctacgtcatgtgcacggggtcattcaagttggaaaaagagctggccgagacgcagcacggcacggtgttggtgcagatcaagtacgaggggaccgacgccccctgcaaaatccccttctctacccaggacgaaaagggggtcacccagaacggcaggctgatcactgccaacccgatcgtcaccgacaaggagaaacccgtgaacatcgaggcggagccaccctttggcgagtcgtacatcgtcatcggggccggcgaaaaggcgctcaagctgagctggttcaagaaagggagtagcatcgggaagatgttcgaggccacagcgcgtggagcccgccgcatggccatcctcggtgacaccgcgtgggacttcggttccatcggcggcgtgttcacctctgctgggaagctcgtgcaccagatcttcggcaccgcctacggggtcctgttctccggcgtgtcctggacgatgaagataggcataggcgtcttgctcacctggcttggcctgaactcccgctctaccagtctcagcatgacctgtatcgccgtcggactggttacgctgtacctgggagtgatggtccaagccgactccgggtgtgtaattaattggaagggccgggagctgaagtgcggaagcggcatattcgtgacaaatgaagtacacacctggaccgaacagtacaagttccaggctgattcgcccaagcgcctgtccgccgctatcggtaaggcctgggaggagggggtgtgcggcatccggtcggccacccgtttggagaacatcatgtggaagcagatctcgaacgaactgaaccacatcctgctcgagaacgacatgaagttcacagtggtcgtaggggacgtagctggcatcctggcccaggggaagaagatgattcggccccagcccatggaatacaagtattcatggaagtcctggggaaaagctaagatcatcggagccgacgtccagaacaccactttcatcatcgacggcccaaacaccccggaatgccccgacgaccagagggcgtggaacatctgggaggttgaggactacggcttcggcatcttcacaaccaacatctggctgaagctgcgggacagctatacacaggtgtgcgaccaccggctgatgtccgccgctatcaaggattcaaaagccgtgcacgccgatatggggtattggatcgaatccgagaagaacgaaacctggaaacttgcgcgggccagcttcattgaggtgaaaacgtgcatctggccgaagtcgcacaccctctggagcaacggcgtcctggagtccgaaatgataatcccaaaaatctacgggggcccgatcagccagcataactaccgcccgggctactttacgcaaaccgccggcccctggcatctggggaagctcgagctggacttcgacttgtgtgagggcaccaccgtagtggtggacgaacattgtggcaaccgggggccgtccttgcgcaccaccacggtcacgggaaaaatcatccacgagtggtgttgccggagctgcacactgcctcccctgcgattccgcggggaagatggttgctggtacggtatggagatccgcccagtgaaggaaaaggaggagaacctcgtaaagagtatggtgtctgccggcagcggcgaggtggactccttctcgctcggcctgctctgcatttccatcatgatcgaggaagttatgaggagccgctggtcccggaagatgctgatgacaggaacgctggccgtcttttttctcctcatcatggggcagctgacttggaacgacctcatccgactgtgcataatggtcggcgcgaacgccagcgacaggatggggatgggcaccacctacctggccctcatggccactttcaaaatgcggccgatgttcgccgtcggactgctgttccgccgactcacctcccgcgaggtcttactactcaccatagggctgagcctggttgcttccgtggagctccccaacagtctggaggagctgggcgacgggctcgccatgggaataatgatcttaaagctgctcaccgacttccaaagtcatcagctgtgggccacgttattaagcctgacattcataaagaccactttctccctgcactatgcatggaagacaatggccatggtcttaagcatcgtgtccctgttcccgctgtgtctaagcacaactagccagaagacgacctggcttccagtgctgctcggcagcctggggtgcaagccgctgaccatgttcctcatcgccgagaacaaaatctggggacggcggtcctggcccctgaacgaggggatcatggccgtgggcatcgtgagcatccttctcagttcgctgcttaagaacgacgtccccctcgccgggcccctgatcgccggcggcatgctgatcgcgtgctacgtaatctcagggtccagtgccgatctctctttggaaaaggcggccgaggtgtcctgggaggaagaagccgagcactccggggcgagccacaacatcctcgttgaagttcaggatgacgggaccatgaagattaaggacgaggagcgagacgacaccttaaccatcctactgaaagcaacgttgctggccgtgtccggcgtatacccgctgtctattcccgccaccttgtttgtatggtacttctggcaaaagaaaaaacagcgctccggggttctgtgggacaccccctccccccccgaggtcgaacgggccgttctggatgacggcatctatcgcatcatgcagcgggggctgctcggtcgctcccaagtgggcgtcggggtgtttcaggagaacgtgttccacaccatgtggcacgtcacaagaggcgcggtgctgatgtaccaggggaagcgcttagagcccagctgggcctccgtgaagaaggacctcattagctatggcggcggttggcgcttacagggctcctggaatacgggggaggaagtccaagtgatcgccgttgagcccggcaagaatcccaaaaacgtccagaccgcgcccgggaccttcaagaccccagagggcgaggtgggtgccatcgcgctcgacttcaaacctggcaccagcggttcccccattgttaaccgcgaagggaagatcgtcggcctctacggcaacggagtggtgaccacgagcggtacgtatgtcagcgccatcgcccaggcaaaggcgtcccaggaggggccgctgcccgagatcgaggatgaggtgtttcggaagcggaacctcactatcatggacctgcacccaggcagcgggaagacccggcgctacctaccagccatagtgcgtgaggcaatcaaacgtaagttacgaacactcatcctcgctcctacacgggtggtggcatccgagatggcggaggccctgaagggcatgcctatccgctaccagaccaccgccgtcaagagcgagcataccggcaaagaaattgtcgatttgatgtgccatgccactttcaccatgcggctgctgtcccccgtgagagtgccgaattacaatatgatcataatggacgaagcgcacttcaccgacccgtcatccatcgcggcccgggggtacatcagcaccagagtaggcatgggggaggccgcggccatcttcatgacggcgactccgcccgggtccgtggaggccttcccgcagtctaacgcagtgatccaagatgaggagcgggacattcccgagaggtcctggaacagcggatatgagtggatcaccgatttccccggaaagaccgtgtggttcgtcccctccatcaaaagcggtaacgacatcgctaactgtttgcggaagaatggaaagcgtgtgatacagctgtctcggaaaactttcgacaccgagtaccaaaagaccaagaacaacgactgggattacgtcgtgaccacggacatctccgaaatgggcgcaaactttcgcgcagacagagtaatagacccacgtcggtgtctgaagccggtcatcctcaaggacggaccggagcgcgtcattctggccggccccatgccggtgaccgtcgcctctgcggcacaacgccgcggacggatcggccgtaaccataataaggagggcgaccagtacatctacatgggacagcccctcaacaacgatgaggaccacgcccactggacggaggccaagatgctcctggacaacatcaacacaccagagggcatcatcccggccctgttcgagccggagcgcgagaagtccgccgcgatcgacggggagtaccggctccgcggtgaggcccgaaagactttcgtggagctaatgcgccgcggggacctgccagtatggctctcctacaaggtggcctcggagggtttccaatattccgacagacggtggtgctttgacggcgagcgcaacaatcaggtgctagaggaaaacatggacgtagagatctggaccaaggaaggggagcggaagaagctgcgccccaggtggcttgatgccagaacctacagcgatcccctggccctgcgggagttcaaggaattcgcggccggccgtcgcagcgtgtccggcgacctcatcttagaaatcggcaagctgccgcagcacctcacccagcgcgcccagaacgccctcgacaatttagttatgctgcacaatagcgaacagggaggtcgggcgtaccgccacgccatggaggagctgcctgacacgatcgagaccctgatgctcctggcactgatcgccgtgctcaccggtggagttactctgttctttttgtccggccggggcctcggcaagaccagcatcggcctgctgtgcgtaatggcaagttctgtcctcctgtggatggcgtccgtggagccccactggatcgccgcctcaatcatcttggagttcttcctcatggtgctgctgatccccgagccggaccgtcagcggactccccaggataatcagctggcctacgtcgtgattgggctgctgttcatgatactcaccgtggccgcgaatgaaatgggcctgttggagaccacaaagaaagatctaggtattggccatgttgccgtggaaaaccaccaccacgcagctatgcttgacgtggacctgcatccagcctccgcctggacgctctacgcggttgccaccaccatcatcacaccgatgatgcgccacacaatagagaacacaaccgccaacatctccttgaccgctatcgctaatcaggcagctatcctgatggggctcgacaaaggatggcccatttccaagatggacatcggggtacctctcctggccctcgggtgttacagccaggtgaatccgcttacgttgaccgcggcggtcctcatgctggtggcacactacgccatcattggaccgggactgcaggccaaggcgactcgcgaggcccagaagagaaccgccgctggaatcatgaagaatccaactgtcgacgggatcgtcgcaattgacctcgatcccgtggtgtacgatgctaaatttgagaagcagctgggccagataatgctgctaatcctgtgcacgtctcagatactgctcatgcgcacgacttgggctctgtgcgagagcatcaccttggcaaccggcccccttaccacactgtgggagggatcaccgggaaagttctggaacactaccatcgccgtaagcatggctaacatcttccggggttcctacctggcgggcgccggccttgccttcagcctgatgaaaagcctcggtggcgggcgtcgggggacaggggcccagggagagacgctcggcgagaaatggaagcgccagctgaatcagctgtccaagagcgagttcaacacatataagcggagtgggattatggaggtggaccgcagcgaggctaaggagggcctcaagcgcggcgagaccaccaagcacgctgtttctaggggtaccgcaaagctgcggtggttcgttgagaggaacctggtgaagcccgaggggaaagtgattgacctgggttgtggccgcggtgggtggagctactattgcgctgggctcaaaaaggtcacggaggtgaaggggtacacaaaagggggcccgggccatgaggagcccattccgatggccacctacgggtggaacctggtgaaactgcactccggcaaggacgtctttttcattccgccagagaagtgcgatacactcctgtgcgatatcggtgagagctcgcctaacccgacgattgaggagggacggaccctgcgggtgctcaagatggtggagccctggctgcgcggcaaccagttctgcatcaaaatcttgaacccctacatgccctctgtcgtggagaccctcgagcagatgcagcggaagcatggcggcatgctggtgcgcaatccgctttcgcggaacagcactcacgagatgtactgggtctcctgcgggacaggtaacatcgtgtctgctgtgaatatgacgagtaggatgctcctgaatagattcaccatggcccaccggaagcccacctacgaacgagacgtcgacctgggggcgggaaccaggcacgtggccgtggagcccgaggtagcaaacctcgacataatcggacagagaatcgagaacatcaagcatgaacataaaagcacctggcactacgacgaagacaacccctataagacctgggcgtatcacggatcctacgaagtcaagccctctggttccgcaagctcgatggtgaacggggtggtgaagcttttgaccaagccttgggacgtcatccctatggtgactcagatcgccatgacggacacaacgcccttcggccagcagcgggtcttcaaggagaaggtcgacacccggacgccgaaggccaagcgagggaccgcccagatcatggaggtaaccgcgaagtggctctggggcttcctgtcccgcaacaagaagccccgtatttgcacccgcgaggagttcacgcggaaggtgcgctcaaacgccgcgatcggagccgtctttgtggatgaaaaccagtggaacagtgcgaaggaggccgtggaagacgaacggttctgggacctggtacaccgcgagcgtgagcttcataagcaggggaaatgtgctacctgcgtatacaatatgatgggcaagcgcgaaaagaagttaggggagtttggtaaagctaaggggtcgcgagccatatggtacatgtggctgggcgctcgattcctcgaattcgaagctctaggtttcatgaacgaagaccactggttttcgagggagaacagtctatccggagtcgagggcgagggcctacacaagttagggtacatcctgcgcgatatctcgaagatccccggcggcaatatgtacgccgacgacaccgccggatgggacaccaggatcactgaggacgacctccaaaacgaggcgcgcatcacagacatcatggagccggaacacgcactgctggcgaagtcaatattcaagctgacctatcagaacaaggttgtacgcgtgcaacgacccgcgaagaacgggactgtcatggacgtaataagcagacgggaccagcgcggctccggtcaggtggggacctacggcctgaataccttcaccaacatggaggcccagctgatccggcagatggagagcgaggggatcttctcccccagcgaactcgagacgcccaacctggccgaacgcgtcctggactggctcggcaagtacggggtggagcggctgaagcgcatggcaatctccggtgacgactgcgtggtaaagccgatagacgatcgcttcgctactgccctcaccgcgctcaacgacatggggaaggtgcgcaaggacatccctcagtgggagccctcaaagggctggaacgactggcaacaggtccccttctgctcccaccacttccaccagctgatcatgaaagacggccgggagattgttgtgccgtgcaggaaccaagatgagctcgtaggccgggcccgcgtcagccagggcgctgggtggagtctccgagagactgcctgtctggggaagtcctatgcacagatgtggcagctaatgtacttccaccggcgggacctccgtctggcggctaatgccatatgctccgccgtgcctgtagattggattcccacttcccgaacgacgtggagtattcacgcccaccaccagtggatgaccacagaagacatgctgtctgtctggaaccgcgtttggatagaagaaaacccatggatggaagacaagacccacataagttcctggggtgacgtgccctatctcggtaagcgggaggaccagtggtgtggctctttgatcggtttaaccgccagggcgacctgggccactaacatccaggtcgccatcaaccaggtgcgccgactcatcggaaatgaaaactacttagactacatgacctccatgaagcgctttaaaaatgagagcgatcccgagggggccctatggtga

SEQ ID NO: 24243 - RNA, 9879 nt, synthetic construct
  misc_feature 1..9879: note = derived and/or modified CDS sequence (opt11) from DENV-1__FJ410284__SS-prME
  source 1..9879: mol_type = other RNA
agcgtgacgatgctgctcatgctgatgcccaccgctctggcattccacttaaccacgcgcggcggggagccccacatgatcgtgaccaagcaagagcgcggaaagagcctgctgttcaagaccagcgcgggggtgaacatgtgcaccctcatcgccatggacctgggcgagctgtgcgaggacaccatgacctacaagtgccctcggatcaccgaggccgagcccgacgacgtggactgttggtgcaacgccaccgacacctgggtgacctacgggacctgcagccagacgggcgagcaccggcgcgacaagcggagcgtggcccttgcgccccacgtcggcttagggttggagacgcgaaccgagacctggatgtccagcgagggcgcctggaagcaaatccagcgggtcgagacgtgggccctccgccaccccggcttcaccgtgatcgccctattcctagcgcacgccatcggcacctccatcactcagaaggggatcatctttatcttactgatgctagtgacgccgagtatggccatgcgatgcgtcggcatcggctcacgcgatttcgtggaagggctcagcggggcaacttgggttgacgtagtgttagagcacgggtcctgcgtcaccaccatggctaaggacaagcccacgctggacatcgagctcctgaagaccgaggtcaccaaccccgcggtcctgcggaagctctgcatagaggccaagatctcaaacaccaccaccgactcccgctgccctacccagggcgaggccaccctgatggaggaacaggacgcgaacttcgtgtgccggagaacgttcgtcgaccgggggtgggggaacggctgcggtctgttcggaaaggggagcctcatcacgtgcgccaagttcaagtgcgtaaccaaactggagggaaagatcgtgcagtacgagaacctgaagtactctgtcatcgtgaccgtgcacacgggcgaccagcaccaggtcgggaacgagagcaccgagcacggaaccacagcgaccattacgccgcaggcccccacctccgagatccagctcaccgactacggagccctaaccctggactgctcgccccgtacgggccttgacttcaacgagatggtgctgctgaccatgaaggaaaagtcttggctcgtgcacaagcagtggttcctcgacctgccgctcccctggacttccggggccagcacctcccaggagacatggaacaggcaagacctgctggtgaccttcaagaccgcccacgcgaaaaagcaggaggtggtcgtgctcggaagccaggagggcgccatgcacacagccctgacgggagctacagagatccagaccagcggcaccacgaccatattcgccgggcacctgaagtgccgcctcaagatggataagctgaccctgaagggcatgagctacgtgatgtgcaccgggtccttcaagctcgagaaggaagtcgcggagacgcagcacggaaccgtgttagttcagatcaaatacgagggcactgacgccccctgcaaaatcccattttcaacccaggacgagaagggggtcatccagaacggccggctgatcacggccaacccgatcgtgaccgacaaggagaagcccgtgaacatcgaggccgagccgcccttcggcgagtcctacatcgttattggcgtgggcgagaaggcgctgaagctgagttggttcaagaaggggagctccatcggtaagatgttcgaggccacagcccgcggggcccggcgcatggccatcctgggcgacaccgcgtgggatttcgggtccatcggcggcgtctttacgagcgtggggaagctggtgcatcagatcttcggcactgcctacggggtcctgttttccggcgtcagctggaccatgaaaatcgggattggcgtgctgctgacgtggctcggcctgaactcccgcagcacgtctctgagcatgacctgtatcgccgtggggctcgtcaccctgtacctgggcgtgatggtgcaggcggactctgggtgcgtcatcaactggaaggggcgggagctcaaatgcggcagcggcatcttcgtcaccaacgaggtgcacacttggaccgagcagtacaagttccaagctgatagcccgaagcgcctgtccgcggccataggcaaagcctgggaggagggggtctgcggaatccggagcgccacccgcctggagaatatcatgtggaagcagatctccaacgagctcaaccacatcctgctggagaacgatatgaagttcaccgtggtggttggggacgtggtgggcatcctcgcccaggggaagaaaatgatccggccccagcccatggagcataaatacagctggaagtcctggggcaaggcgaagatcatcggcgccgacgtccaaaataccacgtttatcatcgacgggcccaacaccccggagtgccccgacgaccaacgcgcctggaacatctgggaggtggaagactacggcttcgggatattcaccacaaacatctggctgaaactgcgggacagctacacgcaggcctgtgatcaccgcctcatgtcagcggccatcaaggacagtaaggccgtgcacgccgacatgggctactggatcgagtccgaaaagaacgagacctggaagctggctcgggcgagcttcatcgaggtcaagacttgcatctggcccaagtcccataccctgtggtctaatggcgtgctcgagtccgagatggtgatccccaagatctacgggggccccatctcccagcacaactaccggcctggctacttcacgcagaccgccggaccctggcacctagggaagcttgaactcgacttcgatctgtgcgagggcaccaccgtcgtagtggacgagcactgcggcaatcgagggccgtccctacgtacgaccaccgttaccggcaagatcatacacgagtggtgctgtcggtcatgcacgttaccgccactccgcttcaagggggaagacggctgctggtacgggatggagatccggcccgtgaaggagaaggaagagaacctggtaaagtccatggtcagcgctggcagcggcgaggtggattccttcagcctcgggctgctgtgcatctccatcatgattgaggaggtaatgcgctcgaggtggtctcgaaagatgttgatgaccggcaccctggccgtcttcctgctcctgatcatggggcaactgacctggaacgacctcatccgcctgtgcataatggtgggcgccaatgcgagcgaccgcatggggatgggcacgacctacctggccctcatggccacgttcaagatgcgcccgatgttcgccgtaggcctgctgttccggcgcctcaccagccgggaggtcctgctgctcacgatcgggctaagcctggtggcttctgtcgagctccccaacagcctggaggagctgggcgacgggctcgcgatgggcatcatgatcctgaagctgctcacagacttccagtcccatcagctgtgggccaccctgctcagcctgaccttcatcaagacgaccctgtccctgcactacgcctggaagactatggccatggtgctgagcatcgtgtccctgtttcccctctgccttagcaccacgtcacagaaaaccacctggctgcccgtcctcttgggcagcctcggatgcaagccgctcaccatgttcctcatcgccgaaaacaagatttggggccggaagtcctggcccctgaacgaggggatcatggccgtaggcgtggtcagcatcctcctgagctccctgctcaagaacgacgtgcccctggccgggcccttgatcgccggcggcatgctcattgcctgctacgtgatctcagggtccagcgcggacctgtccctcgagaaggccgccgaggtctcttgggaagaggaggccgagcactccggcgccagccacaacatcctcgtggaggtgcaggacgacgggacgatgaagatcaaggacgaggagaaggacgacaccctgaccatcttgctcaaggcgaccctgctggccgtctccggggtgtacccgctcagcatcccggccaccctgttcgtgtggtacttctggcaaaagaagaagcagcggtcgggggtcctttgggacacgcccagcccacccgaggtggagcgcgctgtgctggacgacggcatctacagaatcatgcagcgcggcctcctggggcggtctcaggtcggcgtgggtgtgttccaggagaacgtcttccacaccatgtggcacgtgacccgcggcgcagtgctgatgtatcagggcaagcggctcgaacccagctgggcgtccgtaaagaaggacctcatcagctacggcggcggttggcgcctgcagggctcctggaacactggggaagaagtccaggtgatcgcagtcgaacccggcaaaaacccgaagaacgtgcagacggcgcccgggaccttcaagacccccgagggcgaggtgggtgccatcgccctcgacttcaagccaggtaccagcggctcccccatcgtcaaccgggaggggaagatcgtgggcctgtacggcaacggggtggtcacgacaagcggcacctacgtgagcgcgatcgcccaggccaaggcctcccaggaagggccgctgcccgagatcgaggacgaggtgtttcgtaagcggaacctcaccatcatggacctgcatcccggcagcgggaagacgcgccggtacctgcccgcgattgtccgcgaggccaccaagcggaagctccgcaccttgatcctggcaccgaccagagtggtggccagcgagatggctgaggcgctcaagggaatgccaattcgctaccagacaaccgccgtcaaaagcgagcacacgggcaaggagatcgtggacctgatgtgccatgcaaccttcacgatgcgcctgctctcccccgtgcgggttccgaactacaacatgatcattatggacgaggcccactttaccgacccctcgtccatcgccgcgcgcgggtacatcagcacccgggtgggcatgggcgaagccgccgccattttcatgaccgccacgccgcccggctcagtggaggccttcccacagagcaacgccgtcatccaggatgaggagcgagacatccccgagcggtcctggaactccgggtacgagtggattaccgatttccccggcaagaccgtgtggtttgtgccctccatcaagagcggcaacgatatcgccaactgcctgcgcaagaacgggaaacgcgtcatccagctttcccgaaagacctttgacacggagtaccagaagaccaagaacaacgactgggactacgtggtgaccaccgacatcagcgagatgggcgccaacttccgggcggaccgggtcattgacccgcggcgctgcctcaagcccgtgatcctgaaagacgggcccgaacgggtcatcctggctggccccatgcctgtgactgtggcctccgccgcccagcgccgggggcgcatcggacggaaccataataaggagggcgaccagtacatttatatggggcagcccctcaacaacgacgaggatcacgcgcactggaccgaggccaagatgctgctggacaacatcaacacccccgagggaatcatccccgccctcttcgagcccgagagagagaagtccgccgccatcgacggggagtaccggctacgcggcgaggcgagaaagaccttcgttgagctgatgcggcgcggagacctccccgtgtggctgtcctacaaggtggcctcggagggcttccagtacagcgaccggcgctggtgcttcgacggggagcggaacaatcaggttttagaggagaacatggacgttgagatctggacgaaggaaggggagcgcaagaagctccggccacgctggctagacgcccggacttactccgatcccctggccctcagggagttcaaggagttcgccgcgggccggcgcagcgtgtccggtgacctgatccttgagatcgggaagctcccgcagcatctgacccagagagcccagaatgctttggacaacctcgttatgctgcacaacagcgaacagggcgggcgcgcctaccggcacgcgatggaggaattgcccgacactattgagacgttgatgctactggccctcatcgccgtgctgaccggcggggtgaccctgttcttcctctccggcagggggctgggcaagacaagcataggccttctctgcgtcatggcaagtagcgtgctgctgtggatggcatccgtggagccccactggatcgcggccagcatcatcctcgagtttttcctcatggtcctgctcatccccgagccggaccggcagcgtacgccccaggacaaccagctggcctacgtggtgatcggcctcctattcatgatcctcacggttgccgccaacgagatgggcctgctcgagactaccaaaaaagacctggggattggccacgtggcggtggagaaccaccaccacgccacgatgctggacgtcgacctccaccccgcctccgcctggacgctgtacgcagtggcgaccacgatcatcacccccatgatgcggcatacgatcgagaacactaccgccaacatcagcctgaccgctatcgcgaatcaggccgcgatcctcatggggctagacaagggatggcccatctccaagatggacattggagtgcccctcctcgctctggggtgctactcgcaggtcaaccccctgacgctcaccgccgccgtcctaatgctggtggcgcactacgccatcatcgggccggggctccaggccaaggctacccgtgaagctcagaagcggaccgcggccggcatcatgaagaaccctacggtcgacgggatcgtggccatcgacctggaccctgtggtctacgacgccaaattcgagaagcagctgggccagatcatgctcctgatcctgtgcacctcccagatcttgctgatgcgcaccacctgggcactgtgtgagagcatcacgctcgcgactggccccctgaccaccctgtgggaggggagtccgggcaagttctggaatacgaccatcgccgtgagcatggccaacattttccgcgggtcctacttggccggcgccgggctggcgttctcactgatgaagtccctagggggcgggcggcgcggcaccggcgcccagggtgagactctgggggagaagtggaagcggcagttgaaccagctctccaagagcgagttcaacatctacaagcgctccgggattatggaggtggaccggagcgaggccaaagagggtctgaagcgcggggagacgacccgccacgccgtctcccgcggcactgccaagctgcgttggttcgtggagcgcaacctagtaaagcccgaggggaaagtcatcgacctcggctgcggccgcggcgggtggtcctactactgcgccgggctgaagaaggtgaccgaggtgaaggggtacactaagggcgggcccggccacgaagagcctatcccgatggccacgtacgggtggaacctggtgaagctccactccggcaaagatgtgttcttcaccccgcccgagaagtgcgacaccctactgtgtgacatcggggagagctcccccaacccgacaatcgaggagggccgcaccctccgggtgctgaagatggttgagccctggctgcgcgggaaccagttctgcatcaagatcctcaatccctacatgccgtcggtcgtggagaccctggagcagatgcaaaggaagcatggtggcatgctggtgcgcaacccgctctcccggaacagcacacacgagatgtactgggtgtcctgcgggaccggcaacatcgtgagcgccgtcaacatgacgtcccgcatgttgctcaaccggttcaccatggcacaccgaaagcccacctacgaacgcgacgtggacctcggcgcgggcacccggcacgtggccgtagaacccgaggtggccaacctggacatcatcggccagcgcatcgagaatatcaagcacgagcacaagagcacatggcattacgatgaggacaacccctacaagacctgggcctaccacgggtcttacgaggtcaaaccgagcggctctgccagcagcatggtgaacggggtggtcaagctgttaaccaagccctgggacgtgatccccatggtgacgcagattgcgatgacggacaccacccccttcggccaacagcgggtcttcaaggagaaggtggacacccgcacgccgaaggccaagcgggggaccgcccagatcatggaggtgaccgcccgctggttatggggcttcctgtcccggaacaagaaaccccgaatttgcacccgggaggagttcacgagaaaggtgaggagcaacgccgcgatcggggccgtgttcgtggacgagaaccagtggaactccgccaaggaggccgtggaggacgagcgcttctgggatctcgtgcagaaggagagagagctgcacaagcaggggaagtgcgctacctgcgtgtacaacatgatgggcaagagggagaagaagctgggggaattcgggaaagccaaggggagccgggccatctggtatatgtggctcggcgcccgcttcctggagttcgaggcgctgggcttcatgaacgaggaccactggttctcacgggagaacagcctcagcggggtcgagggcgaggggctgcacaagctgggttacatcctccgcgacatctctaagatccccgggggcaatatgtacgcggacgacaccgccggctgggacacccggatcacggaggacgacctgcagaacgaagccaagatcaccgacattatggagcccgagcacgccctgctcgccacctccatttttaagctgacctaccagaacaaggtggtgcgcgtgcagcggcccgcgaaaaacggaaccgtgatggatgtcatcagccgccgcgaccagcggggctccgggcaggtcggcacttatggcctaaacaccttcactaatatggaggcccaacttatccgccagatggagagcgaggggatcttcctgccctccgagctggagacgccaaatctcgccgagcgagtgctggactggctagagaaacacggcgtggaacgcctcaagcggatggccatcagcggggacgactgcgtcgtgaagcccatcgatgatcgcttcgcaaccgcgctgacagccctgaacgacatgggcaaggtgcggaaggacatcccacagtgggagccctccaaggggtggaacgactggcaacaagtccccttctgctcacaccactttcaccagctcatcatgaaggacggccgagagatcgtggtgccgtgccggaaccaggacgagttggtcggccgcgcccgggtgtcccagggggccggctggagcctgagagaaacagcctgcctcggtaagagctacgcgcagatgtggcagttgatgtacttccaccggcgcgacttacggctggccgcgaacgccatctgctccgcggtgcccgtagactgggtgccgaccagccgcaccacctggagtatccacgcccaccaccagtggatgaccacggaggacatgctcagcgtttggaaccgagtgtggatcgaggagaacccatggatggaggacaagacccacgtatccagctggggcgacgtgccctacctggggaagcgcgaggaccagtggtgtggctccctcatcggcctgacggcccgggctacctgggccagcaacattcaggtcgcgatcaaccaagtacgcagactgatcgggaacgagaactatctcgactacatgaccagtatgaagcggttcaagaatgagggcgaccccgaaggggccctgtggtga

SEQ ID NO: 24244 - RNA, 9879 nt, synthetic construct
  misc_feature 1..9879: note = derived and/or modified CDS sequence (opt11) from DENV-1__FJ410285__SS-prME
  source 1..9879: mol_type = other RNA
agcgtgaccatgttacttatgctgatgcccaccgcccttgcctttcacctcaccacccgcggcggcgagccgcacatgatcgttagcaagcaggagcgtggcaaaagcctgttattcaagaccagtgccggagtgaatatgtgcactctcatcgccatggacctgggggaactgtgtgaggacaccatgacctacaagtgcccccggataaccgagactgagcccgacgacgtggactgctggtgcaacgctaccgatacatgggtgacctacgggacctgcagccaaaccggcgagcatcggcgcgacaaacggagcgtggcgctggcgcctcacgtggggctggggctcgagacccgcactgagacttggatgagctccgagggcgcctggaagcagatccaacgggtggagacttgggcccttcgccacccgggtttcaccgtgatcgccctgttcctggcgcacgtgatcggcaccagtatcacccagaagggaataatcttcatactcctgatgctggtgacaccctcgatggcaatgaggtgcgtgggcatcggatcccgcgatttcgtggaggggctctccggcgctacctgggtcgatgtggtgctcgaacacgggagctgtgtcacgaccatggcgaaagacaagcctacgctggacatagagctcctgaagaccgaggtgaccaaccccgcggtgctgcgcaagctctgtatagaggcgaagattagtaacaccacgaccgacagccgctgcccgactcagggcgaggcaactcttgtcgaggagcaagacgctaacttcgtgtgccgaaggacgtttgtggaccggggctgggggaacggctgcgggctgttcggcaaaggatccctcatcacgtgcgccaagtttaagtgtgttaccaagctggaaggcaagatcgtgcagcacgagaacctgaaatactcggtgatcgtcaccgttcacacgggggaccagcaccaggtcggtaatgagtctaccgagcatggtaccacagccaccatcacgccccaggcccccactaccgagatccagttgaccgactacggggcgctgagcctggactgtagcccacggacgggcctcgactttaacgagatggtgcttctgaccatgaaggagaagtcctggttagtacacaagcagtggttcctggacctgccgctcccctggacgtcgggggcctccacgtctcaggagacgtggaaccggcaagacctattagtcaccttcaagaccgcccacgccaagaaacaagaggttgtggtcttggggtcccaggagggcgccatgcacaccgcgctaactggggccacggaaatccagaccagcggcaccacgaccatcttcgcagggcatctgaagtgccgactcaagatggacaaactgaccctgaaaggcatgtcatacgtgatgtgtaccgggagtttcaagctcgagaaagaagtggccgagacgcagcatggcactgtcctggtccagatcaagtatgagggcacggacgctccctgcaagatacccttttcgacacaagacgagaaaggagtgactcagaacggccggctgattacagcgaacccgatcgtcaccgacaaggagaagcccgtgaacatcgaggccgagccgcccttcggggagagctacatcatcataggcgccggagagaaggctctgaaactatcctggttcaagaaggggagctccatcggaaagatgttcgaggcgaccgcccgcggggcgcggaggatggccatcctgggcgacaccgcctgggacttcgggagcatcggcggcgtattcacaagtgtagggaagctggtgcaccagatcttcggcaccgcctacggggttctgttttctggcgtctcctggacgatgaagatcgggatcggcgtactccttacttggctcggcctgaacagccgatccaccagcctgtccatgacctgcatcgccgtggggttggtcaccctatacctgggcgtcatggttcaggccgacagcgggtgtgttattaactggaagggcagagagttgaagtgcgggagcggtatattcgtgacgaacgaggtgcacacatggaccgaacagtacaagttccaggcggactccccaaagcggctgagcgcggcaatcgggaaagcctgggaagaaggggtctgtggcatccgttccgccacccgactggagaatatcatgtggaagcagatatcgaacgagctcaaccacatactactggagaacgacatgaaattcaccgtggtggtcggggatgtagctggcatcctagcacaggggaagaagatgatccggccccagcccatggagtacaagtactcctggaaaagttgggggaaggcgaagataatcggcgccgacgttcaaaacacgaccttcatcatcgatgggcccaacaccccggagtgccccgacgaccagcgcgcatggaatatctgggaggtggaggattacggcttcggtatattcaccacgaacatctggctgaaactgcgggactcctacacgcaggtctgcgaccaccgcctcatgagtgcggcgatcaaagacagtaaggctgtacacgccgatatggggtactggatcgagtctgagaagaatgagacttggaagctggcccgggcttcctttatagaggtcaagacctgcatctggcccaagagccatacgttatggtccaacggcgtgttagagagcgagatgatcattccgaagatttacgggggaccaatctcccagcacaactataggcctggttacttcacccaaactgcaggtccctggcacctgggcaaacttgagctcgacttcgacctgtgtgagggcaccacggttgtggtggacgagcactgcggaaaccgtgggcccagcttgcgcaccactaccgtgacaggtaagattattcacgagtggtgctgccgatcctgcacgctgccaccgttacgctttcgcggtgaggacggttgctggtacgggatggagatccgccccgtcaaggagaaggaggagaacttagtcaagagtatggtgagcgccggccccggcgaagtcgactcgttcagcctcgggctgctctgcatctccatcatgatcgaggaggtgatgcggagccgctggtcccggaagatgctgatgactggaaccttagccgtgttcttcctgctcatcatgggacaactgacatggaacgacctaatacgcctgtgcatcatggtcggtgctaatgcctcagaccgcatggggatggggacaacctacctagcgctcatggccacctttaagatgcgccccatgttcgccgtgggcttgctgttccgtcggctgacatcccgcgaggtgctcctattgaccatcgggctcagcctggtagcgtcggttgagttgcccaatagcctcgaggagctgggcgacggtctggcgatggggattatgattctcaagctcctcgcagactttcagtcccaccagttgtgggccacgctgctgtcactcactttcatcaagacaaccttttccctgcactacgcatggaagacaatggccatggtcctgagcatcgtgagcctattccccctgtgcctgagtactacgtcccaaaagacgacctggttgccggtgttattgggcagcctcgggtgcaagcccctgacgatgtttctaatcgcggagaacaagatatggggccggcgcagctggcccctcaacgaaggtataatggccgtcggcatcgtgagcatcctgctgagctcgcttctgaagaacgacgtgcccctggccggcccgctgattgcgggcggcatgttaatcgcctgctatgtcatcagcgggtcaagcgcggacctatcacttgagaaggccgccgaggtcagctgggaggaggaagccgagcactccggagcctcccataacatactggtggaggtccaggacgatgggacgatgaagatcaaggatgaggagcgggacgacaccctgacgatcctcttgaaggcgaccctgctcgctgtgtcgggcgtgtaccccctatccatccccgcaaccctcttcgtatggtatttctggcagaagaagaaacagcgctcgggggtgttgtgggatacgccctcaccgcccgaggtcgaacgggctgtcctggacgacggaatctatcgcatcatgcagcggggccttttggggcgctcccaagtcggcgttggggtcttccaggagaacgtgttccacactatgtggcacgtgacgcggggtgccgtgctgatgtaccaggggaaacgcctcgagcccagctgggcttccgtgaagaaagatttgatcagttacgggggcggatggcggctccagggctcgtggaacaccggagaggaagtgcaggtcatcgcagtggagccaggcaaaaaccccaaaaacgtccagacggcccccggaactttcaagaccccagaaggagaggtcggcgctattgcccttgacttcaagcctggtaccagcgggagcccgatcgtaaaccgcgaggggaagatagtgggcctgtacggcaacggcgtcgtcacgactagcggcacctacgtcagcgccatcgcacaggccaaagcctcccaggaggggcctctccccgaaatcgaagacgaagtcttccggaagcgcaatttaaccatcatggacctgcaccctgggagcggaaagacgcgacgctacctgcccgcgatcgtgcgagaggccataaagcgccgcttgagaaccctgatcctcgcacccactcgcgtggtcgcctctgagatggcggaggctctcaagggaatgcccattcggtatcagaccacggccgtcaagagcgagcacacgggcaaggagatcgtggacctaatgtgccacgccaccttcaccatgcggttgctgtccccggtacgggtgcccaactacaacatgatcatcatggacgaggcccatttcacggacccctcatccatcgccgcgagggggtacatcagcacccgagtgggcatgggagaggccgccgccatctttatgaccgccacgccgcccggctccgtcgaagccttcccacagagcaatgccgtaatccaggacgaggagcgcgatatccccgagcggtcatggaacagcgggtacgagtggatcactgactttcccggaaagaccgtgtggttcgtgccgtccatcaaatctggaaacgacatcgccaactgcctgcgcaagaacgggaagcgcgtcatccagctcagtaggaaaacattcgacaccgagtaccagaagactaagaacaacgactgggactatgtagtaaccaccgacatcagcgaaatgggcgccaatttccgggctgaccgtgtgatcgatcccaggcgctgcctgaagcctgtgatcctgaaggacgggcccgagcgcgtcatactcgctggcccgatgcctgtgaccgtcgcctccgcggctcaaaggcggggccgaattggccgcaaccacaataaggagggcgaccaatatatctacatgggacagcctctaaataatgatgaggatcacgcgcactggacagaagcaaagatgctgctcgacaatatcaatacccccgagggtattatcccagccctgtttgagccagagcgagagaaaagtgctgccatcgacggggaataccgcctaaggggagaagcccgcaagacgtttgtagaactcatgcggcgcggtgacctacccgtgtggctgtcctacaaggtagcgagcgagggcttccagtactcagaccggcgctggtgctttgacggcgaacgtaacaaccaggtgcttgaagagaatatggacgtagaaatttggaccaaggagggggagcgcaagaagctgcggccccgctggctcgacgccaggacgtattccgacccgctcgcgctgcgcgagttcaaagagttcgcggcgggcaggcgcagcgtcagcggagacctgatcctagagatcggcaagttgccccagcaccttacccagcgagcccagaacgccctcgataacctggtgatgctccacaacagcgagcagggcggccgagcctatcgtcacgcgatggaggaactccctgacaccatcgagaccctcatgctgctcgccctgatcgccgtgctcacgggtggtgtcacactcttcttcctttccggccgcgggttaggtaagaccagcatcggtctcttgtgcgtgatggcatctagcgtgctgctttggatggcctccgtcgagccccactggatcgcagccagcattatccttgagttcttcctaatggtgcttctgataccggagcccgacagacagcgcacgccccaagataaccagctggcatacgtggtcatcgggttgctattcatgatcctaactgtggccgccaacgagatgggcctgctcgagactaccaaaaaggacctggggatcggccacgtggccgtagagaaccaccaccatgccgccatgctcgacgtggatctccacccggcctccgcgtggaccctgtacgcggtggccaccactatcatcacccccatgatgcgccacacaatcgagaatactacagccaacatctcattgacagcaatcgccaatcaagctgccatactgatgggcctggacaaggggtggcccatttccaaaatggacatcggcgtccccctcctggccctgggctgctactcccaggtcaacccgttgacactgaccgccgcggtgcttatgctcgtcgcccattacgccatcatcggccccgggctgcaagccaaggccacgcgggaagcccaaaagcgaacagccgccggcattatgaaaaaccccacagtcgacgggatagtggccatagacctggaccccgttgtctacgacgccaagtttgagaagcagctcggccagatcatgctcctgatcctctgcacctctcagatactgctgatgcggacgacctgggcgttgtgcgagagcataacactggcgactggcccgcttacgaccctgtgggaggggtcccccggcaagttctggaacacgaccatcgccgtgagcatggccaatatcttccgcgggtcttacctagcgggcgctggccttgccttctcactcatgaagtccctagggggcggtcggcgcgggactggcgcccagggcgagaccctgggcgagaaatggaagcggcagctcaaccagctgagcaaatccgagttcaacacctacaagcgctccggtatcatggaggtagaccggagcgaggccaaggaaggcctgaagagaggggaaactacaaagcacgcggtgtcccgtggcaccgcaaagctccgctggttcgtggagcgtaacctggtcaagcccgaaggtaaggtgatcgatctcggctgtggccgagggggctggagctactattgcgcaggcctgaaaaaggtgaccgaggttaagggctacaccaagggcggccccggccacgaggagccaatccccatggccacgtacgggtggaacctcgtaaaactccactccggtaaggatgtgtttttcatcccgccagagaagtgcgataccctgctctgcgacatcggggaatcgtccccgaatccgaccatcgaggagggccggacccttcgcgtgttaaagatggttgagccttggttgagagggaatcagttctgcatcaagatcttgaacccgtatatgccatcagtcgtagagacgctggaacaaatgcagcgcaagcatggcgggatgctcgtgcggaacccactatcccgcaacagcacacatgagatgtactgggtgtcctgcgggaccggaaacatcgtgtcagctgtgaacatgacctctcgcatgttgctcaaccggttcaccatggcgcaccgcaaacccacgtacgaacgggacgtggatctgggggccggcacgcgacacgtcgccgtggagcccgaggtggccaacctggatatcatcggccagcggatcgagaacatcaagcacgagcacaaaagcacctggcactacgacgaagataacccgtataagacctgggcttatcatggctcctacgaggtaaagccatctggctccgcatctagcatggtgaacggcgtcgtgaagctcctgacgaagccctgggacgtgatccccatggtcacccagatcgccatgaccgacaccactccgttcggccaacagcgcgtattcaaggaaaaagtagatacccggacccccaaagccaaacgcggcactgcccagatcatggaggtaacggccaaatggctgtggggcttcctctcccgaaacaagaaaccgcgcatctgcacccgggaggagttcactcgcaaggtgcggagcaacgcggccatcggtgccgtgttcgtcgacgagaaccagtggaactccgccaaggaagcggtagaggatgagaggttctgggatctggtgcaccgcgaacgagagcttcacaagcaagggaagtgtgcgacctgcgtctacaacatgatgggcaagcgcgagaagaagttaggggagttcggaaaggccaaagggtcccgcgcaatttggtacatgtggctgggcgccaggttcctggagttcgaagctctcggcttcatgaacgaggaccattggttctctcgcgagaactctctgtctggggtggagggcgaggggctgcataagctcggttacatcctgcgtgacatcagcaagatccccggcggcaacatgtatgcggacgacaccgctggctgggacactcgcatcaccgaggacgacctgcaaaacgaggctcgcataaccgacatcatggagcccgagcacgccctgctcgcgaagtccatattcaagctgacctaccagaacaaggtggtccgggtccagcgccctgcaaagaacgggaccgtgatggacgtcatcagccggagggatcagcggggctccggccaggtcgggacctacggcctcaatacattcacgaatatggaggcccaactaatacgccagatggagagcgaggggatcttctcccccagcgaactggagaccccaaacctcgccgagcgagtgctcgattggctggagaagtatggtgttgagaggctcaagcggatggctatctccggggacgactgcgtggtaaaaccgatcgatgaccgcttcgcgaccgccctgacggccctgaatgacatgggcaaggtccggaaggacatcccgcagtgggagccctctaaggggtggaacgactggcagcaggtcccgttctgtagccaccatttccatcagctcatcatgaaggacggccgcgagatcgtggtcccatgccggaaccaggacgaactggtaggtcgagcccgggtgtcacagggagccggctggagcctgcgcgagacggcgtgtctcggaaagtcgtacgcccagatgtggcagcttatgtacttccatcggcgcgacttacggctcgccgccaatgcaatttgttcagccgtgcccgtggactggatccccacgtcacgcaccacctggagcatccacgcccatcaccagtggatgacgaccgaggacatgctgtccgtgtggaaccgcgtatggatcgaggagaatccgtggatggaggacaaaacccacataagctcctggggcgacgtcccctacttagggaagcgggaggaccagtggtgtggctctctcatcggactgacagcccgcgccacgtgggcgaccaacatacaggtggccataaaccaggtccgccgcctgatcgggaacgagaactatctcgactatatgacgtccatgaaacgtttcaagaacgagagcgaccccgagggcgccctgtggtaa

SEQ ID NO: 24245 - RNA, 9879 nt, synthetic construct
  misc_feature 1..9879: note = derived and/or modified CDS sequence (opt11) from DENV-1__FJ410286__SS-prME
  source 1..9879: mol_type = other RNA
tctgttactatgctgcttatgctcatgccgacggccctggccttccacctgaccacccgcggcggggagcctcacatgatagtgtcaaagcaggagcggggcaagagcctgctgttcaagaccagcgcgggggtaaatatgtgcaccctcattgcgatggatctaggcgaactgtgcgaggacacgatgacctacaagtgtcctcggataaccgaggcggagcctgacgatgtggactgctggtgtaatgcgaccgatacatgggttacctacggaacctgcagtcagaccggggaacaccgacgcgagaagcgatcagtggccctggcgccacacgtagggctgggcctggagacacgcacagagacctggatgtcatccgagggcgcctggaagcagatccagcgggtcgagacatgggcattgaggcacccagggttcacggtgatcgctctcttcctggctcacgccataggcacctctatcacccagaagggcattatcttcatcctgctgatgttagtgacgcccagtatggccatgcgatgtgtgggcatcggcagtcgcgacttcgtagaggggctcagtggcgccacgtgggttgatgtcgtgctagagcacggctcatgtgtgaccactatggccaaggacaagccgactctagacatagagctcttgaagacagaagtcacgaaccctgcggtcttgcgcaaactttgtattgaggctaagatctccaacacgaccacggacagccgctgtcccacccagggcgaggccaccctcgtggaggaacaggacgctaactttgtctgccgccgtacctttgtggaccggggctgggggaacggctgtggactattcggtaagggctcccttctgacatgcgcgaagtttaagtgcgtgacaaagctcgagggcaagatcgtacaatacgagaacttgaaatactcggtgatagtaactgttcacaccggggaccagcaccaagtaggtaacgagagtacggaacacggtaccactgcgaccattacgccccaggcccccacgacagaaattcagttgacggactacggagccctgacactcgactgctcaccacggacaggactagacttcaatgagatggtccttttaactatgaaggaaaagtcttggctcgtgcataaacagtggttcctggacctccccttgccctggaccagcggagccagcacctcccaagagacgtggaatcggcaggaccttctcgtaaccttcaaaaccgcccacgccaagaagcaggaggtcgttgtgctaggaagccaggagggtgccatgcacaccgctctgacgggtgcgacagaaattcaaacctccggtacgactaccatttttgcggggcacctcaagtgcaggttaaagatggacaagctaaccttaaagggtatgagctacgtcatgtgcacggggtcgttcaagttggagaaagaagttgcggaaactcaacacggtaccgtgctggtacagatcaagtacgagggaacagatgcgccctgcaaaatccccttctctactcaagacgggaagggggtgacgcagaacgggcgtctgatcaccgccaacccgatagtgaccgacaaggaaaagcccgtcaatatcgaggcggagccacctttcggagagtcctacatagtaatcggcgcaggggagaaggccctcaagctaagctggttcaagaagggctcgagcataggaaaaatgttcgaggcaacagcccgaggcgcgcgacggatggcgatcttgggtgacacggcgtgggacttcggctcgatcggcggagtatttaccagcgtcggcaagctcgtccatcagatcttcggcaccgcttacggcgtgctattcagcggtgtgagttggaccatgaagataggaatcggggtgctactcacgtggctgggtctaaattcacggagcacgtccttaagcatgacgtgcatcgccgtaggactggttactttgtacttgggagtaatggtacaggcggattccggctgcgtaatcaactggaagggtagagagctaaagtgcggctccggcatattcgtcacgaacgaggtgcacacatggaccgagcagtataagttccaggcagacagccccaagcgcctgtccgctgccattgggaaggcctgggaggagggtgtctgtgggatccgcagcgccacccgtctagaaaatatcatgtggaagcagattagtaacgaactgaaccacatcctactcgagaacgacatgaaattcactgtggtagtcggcgacgtggcgggaattttagttcaaggcaaaaagatgatccggccccaaccaatggagtacaagtacagctggaagtcctgggggaaagccaaaatcattggagccgatgtccaaaactcgacgttcatcatagacggccccaataccccggagtgtcccgacgaccagcgcgcctggaacatctgggaagtggaggactacggatttggtatttttaccactaatatctggttgaagctccgggactcctacacccaggtgtgcgaccaccgcctgatgtcagcggctattaaagactcaaaagcagtccacgccgacatgggttactggatcgagagcgaaaagaacgagacgtggaagctagcgcgggcgagcttcatcgaagtcaagacgtgcatctggcccaagagccacaccctctggtccaacggggtgttagaaagtgaaatgatcatccccaagatacacggcgggccgatttcccagcacaactaccgtcccgggtactttacgcagaccgccggaccatggcatctggggaagctcgaactggacttcgacttatgcgagggcacaaccgtcgtggtggacgagcactgcggcaaccggggcccatcactcaggacgaccaccgtcacggggaagatcatccacgaatggtgttgccggtcctgcacgttgccacccctgcggttccggggagaagacgggtgctggtatggcatggagatccgtcccgtcaaggagaaagaagagaatcttgtgaagtccatggtatcggcggggagtggggaagtcgactctttctcgctcgggctgctttgtatcagcatcatgatagaggaggtgatgcgttccagatggagcaggaagatgcttatgaccggcacactagcagtcttctttttacttatcatgggccagctgacctggaacgaccttatcaggctgtgcatcatggtaggggctaacgcttccgaccgcatggggatgggcactacgtacctggccctcatggccaccttcaaaatgcggcccatgtttgccgtaggtctgctgtttcgccggctcaccagcagggaggtcctcctgctcacgatcggcctgtccctcgtggcctccgtcgagttgcccaactctctggaagaattaggtgacggcctagcgatgggcatcatgattctaaaactcctcaccgactttcaaagctaccagctatgggctaccttattatcactgaccttcataaagacgacctttagccttcactacgcctggaagaccatggccatggtgctatcgatcgtcagcctattccccttgtgcctctccactacgagccagaagaccacttggctgcccgtgctgctcggctcactgggctgcaagccgctaactatgttccttatcgcggaaaacaagatctgggggcgcaagtcctggcctttaaacgaaggcatcatggctgtggggatcgtgtccattctgctgagtagcttgctgaagaacgacgtccccctcgcaggccccttaattgccggagggatgctgatagcatgctacgtgatcagcggcagctcggcggatctcagtctcgaaaaggccgctgaggtgtcctgggaagaagaggccgaacacagcggggcttcccacaacatcctagtggaagtgcaggacgatggaacgatgaaaattaaggacgaagaacgtgacgataccctcaccatcctgctgaaggcgaccctcctagcggtgagcggggtgtatcctctgagcatccccgccaccttgttcgtgtggcacttctggcagaaaaagaagcagagatcgggcgtgctgtgggatactcctagtccccctgaggtagagagagccgtgctggacgatgggatctaccgaatcatgcaacgcggcctgttaggccggagccaggtgggcgtcggcgtatttcaggaaaacgtgttccacacaatgtggcacgtcacgcgcggggccgtgctaatgtaccaagggaaacgacttgagccctcttgggctagcgtgaaaaaggacttgatctcctacggcgggggctggcgcttccaggggtcttggaacacaggggaggaggtccaagtgatagccgtggagccggggaaaaatcccaagaacgtacagacggccccggggaccttcaagacgcccgagggcgaggtgggggcgatcgcactcgatttcaagccaggcacctccggcagccccattgtgaaccgggaaggcaaaatagtcggcctgtacggtaacggcgtggtcacaaccagcggtacttatgtctccgcgatagcccaagccaaggcctctcaggaggggccgctccctgaaatcgaggacgaagttttccgcaagcggaacctgaccatcatggacctccaccccgggtccggtaagactagaaggtacctcccggctattgtgagagaggccataaaaaggaagctgcggaccctaattcttgcgcccacccgcgtcgtcgccagcgaaatggccgaggctctgaagggaatgcccatcagataccagacgacggccgtgaagtccgagcacactgggaaggagatcgtagatctaatgtgccacgccaccttcacaatgcgcctcctaagccccgtgcgggtgccgaactacaacatgatcattatggacgaggctcactttacggaccccagctcgatcgccgcgcgcggctacatatcaactcgagtcgggatgggtgaagccgcagcgatcttcatgacggcgacacctcccgggagcatggaggcattcccgcaatcgaatgctgtaatccaagacgaggaacgagacatccccgaacgcagctggaactccggatatgagtggatcactgacttccctggcaagaccgtatggttcgtcccttctattaaggccggcaacgacattgccaactgcctgcgcaagaatggcaaacgggtcattcaactgtcccgtaagaccttcgacaccgagtaccaaaagacgaagaacaacgactgggactacgtagtcaccacggacatatcagagatgggggcgaacttccgcgccgaccgggtgatcgacccgcgaaggtgcctgaagccggtgatcttaaaggatgggccagagcgggtcatcttggccggacctatgccggtgaccgtcgcgtccgccgcgcaacgccgcggtcgcatagggcggaatcacaataaggagggagaccagtacatttacatgggacagccactcaacaacgacgaagatcacgcgcactggacggaagctaagatgctgctcgacaatatcaacacccccgaggggatcattcccgcactttttgagccggagcgcgagaagtccgccgcaatcgacggtgaatatcgcctccgtggcgaagcacgcaagactttcgtggagctcatgaggagaggggatttgcccgtttggctgtcctacaaggtcgcatccgaaggcttccagtacagcgaccggcggtggtgttttgacggtgagcgtaacaaccaagtactcgaggagaatatggatgtggagatctggacgaaggagggcgagcgtaagaaacttcgtccgcgctggctggatgcccggacttattcggacccgctcgccttaagagagttcaaggagttcgctgccggacggcggtcagtatccggtgacctcatcttagagattgggaaactgccccaacacctgacccagagagctcagaacgctctggataacctcgtgatgctgcacaatagcgaacagggcgggcgcgcgtaccgtcacgccatggaggaactcccggacacaatcgaaaccctcatgctgttggcgctgatcgccgtgcttaccggcggagtgacactattcttcttatccgggaagggcttgggcaaaaccagtatcggccttctgtgcgtgatggcctccagcgtgctgctctggatggcttccgtcgagccgcactggattgccgcgtccatcatcctggagtttttcttgatggttctactgatccccgaaccggaccgtcagcgaacgcctcaggacaaccaactggcatatgtggtaattggcctcctgttcatgatactgaccgtggccgcaaacgagatggggttactcgagacgactaaaaaggacctgggcatcggacacgttgccgtcgagaaccaccatcacgcagccatgttggacgtggaccttcaccccgcgtcggcttggaccttgtacgcggtggcaaccactatcatcacaccgatgatgaggcacacaattgagaataccaccgccaacatctcgctcacagccatcgcgaaccaggcggccatactgatggggctggacaaggggtggcccatctcaaagatggatatcggggtcccccttctggccctgggttgctatagccaggtgaaccccctcaccctgactgcggcggtgctaatgctcgtcgcccactacgccatcatcgggccgggcctgcaagctaaggcgacgcgggaagctcagaagcggacagctgccggcatcatgaagaaccccacgatcgacggcatcgtggccatcgatctagatccagtggtgtacgatgcgaagtttgagaaacagctcggccaaatcatgttattaatcctctgcacaagtcaaattctgctgatgcgcaccacctgggcactttgcgagtccataaccctggcgaccgggccccttacgaccctgtgggaaggctccccagggaagttctggaacaccaccatcgctgttagcatggccaacattttccggggctcttacctggcgggcgccggtttggccttcagcttgatgaagagtctgggaggcggacgccgcggtacgggagcccagggcgagaccctaggggagaagtggaagaggcagctgaaccagctgtccaagtctgagtttaacacctacaagcggtccgggattatggaggttgaccgtagcgaggcaaaagaggggctgaaacgcggggagaccacaaagcatgccgtctctaggggtacggccaagctccggtggttcgtggagagaaaccttgttaagcccgaggggaaagtgattgacctgggctgcggtcggggcgggtggagctactactgcgcaggcttaaagaaggtgacggaggtgaagggctacaccaagggcggtcccggacacgaggaacccatcccgatggcaacgtacggatggaacctcgtaaagctgcactccgggaaagatgtcttcttcatcccgcccgagaagtgcgacaccctgctctgcgacattggcgaaagctcccccaaccccaccatagaggaggggcgcaccctaagggtgctgaaaatggtcgaaccctggctcaggggcaaccaattctgcatcaagatcctgaacccctacatgccaagcgtggtggagacgctggagcagatgcaaagaaagcatggagggatgttggtcagaaaccccctatcccgcaacagcacccacgagatgtattgggtgtcttgtggcaccgggaacatagtgagcgctgtcaacatgacgtctcgcatgctcctaaaccggttcaccatggcccaccgcaaacccacgtatgagagggatgtcgacctgggcgccggcactagacatgttgccgtggagccggaggttgccaacctggacattatcgggcagcgcatcgagaacatcaagcacgagcacaagagcacctggcattacgacgaggacaacccctataagacatgggcgtatcacggctcctacgaagtgaaacccagcgggtccgcctcatccatggtaaacggagtcgtcaagctcctaaccaaaccatgggatgtgatccccatggttacccagatcgcaatgaccgacaccacgcccttcggtcagcagcgggtgttcaaagaaaaggtggatactcggaccccaaaagccaagcgggggaccgcccaaataatggaggtaacggcgcgatggctgtggggctttctctcccggaataaaaagccccgcatttgcacacgggaagagttcaccagaaaagttaggtccaatgccgcaattggggccgtgtttgtcgacgagaaccagtggaactcggcaaaggaagccgtagaggacgacagattctgggacctggtacaccgtgagcgagagctacacaaacagggcaagtgtgcgacttgtgtgtacaacatgatggggaagagggagaagaaacttggcgagttcgggaaggctaaagggtcaagagccatctggtatatgtggctgggagctcggtttttagagttcgaagccctggggttcatgaacgaggaccactggttttccagagagaactctttatctggcgtcgagggggaaggactgcataagctcgggtacatcctgcgggacataagcaagatccccggaggcaacatgtacgccgacgatacggccgggtgggacaccaggatcaccgaggacgatttacagaacgaagcgaagattaccgatatcatggagccggaacacgccctcctagccaagagtatcttcaagctgacgtaccagaataaggtggttcgcgtccagcgcccggccaagaacggcaccgtgatggacgtaatcagtcgccgggaccagcgcgggagtggacaggtgggaacttacggtttgaacaccttcacaaacatggaagcacagctgatccggcagatggagagcgaaggcatcttcctgcccaacgagctcgaaaccccaaatctagcggggagggtactggattggctagagaagtacggtgtagagaggctgaagcgcatggcaatatccggagatgattgcgtggttaagccgatcgatgaccggttcgccacagccctcactgctctgaacgatatgggcaaagtgcgcaaggacatcccccagtgggaacccagcaagggctggaatgactggcagcaggtaccgttctgctctcaccatttccaccagctgataatgaaggacgggcgggagatcgtggtgccgtgcagaaaccaggacgaactggtggggagggcacgggtgtcgcaaggggcaggttggagcttgcgagagacggcgtgtctcggaaaaagctacgcgcagatgtggcagctcatgtacttccaccgccgggacctccgcctggccgcgaacgctatatgcagcgccgtgccagttgattgggtgcccacatctaggaccacttggtccattcacgcccaccatcagtggatgacgacggaggacatgctgtccgtatggaaccgggtctggattgaggagaacccctggatggaggataagacccgtatttcttcctgggaagacgtgccgtacctcggtaaacgcgaggatcagtggtgcggcagccttatcgggctgacggccagagcgacgtgggcaaccaacatccaagtcgccatcaatcaggtcaggagactaatcggtaatgagaactacagtgactacatgaccagcatgaagcgattcaagaacgagagtgagcccgagggagccctgtggtga

SEQ ID NO: 24246 - RNA, 9879 nt, synthetic construct
  misc_feature 1..9879: note = derived and/or modified CDS sequence (opt11) from DENV-1__FJ461339__SS-prME
  source 1..9879: mol_type = other RNA
tcagtgaccatgctgttgatgctgatgccgaccgcccttgccttccacctgaccacccggggcggggagccgcacatgatcgtgagcaaacaggagaggggcaagagcctgttgttcaagacttctgcgggggtgaacatgtgcacactcatcgcaatggacctgggcgagttctgcgaggacactatgacctacaagtgccctcgcattacagaagccgaacccgacgacgttgactgctggtgcaacgccacagacacgtgggtgacctacgggacctgctcccagaccggcgaacaccggagggacaaaaggtcggtggccctggcgcctcatgtgggcctcggtctggagacgcgcactgagacgtggatgagctccgagggcgcctggaagcaaatccagcgggtcgagacctgggccctgcgccatcccggctttacggtgatcgccctcttcctcgcgcacgccatcggcacaagcatcacccagaaggggatcatatttattctgctcatgctggtaaccccctccatggccatgcggtgcgtgggcatcgggtcccgagactttgtggaaggcctgtcaggcgccacgtgggtggatgtcgttctcgagcacgggagctgcgttaccaccatggctaaggacaaacccaccctggacattgagctcctcaagacggaggtgaccaatcccgctgtgctgcggaagctgtgcatcgaggccaaaatttccaacaccaccacggacagccgatgtcccacacagggggaagcaaccctcgtggaggagcaggacgcaaacttcgtctgccggcgcactttcgtcgaccgtggctggggcaacggctgtgggctgttcggcaaagggtccttgattacgtgcgccaagttcaagtgtgtgaccaaactcgagggcaagattgtccagtatgaaaacctgaagtacagcgtgatcgtgactgtccacaccggcgaccagcaccaggtggggaacgagtccacggagcacggcaccaccgccaccatcacgccccaggccccaagcaccgagatccagctgaccgactacggggcactcactctggactgcagtccccggaccggattagacttcaatgagatggtcctcttaacgatgaaagagaaatcctggctcgtacacaaacagtggttcctcgacctgccactgccctggacaagcggagcctccactagccaggagacctggaatcgccaggacttacttgtgacgtttaagaccgcccacgcgaagaagcaggaggtagtggtgttaggctcccaggagggcgccatgcacaccgccttgaccggggccacggagatccagacctccggcaccaccacaatcttcgccggtcacctgaagtgtcgattgaagatggacaagttgaccctgaagggcatgtcctacgtcatgtgcaccgggagcttcaaattagagaaggaggtggcggagacacagcacggaaccgtgctcgttcaaattaagtacgaaggcaccgacgccccctgcaagatccccttctctacgcaagatgagaagggtgtgacccagaatggccggcttatcactgccaaccccatagtgacggacaaggagaagcccgtcaatatagaagccgaaccccctttcggcgagagctacatcgtaatcggcgcaggcgagaaggccctgaagttgtcctggttcaaaaaagggagctccatcgggaaaatgttcgaggcgaccgcccgcggggcccggcgaatggcgatcttgggcgataccgcctgggacttcgggagcatcggaggagtcttcacgtccgtagggaagctggtgcatcagatcttcggcaccgcctacggcgtgctgttctctggcgtatcctggaccatgaagatcgggattggcgtgctcttaacctggctgggcctcaattcacgctccacgagcctgtccatgacctgcatcgccgtggggctggtcactctctacctgggtgtcatggtgcaggccgacagcggttgcgtcatcaactggaagggccgtgagcttaagtgtgggtcagggatattcgtaactaacgaggtgcacacttggaccgagcaatacaagttccaagcggactccccgaaacgcctcagtgccgccataggcaaggcctgggaagaaggagtctgtggaatacggtccgccacacgcctggagaacattatgtggaagcagatcagcaacgagctgaatcatatcctcctggagaacgacatgaaactgaccgtggttgtcggggacgtggcgggcatccttgcccaggggaagaagatgatccggccccagcccatggagtacaaatactcctggaaatcctggggcaaggcaaagatcatcggcgcggacgtgcagaacactacgttcattatcgacggtcccaacactcccgagtgccccgacgaccagcgcgcgtggaacatctgggaggtcgaagactatggatttgggatcttcaccaccaatatctggctaaagctgcgggacagccacacccaggtgtgcgatcaccgcctcatgtctgccgccatcaaggactccaaggccgtgcacgcagacatgggctactggatcgaaagcgagaagaacgagacctggaagctggcccgggcttcctttatcgaggtgaaaacctgcatctggcccaagtcacacacgctatggtccaacggcgtccttgagagtgagatgataatccccaagatctacggaggcccgatttcccagcacaattaccgccccgggtacttcacacaaaccgccggcccctggcacctggggaagcttgaactcgactttgacctgtgcgagggtaccaccgtggtcgtggacgagcattgcggaaatcgggggccgagcctacgaacaactactgtgactggcaagattatccacgagtggtgttgccggtcctgcacgctcccgcctcttaggtttaagggggaggacggttgctggtacgggatggagatccgtcccgtcaaggaaaaggaggagaacctggtcaagtcgatggtgagcgccggctccggcgaagtcgactctttttcactcgggctgctgtgtatcagcataatgatcgaagaggtgatgcgctcccggtggagccgcaagatgctcatgaccggcaccctggccgtgttcttcctgctcatcatggggcaattgacctggaacgacttgatcagactctgcatcatggtcggtgcgaatgcctccgaccgaatggggatgggcacgacctacctggctttgatggccaccttcaagatgcgcccgatgttcgccgtcggccttcttttcagacgcctcaccagccgggaggtgttactgctgacgatcgggctctccttggtcgcctccgtggagctgcccaactcgctagaggagctgggcgacgggctggccatgggcatcatgatactcaagctactgactgatttccagccccaccagctttgggccacccttctgtccttgactttcattcggacaaccttcagtctccattatgcatggaaaaccatggctatggtactgagcatcgtatctctcttccccctttgtctgagcacaacgtcccaaaagaccacctggctcccggtgctcctgggcagccttggctgcaaaccattgacgatgttcctgatcgcagagaacaagatctggggaagaaagtcatggcccctcaacgagggcatcatggccgtcggcattgtgtcaatcctgctctcttcgctcctgaagaacgacgtacccctagccggaccgctaatcgccgggggcatgctaattgcgtgttacgtaatctcggggtccagcgccgacctgtccctcgagaaggccgcggaggtgagctgggaggaggaggccgagcattccggcgcaagccataacatcttggtggaagtgcaagacgacggaacgatgaagatcaaggacgaggagcgcgacgacacactgaccatcttattgaaagccacactgttagccgtatccggcgtgtaccccctgagtatccccgcgacactcttcgtctggtacttctggcagaagaagaaacagcggtccggtgtactgtgggacacgccgagcccgcctgaggtggagcgcgcagttctagatgacggcatctaccggattatgcagcgaggtctgctggggcggtcccaggtgggcgtaggggtcttccaggagaacgttttccacacgatgtggcacgtgacccgcggcgcggtcctcatgtatcaggggaagcgactggaacctagctgggcttccgtgaagaaggacctgatcagctacggcggcgggtggcgcctacagggctcctggaatacaggtgaggaggtgcaggtcatagccgtggagcccggcaaaaacccgaagaatgtacagacggcccccggtaccttcaagaccagcgagggagaggtcggcgccatcgcattggatttcaagccggggacctccggctcgcctatcgtgaaccgggaagggaagatcgttggcctgtacggcaacggagtcgtgacgaccagcggcacctacgtttccgccatcgcccaggctaaggcgtcacaggaggggccattgcccgagattgaggatgaggtcttccgcaagcgaaacctgaccataatggacctgcaccccggctccggtaagacgcgacggtatctaccggccatcgtgcgcgaggccattaagcgccgcctgcgcaccctcatcttagcccccaccagggtcgtcgccagcgagatggcggaggccctgaaaggcatgcccatccgataccagaccacggccgtgaagtccgaacacaccggcaaggagattgtggacctgatgtgccatgccaccttcacaatgaggctcctgagcccggtccgcgtgccgaactataacatgatcattatggatgaggcccacttcacggacccatccagcattgcggcccgtgggtacatttccacccgcgtgggcatgggggaagccgccgcgattttcatgacagcgacgccgcccgggagcgtagaggcgttcccgcagtcgaacgccgtgatacaggacgaggagcgggatatccccgagcgcagctggaactccgggtacgagtggatcacagacttccctggaaagaccgtgtggttcgtccccagcataaagagtgggaatgacatcgccaactgcctgcggaagaacggtaagcgcgtgatacaactaagccgcaagaccttcgacaccgagtaccagaaaacgaagaacaacgactgggattacgtggttaccaccgacatctcggaaatgggggcgaactttcgcgctgatcgggttatcgacccgagacggtgtctgaagccagtgatcctgaaggacggcccggagagggtcattcttgccggccccatgccagtgaccgttgccagcgccgctcagagacgcgggcggataggccgcaatcacaacaaggagggcgaccagtacatttacatggggcagcccctgaacaacgacgaggaccacgcccactggacggaggccaagatgctgttggacaacatcaacacacctgagggtatcatacccgctctgttcgagccggagcgcgagaagtctgccgccattgacggggagtatcggctaagaggtgaggcccgaaaaactttcgtcgagctgatgagacgcggagacctgcctgtgtggctgagctacaaggtcgcctcggagggctttcagtactccgaccgccggtggtgttttgacggcgaacgtaacaaccaggtgctcgaggagaacatggacgtggaaatctggactaaggagggggaacgtaagaagctacgtcctcggtggctggacgcgcgcacgtacagcgaccccttggctttgcgggagttcaaggagttcgcggccggccgcaggtcggtgagcggggacctaatcctggaaatcggcaagctgccacagcatctgacgcagcgtgcccaaaacgccctcgacaacctggttatgttgcacaactccgagcagggcgggcgagcgtaccgccacgccatggaggagctcccagacaccatcgagaccctgatgttactcgcccttattgccgtcctgacgggtggggtcacccttttcttcctgagcggccgggggctggggaaaacatccatcggcctcctatgtgtgatcgctagcagcgtgctcttatggatggcgagcgtggagccccattggattgccgcctccataatcttagagttcttcctgatggtgttactgattcccgagccagaccgccagcggacgccccaggataatcagctggcgtacgtggttattggtctcctgttcatgatcctgacggtggccgcgaacgagatgggacttctggagacgaccaaaaaagacttggggatcgggcacgtggccgtcgagaaccaccaccacgccgccatgctcgacgtggacctgcaccccgccagcgcgtggaccttgtatgcggtggcgacgacaatcatcacgcccatgatgcgacacaccatcgagaacacgacggccaacatcagtctcacggccatcgcgaaccaagcggccatcctgatggggttggataagggatggcccataagcaaaatggacatcggtgtccccctgctagccctggggtgctattcccaggtgaatcccctaacccttacggcggccgtgcttatgctcgtcgcccactacgccatcattggcccggggctgcaagcgaaagctacgcgcgaggctcagaagcggaccgccgccggcataatgaaaaatcctacagtggatgggattgtggccatcgacctcgaccccgtcgtgtacgatgcgaagttcgagaagcagctcgggcagatcatgctgctgatcctctgcactagccaaatcctgctgatgcgcacgacctgggccctctgcgagtctatcaccctggccaccggccccttaacgaccctatgggaagggagcccgggcaagttttggaacacgaccatcgctgtgtcaatggccaatatcttcagagggagctacttggcgggcgtcggtcttgctttcagcctcatgaagtccctcgggggcggccgccgagggaccggggcccagggagagactctaggcgagaagtggaaaagacagctcaaccagctgagcaagtccgagttcaacacttacaagcggagcgggattatggaggtggatcgctccgaggccaaagagggactgaagcgcggggagaccacgaagcacgcggtgagccgcggcaccgccaagctccggtggtttgtggagcgcaatctcgtgaagcccgaggggaaggtgatagacctgggctgcgggcgcggtgggtggtcctactactgcgccggcctgaaaaaagtcaccgaggtcaaggggtacaccaagggcggccccggccacgaggagcccatcccgatggccacgtacggatggaacctcgttaagctgcacagcggcaaggatgtcttcttcatccctcccgagaagtgcgacaccttgttatgcgacatcggggagtccagcccaaacccgaccatcgaggagggccgcaccctgcgcgttctcaagatggtggagccctggctgcgcggcaaccagttctgtatcaagatcttgaacccatacatgccgtccgttgttgagacactggagcagatgcagcggaagcacggcggcatgctagttcgcaacccactgtctcggaactccacccacgagatgtattgggtcagctgcgggaccggcaacatcgtgtccgccgtgaacatgaccagccgcatgctgctgaacagattcaccatggcgcaccggaaacccacatacgaacgagacgtcgacctgggggctggcacccggcacgtagctgtagagcccgaggtcgccaacctcgacatcattggccagcgcattgaaaacattaagcacgagcacaagtccacctggcactatgacgaggacaacccctacaaaacgtgggcttaccatggctcgtacgaggtgaaaccgtccggctcagccagctccatggtcaacggtgtggtcaagttgttgacgaagccgtgggacgtcataccaatggtgacccagatagccatgaccgataccactccattcggccagcagcgggtgttcaaggagaaggtcgacaccagaaccccgaaggccaagcgggggaccgcccaaatcatggaggtgacggccaagtggctgtggggattcttgagcaggaataagaagccgcggatatgcacccgcgaggagttcacgcgcaaggtgagatccaacgcggccatcggcgctgttttcgtggacgaaaaccaatggaacagcgccaaagaggctgtggaggacgaacggttctgggatttagtccaccgcgagcgggagctgcacaagcaggggaagtgcgcgacctgcgtgtataacatgatgggcaagcgcgagaagaagctgggggaattcggcaaggccaaggggtccagggccatatggtacatgtggctgggggcccgctttctggagttcgaggcgctaggcttcatgaacgaggaccactggttttcgcgggaaaactcattaagcggggtggagggcgaggggctgcacaagcttggctatatccttcgcgatatctccaagatccccgggggtaatatgtacgcggatgacacggccggctgggacaccagaatcactgaggacgacctgcagaacgaggccaagattacggacatcatggagccggagcacgccctcctggccaagagcatcttcaagctgacgtatcagaacaaggtcgtgcgagtgcagcgccccgctaagaatggcaccgtcatggacgttatcagccggcgcgaccagcggggatccggccaggtgggtacttacggccttaacacgttcacgaatatggaggcccagctgatccgccagatggaatcagaagggatcttcagcccctccgaactggagacaagtaacctagccggccgggtcctggactggctggagaagcacggggtggaacgactcaagcggatggccattagtggcgatgactgtgttgtcaagcccatcgatgaccgcttcgcgaccgcactgaccgccctaaatgacatgggcaaggtgcggaaggacatcccgcagtgggagcccagcaagggttggaatgactggcagcaggtcccgttctgcagccaccacttccaccagctcatcatgaaggacggccgcgagatcgtcgtgccctgcaggaaccaggacgagctggtggggcgcgcccgggtctcccagggcgccgggtggtccttgcgcgagacggcctgcttgggcaagtcctatgcgcagatgtggcagctgatgtactttcaccggcgcgacctgagattagctgccaacgctatctgcagcgccgtgccagttgactgggtccccacctcccgaaccacctggagcatccacgcccaccaccagtggatgacgaccgaggacatgctgtcggtgtggaaccgggtttggatagaggagaacccgtggatggaggacaagacccacgtcagctcctggggcgacgtgccctatctgggcaagcgcgaggaccagtggtgtggtagcctcatcgggctgaccgcccgagccacctgggcgaccaacattcaggtggcgatcaatcaggtgcggcgtctgctcgggaatgaaaattatctggattacatgacctcgatgaaacggttcaagaacgagagcgacccggagggagccttgtggtga

SEQ ID NO: 24247 - RNA, 9879 nt, synthetic construct
  misc_feature 1..9879: note = derived and/or modified CDS sequence (opt11) from DENV-1__FJ882515__SS-prME
  source 1..9879: mol_type = other RNA
tcggtgacaatgctgctaatgctgatgcccaccgccttggcctttcacctcacaacccggggcggggagccccacatgatcgtgaccaagcaggagcgggggaagagcctgcttttcaagaccagcgccggggtgaacatgtgcaccctcatcgccatggaccttggcgagttgtgtgaagacaccatgacgtacaagtgccctcgcatcaccgaggccgagcctgacgatgttgactgttggtgcaacgccacggacacctgggttacctacggaacctgtagccagacgggcgagcacaggcgcgacaaacggagcgtggcactggcgccccacgtgggcctggggctggagacacgtacagagacctggatgtccagcgaaggcgcctggaagcagatccagcgggtcgagacgtgggccctccgccacccagggttcaccgtgatagccctatttctggcgcacgctatcggcacctccattacccaaaaggggatcattttcattctcctgatgctggtgacgccgtcaatggccatgcgatgcgtcggtatcggctcccgcgatttcgtggaggggctcagcggagccacctgggtggacgttgtgctggagcacgggagctgtgtcaccaccatggccaaggacaaacccacgctggacatcgagcttctgaagacagaggttaccaaccccgcggtcctgcggaagctttgcatagaggccaagattagcaacaccacgacagactcccgttgcccaacccagggagaggccaccctgatggaggagcaggacgccaacttcgtttgtcgtcgcacgttcgttgaccggggctggggtaacggctgcgggctgttcggaaaggggtcactcatcacgtgcgccaagttcaagtgcgtgaccaagctggagggcaagattgtgcagtatgagaatctgaagtattcagtaattgtcaccgtgcacacgggcgatcagcaccaggtcgggaatgagtccacggagcacggcacaaccgcgaccatcacgccccaggcccccacttccgaaatacagctcaccgactacggggccctgaccctggattgtagcccccgcactggcttggacttcaatgagatggtactgctcaccatgaaagagaagtcgtggctcgtccataaacaatggttcctggacctgccgctcccatggaccagcggcgccagcacctcccaggaaacatggaataggcaggacctgctggtaaccttcaagacagcacacgcgaagaagcaggaggtggtcgtgctcggtagccaggagggcgccatgcacaccgcacttacgggggccaccgagatccagacctccggcacaacgactatcttcgccgggcacctgaagtgccgcctcaagatggataagttaaccctgaaaggcatgagctacgtgatgtgtacggggtccttcaagctggagaaggaagtcgcggagacgcagcatggcactgttttggttcagatcaagtacgaaggcaccgacgcaccctgcaagatacccttctcgacccaggatgagaagggggtcacgcagaacggccggctgatcacagcgaacccgatcgtcaccgacaaggagaagcccgtgaacatcgaggccgagcctcctttcggggagtcttacatcgtcataggcgcgggcgagaaggcgctgaagctcagctggttcaagaaggggagcagcataggcaagatgttcgaggccaccgctcgcggtgcccggcgcatggcgatcctgggtgacacggcatgggactttggttccatcggaggcgtgttcaccagcatcgggaaattagtgcaccagatttttgggacagcctatggggtcctcttctctggcgtctcttggaccatgaagattgggattggagtgctactgacgtggctcggcctgaactcccgtagcacctccctgagcatgacttgcatagcagtcgggctcgttaccctgtacctgggcgtgatggtccaggcggactccgggtgcgtgataaactggaagggccgggaactcaagtgcgggagcggcatttttgtgaccaatgaggtccacacatggaccgagcaatataaattccaggcagatagcccgaagcgtctgtccgcagccatcgggaaggcctgggaagagggggtctgcggtattcggagcgccacccgtctggagaacataatgtggaagcagatctcaaacgagctcaaccacattctgttggaaaacgacatgaagttcacagtggtcgtgggagacgtggtaggtatcctcgcgcagggcaaaaagatgattaggccccagccaatggagcacaagtacagctggaagtcgtggggcaaggctaagattatcggcgccgatgtgcagaacacgacgttcatcatcgatgggcccaacaccccggagtgcccggacgaccaaagggcttggaatatatgggaggtagaggactacggattcgggatctttacgacgaacatttggctgaagatgcgggacagctacacccaggtctgcgaccaccgcctcatgtccgcggccatcaaagacagcaaagccgtgcacgccgatatgggctactggatcgagtctgagaagaacgagacctggaagttggcccgggcgagcttcatcgaggtgaagacctgcatctggcccaaatcccacacgctgtggagcaacggcgtcctggagtccgagatgatcatccctaaaatatacgggggcccgatcagccagcacaactaccgcccggggtactttacccagaccgccggcccctggcacctcgggaagctggagctggatttcgacctctgcgagggcaccacggtggtggtcgatgagcactgcggcaaccgggggccgagcctgcgcaccacaaccgtaacgggcaagatcatccacgagtggtgctgccgcagctgtaccctgccacccctgcgcttcaagggtgaggacggctgctggtatgggatggagatccgaccagtgaaggagaaagaggagaacctggttaagtccatggtaagcgccggaagcggagaggtcgactcctttagcctggggctcctgtgcatctccatcatgatcgaggaggtcatgcgcagccggtggtcccgtaagatgctgatgaccggcacccttgccgtttttctgctgctcatcatggggcagctgacttggaacgacctgatccggctctgtatcatggtgggcgccaacgcgagcgatcgcatgggcatgggcaccacatatctggccctgatggccaccttcaagatgcgcccgatgttcgccgtcgggctactgtttcggcgattgacatctcgggaggtgctactgctgaccatcggtctctctctggtggcctccgtcgagctgcccaactctctcgaagagctgggcgacgggctggcgatgggaattatgatccttaagctactgaccgacttccaatcccaccaactttgggccactctcctgagcttgacgttcattaagactacattgtccttacactatgcctggaagacgatggccatggtcctgtccatcgtctctttaatccccctgtgcctaagcacgacatcccagaaaaccacgtggctgcccgtgctgctcgggagcctagggtgcaagccgctgacgatgttcctcatcgcggagaacaagatctggggacgcaagtcctggcccctgaacgaggggatcatggccgtgggcgtcgtgagcatcctactctcctccctgctcaagaacgacgttcccctcgcggggcccctaatcgcgggtggcatgttaatcgcctgttacgtcataagcgggtccagcgcggacctgtccttagagaaggccgccgaggtgagctgggaggaagaagccgagcactccggagccagccacaacattctggtggaggtccaagacgatgggaccatgaagataaaggatgaagagcgggacgacacgctcaccatcctgctgaaggcgaccttactggccgtgagcggagtgtacccactgagcatcccggccacgctctttgtctggtacttctggcagaagaaaaaacagagatccggggtgctatgggacacgcccagcccgcccgaggtggaacgggccgtcctggacgacggcatctaccgcatcatgcagcggggactattaggccgctcacaggtgggcgtgggcgttttccaggagaacgtgttccataccatgtggcacgtgacccggggcgcggtcctgatgtatcaggggaagcgccttgagcccagctgggcgtcagttaagaaggacttgatctcttacggcggcgggtggcggctgcaaggatcctggaacaccggggaggaggtccaggtcatcgccgtggaacccggtaaaaatcctaaaaacgtgcaaaccgccccgggaactttcaaaacacccgagggagaagtcggggccatcgcgctggattttaagcccgggacgagcggctcccccatcgtgaaccgcgagggcaagatcgtggggctctacggcaacggggtcgtgaccactagcggcacctacgtgagcgcgatagcccaggccaaagcgtcgcaggaggggcccttacccgagatcgaggacgaagtcttcaggaagcgcaacctaacgataatggacctccatccaggcagcgggaagacccggcgctaccttccggcgattgtgcgggaggccatcaagcgcaaactgaggaccctcatcttagcccccacccgcgtagttgcttccgaaatggccgaggcgcttaagggcatgccaatccgctaccagacgaccgctgtaaagagcgagcacaccggtaaggagatcgtggacctcatgtgccacgctaccttcacgatgcggttattaagtccggtccgtgtgccgaactacaacatgattatcatggatgaggcccacttcaccgacccctcatcaatcgctgcacggggctacatcagcacccgcgtgggcatgggggaggccgctgcaatctttatgacagccacgccccctggctccgtcgaagcgtttccgcagagcaacgccgtgatccaagacgaggagagggacatacccgaacgctcctggaattctgggtacgaatggatcaccgactttcccggcaagaccgtttggttcgtcccctccatcaagagcggcaacgacatagccaactgtttgcggaagaacggaaagcgtgtgatccagctatcgagaaagaccttcgacacggagtaccagaaaacgaagaacaatgactgggactacgttgtcaccaccgacattagcgaaatgggcgctaactttcgcgctgaccgggtgatcgacccccgccggtgcctgaaacctgtgatcttaaaggatgggcccgaacgagtgattctggccggccccatgcctgtcacggtcgcctccgccgcccagcgccgcgggcggatcggtcgcaaccacaacaaggagggcgaccagtacatctacatgggacaacccttaaacaacgacgaggaccacgctcattggaccgaagccaagatgctcctggacaacatcaacacccccgagggaatcatccccgccctgttcgagccggagcgggaaaagtccgccgccattgacggggagtaccgtctccgcggcgaggcccgaaagacctttgtggagctgatgcgccgcggggatctgcccgtgtggctctcctacaaggtggctagcgaggggttccagtacagcgatcgccggtggtgttttgacggcgagcgcaacaaccaggtgctggaagagaacatggacgtggagatctggaccaaggagggagagagaaagaagctgcgcccccggtggctcgacgcacgtacctactccgatcccctcgcccttcgggaattcaaggaattcgccgccgggcgccggagcgtatccggcgacctcatccttgagatcggtaaactccctcagcacttaacacaacgggcccaaaacgccctggacaacctagtcatgctccacaatagtgagcagggcgggcgggcataccgacacgcgatggaggagctgcccgacaccatcgaaacgctgatgctcctggccctgatcgccgtcctcaccggaggagttactcttttcttcctttccgggcgggggctcggcaaaacgtctatcggactcctatgcgtgatggcgtcttcagtgctcctgtggatggccagtgtggaaccccactggatcgcggcctctatcatactggagtttttcctcatggttttgctgatccccgagccggacagacagcggacgccccaggacaaccagctcgcctacgtggttatcgggctgctattcatgatcctcacggtggccgccaacgagatgggcctgctggagaccaccaaaaaggacctcgggatcggccacgtggccgtagagaatcaccaccacgccaccatgttagacgtggatctccaccccgcctccgcttggacgctctacgcggtggccacgacgatcataaccccgatgatgcgccacacgatagagaacaccaccgccaacataagcttgacagcgatcgctaaccaggccgctatcctgatgggcctcgacaagggctggcccatctctaagatggacatcggcgtccccttactggcattaggttgctacagccaggtgaaccctttaacgctgaccgccgccgtgctcatgctagttgcgcactacgccatcatcggaccggggctgcaggccaaggccacccgggaggcacagaaacgcaccgcggccggtatcatgaaaaaccccacggtggatgggatagtggccatcgacctcgaccccgttgtgtacgacgccaagttcgagaagcaactcgggcaaatcatgctgctcatactctgcacctcacaaatcctgctcatgcgcaccacctgggccctgtgcgaaagcattacactggcgaccggccccctcaccaccttgtgggaggggagccctggcaaattctggaacactaccatcgcagtgagtatggccaacatcttccgagggtcctatctcgcgggtgccggcttagcgttcagcctgatgaagtcccttgggggcgggcgccgggggaccggtgcccagggagagaccctcggggagaagtggaagcggcagcttaaccagctgtccaagagcgaattcaacatctacaagcgaagtggcattatggaggtcgaccgcagcgaggcaaaggagggcttgaagcgcggggagacgacccgccacgcagtgtcccggggcacggcgaagctgcgatggttcgtggagcggaacttagtcaaacccgagggcaaagtgatagacctgggttgcggccgagggggctggagctactactgcgcagggctcaagaaagtgaccgaggtcaaaggctacacaaagggggggcccggccacgaggagcccattcccatggccacctacgggtggaacctggtgaaactgcactccggcaaggacgttttctttacgccaccggagaagtgtgacaccctcctgtgcgacatcggggagagctccccgaacccgacgatagaggaggggcggaccctgcgcgtcctcaagatggtagaaccctggctgcgggggaaccagttttgcatcaagatcctgaacccctacatgccctcagttgttgaaaccctcgagcagatgcagcgcaagcacggcggcatgctggtgcgtaacccgctttccagaaacagtacccacgagatgtactgggttagctgcggtacaggcaacatcgttagcgccgtcaacatgactagccggatgctcctgaaccgattcaccatggcccaccgcaagcccacttacgagaaggacgtcgatctgggggcgggcaccaggcacgtcgccgtggaacccgaggtggccaacctagatatcatcggccaacgcatcgagaatattaagcatgagcacaaaagcacgtggcattacgacgaggacaacccctacaagacatgggcttaccacgggtcctacgaggtcaagccaagcggaagtgccagttcgatggtcaacggggtcgtgaagcttctgaccaagccctgggacgtgatccctatggtcacacagattgcgatgacggacaccacccccttcggccagcagcgggtgttcaaagagaaggtggacactcgcacgcccaaggccaagcgggggaccgtccaaattatggaggttactgcgcgctggctctggggcttcctatccagaaacaagaagcccaggatctgcacccgggaggagttcacgcggaaagtaaggagcaacgccgccatcggcgcggtcttcgtagacgaaaatcaatggaattccgccaaggaggccgtggaagacgaacgcttctgggacctggtccagaaggagcgggagctacacaagcagggcaaatgcgcgacctgtgtatacaacatgatggggaaacgcgagaagaaactgggggagttcggtaaggctaaggggagccgggccatttggtacatgtggctgggcgcacgcttcctcgagttcgaagccctgggcttcatgaacgaagatcactggttctcccgggagaacagcctgtctggggtggagggcgaggggctccacaagctgggctacatcctgcgcgacattagcaagatccccggtggcaacatgtatgccgacgacaccgcgggctgggacacccggatcacggaagacgacctccaaaatgaggccaagatcaccgacatcatggagccggagcacgccctgctggccacctccatctttaagcttacctatcaaaacaaggtcgtgcgcgtgcaacggcccgccaaaaacgggactgtcatggacgttatctcacgccgtgaccaacgaggctccggacaggtgggcacctacggcctgaacaccttcaccaacatggaggcgcagctgatccgccagatggagagcgagggtatcttcctcccatcagagttggagacgccaaacctcgccgaacgggtcttagactggctggagaagtacggggtggaacgcctgaagcggatggctattagcggtgacgactgcgttgtcaagccgatcgacgaccggttcgccaccgccctgaccgcgttgaacgacatgggcaaggtgcggaaagacatcccccagtgggagccgtccaagggttggaacgactggccccaggtgccgcactgcagccaccacttccaccagctcatcatgaaggacggccgagagatagtggtcccctgccggaaccaagacgagcttgtgggacgagcccgggtatcacagggcgccggctggagcctgcgagagaccgcctgtctgggcaagagctacgcccagatgtggcagctcatgtacttccaccggcgagacctccggctggcggccaacgccatatgttccgccgtgcctgtcgactgggtaccgacgagccgaaccacatggtcaatccacgcgcaccatcagtggatgaccacggaagacatgctttctgtgtggaatcgggtatggatagaagagaacccgtggatggaggataagactcatgtctcctcctggggggatgtaccctacctaggcaaaagagaggaccagtggtgcgggtccctgatcggcctcaccgcccgagccacctgggccagcaatatacaggtggccatcaatcaggtgcgccgcctgatcgggaatgagaactacctggactatatgacgtccatgaaacggttcaagaacgaggacgaccccgagggcgcgctatggtga

SEQ ID NO: 24248 - RNA, 9879 nt, synthetic construct
  misc_feature 1..9879: note = derived and/or modified CDS sequence (opt11) from DENV-1__FJ882517__SS-prME
  source 1..9879: mol_type = other RNA
agtgtgaccatgttgctaatgctgatgccaaccgccctggcgttccacctcactacccggggcggggagccccacatgatcgtcagcaagcaggaacggggcaagagcctgctgttcaagacctcagcgggggtcaatatgtgcaccctcatcgccatggatctcggcgagttctgcgaggacacgatgacctacaaatgcccccgcatcactgaggctgagcccgatgacgtcgactgctggtgcaacgccaccgacacgtgggtgacatacgggacctgtagccagacgggcgaacaccgtcgggacaagcggtccgttgccctggcgccccacgtgggcctcggcctggagacacgcaccgagacttggatgtcgtccgagggcgcctggaagcagatccagcgggtggagacctgggccctgcgccacccggggttcacggtgatcgccctcttcctggcgcatgccatcggcaccagcatcacccaaaaggggatcatcttcatcctgctcatgctggtgacccctagtatggccatgcgctgcgtcggcatcggctcccgcgacttcgttgaggggctgtccggggccacgtgggtggatgtcgtactagaacacgggagctgcgtcaccaccatggcgaaggataagcccaccctagatattgagctgctcaagacggaggtcaccaaccccgccgtgctgcggaaactgtgcatcgaagccaagatctccaatactaccacggacagtcgctgcccgacccagggcgaggccaccctcgtggaagagcaggacgccaacttcgtctgccggcgcaccttcgtggaccgtggctgggggaatggttgcgggctgtttggtaaaggttcccttatcacgtgcgcaaagttcaagtgcgtgaccaaactcgagggtaagaccgtccaatacgaaaacttgaagtacagcgtgatcgtgactgtccacacgggtgaccagcaccaggtggggaacgagtccaccgagcacggtaccaccgcgaccatcacgccccaagccccatcgacggagatccagctgacggactacggggcactcaccctggactgcagcccccggacggggctggacttcaacgaaatggtgctcctgacgatgaaggagaagtcctggctggtgcataagcagtggttcctcgacctgccgctgccctggacctccggggcctccacctctcaagagacctggaaccggaaggatctcctggtgacatttaagaccgcccacgcgaaaaagcaagaggtcgtagtgttgggctctcaagaaggcgccatgcacaccgccttgacgggggctaccgagatccagaccagcggcacgaccaccatcttcgccggccacctgaagtgtcgtttaaagatggacaaactcaccctaaagggtatgtcctacgtgatgtgcacagggagctttaagctggagaaggaagtggcggagacgcagcacggtacggtgttggtgcagatcaagtacgaggggaccgacgccccctgcaagatacccttctccacccaggacgagaagggtgtcacgcaaaacggcaggctgatcaccgccaatccgatcgtgacggacaaggagaagccagtcaacattgaggcagagcctccgtttggagagtcctacatcgtgataggggcaggcgaggaggctttgaagctgagctggtttaagaaggggagctccataggcaagatgttcgaggcgaccgcgcgcggcgcccgtcgcatggccattctcggcgacacggcctgggacttcgggagcatcggtggggtgttcacgtcagtcgggaagttagtccaccagattttcgggaccgcgtacggggtgctgttcagtggggtcagttggacgatgaagattgggatcggcgtcctcctcacgtggctgggcctcaactcgcgcagcaccagcctgtcgatgacctgcatcgccgtggggctggtgaccctttacctgggcgtgatggtccaagccgattccgggtgcgtcatcaactggaagggacgggagctgaagtgcggaagcggaatcttcgtcacaaacgaagtgcacacctggaccgagcagtacaagttccaagcggattccccgaaacggctcagcgccgctatcggcaaggcttgggaggagggggtatgcggcatccggtccgccacccgtctggagaatatcatgtggaagcagataagcaacgagctcaaccacatcctcctggagaacgatatgaagtttaccgtggtggtcggggacgtggcgggcatcctggctcaggggaagaagatgatccggccccagcccatggagtacaagtattcctggaagagttggggcaaggccaaaattatcggggccgacgtgcagaacacgaccttcatcatcgacgggccgaatactcccgagtgccccgacgatcagcgcgcgtggaatatatgggaggttgaggactacggcttcgggatcttcaccacgaatatctggcttaagctgcgagactcctacacccaagtgtgcgaccaccgcttaatgagcgcagccattaaggactcgaaggcggtgcatgccgacatgggctactggatagagagcgagaagaacgagacatggaagcttgcgcgggccagcttcatcgaggtcaagacctgcatttggcccaagagccacaccctgtggtcaaatggcgtgcttgagagcgagatgatcatccctaaaatctatgggggcccgatctcccagcacaactaccgccccgggtatttcacccagacggccggcccctggcacctcgggaagctggagctcgacttcgacctctgcgagggcaccacagtggtggtggacgagcactgcggcaaccgggggccgagcctgagaaccaccaccgttacgggcaagattatccacgagtggtgctgccggagctgcactttacctccgctgcgcttcaaaggggaggacgggtgctggtacgggatggaaatccggccagtcaaggagaaggaggaaaacctggtcaagagcatggtctccgccggctccggtgaggttgacagcttctccctggggctcctgtgcatcagcatcatgatcgaggaggtgatgcgcagtcgttggagccgcaagatgctcatgacgggaactctggctgtgttcttcctgctgataatggggcagctcacctggaatgatctgatccgactgtgtatcatggtcggcgcgaacgcctcggaccgcatgggaatgggcaccacctacctcgcgctaatggtgactttcaagatgcgcccgatgttcgcagtcgggctcctgttccggcgcctgacgagccgggaagtcctgctcctgaccatcgggctgtccctagtggccagcgtcgagctgcccaacagcctggaggagctcggcgacggactggcgatgggcataatgattctcaagttactaactgacttccagagccaccagctgtgggccaccctcctgtccctgacgttcatcaagaccacattcagtctccattacgcctggaagaccatggctatggtactgtcaatagtgtcgctattccccctctgcctgagtaccaccagccagaagacaacgtggctgcccgtactcctgggctccctgggttgcaagcccctcacgatgttcctgatcgccgagaataagatctggggccgcaagagctggcccttaaacgaaggaatcatggccgtgggcatcgtgagcattttattgtccagcctgttgaagaacgatgtcccactggcggggcccctgatcgccggaggtatgctcatagcttgttacgtgatatcagggagctctgcggacctgagcctggagaaggccgctgaggtctcgtgggaggaggaggcagaacacagcggcgcctcccacaacatactcgtcgaggtgcaagacgacggaaccatgaagatcaaggacgaagagcgtgacgataccctgaccatactcctaaaggcgaccctgctggctgtaagcggcgtctacccgctctccatccccgccacgctgttcgtgtggtatttctggcagaagaagaagcagcgcagcggcgtgctctgggacaccccttcaccgcccgaagtcgagcgggccgtgctcgacgatggcatctaccgcataatgcagcggggcttactgggtcgcagccaggtgggcgtcggggtcttccaggagaacgtgttccacaccatgtggcacgtcacccggggcgcggtgctgatgtatcaggggaagcgcctcgaaccctcctgggcctccgtgaagaaggatcttatttcctacggtggggggtggcggctgcagggcagctggaatactggggaagaggttcaggtgatcgccgtggagcccggcaaaaatcctaagaacgtgcaaaccgccccggggaccttcaagacgtccgagggcgaggtgggcgccattgccctcgatttcaagcccgggaccagcggcagccccatcgtgaatagagaggggaagatcgtgggcctgtacggaaacggagtggtgaccacctccggtacctacgtcagcgcgatcgcccaggccaaggcctcccaggaggggccgctgccggaaattgaagacgaggtctttagaaagcgcaacttgacgattatggatttacaccccggctcgggtaagacccgacgctaccttcccgcgatagttcgggaggccatcaagcgcaagctccggacgctgatcttagcccccacccgcgtcgtggcctccgagatggcggaggcactcaaaggcatgccaatccgctaccagacgaccgctgtcaagtcagagcacaccggcaaggagatcgtcgacctgatgtgccacgcaacctttacaatgcgcctgctctctccagtgagagtgcccaactacaacatgatcatcatggacgaggcccactttactgacccgagctctatcgccgcgcgggggtatatcagcactcgcgtcggcatgggcgaggccgctgccatcttcatgaccgccacgccgcctggctccgtggaagcgttcccccagtcaaacgcagtgattcaggacgaggagagggacatccccgagcgctcctggaacagcggctatgagtggatcaccgacttccccggaaaaacagtgtggttcgtgccatccatcaagagcggcaacgatatagcgaactgccttcggaaaaacggcaagcgcgtgatccagctgtccaggaagacctttgacacggagtaccagaagacaaaaaacaacgactgggactatgtcgtgaccacggacatcagcgagatgggtgccaatttccgcgcggaccgcgtgatcgacccccgccggtgcctcaagccggtcatcctgaaagacggacccgagcgagtgatactggccggccccatgcccgttacggtggcctccgccgcgcagagacgcgggcgtataggccgcaaccacaacaaagagggcgaccagtatatttacatggggcagccgctcaataacgacgaagatcatgcgcattggaccgaagccaagatgctgttagacaacataaacacccccgagggcatcatccccgccctcttcgagcctgagcgggagaagtccgccgccattgatggggagtaccgcctaagaggagaggcgcgcaagaccttcgtggagctaatgaggcgtggcgacctccctgtctggttaagctacaaggtggcctccgagggctttcagtacagcgaccggcggtggtgctttgacggcgagcgcaacaaccaggtgctggaggagaacatggatgtcgagatatggactaaggagggggagcgaaagaaactcagaccccgctggctggacgcccgcacctactccgacccccttgccctccgggagttcaaggagttcgccgctggacgccgtagcgtttcgggagatctgatcttagagataggcaagctcccccaacatctaacgcagcgcgcccagaacgccttggacaacctcgtgatgctgcacaatagcgagcagggcgggcgggcatatcgccacgcgatggaggagttaccggacaccatcgagaccctaatgcttctggccctcatcgccgtcctgaccggtggggtcacgctgttcttcctctccggccggggtctgggcaagactagcataggcctgctgtgcgttatggcgagcagcgttctgttatggatggcctcggttgagccccactggatcgcggccagcatcatcttagagttcttcctcatggtcctgctcatcccggagcccgaccgccaaagaactccgcaagacaaccagctggcgtacgtagttatcgggctccttttcatgatccttacggttgcggcaaacgaaatgggccttctcgagaccaccaagaaggacctgggcattggccatgtcgcggtggagaaccatcaccatgccgcgatgctggacgtggatctccaccccgcatccgcctggaccctctacgcagtcgcgacgaccatcatcacccccatgatgcgccacaccatcgaaaacacgactgccaacatcagcctgaccgccatcgccaaccaggcagcgatcttaatgggactggacaagggctggccgatctccaagatggacatcggagtgcccctgttagccctggggtgttacagccaggtgaaccccctgaccctcactgccgcagtcctcatgctggtggcccactacgccatcatcggccccggtctacaggccaaggctacacgcgaggcgcaaaaacgtaccgccgccggcatcatgaagaacccgactgtggatgggatcgtagctatcgacctggaccccgtggtgtacgacaccaagttcgagaaacaactgggccagatcatgctgctcattctttgcacctcccagatcctcctgatgcgcacaacctgggccctgtgcgagagcatcacgctcgcgaccggacccctgaccacattgtgggaggggtcccccggcaagttctggaacactactatcgccgtaagcatggctaacattttccgggggagctacctggctggcgccggccttgcgttctcccttatgaagtccttaggcggcggccgccggggcaccggggcccagggagagaccctgggcgagaagtggaagcgccagctgaaccagctaagcaagagcgagttcaacacgtacaagcggtccgggatcatggaggtggaccgtagcgaggctaaggagggccttaagcgcggggaaaccaccaaacacgccgtgtcccgcggcaccgcaaagttacgttggttcgtcgagcgcaacctcgtgaagccagaggggaaggtcatcgacctgggctgcggccgcggggggtggagctactactgcgctgggctgaaaaaagtaacggaggtgaaggggtacaccaaaggcgggcccggccacgaggagcccattcccatggccacatacgggtggaacctggtgaagctccactccggaaaggatgtctttttcataccacccgagaagtgcgacactctgctgtgcgacatcggtgaaagctcccccaaccccacgattgaagagggtcgaaccctccgggtgcttaagatggtggaaccgtggttacgcgggaatcaattctgcatcaaaatcttaaacccctacatgcccagcgtggttgagaccctggagcagatgcagcggaagcacggcggcatgctggtgcgcaaccccctaagccggaacagcacccacgagatgtactgggtctcgtgcgggaccggcaacattgtgagcgcagtgaacatgacgagccgaatgctccttaaccggttcaccatggcccatcgcaagcccacttatgaaagggacgtcgacctcggggctggcacgcggcacgtggccgttgaacccgaggtcgccaacttagacatcatcgggcagcgcatcgaaaacatcaagcacgagcacaaaagcacgtggcactacgacgaggacaatccctacaagacttgggcctaccacggctcttacgaagtaaagcccagcggctcagcttccagcatggtcaacggggtggtgaagctgctcaccaaaccgtgggacgtcatcccgatggtgacccagatagcgatgacggacactacccccttcggacagcagcgggtgttcaaagagaaagttgacacccgcacgccgaaggccaagagggggactgcccagatcatggaagttactgccaaatggctgtggggctttctgtccaggaacaagaaaccccggatctgcacgcgagaggagtttacacgaaaagtgcgcagcaacgccgcgatcggggccgtcttcgtggacgagaaccagtggaactccgccaaggaggccgtggaagacgagcggttctgggacctcgtccaccgtgagcgggagcttcataaacagggcaagtgcgcgacctgcgtgtataacatgatgggcaagagggaaaagaagttgggcgagttcgggaaggccaaggggagccgggccatctggtacatgtggctcggcgcgcgcttcctggagttcgaggccttaggattcatgaacgaggaccactggttctcccgggagaatagcttatccggggttgagggcgagggtctgcacaagctggggtacatcctccgcgacatcagtaagatccccgggggcaacatgtacgctgacgacaccgccggttgggacactagaattacggaagacgacttgcaaaatgaagcgaagatcaccgacattatggagcccgagcacgccttgctcgcgaaatccatttttaagctgacataccaaaacaaggttgtgcgcgtgcagcgcccggctaaaaacggcaccgtcatggacgttatctctcggcgcgaccagcggggctccggccaggttggaacgtacggcctgaacaccttcacgaatatggaggctcagctcatccggcagatggagagtgaggggatcttctcccccagcgagcttgagacacccaacctcgccggccgggtcttggattggctggagaagcacggggtggagcgcctgaagcggatggccatttccggggatgactgcgtggtcaagccgatcgatgaccgcttcgccacggctctcaccgccctgaacgatatgggaaaggtgcggaaggacatcccgcagtgggagccctcgaagggctggaacgactggcagcaagtccccttctgtagccaccacttccaccagctgataatgaaggacggccgcgagatagtcgtaccctgccggaaccaggacgagctcgtggggcgcgcccgggtatcccagggggcagggtggagcctgagagaaaccgcgtgtctgggaaaatcttacgcccaaatgtggcagctaatgtacttccaccggcgcgacctgcggctggcagccaacgccatctgctctgcggttccggtggactgggtccctacatccaggacgacttggtcaatccacgcccaccaccagtggatgacaaccgaggacatgttgtccgtgtggaaccgggtatggatcgaagagaacccgtggatggaggataagacgcacatcagcagctggggcgacgtcccctacctgggcaagagagaagaccagtggtgcggcagcctgatcgggctcaccgcccgggcaacctgggccaccaacatccaggtggcgatcaaccaggtgcgccgcctgataggcaacgaaaactatctggactacatgacctccatgaagagattcaagaatgagagcgacccagagggggccctctggtga

SEQ ID NO: 24249 - RNA, 9879 nt, synthetic construct
  misc_feature 1..9879: note = derived and/or modified CDS sequence (opt11) from DENV-1__JQ287661__SS-prME
  source 1..9879: mol_type = other RNA
tcggtgaccatgctgctcatgttaatgcctaccgctctcgcattccacctcacaactcggggcggggaaccccacatgatagtgaccaaacaggagcggggcaaatcacttctgttcaagacatcggccggggtgaacatgtgcaccctcatcgccatggacttgggcgagctgtgcgaagataccatgacctataagtgcccgcggatcaccgaggccgagcccgatgacgtggactgctggtgcaacgcaacggacacctgggtcacctacgggacctgctcacagacgggcgagcaccgacgcgacaagagaagcgtggccctcgcaccacacgtgggcctggggctggagacccggaccgaaacctggatgtcctctgagggcgcctggaaacagattcagagggtcgagacgtgggccttgcgtcaccccgggttcaccgtgatcgccctgtttctcgcgcacgccatagggacctccatcacccaaaaggggatcatattcatactcttaatgctcgtgactcccagcatggcgatgcgctgtgtcgggatcggctcgcgcgacttcgtggaggggctcagcggcgctacctgggtggacgtcgtgctggagcatgggtcctgcgtgaccaccatggccaaggacaaacccacactcgacatagagctcctcaagaccgaggtcaccaaccccgcggtgctgaggaagctctgcatcgaggcgaagatcagcaacactactaccgacagccgctgccccacacagggcgaggcaaccctaatggaggagcaggatgccaacttcgtgtgccggcgcaccttcgtcgaccggggctggggaaacggctgcggcctgttcggcaaggggagcctaattacctgcgccaagttcaagtgcgtcaccaagctggagggcaagatcgtccagtacgaaaacctgaagtactccgtaatcgtgacagtgcacactggcgaccaacatcaggtagggaacgagagcaccgagcacgggaccacagcaaccatcacgccccaggcccccactagcgagattcagctcacagactacggggccctgaccctggattgtagccctcgcactggcctcgacttcaatgagatggtgctccttactatgaaggaaaagagttggttagtccacaagcagtggttcttggatctaccgctgccctggacctccggggcttcaacatcccaggagacgtggaaccggcaggacctgctggtgacgttcaagaccgcccacgccaaaaaacaagaagtggtcgtgctcggcagccaggagggcgccatgcacactgcactgactggcgccaccgagatccagacctctggtacaacaacaatcttcgcaggacacctcaagtgcagactcaagatggacaagctaacgctgaaaggcatgagctatgtcatgtgtaccgggagttttaagctggagaaggaggtcgcggagacccagcacgggaccgtgctggtgcaaatcaagtacgagggcaccgatgctccctgcaagatcccctttagcactcaggacgagaagggggttacccagaacgggcggcttatcactgccaatcccatcgtgacagacaaagagaaacccgtgaacatcgaggcagagcccccgttcggggagtcctacatcgtaatcggagcaggcgagaaggccctgaaactgtcatggttcaaaaaggggtccagcatcggtaagatgttcgaggccaccgcccgtggggcccggaggatggcgattctgggcgacacggcgtgggacttcgggtccataggcggcgtgttcacgagcatcgggaagttagtgcaccaaatctttggcaccgcgtacggagtcctcttctccggagtttcttggaccatgaagatcgggatcggcgtacttctaacttggctaggcttgaactccagatctacctccctttccatgacctgcatcgccgtaggtctcgtcaccctgtatctgggcgtgatggtacaggccgactctgggtgtgttattaactggaagggccgggaacttaagtgtgggagcggcatattcgtaacaaatgaggtccacacttggacggaacaatacaagttccaggcggacagcccgaaacgcctttccgcggccatcggcaaggcctgggaggagggggtgtgcggcatccggagcgccacgagactggagaacgtgatgtggaagcaaatatccaacgagctgaaccacatattgctggagaacgacatgaagttcacggtcgtagtgggggatgtcgtcggcatcctcgcgcagggcaagaagatgatccgtccccagcccatggagcacaagtacagctggaagtcctggggcaaagccaaaatcatcggcgctgacgtccagaacactaccttcatcatcgacggccctaacacacctgagtgcccagatgaccagcgcgcatggaacatctgggaggtggaggactacggcttcgggatattcactacgaacatctggctgaagatgcgggacagctatacccaggtgtgcgaccaccgcttaatgagtgctgccatcaaggacagcaaggccgtgcacgccgacatggggtactggatcgaaagtgagaaaaacgagacctggaagctcgccagggcgagcttcatcgaagtcaagacctgcatctggcccaagtcccataccctgtggtctaatggtgtgctggagtctgaaatgattatccccaagatctacggtggcccgattagccagcacaactaccgcccagggtatttcacccagaccgccggaccctggcacctcgggaagctggagctggacttcgacctctgcgagggcaccacggtagtcgtggacgagcactgcggaaaccgggggccttcgctccgcaccaccacggttacgggcaagattatacacgaatggtgctgtcggagctgcaccctcccccccctgcgctttaagggggaggacggctgttggtatggtatggagatccgccctgttaaggagaaagaagagaacctggtcaagagtatggtttcagccggcagtggagaggtagactccttcagcctggggttgctgtgtatctccataatgatcgaggaggttatgcgcagccggtggtcccgcaagatgctgatgacgggtaccctcgccgtgttcctgctgctcatcatggggcagttaacatggaacgaccttatccggttgtgcatcatggtcggcgccaacgcgagcgaccgcatggggatgggaactacctacctggccctaatggctactttcaaaatgcgcccgatgtttgccgtgggattactgttccgacgcctgacgtcccgggaggttctcctattaacaatagggctatcattggtggcctccgttgagctccccaacagcctcgaagaactgggcgacggactggcgatggggattatgatactaaagctgctgaccgacttccagtcccaccagctctgggccactctcctgagcctcacgttcatcaagaccaccctatcgctgcactacgcctggaaaacgatggctatggtcctctcaatcgtgagtctgatcccactctgcctcagcaccacctcacagaagacgacctggctgcccgtgttattaggctctttaggctgcaaaccattaacgatgttcctcattgcggaaaacaaaatttgggggcgcaagtcctggccccttaacgaggggatcatggccgtgggcgtggtgagcatcctgctcagctccttactgaagaacgacgtccccctggccgggcctctgatcgccggaggcatgctgattgcttgctacgtaataagcgggagtagcgcggacctcagtctagaaaaggcagccgaggttagttgggaggaggaagccgagcattccggagctagccacaatatactggtcgaggtgcaggacgatgggacaatgaagatcaaagacgaggagcgggacgacaccttgacaatcttactgaaggccaccctcctggccgtatctggagtgtacccgctctctatccccgccaccctcttcgtatggtacttctggcagaagaagaagcagcgctccggagtgttgtgggataccccttccccgcccgaagtagagcgggccgtgctggacgacggcatctatcgcatcatgcaacgtggcctgctagggcgctcccaggtgggcgtaggggtattccaggagaatgtattccacaccatgtggcacgtcacccggggcgccgtgctgatgtaccaagggaagcgcctggagccctcttgggcgtccgtgaagaaggacttgatctcttacggcggcgggtggcggctgcaggggtcatggaacacgggggaggaggtccaggtgatcgcggtggagcccggaaagaacccaaagaacgtccaaaccgcgcccgggacctttaaaaccccggagggcgaagtgggagcgatcgccctggacttcaaacccggtacgagtggctccccaatcgtcaaccgcgagggcaagattgtcggcctctacggcaacggtgtggtgaccacaagcggcacgtatgtaagcgccattgcccaggccaaagcctcccaagaggggcccttgcccgagatcgaagacgaggtatttcggaagcgcaacctcacaattatggacctccaccccggcagcgggaagacccgtcgctacctgccggcgatcgtgcgggaggccatcaagcgcaagctccggactctcatcttggcccccacccgcgtcgtggcctcggagatggcagaggcgctgaaaggaatgccgattaggtaccagaccaccgccgtcaagtccgaacacaccgggaaggagatcgtagacctcatgtgtcacgccacattcacgatgcgtctgctgtccccggtgcgcgtaccgaactacaacatgatcatcatggatgaggcccattttaccgatccctcttccatcgccgcgcgcgggtacatctctacacgtgtgggcatgggggaggccgctgccatattcatgaccgctacgccgcccggctccgtggaggcgttcccgcagagcaatgccgtgatccaagacgaggagcgggacattcccgaaagatcctggaactctggttacgagtggatcacggacttccccggcaaaaccgtatggttcgtgccctccattaagagcgggaacgatattgccaactgcttacgcaaaaacggtaagcgggtaattcagctgagccggaagacgttcgacacggagtatcagaagactaagaataacgattgggactacgtcgttacgaccgacatatccgagatgggcgctaacttccgcgcggaccgggtgatcgacccgcgccggtgcctgaagccagtgatattaaaggacgggcctgagcgcgttattctggccggccccatgccagtcacggtggcctccgcggcccagcgccgcgggcggatcggccgcaaccataacaaagaaggcgaccagtacatctacatggggcaacctctgaacaacgacgaagaccatgcacactggactgaagccaaaatgctgctggacaacattaacacccccgagggtattatccccgcactgttcgaaccggagcgggagaagtccgccgccatcgacggggagtaccgtctcaggggcgaggcaagaaaaaccttcgtggagctgatgcgcagaggggacctgcccgtctggctctcctataaggtggcctcagagggtttccagtattctgaccgacgctggtgcttcgacggcgaacgcaataaccaggtgctggaagagaacatggacgtagaaatatggaccaaagagggggagcggaagaagctaagaccccggtggttggatgcccgcacctacagcgaccccctggcgctgcgggagtttaaggagttcgccgcaggtcgccgatccgtgtccggtgatctcatcctggagataggcaagctgcctcagcatttgacccaacgcgcccagaacgcgcttgacaacctggtgatgctccacaacagcgagcagggcggaagggcctaccggcacgcgatggaggaactgcccgacactatcgagacgttgatgctcctggccctgatagcagtcctcacaggcggagtgaccctgttttttctgtcaggccgggggttagggaaaaccagcataggcctgctgtgcgtgatggcctccagcgtcctcctgtggatggccagcgtagagccccattggatcgccgccagcatcatcctagagttcttcctgatggtgctgctgatcccagagccagatcgacagcggacacctcaagacaaccagctcgcctacgttgtgatcgggcttttgttcatgatcctcacggtagccgccaacgagatgggattacttgagaccaccaagaaggacctcgggatcggccacgttgctgtggagaaccatcaccacgctacaatgctagacgtggatcttcaccctgcctccgcatggacgctctacgccgtcgccaccaccatcattacgccaatgatgcgccacacgatcgagaacaccaccgccaatatcagcctgaccgctatcgccaaccaggctgcgatcctgatgggattggataagggctggccaataagcaaaatggacataggcgtgcccctgttagctctggggtgctattctcaggttaacccgctgactctgaccgccgccgtcctcatgctggtggcccactacgccatcatcggtccggggctgcaggccaaggccaccagggaggcccagaaacgcaccgcggccggcatcatgaaaaatcctacagtggatgggatcgtcgccatcgacctcgacccggtggtgtacgacgccaagttcgagaagcagctgggccagattatgttgctcatcctgtgtacctcccagatcctgctcatgcgcaccacctgggccttatgcgaaagcatcacgcttgcgaccggcccattgaccaccctgtgggaagggtcccccggaaaattctggaacacgaccatcgccgtaagcatggccaacatctttagggggtcttacctagccggcgccgggctcgcgttcagcctaatgaagtccctcgggggcgggcgccggggcacgggggcacagggcgagacactcggcgaaaaatggaagagacagctgaatcaactatctaaaagcgagttcaacatctacaagcggtctgggatcatggaggtggaccgcagcgaggccaaggaggggctcaagcgcggagaaacgacccggcatgcagtgagccgcggcaccgcgaagctgcgctggttcgtcgagcggaacctggtgaagcccgagggtaaggtcatcgacctgggatgtggcaggggcggctggagttattactgtgccgggctcaagaaggtgactgaggtgaagggctacactaagggcggccccggccacgaggaacccatccccatggcgacgtacgggtggaatctggtgaagctgcacagcggcaaggacgtcttcttcacgccgcctgagaagtgcgacacgctcctgtgcgacataggtgagtcgtcacccaaccccacgatcgaggagggccggaccctgcgcgtgctcaaaatggtggagccctggctgcgggggaatcaattctgtattaagatcttaaacccctacatgccgagcgttgtggagaccctcgaacagatgcagagaaagcacgggggcatgctggtgcggaatccgctgtcccgcaatagcacccacgagatgtactgggtatcctgtggaaccggtaacatcgtgagtgccgtgaatatgacaagccggatgctccttaaccgtttcacgatggctcaccgcaagcccacctacgagaaggacgtcgacctgggagcgggcacccggcatgtcgccgtggagcccgaggtcgccaacttggacatcattggccagaggatagagaacatcaagcacgagcacaagtcaacgtggcactacgacgaagacaacccctacaagacctgggcctaccacgggtcctacgaggtgaaaccgtctggttccgccagctcaatggtcaatggggtagtgaagctgttaactaagccttgggacgtcatccccatggtgacacagatagccatgaccgacaccaccccgttcggccaacagcgggtgttcaaggaaaaagttgatacccgaacgccgaaagccaaacgggggacggtgcagatcatggaggtcacagcccggtggctctggggattcctgagccggaacaagaagccccgcatctgcacgcgggaagagtttacgagaaaggtccggagcaatgccgccatcggcgcggttttcgtggacgaaaaccagtggaactccgccaaggaggccgtcgaggatgaacgattctgggatctggtgaagaaggagcgggagctccacaagcaagggaagtgtgcgacctgtgtctacaatatgatgggcaaacgcgagaagaagctgggggagtttggcaaggcaaaggggagccgggctatctggtacatgtggctcggcgcccgcttcctcgagttcgaagccctgggcttcatgaacgaagatcactggttcagccgggaaaactctctgtccggtgtcgaaggcgagggcttgcacaaactgggctatatcctgcgggacatctcaaaaatacccggcggcaacatgtatgccgacgataccgctggctgggacacccgcatcacggaggacgatttacaaaatgaggccaagatcaccgacatcatggagcccgagcacgccttgctagctacatccatcttcaaactcacctaccagaataaagtggtgcgcgtccagcggcccgctaagaacggtacggtgatggacgtgatcagccgccgcgaccagcgtggctccgggcaggtcggcacctacggcctaaacactttcaccaatatggaggcgcagctgatccgtcaaatggagtcggaggggatcttcctcccctctgaattggaaacgccgaacctggccgaacgcgtgctcgactggctggaaaaatacggcgtggagcgcctgaagcggatggcgataagcggggacgactgcgtcgtaaagccgatagacgaccgtttcgctaccgcgctcaccgcgttaaacgatatgggcaaggtacgtaaggacatcccccagtgggagccctccaaggggtggaacgattggcagcaggtccccttctgtagtcaccacttccaccagctgatcatgaaggacggccgcgagatcgtcgtaccatgccggaaccaggacgagttggtcggtagagcccgggtctcccagggggccggttggagcctaagagagaccgcgtgcctgggcaaaagctacgcccagatgtggcagcttatgtatttccaccgccgcgatctgcgactcgcagccaatgccatatgttctgccgtgcccgtcgactgggtgcccacctctagaaccacctggagtatccacgctcatcaccagtggatgaccacggaagacatgctatctgtatggaatcgggtctggatcgaggaaaacccttggatggaagacaagacccatgtgtccagctggggcgacgtgccctacctggggaagcgtgaggatcagtggtgcggctccctgattggcttaaccgcacgtgcgacctgggcctcaaacatccaagtcgctatcaaccaggtccgccgcctgatcgggaacgagaactacctagattatatgacgtccatgaaacgcttcaagaacgagggcgaccccgagggagcgttgtggtaa

SEQ ID NO: 24250 - RNA, 9879 nt, synthetic construct
  misc_feature 1..9879: note = derived and/or modified CDS sequence (opt11) from DENV-1__FJ882518__SS-prME
  source 1..9879: mol_type = other RNA
agcgtgactatgctgctcatgctgatgccaaccgccctggccttccatctcacgaccaggggtggggaaccccatatgatcgttaccaagcaggaacgaggcaagagtctgctattcaagaccagcgcgggcgtgaacatgtgcaccctcatcgccatggacctgggcgagctgtgcgaggacaccatgacctacaagtgtcctcggatcaccgaggcagaacccgacgatgtggactgctggtgcaacgcgacagacacctgggtgacgtacggtacctgtagccaaacgggagagcatcggcgcgacaagcggtctgtggccctcgctccccacgtgggactggggctggagacaagaactgagacatggatgtccagtgagggcgcttggaagcaaatccagcgggtcgaaacctgggcgttacgccacccgggcttcacggtgatcgccctgttcttggcacacgccataggtacctccatcacccagaaggggatcatctttatcctcctaatgctggtgacgccctctatggctatgcggtgcgttggcatcggctcccgcgactttgtggaggggttgtccggtgctacctgggtggacgtagtgcttgagcacggatcctgcgtcaccaccatggcaaaggacaagcccacactggacatcgagctcctgaagacggaggttaccaaccccgcggtcttgcggaagctctgcatcgaagccaagatatccaataccacgacggactcccgttgtcccacacaaggcgaggcgacactgatggaggaacaggacgccaactttgtctgccggagaaccttcgttgaccggggctggggtaatggctgcggtctgttcggtaagggcagcctcattacgtgcgccaagtttaagtgcgtgacgaagctggaagggaagatcgtccagtatgagaacctgaagtactccgtcatcgtgactgtgcacacgggggaccagcaccaggtggggaacgagagcactgaacacggcaccaccgcaaccatcacgccccaggcccccacctccgagatccagctgaccgactatggtgcactgactcttgactgctcaccaaggacgggcctagatttcaacgagatggtgttactgaccatgaaagagaagagttggctcgtccacaagcaatggtttctggatctgccgctcccgtggaccagcggggcctccacctcccaggagacctggaaccggcaggacctgctcgttaccttcaagactgcccacgcgaagaagcaggaggtggtcgtcctcggctcccaggagggcgcaatgcacaccgcgctgacgggtgctactgagatccagacctccggcaccaccaccatattcgcggggcatctgaagtgtcgccttaagatggataagctaaccctgaagggcatgagctacgtgatgtgcacaggctctttcaagttagagaaggaggtagcagagacacagcacggaactgtgctggtgcaaatcaaatacgagggcacagacgccccctgcaagatcccctttagcacccaggatgaaaagggtgtcacgcagaacgggcggctaatcaccgcaaatccgatcgtcaccgataaagagaagccggtgaacatcgaggcagagccacccttcggcgaatcgtatatcgtcatcggcgcgggcgaaaaagccttgaagctgagctggttcaagaagggctcaagcatcggcaaaatgttcgaggctaccgcccgcggcgcacgaagaatggcgatcctgggggacacggcctgggacttcgggtccgttggcggcgtattcacctcggtcgggaagctggtgcaccagatcttcggcaccgcctacggggtcctgttctccggcgtttcctggactatgaagattgggatcggggtgctcctcacttggctaggcctgaactccaggagcacctccctgagcatgacgtgcatcgccgtgggactcgtcaccttgtatctgggcgtaatggtgcaggcagactccggatgcgtcatcaactggaaggggcgcgagctaaagtgcgggagcgggatcttcgtgactaacgaggtgcacacctggaccgaacagtataagttccaggccgacagcccgaagcgcctgtccgccgcaatagggaaagcctgggaggaaggggtctgcggcatccgcagcgcaacgagactagagaacatcatgtggaagcaaataagcaacgagctcaaccacatcttactggaaaatgacatgaagttcaccgtagtggtcggggacgtggtgggcatactcgcgcaggggaagaagatgatccggccgcaaccaatggagcataagtatagctggaagtcctggggcaaggccaagatcatcggggccgacgtacagaatactaccttcataatcgatggccccagcaccccggagtgcccagacgatcaaagggcctggaacatctgggaggttgaggactacggcttcgggatcttcaccacgaacatttggctgaaactgcgggattcctacacccaggtgtgcgaccaccgactcatgagcgctgccatcaaagactccaaggctgtccacgctgacatgggctactggatcgagagcgaaaagaatgaaacctggaagctggcgcgggcgagtttcatcgaggtgaaaacctgcatctggcctaagagccacacattatggtccaacggcgtgctggaaagcgaaatgatcatccccaagatctacgggggcccgatcagccagcacaactaccgccccggatacttcacccagacggccggcccctggcacctggggaagttggagctggacttcgacctgtgcgagggaaccacggtcgtggtcgacgagcactgcggcaatagggggccgagcttgcggacaacaaccgtaacgggcaaaatcatccacgagtggtgctgccgttcctgcacactgccgccactacgcttcaaaggggaggacggctgctggtacggtatggagattcgacccgtgaaggagaaagaagagaacctcgttaagtccatggtttcggccggctcgggcgaggttgactccttctccctcgggctattatgcatctcaatcatgatcgaagaggtcatgcggtcccggtggagtcggaagatgctcatgacaggcacattagccgtcttcctgctcctgatcatggggcagctgacgtggaacgacctcatccggctgtgtatcatggtcggcgccaatgcgtccgaccgcatgggcatgggtaccacttacctcgccctcatggccacatttaagatgcgcccgatgttcgccgtgggtctgctattcaggcgccttactagccgggaggtactgctgctcaccatcgggctgtccctggtggcctccgtcgagctccccaactccctggaggaactgggcgacggtctcgcaatgggcatcatgatcttgaagctgttgaccgacttccagtcgcaccagctgtgggccaccctgctctccttaacgttcatcaagacgaccttatccctccactatgcgtggaagactatggctatggtgctctccatcgcgagtctgttccccctctgtctgtccaccacctctcagaagaccacctggctgcccgtgctcctgggctccctcgggtgcaagccgctcacgatgttcctgatcaccgagacgaaaatctggggccgcaagagctggcccttgaacgaggggatcatggccgtgggcgtggtgagcatactgctgtccagcttgctgaagaatgacgtccccctggccgggcccctgatcgccggcggcatgctcatcgcctgctatgtgatcagtgggtcatccgcagatctgtcgctcgagaaggctgcagaggtgtcctgggaggaggaggccgaacactccggggcgtcacacaacatccttgttgtcgtgcaggatgatgggaccatgaagatcaaagatgaggaacgcgacgacaccctgacgattctgttgaaggccaccctgctggcggtcagcggggtgtacccgctcagcatccccgccacactgttcgtgtggtatttctggcagaaaaagaagcagcgaagcggtgtcctgtgggacacccccagcccgcccgaggtagagcgggccgtactggacgatggtatctaccgcatcatgcaacgaggcctacttgggcgaagtcaagtcggcgtgggggtattccaggagaacgtcttccatacgatgtggcacgtgaccagaggagccgtgctgatgtaccaggggaagcgcctcgagccctcgtgggcgagcgtgaagaaggacctgatctcttacggaggcgggtggcggctgcagggaagctggaacacaggggaagaggtccaagtgattgcggtcgaacccggcaagaaccccaagaacgtccagacagcccccgggacatttaagacccccgaaggtgaagtaggcgccatcgccctcgatttcaaacctgggaccagcggatcacccatcgtgaaccgtgagggcaagatagtgggactgtacggcaatggagtcgtcaccaccagtggaacctacgtgtccgcgatcgcccaagccaaagcctcgcaggaggggccactgccagagatcgaggacgaagtgtttcggaagcgtaacttaaccataatggacctgcaccccgggtccgggaagacacggcgctacctgccggcgatcgtccgggaagcgatcaagcgcaagcttcgaacgctgatcctagcccccacccgcgtggtcgctagcgaaatggcagaggcgctgaaggggatgcccattaggtaccagaccaccgcagtgaagagcgaacacacgggcaaagagatcgtggatttgatgtgccacgccacctttaccatgcggttactgtcccccgtgcgagtcccgaactacaacatgattatcatggacgaagcacacttcaccgacccctcttccattgccgcgcggggttacatcagcacgcgggtggggatgggggaggcagccgctatattcatgaccgctacgccccccggcagcgtggaggcgttcccgcagtccaacgccgtcatccaggacgaggagcgggacataccagagcgatcctggaactccggctacgaatggatcaccgacttccccggtaagacagtgtggtttgtacccagcatcaagtccggcaacgatatcgctaactgcctccggaagaacgggaaacgcgtcatccaactgtctcggaagacctttgacaccgaataccagaaaaccaagaacaatgactgggactatgtggtgacgaccgatatttccgagatgggcgccaacttccgcgcagatcgggtaatagaccctaggcggtgcctcaaacccgtcattctgaaggacgggcctgagcgcgtaatcctggctggccctatgcctgtgaccgtggcctcagccgcacagcggcgcgggcggatcggccgcaaccataacaaagagggcgaccagtacatatatatggggcaacccctcaacaacgatgaggaccacgcgcactggacagaagccaagatgttattggacaacattaatacccccgagggcataatccccgctcttttcgagccggaacgggagaagagtgccgccatcgatggagagtaccgcctgcgcggcgaagcgagaaagacattcgttgaactgatgcggcgtggtgaccttcccgtgtggctaagctacaaggtcgcaagcgagggctttcagtactccgatcggcggtggtgcttcgacggtgagaggaacaaccaggtcctggaggagaatatggacgtcgagatttggaccaaggagggggagcgaaagaaactacgcccacggtggttagacgcacgcacctattcggaccccctggcgctccgggagtttaaggaattcgccgcgggccgccgctccgtgtcgggagatctcatcctggagatcggcaagctcccgcagcacctgacgcagcgcgcccagaatgctctggataacctcgtcatgttgcacaactccgaacaaggcggccgggcctaccgccacgccatggaggaactgccagacacgatcgagacgctaatgctgctggcactcattgcagtgctaactgggggggtgactctgtttttcctctctggccggggtctgggtaagacatccatcggcctgctctgtgtgatggccagctctgtactgctgtggatggcgagcgtggagccccactggatagcggcgtccataatcctcgagtttttccttatggtactactcattcccgagcccgaccgccagcggactcctcaagacaaccagctggcctacgtggtgatagggctactattcatgatccttaccgtcgccgctaatgagatgggcctgttggagaccacgaagaaagacctgggtatcggccacgtggcggtagagaatcaccaccacgcaaccatgctggatgtcgatctccatccggccagcgcctggaccctgtacgccgttgcgacgacgattatcactccgatgatgcgccacaccatagagaacacgacggctaacatctccctgaccgccatcgctaaccaggcggctattctcatgggcttagacaaaggctggccaatcagcaagatggacattggtgtacccctgctcgccctggggtgctactcccaggtcaaccccctgaccctcaccgccgccgtgttaatgcttgtggcgcactacgcaatcatcgggccaggactccaggccaaggccacgagggaggcccagaagcgcactgccgccggcattatgaagaacccaaccgttgatggtatcgtggctatcgacttggaccccgtagtctacgacgcgaagttcgagaagcaacttggccaaataatgctattaatcctatgcaccagtcagatcctcttaatgcggacgacatgggcgctgtgcgagtcgatcaccctcgcgactggccccctgacgactctttgggagggaagccccggcaagttctggaacaccacgatcgcagtgtctatggccaacatattccgggggtcatacctcgccggcgccgggctggccttcagcctgatgaagtccctcgggggcgggcgcaggggcacaggggcccagggagagaccttaggcgagaagtggaaacgccagctgaaccagctatcaaagtccgagtttaacatctacaagcgatctgggatcatggaagtagaccgctccgaagccaaggagggcctgaaacgtggggagacgacgcgccacgccgtctcccggggcacggccaagctgcgctggttcgtggaacggaatctggtgaagcccgagggcaaggtaatcgacctcggctgtgggagagggggctggtcgtactactgtgctgggctgaagaaggtgaccgaggtgaaggggtatacaaagggcgggcccggccacgaagagccaatccccatggccacctacgggtggaacctcgtcaaactgcactcaggcaaagacgtgttcttcacgccgccggagaagtgcgacacgcttctgtgcgacatcggggagtccagcccgaacccgactatcgaagaagggagaaccctccgtgttctgaagatggtcgagccctggctacgagggaatcagttttgcatcaagattctcaacccttacatgccctccgtggtcgaaactctggagcaaatgcagcgcaagcacggggggatgcttgttcggaacccgcttagccgcaactccacgcatgagatgtactgggtgagttgcggtaccggaaatatcgtgtccgctgtcaacatgaccagccggatgctgttgaaccgctttaccatggcccaccgcaaacccacatatgagcgtgacgtggacctcggggccggaacccgccacgtagccgtcgaaccagaggtggccaacctggacattataggccaacggatcgagaacatcaagcacgagcataagtccacctggcactatgacgaggacaatccctacaagacttgggcctaccacgggagctacgaagtgaagccgtctggaagcgcctcttcaatggtcaacggggtagtgaagctcttaacgaagccctgggacgtcatccccatggtgacccagatagcgatgaccgacaccacgcccttcggccagcagcgggtcttcaaagagaaggttgatacccggaccccgaaggccaagcgcggcacagcgcagatcatggaggtgacggcgcggtggctatggggcttcctgagccgcaacaagaagccaagaatctgcacccgcgaggagtttacgcgaaaagtgcgctccaacgccgcgatcggcgccgtattcgtggatgagaaccagtggaacagcgccaaggaggccgtggaggacgagcggttctgggacttagtacaaaaggaacgcgagttacacaagcaggggaagtgcgctacctgcgtgtacaacatgatgggcaaacgggagaagaagcttggggagttcggtaaggccaagggctcccgcgccatatggtacatgtggttgggcgcccgctttctggagttcgaggctctgggctttatgaacgaggatcattggttcagccgtgagaactccctcagtggggtcgaaggcgaggggttacacaagctgggctacatcctccgggacatcagtaaaatacccgggggcaacatgtacgctgacgatacggcaggctgggacacccgaatcaccgaggacgatctgcagaacgaggccaagattacggatattatggagcccgagcacgccttactcgcgacgagcatcttcaaactgacctaccaaaataaggtggtgagggtccagcgccctgcgaagaacgggaccgtgatggacgtgatctcccgacgggaccagaggggaagcgggcaggtcggcacttacggtctgaacacattcaccaacatggaggcccagctgatccgccaaatggagtccgaaggtatcttcctaccatcagagctggaaacccccaatcttgccgagcgcgtactcgactggttagagaagtacggcgtagagcggctcaagcgaatggctatctctggggacgactgcgtcgtgaagccgatcgacgaccggttcgccaccgccctgacggccctgaacgatatggggaaggtgcgcaaggacatcccccagtgggaaccgtcgaaggggtggaacgactggcagcaagtccccttctgttcccatcacttccatcaactaattatgaaggacggacgagagatcgtggttccgtgccgcaatcaggacgagttagtaggccgggcccgcgtgagccagggggccgggtggtcactgagggagaccgcctgtctcgggaagagttatgcgcagatgtggcaactgatgtatttccaccgccgggatctgcggctcgccgctaacgctatctgtagcgcggtgcccgtcgactgggtgcccacgtcccggaccacgtggagcatccacgcgcaccatcaatggatgacaacagaggacatgctgtccgtgtggaatcgagtctggattgaggaaaatccgtggatggaggataagactcacgtgagttcatggggcgacgtgccttacctggggaagcgggaggaccagtggtgcggctctctcatcggcctcacagcccgcgccacgtgggcctccaacatccaggtagcgatcaatcaggtgcgccggctgattggcaacgagaactacctcgactacatgacgtcaatgaaacgcttcaaaaacgagggcgaccccgagggagctctttggtga

SEQ ID NO: 24251 - RNA, 9879 nt, synthetic construct
  misc_feature 1..9879: note = derived and/or modified CDS sequence (opt11) from DENV-1__FJ882519__SS-prME
  source 1..9879: mol_type = other RNA
agcgtgaccatgctgctcatgttaatgcccaccgccctggctttccacttaacgacccggggtggggaaccgcacatgatcgtaagcaagcaagagcggggcaagagcctcctcttcaagacgtcggccggggtaaatatgtgtactctcatcgccatggatctgggggagttctgcgaggacaccatgacctataagtgccccaggattaccgaggccgagcccgacgatgtggactgctggtgcaacgccaccgatacgtgggtgacctacgggacctgcagccagacgggggagcaccgtcgggacaagcggtccgtcgcgctcgctccccacgtggggttagggcttgaaacgcgaaccgagacctggatgtcctcggagggcgcctggaaacaaattcaacgtgtggagacctgggccctgaggcaccccgggttcacggtgatagccctcttcctggcccacgccataggtactagcatcacccagaaagggatcatcttcatcctgcttatgctggtgaccccttccatggccatgagatgtgttgggatcggctctcgggacttcgtggaggggttatctggcgcgacgtgggtggacgtagtactcgagcatggtagttgcgtgactaccatggccaaggataagcccaccctggacatagagctgctcaagacagaggttacaaatcccgccgtactgcggaagctgtgcattgaggctaaaatctccaacaccaccacggacagtaggtgcccgacccagggtgaggcaaccctcgtcgaggagcaggacgccaattttgtctgcaggcgcactttcgtggataggggctgggggaacggctgcggactcttcgggaaggggtccctgatcacgtgcgcaaagttcaagtgcgttaccaagctcgaggggaaaattgtgcagtacgagaacctgaagtatagcgtgatcgtgacagtccacaccggcgaccaacaccaggttgggaacgagagtacggagcacggcaccaccgcgaccattacgcctcaggcccccagcaccgagatccagttaaccgactacggggcgctcaccctggactgcagcccccgcaccggcctggatttcaacgaaatggtcctcctgacgatgaaggagaagtcctggctggtgcacaaacaatggttcctcgacctaccgttaccctggacttctggggcgtccacgagccaggagacttggaaccggaaagatctactggttaccttcaagaccgcccatgcgaagaaacaggaggtcgtggtgttgggctcccaggaaggcgcaatgcacaccgcactcacgggggccacggagatccagacctccggtaccaccaccatcttcgccggccacctgaagtgccgcctcaagatggacaagttgacactgaaaggcatgtcctacgttatgtgcaccgggagtttcaagctggagaaggaggttgcggagacccaacacggtaccgtgctagtccagatcaaatacgagggcaccgacgccccctgcaaaatccctttctccacccaagatgagaagggggtgacacagaacggccggctgattacggccaacccaatcgtgaccgacaaggagaagccggtcaacatcgaggccgagccgcccttcggtgaaagctacatagtgatcggcgcgggggagaaagccctgaagctgtcctggttcaagaaggggtcctccatcggcaagatgttcgaggccaccgccagaggggcgcggcgcatggctatcctcggggacaccgcctgggatttcgggagcatcggcggggtgtttacgtcggtcgggaagctggtgcatcagatcttcggcaccgcgtacggggttctattcagcggcgtctcctggacgatgaagattgggatcggcgtgttactgacatggctgggccttaacagcagatccacgtcactatcaatgacctgtatcgccgtggggcttgtcaccctctacttgggggtcatggtgcaagcggacagcgggtgcgtcatcaactggaaggggcgggagctgaagtgcgggtcaggcatcttcgtgacaaatgaggtgcacacgtggacggagcagtacaaattccaggcggactcaccgaaacgcctcagcgcagccatcggcaaggcctgggaagagggagtctgtggcatccgttccgccactcgtcttgagaatattatgtggaagcagataagcaacgagctgaaccacattctcctggagaacgatatgaagtttaccgtcgtcgtgggggacgtcgcgggcatactggcccaggggaagaagatgatacggcctcagcccatggagtataagtacagttggaaatcctggggcaaggccaagatcattggcgcagacgttcaaaacactactttcatcattgacgggccaaacacgccggagtgccctgacgatcagcgcgcgtggaatatttgggaggtcgaagattacggctttgggatcttcaccacaaacatctggctcaaactgcgggacagttatactcaggtttgcgaccaccgactgatgagtgcagcaatcaaggactccaaggccgtgcacgccgacatgggatactggatcgagtcagaaaagaacgaaacatggaagttagcgagagcctcattcatcgaggtcaagacctgcatctggcccaagtcgcataccctgtggtctaacggcgttctggagagtgagatgattatcccaaaaatctatggagggccgataagccaacacaactatcgccccgggtactttacgcagaccgccggcccctggcacttaggaaaactggagctggacttcgacctctgcgaaggcacgaccgtggtagtcgacgaacactgcggcaacagagggccgagcctgcgcacgaccacagtgacgggaaagatcatacacgagtggtgctgccggtcctgcacgctgccgcccctccgcttcaagggggaggacggttgctggtacgggatggagatccggcccgtcaaggagaaggaggagaacctggtgaaaagcatggtgtccgcgggctcaggggaggtagacagcttcagcctggggctcctgtgtatcagtatcatgatcgaggaggtgatgagatcccgttggagccgcaagatgctcatgacgggcaccctcgccgtgttcttcctgctgattatgggtcagttaacctggaacgacctaatacgcctgtgcataatggtcggtgccaacgctagtgacaggatgggaatgggaacgacctacctcgccctcatggccacgttcaagatgcggcctatgtttgccgtgggcctcctgttccgaaggcttacgtcccgggaggtactgctcttgaccatcgggctgtcactcgtcgcgagcgtggagctgccaaactccctggaggagctcggcgacggactagccatgggcatcatgattctgaaacttctgaccgattttcagagccaccagctgtgggccaccctcctgtccctgacttttatcaagacgaccttctcgctccactacgcatggaaaaccatggcgatggtcctgtccatcgtgtccctgttccccctctgcttatcaacgacgtcgcaaaagaccacctggttaccggtgcttctaggctccttggggtgtaaaccgctaaccatgttcctgatcgcagagaacaagatctggggcagaaaaagttggcccctgaacgaagggattatggctgtcggcatcgtgtctatcctcctgtcaagcctgctcaagaacgacgtgccgctggccggccccctgatcgcaggcggaatgttgatcgcgtgctatgtcatctcagggtcaagcgcagacctatcgctcgagaaagccgccgaggtgtcctgggaggaggaggctgagcacagcggcgcgagccataatatcctcgtggaggtccaagacgatgggacgatgaagatcaaagacgaagaacgggatgacacccttaccatactactcaaggccactctgctggcggtgtctggcgtgtacccgctctccatacctgctaccctgttcgtgtggtacttctggcagaagaaaaagcagcgctctggggtgctgtgggatacgcccagcccgcccgaggtggagcgggcagtactcgatgacggcatctaccggatcatgcaaaggggtctgctgggccggtcccaagtcggcgtgggagtattccaggagaacgtgttccacaccatgtggcacgtgacccgaggcgccgtcctgatgtaccaggggaagcgcctcgaaccctcttgggcgtcggttaagaaggatctgatatcctacggcggcggttggcgactacaaggaagctggaatacaggggaggaggtgcaagtaatcgctgtggagcccggcaagaaccccaaaaacgtgcagactgctcctggcaccttcaagacctccgagggcgaggttggagccatagcgctagacttcaagcccgggacctcaggcagccccatcgtgaaccgcgaagggaagatcgtgggcctctacggcaacggggtcgtgacgacctctggtacctacgtgagcgccatcgcccaggccaaggcgtcccaggaggggcccctgcctgaaattgaggacgaggtcttccggaagcgcaacctcaccataatggacttgcaccccgggtctgggaagacacggcgttacttgcccgccatcgtgcgggaggccatcaagcgcaagttgcgcacccttatcctagctccgacacgcgtggtagcctccgagatggcggaggccctcaagggcatgcccatacgttaccagaccacggcggtcaagagcgagcacaccggcaaggagatcgtcgacctgatgtgtcatgcaacgttcaccatgcgtctgctctcccccgtacgcgtgccaaactataacatgatcatcatggacgaagcgcacttcacggacccgagctccatcgcggcccgcgggtacataagcactcgcgtgggtatgggggaggccgccgccatcttcatgacggcgaccccgccgggttccgtcgaggccttcccccagagcaatgccgtgatccaggacgaggagcgtgatatcccggagcggtcctggaacagcgggtacgaatggatcacggactttcccggcaagaccgtgtggttcgtgccgtccataaagtctggcaatgatatcgccaactgcctgcggaagaacgggaagcgcgtcattcagctgtcccgcaagacctttgacaccgagtaccagaagacgaagaacaacgattgggattacgtggtcacaactgacataagcgagatgggcgccaactttcgcgccgaccgtgttatagacccacggcggtgcctcaagccggtgatactgaaggatgggcccgaacgcgttatcctggccggccctatgcccgtgacagtcgcctccgcggcgcagcgtcgcgggcggatcggccgcaaccacaacaaggagggggaccagtacatatacatgggccagccgctcaataatgacgaggatcacgcccactggacagaggccaaaatgctgctcgataacattaacaccccggagggaatcatcccggccctcttcgagcccgagcgagagaagtccgccgcgatcgatggagagtatcgactgcgcggggaggcccggaaaaccttcgtggagctgatgcgccgcggggacctcccggtgtggctgagttataaagtcgcgtccgaaggctttcagtatagtgatcgtcggtggtgttttgacggtgagcgtaacaaccaggtcctcgaggagaacatggacgtggagatctggaccaaagagggggaacggaagaagctccgcccccgctggctagacgcccgcacgtactccgaccccctggccctccgggagttcaaagagttcgcggccggtcgtcgtagcgtttcaggggacctcatcttggaaatcggaaagctcccgcagcacctgactcagagagcccaaaacgccttggataacctcgtgatgctgcacaacagcgaacagggtgggcgggcttatagacatgccatggaggagttgccagacaccatcgagaccctcatgctactggccctcatcgcggtgctgacgggaggggtcacattgttcttcctctccggccgggggctaggcaaaaccagcatcggcctactctgcgtcatggcctcctccgtgttactgtggatggcttccgtggaaccccactggatcgccgcatcaatcatcctagagttcttcctgatggtgctcctgatacccgaaccggatagacagcgtaccccgcaagacaatcagctggcctacgttgtcataggtctgctttttatgatcctgacagtggccgcgaatgagatgggcctgttagagacaaccaagaaggatctgggaatcggtcatgtggccgtcgagaaccatcaccacgcggccatgttagacgtggaccttcaccccgcctccgcgtggaccctgtacgcagtggcaaccaccatcatcacccccatgatgcgccacaccatcgaaaacacgacggccaacatctccttaaccgctatagcgaaccaggccgccattctaatgggcctggataagggctggccgatatccaagatggacatcggggtcccgctgctagccctaggctgctacagccaggtcaaccccctgaccctcaccgcggccgtgctgatgctggtcgcacactacgcaataatcggccccggtttgcaggccaaggctacgagggaggcccaaaaacggaccgccgccggcattatgaagaacccgaccgtggacggcatagtggccattgacctggaccccgtggtgtacgacgcgaagttcgagaaacagctggggcagataatgcttttgatcctgtgcacgtcccagatcctcctgatgcgcacgacctgggcactgtgcgaaagcatcaccctcgccaccggccccctaacgaccctgtgggagggatcccctggcaagttttggaacaccaccatcgccgtgagcatggcaaacatctttcgtgggagctacctcgcgggcgccggtctggccttctcgcttatgaaatcactgggtggcggacgccggggcacgggggcccaaggtgagacactgggcgagaagtggaagcgccaattaaaccaactgtccaagtccgagttcaatacctacaagcggtccggtataatggaagtggaccgctctgaggcaaaggagggactgaaaagaggggagacgactaagcacgccgtatcgcgcggaaccgccaagctgcgttggttcgtggagaggaacctcgtgaaacctgaaggcaaggtgatcgacttaggctgcggccgcggcgggtggtcatactactgcgcagggctaaagaaggtgaccgaggtgaaagggtacaccaagggtgggcctggccacgaggaacccatacccatggctacgtacgggtggaacctagtgaagctccactcaggcaaggatgtgttctttatcccgccagagaagtgtgacacgctgctgtgcgacatcggggagtcctcccccaacccaaccatcgaagagggacgaacactacgggtcctgaagatggtggagccgtggctgagagggaatcagttttgcatcaagatcctcaacccctatatgccttctgttgtcgaaacactggagcagatgcaacggcgccacggcgggatgctggttcgtaacccactctcccgtaatagcacccacgagatgtattgggtgtcatgcgggacgggcaacatagtgagcgcggtgaacatgacatccagaatgctgctgaatcgcttcaccatggcccatcgcaagccgacgtacgagcgggacgttgatctcggggccggcacccgacatgtcgctgtggaacccgaagtggccaacctggatatcatcgggcaacggatcgagaatatcaagcacgagcacaagagcacctggcactacgacgaggataacccctacaagacctgggcgtatcacgggtcctatgaggtcaagcccagcggtagcgcaagcagcatggtaaatggtgtcgtgaagttattaacaaaaccgtgggacgtgatccccatggtcacccagatcgccatgaccgacaccacgcccttcgggcagcagcgcgtgttcaaggagaaggtggacactcggacccccaaggccaagcgggggaccgcccagatcatggaggtcacggctaagtggctgtggggctttctgtccaggaataagaagccgcgcatctgcacccgggaggagttcacccgcaaagtgcggagtaacgccgccatcggcgccgtattcgttgacgagaaccagtggaactccgcgaaggaggcagttgaggatgagcgcttttgggacctcgttcaccgggagcgcgagctgcacaagcagggtaagtgcgcgacttgcgtctataatatgatgggcaagcgggagaagaaacttggcgagttcggcaaagctaaagggagccgtgcgatctggtacatgtggctaggcgcgcgtttcttggagtttgaggcgctgggatttatgaatgaggatcattggttctcccgcgagaacagcctctctggagtggagggcgaggggctgcacaagctgggatacatcctacgcgacatctcgaagatccctggaggcaacatgtatgccgacgacactgccgggtgggacacacggatcaccgaggacgatctacagaacgaggccaaaataactgacataatggagcccgagcacgcactcctcgctaagtccatcttcaagctgacttaccagaataaggtggtgcgggtacagagaccggcaaagaatggaactgttatggacgtcattagtcggcgggaccagcgtggctccggacaggtgggcacgtacggcttgaacaccttcacgaacatggaagcccagctcatacggcaaatggagagcgaggggatcttctcccccagtgagctggagacgcccaacctagccggccgcgtgctcgactggctagagaagcacggtgtcgagcggctgaagagaatggcgatttccggcgatgactgtgtggtgaagcccatcgacgaccgcttcgccaccgcactgacagccctgaacgacatgggcaaggtgcgtaaggacatcccgcagtgggagcctagcaagggctggaacgattggcagcaagtccccttttgtagccaccacttccaccagctgatcatgaaggacggtcgggagatagtggtcccctgccggaaccaagacgagttggttggtcgggcacgcgtatcccagggtgcggggtggagcttacgggaaacagcatgcctggggaagtcttacgcccagatgtggcagctcatgtacttccaccgccgggacctacgcctggccgcgaatgccatctgcagtgcggttccggtggactgggtcccgaccagtcggaccacctggtcgatccacgcccaccaccagtggatgacgaccgaggacatgctctccgtatggaacagggtgtggattgaggagaatccctggatggaggacaaaacccatatcagctcctggggagacgtgccctacctgggcaagagagaagaccaatggtgtggcagcctgatcgggctcacagcacgcgcgacttgggctaccaacatccaggtcgcgattaaccaggtgaggcggttgattggcaacgagaactacctcgactatatgacctccatgaagaggtttaagaacgagagcgacccggagggggcactctggtga

SEQ ID NO: 24252 - RNA, 9879 nt, synthetic construct
  misc_feature 1..9879: note = derived and/or modified CDS sequence (opt11) from DENV-1__FJ882520__SS-prME
  source 1..9879: mol_type = other RNA
agcgtgaccatgttgctcatgctgatgcccaccgccttggccttccacctcaccacccggggcggggagccccatatgatagttagcaagcaggaaaggggcaaaagcctgctgttcaagaccagcgccggggtgaacatgtgcaccctcatcgctatggacctgggcgaactatgcgaggacaccatgacttataagtgccctcggatcaccgaggtggagccggatgacgtggattgctggtgcaacaccacagacacctgggtgacctacgggacctgcagccagacgggcgagcaccggcgcgacaagaggagcgtagccctagcaccgcacgtcggcctggggctggagacccgggcagagacctggatgagctccgagggcgcgtggaagcagatccagaaggtggagacctgggccctccggcaccccggattcacggtgatcgccctgttcctggcacacgcgatcggcacgagcatcactcagaaagggatcatcttcatactcctgatgcttgtgaccccgtccatggccatgcgctgcgtgggaatcggatcacgggatttcgtggaggggctgtccggcgccacgtgggtggacgtggttctggaacacgggagctgcgtcacaacaatggccaaggacaagcccaccctcgacatagagctcttgaaaacggaggtcaccaaccccgccgtgctgcgcaagctctgtatcgaggcgaagatctccaacaccaccacggatagccggtgcccgacacagggggaggccaccctggttgaggagcaggacgccaacttcgtgtgccgccggaccttcgtggaccgcgggtgggggaacggctgcgggctcttcggcaaggggtctctcatcacgtgcgccaagttcaagtgcgtcaccaagctggaaggcaagatcgtgcaatacgagaatctgaagtacagcgtgatcgtcaccgttcacaccggcgaccagcaccaggtcgggaacgagagtacggaacatggcaccaccgccaccattacgccccaggcccccacgtctgagatccagctcaccgattacggggccctgacgctggactgctcgccccggaccggcctcgacttcaacgagatggtgctgctgacgatgaaggagaagtcctggctcgtccacaagcagtggttcctggacctgcctctcccctggaccagcggcgcctccaccagccaggagacctggaaccgccaggaccttctggtcacgttcaagaccgcccacgccaagaagcaggaggtggtggtcctcggctcccaggagggtgcgatgcatacggctctgaccggggccacggagatccagacctcgggtacaaccacgatcttcgccgggcatctgaagtgccggctcaaaatggacaagcttaccttgaagggcatgtcctacgtgatgtgcaccgggagctttaagttagagaaggaggtggccgagacccaacacggcacggtcttggtgcagattaagtacgaggggaccgacgcgccctgcaagatccccttctccacccaggacgagaagggggtgacccagaacggccgcctgatcacggccaacccgatcgtcaccgacaaagagaaacccgtgaacatcgaggccgaaccgcccttcggggaaagctacatcgtgattggtgccggagagaaggcactgaagctctcctggttcaagaagggttctagtatcggcaagatgttcgaggccaccgcccgcggagccaggcggatggccatcttaggcgacactgcgtgggatttcggaagcatcggcggagtattcacgtccgtggggaaactggtgcaccagatatttggcaccgcctacggggtcctcttcagcggcgtgtcctggaccatgaagatcgggatcggcgtgctgctaacctggctcggcctgaattcccgctcgaccagcctgtccatgacctgcatcgccgtcgggctcgtgaccctgtatctgggggtcatggtccaggccgacagcgggtgcgtgatcaactggaagggccgcgagctcaagtgcgggagcggaatttttgtgaccaatgaggtccacacgtggaccgagcagtacaagttccaggccgacagcccgaagcggctgagcgctgccatcggaaaggcctgggaagagggggtgtgcggcatccgctccgccacccggctggaaaacatcatgtggcgccagatctcaaacgagttaaaccacatactgctggaaaacgacatgaagttcaccgtggtcgtgggtgacgtggtaggcatccttgcccaggggaaaaagatgatccggccccagcctatggaacacaaatacagttggaagtcctggggcaaagctaagatcatcggtgccgacgtgcagaacaccacgttcatcattgacgggcccaacaccccggagtgccccgacgaccagcgcgcctggaacatatgggaggtggaggactatggctttggtatcttcaccaccaacatctggctgaagctgcgggactcctatacgcaggtatgcgaccaccggttgatgagcgccgccatcaaggactccaaggccgtccatgccgacatgggctactggatcgagagcgagaagaacgagacctggaaactggcccgggcctccttcattgaggtgaagacctgcatctggcccaagagccacaccctgtggtccaacggcgtcctcgagtccgagatgatcatccccaagatctacggaggcccgatctcccagcacaactaccgacccggatacttcacacagaccgcgggcccgtggcacctggggaagttagagctcgacttcgatctgtgcgagggcaccaccgtggttgttgacgagcactgcggcaaccgggggccgtcactgcgcacgaccaccgtgaccggcaagatcatccacgagtggtgctgccggtcctgcacgctgcctcccctccgcttcaagggggaagatggctgctggtacgggatggaaatccggcccgtgaaggagaaggaagagaacctggtcaagtctatggtctcagccggctcaggcgaggtggatagcttctccttggggctgctgtgcatcagcatcatgatcgaggaggtgatgcgctcccggtggagccgcaagatgctcatgaccggcaccctggcggtgttcttcctgctcatcatggggcagctgacctggaacgatctgatccggtcttgcatcatggtgggcgccaacgccagcgaccgcatggggatgggcacgacgtatctcgctctgatggccacatttaagatgcgcccgatgttcgccgtcggccttctgttccggcgcctaacctcccgggaggtgctgctcctgactatcgggctgagccttgtcgcctccgtggagctgcccaacagcctggaggagctaggcgacggtctggccatggggatcatgattctgaagctcctgaccgacttccagtcctaccagctgtgggctacgctactgagcctgaccttcatcaagacgaccttctcgctccactatgcctggaagaccatggccatggtgctgagcattgtctccctgctccccctgtgtctgagcactacgtcccagaagacgacctggctgcccgtgctactgggcagcctgggatgcaagccgctgaccatgttcctgatcgccgagaacaaaatctgggggcgcaagagctggcccctcaacgaggggataatggcggtgggcatagtctccatcctgctgtcctccttattaaagaacgacgtgcccctggccgggcccctcatcgccggcggcatgctgatcgcttgctacgtgatcagcgggtccagcgccgacctgtcccttgagaaagcggccgaggtcagctgggaggaggaggccgagcactccggcgccagccacaatatcctggtggaggtgcaagacgacgggacgatgaagatcaaggacgaggagcgggacgacaccctcaccatcctcctgaaggccaccctgctagcggtctccggcgtgtacccgttaagcattcccgccaccctgttcgtgtggtacttctggcaaaagaagaagcagcgttccggtgttctctgggacacgcccagcccgcccgaggtggagcgggccgtgctggacgacggcatctaccgcatcatgcagcggggcctgctggggcggtcccaggtcggtgtgggggtgttccaggagaacgttttccacaccatgtggcacgtgaccagaggcgctgtgctcatgtaccaggggaaacgcctggaaccctcttgggcctccgtcaagaaagatctgataagttacggaggcgggtggcggctccagggcagctggaacacgggggaggaggtccaggtcatcgcggtcgagcccggcaagaaccccaagaacgtgcagacggcccccgggaccttcaagacccccgagggcgaggtgggcgccatcgccctggacttcaaaccagggactagcggcagccccatcgtcaaccgcgaggggaagatcgtgggcctgtacggcaacggggtggtcacgacctccggcacctacgtgagcgctatcgcacaggccaaggcctcccaggagggcccgctccccgagatcgaggacgaggtgtttcggaagcgtaacctcaccatcatggacctgcaccctggcagcgggaagacgagacgctacctcccggccatcgtccgggaggcgataaagcgcaagctgcggacactgatcctagcccctacccgcgtggtggcctccgagatggccgaggccctgaagggtatgcccattcgctaccagaccacggcggtgaagagcgagcacactggccgggagattgtggacctgatgtgccacgccacattcaccatgcgcctcctgtctcccgtccgggtcccgaactacaacatgatcatcatggacgaggcgcacttcacggacccctcctccatcgccgcccgcggatacatcagcacccgggtgggcatgggggaggcggccgccatcttcatgaccgccacgccgcccggctcagtggaggcctttccgcaaagcaacgcggtcatccaggatgaggagcgcgacattcctgaacggtcctggaacagcgggtacgagtggatcacagactttcccggaaagacagtgtggttcgtgccctccatcaagtcgggcaacgacatcgccaattgcctccgcaagaacgggaagcgtgtcatccagctttcccgcaagaccttcgacaccgagtaccagaagacgaagaacaacgactgggactatgtggtgacgaccgacattagcgagatgggcgcaaacttccgggcggaccgcgtcatcgacccccggcgctgcctgaagcccgtgatcctgaaggacgggcccgagcgggtcatcctcgcgggacctatgcccgttacagtggcctccgccgcccagcgccgggggcgcatcggccggaaccacaacaaggagggcgatcaatacatctacatgggacagcccctgaacaacgacgaggaccacgcccactggacggaggcgaagatgctgctcgacaacatcaacacgcccgagggtatcatccccgccctgttcgagccggagcgcgagaagtccgcagccatcgatggggagtaccgcctgagaggcgaggcccgcaagaccttcgtcgagctcatgcggagaggggacctgcccgtgtggctgagctacaaggtcgcgtccgagggcttccagtatagcgaccggcggtggtgcttcgacggagagcggaacaaccaggtcctcgaggagaacatggacgtggagatctggaccaaggagggggagagaaagaagctgcggcccaggtggctggacgcccgtacctattccgacccactcgccctgcgcgagttcaaggagttcgccgccggccggcgcagcgtgtccggggatctgatcctagagatcggcaagttaccccagcaccttacccagcgagcgcagaatgccctcgacaacctggtcatgctgcacaactccgagcagggaggacgcgcctaccggcatgccatggaggagctccccgacaccatagagaccctaatgctactcgcgctgatcgccgtgctgacgggcggggtgaccctcttcttcctctccggccgcgggttaggcaagacatcgatcgggctcctgtgcgtcatggcatccagcgccctgctttggatggcctccgtggagccacattggattgccgccagcatcatcctagagttcttcctgatggtgctcttgatcccggagccggaccggcagcgcacgccccaggacaaccagctggcctacgtcgtgatcggactcctattcatgatcttgactgtggccgccaacgagatgggcctcctggagaccaccaagaaggacctggggattggccacgtcgcggtggagaaccaccaccacgccaccatgctcgacgtggatctgcacccagcctccgcctggaccctgtacgccgtcgcgacgactattatcaccccgatgatgcggcacaccatcgagaacacgaccgccaacatcagcctcaccgccatcgcgaaccaggccgcgatcctgatggggctggacaaagggtggcctatatccaagatggacatcggcgtgcccctcctggccttagggtgctacagccaggtgaaccccctcaccctgacggccgcagttttgatgctcgtggcgcactacgcaataatcggcccgggattacaggccaaggccacccgcgaggcccagaagcgcaccgcggccggcatcatgaagaaccccaccgtggacgggatcgtcgcgatcgacctggaccccgtggtgtacgacgcgaagtttgagaagcaactcggccagatcatgctgctgatcctctgcacttcccaaatcctgttaatgcggaccacctgggctctctgcgagagcattaccctggcgacgggcccccttacaaccctctgggaggggtcaccaggcaagttctggaacaccacgatcgcggtcagtatggccaacatcttccgcggcagctacctggccggcgccggcctggcgttctcgctcatgaagtcgctagggggcgggcggagagggaccggggctcagggcgagaccttaggcgagaagtggaagcggcagctcaaccagctgtcaaagagcgaattcaacacctacaagcgctccgggataatggaagtggacagaagtgaggcgaaggagggcctgcgccgcggggaaactaccaagcacgccgtgtcccgcggaaccgcgaagctccggtggttcgtcgagcgcaacctggtgaaacccgaggggaaagtgatcgacctgggttgcggccgcggtgggtggagctactactgcgccgggctgaagaaagtcaccgaggtgaaggggtacaccaagggcgggcccggccacgaagagcccattcctatggccacctacgggtggaacctcgtgaagctacactccggcaaagacgtcttcttcatcccgcccgagaagtgcgacaccctgctctgcgacatcggggagagctcccccaacccgaccatcgaggaaggccgcacgctgcgggtgctgaagatggtggagccctggttgcgcgggaaccaattctgcatcaagatcctgaacccctacatgcccagcgtcgtggagaccctggagcagatgcagcggaaacacggcggcatgctcgtgcgcaaccccctttcccggaactctacccacgagatgtattgggtctcctgcgggaccggcaacatcgtgtccgccgtcaacatgacctctcgcatgctgctcaatcgcttcacaatggcccacagaaaacccacctacgagcgtgacgtggacctgggcgcgggcacccggcacgtggccgtagagcccgaggtggccaacctggacatcatcggccagcgcatcgagaacattaagcacgagcataagagcacctggcactacgacgaggacaacccatacaaaacttgggcctaccatgggtcctacgaggtgaagccgagcggcagcgcatcctccatggtcaatggggtagtgaagctgctgaccaagccctgggacgtgatcccgatggtgacccagatcgcgatgaccgacacgaccccctttggccagcagcgggttttcaaggagaaggtcgacacccgcaccccgaaggccaagcggggcaccgcccagattatggaggtcaccgcgcgctggctgtggggtttcctctcgcgaaacaagaagccccgcatctgcaccagggaggagttcacccgcaaagtgcggagcaacgccgcgatcggcgccgtcttcgtggacgagaaccagtggaactccgccaaggaggcagtggaggacgaacgcttctgggacctggtccaccgtgagcgcgagctgcacaaacaggggaagtgcgcaacgtgcgtgtacaatatgatgggcaagcgggagaagaagcttggggagttcggcaaggccaaagggagccgcgccatctggtacatgtggttgggcgctcggttcctggagttcgaggccctcggcttcatgaatgaggaccactggttctcccgggagaactctttatccggggtggaaggagaggggctacacaagctcggctacatcctgcgggacatcagcaagatccccgggggcaacatgtacgcggacgacacagcgggctgggacacccgaatcacggaggatgacctgcagaacgaggccaagatcactgacattatggagccggagcacgccctcctggccacctccatcttcaagctgacctaccagaacaaggtcgtgcgcgtgcagaggcccgcgcgcaacggtacagtcatggatgtgatcagccggcgcgaccagcggggcagcgggcaggtgggcacgtacgggttaaacaccttcaccaacatggaggcacagctgatccgccaaatggagagcgaggggatcttcagtccctccgagctggagacccccaacctcgccgagcgggtcctggactggctggagaaacacggcgtggagcgcctcaagcggatggccatctccggggacgactgcgtggtcaagcccatcgacgatcgcttcgccacggcgctgagcgccctcaacgacatgggcaaggtgcggaaagacataccccagtgggagcccagcaaggggtggaacgactggcagcaggtccccttctgctcccatcacttccaccagctcatcatgaaggacggccgcgagatcgtcgtgccgtgccggaaccaggacgagctggtgggccgcgcccgcgtctcccagggggccggctggtcccttcgcgagaccgcctgtctcggcaaaagctacgcgcagatgtggcaactgatgtacttccaccggcgcgacctgcggctcgcagcaaacgcaatctgctccgcggtgcctgtggactgggtccctaccagccgcaccacgtggtcaatccacgcacatcaccagtggatgaccaccgaggacatgctgtcggtgtggaaccgcgtgtggattgaagaaaacccatggatggaagacaagacccacatctcaagctggggcgacgtcccgtacctggggaagcgggaggatcagtggtgcgggtccctcattggcctgacggccagggccacctgggcaaccaacatccaagtggcgatcaaccaggtacggcgtctgatcgggaacgagaactacctcgactacatgacatcaatgaagcggttcaagaacgagtcggaccccgaaggcgccctgtggtga

SEQ ID NO: 24253 - RNA, 9879 nt, synthetic construct
  misc_feature 1..9879: note = derived and/or modified CDS sequence (opt11) from DENV-1__FJ882523__SS-prME
  source 1..9879: mol_type = other RNA
agcgttaccatgctcctaatgctgatgcccaccgcacttgcctttcacttgacgacgcggggcggtgagccacacatgatagtcactaagcaggagcggggcaagagcctgctgttcaagaccagtgcgggggtaaatatgtgcaccctcatcgcaatggacctgggcgagctgtgcgaagacaccatgacctacaagtgcccccggatcaccgaggccgagccggacgatgtggactgttggtgcaacgccaccgacacttgggtgacctacgggacctgcagccagacgggcgagcaccggcgcgacaagcggagcgttgccctcgctccccacgtgggcctgggtctggagacccgaactgagacctggatgagcagcgagggcgcctggaagcagatccagcgggttgagacgtgggctctccgccacccggggtttaccgtaatcgcgctgttccttgcacacgccatcggcacctccatcacgcagaagggtatcatcttcatcctcctgatgctggtgaccccctccatggctatgcggtgcgtcggcatcggctcccgcgacttcgtggaagggctctccggcgccacctgggtggatgtcgtcctagagcacggctcctgtgtgaccaccatggctaaggacaagcccacgctggacatcgaactcctcaagaccgaggtgaccaaccccgcggtactgaggaagctctgcatcgaggccaaaatcagtaacaccacgaccgactccagatgccccacacagggcgaagcaaccttgatggaggagcaggacgccaactttgtgtgccggcgcacgttcgtcgacaggggctgggggaacggctgcgggctgttcggcaaagggtcactcatcacatgtgccaagttcaaatgcgtcaccaagctggagggcaagatcgtgcagtatgagaatctaaagtattcggtcatagttactgtgcacacaggcgaccagcatcaggtgggcaacgagagcactgagcacggtaccaccgcgaccatcacgccccaagcaccgacgtccgagatccagctcaccgactacggggctctcacgctggactgcagcccccgcacgggcctcgacttcaacgagatggtgctgctgacaatgaaggagaaatcctggttagtacataaacaatggttcctggacttacctctcccctggaccagcggtgccagcaccagtcaggaaacgtggaaccggcaggacctgctggtgaccttcaagaccgcccacgcaaagaaacaggaggtggtcgtgcttggcagccaagagggcgccatgcacaccgccctgacgggggccaccgagattcagacaagcggcaccactacaatcttcgccgggcaccttaagtgccgcctcaagatggataagctgacccttaagggcatgtcctacgtgatgtgtaccggttcctttaagctcgaaaaggaagtcgccgagacgcagcacggcaccgtgctcgtgcagattaagtacgagggcaccgacgccccatgcaagatccctttcagcacccaggacgagaagggggtcacccagaacggccggctgataacggccaacccgatagtgactgacgaggagaagcccgtgaacatcgaggccgagccgcccttcggcgagtcgtatatagtcatcggagcgggcgagaaggcccttaagttaagctggtttaagaaggggtcctctattggcaagatgtttgaggctacggcccgcggagccagacgcatggcgattcttggcgacacggcgtgggacttcgggagtatcgggggcgtgttcacctccgtggggaagctggtccaccaaatcttcggcactgcctatggggtgctgttcagcggagtgtcgtggaccatgaagatcgggatcggcgtgctactgacgtggctgggtctgaattctcgctccacctccttgagcatgacctgcattgccgtggggctggttaccttgtatctgggcgtcatggtccaggccgactccgggtgcgtgatcaactggaaggggcgggaacttaagtgcgggtccggaatcttcgttactaacgaggtccacacatggacggaacagtacaagttccaggcggacagtccaaaacgcctgtccgccgccatcgggaaggcctgggaggagggggtgtgcggcatccgctcggccactcgcctggagaacatcatgtggaagcagatctccaacgaattgaaccatatcttattagagaacgacatgaagttcaccgtcgtggtcggggatgtcgttggtatcttggcgcaggggaagaagatgatcaggccccagcccatggaacataagtatagctggaagtcctgggggaaggcaaaaataataggggcggacgtgcaaaataccacattcattatcgacggccccaataccccggagtgccccgatgaccaacgcgcgtggaacatctgggaggtggaggattatggtttcggaatcttcaccaccaacatctggctgaagttacgcgatagctatacccaggtgtgtgaccaccgcctcatgtccgcggccattaaggacagcaaggccgtccacgccgacatgggctactggatcgagtcagaaaagaacgagacctggaagctggcccgggcgtccttcatcgaagtaaagacctgcatatggccaaaatcccatacgctgtggtcaaacggcgtgctcgagagtgagatgataatccccaaaatctatgggggcccgataagccagcataactacagacccgggtatttcacgcagactgccggcccctggcacctggggaagctggagttggactttgatctgtgtgagggcacaacggtggtcgtggacgagcactgcggcaaccgggggcccagtttaagaaccaccaccgtgacgggcaagataattcatgagtggtgctgtcggtcctgcaccctgccgccactacgatttaagggggaggacggctgctggtacgggatggagatcaggcccgtcaaggaaaaggaggagaacctggtgaagtcgatggtgagcgcgggatctggggaggtcgactccttcagcctcgggctgctgtgcatctccatcatgatcgaggaggtgatgcgcagccggtggtcccgcaaaatgctcatgaccggcacactggccgtgttcctattgctgatcatggggcagctgacgtggaatgacctaatccggctctgcatcatggtcggggccaacgccagcgaccgcatggggatgggcaccacctacctggcactcatggccaccttcaagatgcgccctatgttcgcagtgggactgctgttccggaggctcacgtcccgggaggtgttactgcttaccatcgggcttagcctggtcgcctccgtggagctccccaacagcctggaagagttaggcgacgggctcgcgatgggcatcatgatcctgaaactgctaaccgattttcagtcccaccagctgtgggccaccctgctcagcctgaccttcatcaaaacgacactttccctccactatgcctggaagaccatggcgatggtccttagcatcgtgtccctgttccccctatgcctgagcacgacctcccagaaaaccacgtggctgccagtgctcctgggcagcctcgggtgcaagccgctcaccatgttcctgatcgcggagaacaaaatctgggggcgcaagtcctggccactgaacgaggggatcatggctgttggcgtggtaagcatcctcctgagctccctgttaaagaatgacgtccccctggccggaccactgattgcaggcggcatgctaatcgcctgctacgtgatcagcggatctagcgccgacctgtcgctggagaaggcggcggaggtgagctgggaagaggaagccgaacactccggagcgagccacaacatcttggtcgaagtgcaggacgacgggaccatgaaaataaaggacgaggagagagacgacaccctgacaatcctgctcaaggcgacactcctggccgttagcggcgtctacccgctcagcataccggcgaccctgttcgtatggtacttttggcagaaaaagaaacaacgctccggggtgctgtgggacacgcctagccccccggaagttgagcgagcagtgctggatgacggtatctaccgcatcatgcagcggggcctcctgggacgcagccaggttggcgtcggggtcttccaggagaacgtgtttcacacgatgtggcacgtcacgcggggcgccgtgctgatgtatcaggggaaacgcctggaacccagctgggcctctgtcaaaaaggacctgattagctacggcggcggttggcggctgcagggctcctggaacaccggagaggaggtccaggtgatcgccgtggagcccggcaagaatccgaagaacgtccagaccgcgcccgggaccttcaagacccccgaaggcgaggtgggcgccatagctctcgacttcaagcctgggacgagcggttcaccaatcgtcaaccgggaagggaagatcgtaggcctgtacggcaacggtgttgtgaccaccagcggcacctatgtcagtgcgatagcccaggccaaggcctcccaggagggcccgctgccggaaatcgaggacgaggtgttccggaagcgcaacctcacgatcatggatctgcaccccggaagcgggaagacccggcgctacttgccggcgatagtgcgggaggccataaagaggaaattgcggacccttatcctggcccccacccgcgtcgtggcatccgaaatggccgaggcgcttaagggtatgcccatccgatatcaaaccaccgccgtcaagagcgaacataccggcaaggaaatcgtcgacctgatgtgtcacgccaccttcactatgcgcctgctctcccccgtgagggtccccaactacaacatgatcattatggacgaggcccacttcaccgaccccagctccatcgccgcgcgtggatacatcagcaccagggtcggcatgggagaggccgccgcgatcttcatgaccgccacgccgcccggctccgtggaggctttcccgcagagcaacgccgtcatacaagacgaagagcgggacatccccgaacgctcctggaacagcggctacgaatggatcaccgatttccccggcaagaccgtctggttcgtgccctccataaagagcggcaacgacatcgccaactgccttcggaagaacgggaagcgcgtgatccaactgtcccggaaaacctttgacacggagtaccagaaaaccaagaacaacgactgggactacgttgtaacaactgacatcagcgaaatgggcgctaattttcgcgcggatcgggtgatcgatccgcggcggtgcctaaaacccgtcatcctgaaggacggtcctgagcgcgtgatcttggcgggccccatgcctgtgacggtggcctcggccgcccagcgaagggggcggatcggccgcaaccacaacaaggaaggagaccagtacatctatatgggacagccacttaacaacgacgaggaccacgcgcactggaccgaggccaaaatgctgctggacaacatcaacacgcccgaggggatcatacctgcactattcgagccggaacgggagaagtccgcagcaatcgacggggagtatagactgcgaggcgaggcgcgtaagacgtttgtggagctaatgcgccgcggggacctcccggtctggctgtcctacaaggtggcctctgagggattccagtacagcgacaggcggtggtgtttcgacggcgagcggaacaaccaggtgttggaagagaacatggacgtcgagatctggacgaaggagggtgagcgtaagaagctccggccgcggtggctggacgcccgcacatactcggaccccctcgcactccgggagttcaaagagttcgccgctgggcgcagaagcgtctccggggacctgattctggagatcggcaaactcccgcaacacctgacacagagggcgcagaatgccctggacaacctcgtgatgcttcacaacagcgagcagggcgggcgggcctaccgccacgcgatggaagagcttcccgataccatcgagaccctcatgctgttggccctcatcgccgtcctgaccggcggggtgaccctgttcttcctgtccggccgggggctggggaaaacctccattggcctgctctgcgtgatggcctccagcgtactgctctggatggcatccgtggagcctcactggatcgcggcaagcatcatactcgagttcttcttgatggttctcctcatacccgagccggaccgccagagaacgccccaggacaaccaacttgcgtacgtcgtgatcgggctattattcatgatactgaccgtagccgcaaacgagatgggcctgctagagacgacaaagaaggacctcgggatcggacatgttgcggtggagaatcaccatcacgccacaatgctagacgtggacctccaccctgcctccgcctggacgctgtatgccgtcgcgaccacaatcataacaccgatgatgcgtcacacaatcgagaacacaaccgccaacatcagcctcaccgccatcgccaaccaggccgcgatcctcatggggctggacaagggctggcccatctccaagatggacatcggcgtgccgctcctcgcactcgggtgttacagccaggtgaaccccttaacgctcactgccgccgtcctgatgctggtcgcgcattacgctatcatcggcccgggactgcaggccaaggctaccagagaggcacagaagaggaccgcggcgggtatcatgaagaaccccaccgtggacgggatcgtagccatcgacctggatcccgtagtttacgatgccaaattcgagaagcaactgggccagattatgctcctcatcctgtgcacctcccagatactcctgatgagaaccacctgggccctgtgcgaatcaatcactctcgcgacgggccccctgacaactctgtgggaggggtccccgggcaagttctggaacaccaccatcgccgtcagcatggccaacatctttcgtgggagttacctcgctggcgctggccttgcgttctcgctgatgaagtccctcggtggtgggcgccggggcaccggggcacagggggagacccttggtgagaagtggaagcgccaactgaaccagctctctaaaagcgagttcaacatctacaaacgttctgggatcatggaggtggaccgtagcgaggccaaggaaggccttaagcgcggggagacgacgcgccacgccgtgagccggggcaccgcgaagcttcgatggttcgtcgagcggaacttagtgaagcccgaagggaaggtgatcgacttaggctgcggacgcgggggctggagctattactgtgcagggctgaaaaaggtgaccgaggtgaagggctacacgaagggcggacctggccacgaggagcccattcccatggccacatacgggtggaacctggtgaagctacactccggcaaggatgtcttttttacaccgcccgaaaaatgcgacacactgctgtgcgacatcggcgagagctcccccaacccgaccatcgaggagggccggaccctcagagtgctgaagatggtagagccctggctcagggggaaccagttttgcatcaagatcctaaacccctacatgccatctgtggtggagacacttgagcagatgcagcgcaagcatggcggcatgctggtgcggaacccgctgtcacgtaactcgacccacgagatgtactgggtttcctgcgggaccggcaatatagtgagcgccgtgaacatgacttcccgcatgctgctcaaccgcttcactatggcccaccgcaagcccacctatgaacgggacgtggatctcggggcgggcacccgccacgtggccgtggagcccgaggtcgccaaccttgacatcatcggccagcggattgagaacatcaagcacgagcacaagagcacctggcactacgacgaggacaacccctacaaaacctgggcctaccacgggtcttatgaggtgaagccgagtggctccgccagcagcatggtcaacggggtggtgaagttactcaccaaaccctgggacgtcatccccatggtgacccagatcgcgatgacggacacaacacccttcggccagcagcgcgtgttcaaggagaaggtcgacacaaggacgcctaaagccaagcgcgggaccgcccagatcatggaagtaaccgcccgatggctgtggggcttcctgtcccgcaacaagaagccccggatttgcacccgcgaggagttcacacggaaagtgcgcagcaacgccgctatcggcgccgtgtttgtggatgagaatcagtggaattccgccaaggaggccgtggaagacgaaaggttttgggacctcgtccagaaggagcgggagctgcacaagcaggggaagtgtgcgacctgcgtgtacaacatgatgggcaagcgtgagaagaagctgggggagttcggcaaggccaaggggagccgcgccatttggtacatgtggctcggagcccggttcctggagttcgaggccctaggcttcatgaacgaggaccactggttctcccgcgagaacagcctctccggggtggagggcgaggggttgcacaagctgggatatatcctccgggacatcagcaagatccccggaggcaacatgtacgcagacgacaccgccggatgggacacacgcatcacggaagacgacttgcagaatgaggcgaaaatcactgacattatggaaccggagcacgccctgctggccacctccattttcaagctgacctaccaaaataaagtcgtgcgggtgcagcgcccagcgaagaacggaacggtcatggacgtgatcagccgccgggaccaacgcggctccggccaggtgggcacctacggcctgaacactttcactaacatggaggcacagctcatcaggcaaatggagagcgaggggatcttctcccccagtgagcttgagatcccgaacctagccgagcgcgttctagactggctggagaaatacggagtggagcgactgaagcggatggccatatccggggacgactgcgtggtcaaaccgatcgacgaccggttcgccactgcgctcaccgccctgaacgacatgggcaaggtgcgcaaggacgtaccccagtgggagccttccaaagggtggaatgactggcagcaggtccccttctgcagccaccacttccaccagttgataatgaaagacggacgggagatcgtggtgccgtgccgcaaccaggacgagctcgtaggccgggcccgcgtgagccagggggccggctggagcctgcgggaaaccgcctgcctggggaaatcctatgcgcagatgtggcagctcatgtatttccaccgccgggacttacgcttagccgccaacgccatctgctcagcggtacctgttgactgggtgcccacctcccggacgacatggagcatacatgcccatcaccagtggatgaccacggaggatatgctctccgtctggaaccgagtctggattgaagagaatccctggatggaggataagacgcatgttagctcctggggcgacgtgccgtatctggggaaaagagaagatcaatggtgtggcagtctgatcggcctcaccgcccgcgccacctgggccagtaacatccaggtcgccatcaaccaggtcagaaggctaatcgggaacgaaaactacttagactacatgaccagcatgaagcgctttaaaaacgaaggcgacccggaaggggccctctggtga

SEQ ID NO: 24254 - RNA, 9879 nt, synthetic construct
  misc_feature 1..9879: note = derived and/or modified CDS sequence (opt11) from DENV-1__FJ882524__SS-prME
  source 1..9879: mol_type = other RNA
agcgtaaccatgctgcttatgctcatgcccactgccctcgccttccacctcaccactcggggcggggagccacacatgatcgtgaccaagcaggagcggggcaagtcactgttgttcaagaccagcgctggggtgaacatgtgcaccctgatcgccatggatctgggcgagctgtgcgaagacaccatgacttacaaatgccccagaatcaccgaagccgaaccagacgacgtggactgctggtgcaacgccacagacacctgggtgacctacggcacctgcagccagaccggcgagcatcggcgcgacaagcggagcgtggccttagcgccccatgtgggcctggggcttgaaacccgcaccgaaacttggatgtcctctgagggagcctggaagcagatccagcgggtagagacgtgggccctcaggcacccggggtttaccgtgatcgccttatttctggcgcacgccatcggcacttccatcacacaaaagggaatcatattcatcctcctgatgctggtgacacccagcatggccatgcggtgcgtaggtatcggctcccgcgatttcgtggaggggctcagcggagcaacctgggtagacgtcgtgctggaacacgggtcctgcgtgaccaccatggccaaggacaagccgacgctggacatcgagctcctgaagaccgaggtgaccaaccccgctgtgctgcggaagttgtgcatcgaggccaagattagcaacaccaccaccgactcacgctgccccacccagggcgaggccaccctgatggaggagcaagacgccaactacgtgtgtaggcgtacgttcgtggaccggggctggggtaacggctgcgggttattcggcaagggcagcctcatcacgtgcgccaaattcaagtgcgtcaccaaactggagggcaagattgtgcagtacgagaacctgaagtactccgtcatcgtgaccgtacacacgggtgaccagcaccaggtcggaaacgagagcaccgagcacggcaccaccgcgaccatcacgcctcaggcccccacctccgagatccagttaaccgattacggggctctgaccctggactgcagcccccgcaccggcctggatttcaacgagatggtgctgctgaccatgaaggagaagtcctggctcgtccacaaacagtggttcctagaccttccgctcccctggaccagtggggccagcacctcacaggagacttggaatcggcaggatctgctggttactttcaagaccgcccatgcgaagaaacaggaggtggtcgtgctcggcagccaggagggtgccatgcacaccgccctgacaggggccaccgagatccagacctccggcaccacaacgatcttcgccgggcatctgaaatgccgactcaagatggataagctgaccctgaagggcatgagctacgtgatgtgcaccgggtccttcaagctcgaaaaggaggtggcggagacgcagcatggcacggttctggtgcagatcaagtacgagggcaccgacgccccctgcaagatccctttcagcacccaggacgagaaaggagtcacgcagaacggccggctgatcaccgccaacccgatcgtaaccgacaaagagaagcccgtgaacatcgaggccgagccgcccttcggggagtcctatatcgtaatcggcgcaggcgagaaggccctgaagctcagctggttcaagaaaggatctagtatcggcaagatgttcgaagcaaccgccagaggggcacggaggatggcgatcctgggcgacacggcctgggacttcgggtctataggcggggtgttcaccagcgtgggaaaactggtccaccagatcttcgggaccgcctacggcgtcctgttctccggagtgtcttggactatgaaaatagggatcggcgttctcctgacgtggctcggcttgaactcccgcagcacctccctaagcatgacctgcatcgcggtggggctcgtgaccctgtatttaggcgtcatggtgcaggccgattccgggtgcgtgatcaactggaaaggtcgggagcttaagtgcgggagcggcatctttgtcacgaacgaagtgcacacctggacagaacagtacaagttccaagcggactcgccgaagcgcctgtctgctgcgatcgggaaggcctgggaggagggggtgtgcggcattcggagcgccactcgcctagagaatatcatgtggaagcagatctccaatgagttgaaccacatcctgctggagaacgacatgaagtttaccgtcgtcgtgggtgacgtcgtgggcatcctcgcacaggggaagaaaatgattcggccacagccaatggagcacaagtatagctggaagtcctggggcaaggctaagatcatcggcgccgacgtgcaaaacacgactttcataatcgacgggcccaatactccggaatgccccgatgatcaacgcgcctggaacatatgggaggtggaggattacggcttcgggatcttcaccacgaacatctggctgaagttacgggacagctacacccaagtgtgcgaccaccgcctcatgtccgcggcaatcaaggactccaaggcggtgcacgccgacatgggctactggatcgagtctgagaaaaacgagacgtggaagctggcccgggccagcttcatagaggtcaaaacttgcatctggcccaaatcccacacgttatggagcaacggcgtgttggagtccgagatgatcatccccaagatttatggggggcctatcagccagcacaactaccgccccggttacttcacacagaccgccggcccctggcacctggggaagctggagctcgacttcgacctgtgtgagggcaccacggttgtcgttgacgagcactgcggcaaccgggggccctccctgcgcaccaccaccgtgacgggcaagatcatccacgagtggtgctgcaggagctgtaccctgccgcccctccgcttcaagggggaggacggctgctggtatgggatggagatccggcccgtcaaggaaaaggaggagaacttagtgaagtccatggtgagcgcgggctccggcgaggtcgactcctttagcctcggcctgctgtgcatttccatcatgatcgaagaggtaatgcgcagccggtggtcccgcaagatgctcatgactggcaccctggccgtgttcctgctccttatcatggggcagctgacgtggaacgaccttatccggctgtgcataatggtaggcgcaaacgcgagcgacaggatggggatggggaccacctacctggccctcatggccaccttcaagatgcgcccgatgtttgccgttgggctgctgttccggcgcctcacgtcccgggaggtgctgctgttaaccatcgggctgagcctggtcgccagcgtggagctaccaaacagcctggaggagctgggcgacggtctggcgatgggcatcatgattttaaagttactcactgacttccaaagccaccagctgtgggcaaccctgctgagccttacgttcatcaagaccaccctgagtcttcactatgcctggaagaccatggcgatggtcctgagtatcgtgtccctgtttcccttatgcctgagcacgacaagtcagaagaccacctggctgcccgtgctcctcggctcgctggggtgcaagcccctcacgatgttcctaatcgctgagaataagatctgggggcgcaagtcttggccactaaacgaggggatcatggccgtcggcgttgtgtcgatcctcctgagctccctgctcaagaacgacgtccccctagccgggcccctgatcgccggaggcatgctcatcgcctgctacgtaatcagcgggtctagcgcggacttaagtttagagaaggccgccgaagtgtcatgggaggaggaggccgagcactccggcgcaagccacaacatcttagtcgaggtgcaggacgacgggacaatgaagatcaaggacgaagagcgggacgacaccctgacaatcctgctaaaggcgaccctgctggccgtctccggcgtctacccgctcagcatccccgcaacgctatttgtgtggtacttctggcagaaaaagaagcagcgctccggggtgctgtgggacacgcccagcccgcccgaagtcgagcgagcagtgctggacgatggcatttaccgcataatgcagcgggggttgcttgggcgctcccaggtgggggtcggtgtcttccaggagaacgtgttccatactatgtggcacgtcaccagaggcgccgtgctgatgtaccaggggaagcgcctcgaaccctcgtgggcgtccgtcaagaaggacctgatcagctatggcggcgggtggcggctgcagggctcgtggaacacgggggaggaagtccaggtgatcgccgtggagcccggcaagaacccgaagaacgtccaaaccgcccccggtacctttaagacccccgagggcgaggtcggagcaatagcgctggacttcaagcccgggacgagcggctctcccatcgtcaaccgcgaggggaagatcgtcggactttacggcaacggggtggtgaccacctctggcacctacgtctcagccatcgcacaagcgaaggcctcccaggaaggtcccctgccagagatcgaggacgaggtattccgaaagcgcaacctcacaatcatggacctgcaccccggcagcgggaagacccggcgctacctgccggctatcgtgcgggaggccataaagcgcaagctccggacccttatcctggcccctacccgcgtcgtggcttccgagatggcggaggcgctcaagggcatgcccatcaggtaccagacgaccgccgtcaagagtgagcatactgggaaggaaatcgtcgacttgatgtgccacgccaccttcacgatgcggctgctctccccggtgcgcgtcccgaactacaacatgatcatcatggacgaggcccacttcaccgatcctagctccattgcggcccgggggtatattagcactcgagtcggcatgggagaggccgcagccatcttcatgaccgcaacaccgcccggcagtgtggaagcgtttccgcagagcaatgccgtgatccaggatgaggagcgggacatccctgaacgcagctggaactctggatacgagtggataactgacttccccggaaagaccgtctggttcgtgccctccatcaagtctggcaacgacatcgccaactgcctgcggaaaaatgggaagcgcgtgattcaactttcccggaagaccttcgacacggagtaccagaagaccaagaacaacgactgggactatgtcgtgaccaccgacatctctgaaatgggcgccaacttccgcgccgaccgggtgatcgatccacgccggtgcctcaagcccgtaatactgaaggacgggccggagcgggtgatcctcgccggccccatgccggtcacggtggcttccgccgcccagcgacgcggaaggataggccgcaaccacaacaaagagggcgaccagtatatttacatggggcagcccttgaacaatgacgaggaccacgcgcactggacggaggccaagatgctgttagataacataaacacccccgagggaataatccccgccctcttcgagccagaacgggagaaatcagccgccatcgacggagagtaccgacttcgcggcgaagcgcggaagacgttcgtagagcttatgcgcagaggggacctcccggtctggttatcctacaaggtggctagcgagggcttccaatacagcgaccgccgatggtgcttcgacggtgagcggaataaccaggtgctggaggagaacatggacgtcgagatctggacgaaggagggggagcggaagaaactccgccctcggtggctggatgcccgcacctactccgacccccttgccctgcgggagttcaaggagttcgccgcgggcaggcggagcgtgtccggcgaccttatcctggaaatcggcaagctcccgcagcacctgacccagcgcgcccagaacgccctggataacctcgtgatgctacacaacagcgaacagggcgggagagcctaccgccatgcgatggaggagctgcccgacaccatcgagacgctcatgctgctggccctcatcgccgtactgaccggcggggtgaccctcttcttcctctctggacgtgggctggggaagacctccatcggcctactctgtgttaccgcttccagtgtcctgctgtggatggccagtgtggagccacattggatcgcggcctcaatcatcctggagtttttcctgatggtcctattaatccccgagccggaccgccagcggacgccccaggacaaccagctggcctacgtcgtgattggcctcctcttcatgatcctgaccgtagccgccaacgagatgggcctgctcgaaaccacaaagaaggacctggggatcggccacgtcgcggtggaaaaccaccaccacgccacgatgctagacgtggacctccatcccgccagcgcctggaccttgtacgccgtcgcgaccacaataatcacgccgatgatgcgccacaccatcgagaataccaccgccaacatcagcctgacggccatcgccaaccaggccgccatcctcatggggctagacaagggttggccgatctccaaaatggacatcggcgtgcccctcctcgccctgggatgctatagccaggtaaaccccctgaccctcacggccgccgtcttaatgttagtggcgcactacgccatcatcggcccgggtctccaagctaaggccacaagagaagcccagaaacggacggctgccggcatcatgaagaaccccaccgtggacggcatcgtcgccatcgacttagaccccgtggtgtacgacgccaagttcgagaaacagctgggccaaatcatgctcctaatcctgtgcacgtcccagatcctcttaatgcgcaccacgtgggccctttgcgagagcatcaccctcgcaaccggccccctgaccacgctgtgggaaggatccccgggcaaattctggaacaccaccatcgctgtctccatggccaacatctttcgggggtcctacctcgccggtgccggcctggcgttcagcctgatgaagtcactcgggggcgggaggcgcggcaccggggcccagggagaaacgctgggcgagaagtggaagcgccaattaaaccagctctccaaaagcgagtttaacatctataagcgatccgggatcatggaagtggaccgcagcgaggcaaaggagggcctgaaacggggggagacaacccgccacgccgtgtcgcggggaaccgcgaagctgcgatggttcgtcgaacgaaacttggtaaagcccgaagggaaggtgattgatctcggctgcggccgcgggggctggagctattactgcgcggggctgaagaaggttacggaggtgaagggctacaccaaaggcgggcctggccatgaggaacccatcccgatggccacctacggctggaacctcgtgaagcttcactccggcaaagatgtctttttcacgcccccggagaagtgcgacaccctgctgtgcgacattggggagagctcccccaacccgaccattgaggagggccgtaccctccgcgtcttaaagatggtagagccctggctgcgcgggaaccaattctgcatcaagatcctcaacccctacatgcccagcgtcgtggagaccttagagcagatgcagcgaaagcacggtggcatgctggtgcggaacccgctctcccgcaacagtacccacgagatgtactgggtctcctgcggtacgggcaacatcgtgtcggccgtgaacatgacttcccggatgctgctgaaccgcttcaccatggcccaccgcaagcccacctacgagcgggacgtggatttaggggcgggcacgcgccatgttgccgtggagcccgaggtcgccaacctggatatcatcggccagcggatcgagaacattaagcatgagcacaagagcacttggcactacgacgaagacaacccctacaagacctgggcgtatcacggttcctacgaggtgaagccgagtggctcagcctcttctatggtgaacggggtggtgaagctactcaccaagccctgggacgtgattccaatggtgacgcagatcgcgatgaccgacaccaccccatttggccagcagcgggtgttcaaggagaaggtcgacacgagaaccccgaaggccaagcgcggaaccgcacagattatggaggtgaccgctcgctggctgtggggctttttatcccgcaacaagaagccccggatctgcacgcgcgaggaattcacccggaaggtgcgcagcaatgctgcgatcggcgccgtcttcgtggacgaaaaccaatggaactccgccaaggaggccgtggaagatgagcggttttgggacttggtacagaaggagcgggagctgcacaagcaggggaaatgcgctacctgcgtctacaacatgatgggcaagcgagagaagaagctgggggaatttggcaaggcaaagggcagccgcgccatctggtacatgtggttaggcgcccggttcctggagttcgaggccctgggcttcatgaacgaggatcactggttctcccgcgagaactcgctctccggcgtggagggcgaagggctgcacaagctgggctacatcctccgggatatcagtaagatacccgggggaaacatgtatgccgacgacaccgcggggtgggacacgcgcatcaccgaggacgacttacagaatgaggccaagataaccgacatcatggagcccgagcacgccctgctcgccacctccatcttcaagctcacgtatcagaacaaggtcgtacgggtgcagcgccccgctaagaatgggacagtcatggacgtgatcagccgccgggaccaacgcggctccggacaagtgggaacgtacgggctgaacaccttcacgaacatggaggcccagttgatccggcagatggagagcgagggtattttctcccccagcgagctggaaataccgaacctcgccgagcgtgtcctcgactggttggagaaatacggggtggagcggctgaagcgcatggccatctccggggacgactgcgtggtcaagccgatcgacgaccggttcgccacagcactcaccgccctgaacgacatgggcaaagtgcgcaaggacgtgccacagtgggaaccctccaaggggtggaacgactggcagcaggtccctttctgctctcaccacttccaccagctgatcatgaaggacggcagggagattgtggtgccgtgccgcaaccaggatgagctcgtcggccgggcccgcgtgtctcaaggggcaggctggagcctgcgggagaccgcctgcttgggaaagtcctacgcacagatgtggcagctcatgtacttccaccgccgggacttacgcctggccgccaatgccatctgcagcgcggtgcccgtcgactgggtgccgacgtcccggaccacctggagcattcacgcccaccaccagtggatgaccacggaggatatgctctcggtgtggaaccgcgtgtggatcgaggaaaacccctggatggaagacaagacacacgtgagctcctggggcgacgtgccttacctggggaagcgtgaagatcagtggtgcggcagcctgataggtctcaccgcaagagccacctgggcctccaacatccaggtcgcgatcaaccaggtgcgtcggttgatcgggaacgagaactacttggactacatgacgagcatgaagcgcttcaagaacgagggcgaccccgaaggtgccctctggtga

SEQ ID NO: 24255 - RNA, 9879 nt, synthetic construct
  misc_feature 1..9879: note = derived and/or modified CDS sequence (opt11) from DENV-1__FJ882525__SS-prME
  source 1..9879: mol_type = other RNA
tccgtgaccatgctgctcatgttaatgcccaccgccctggccttccacctcacgacccgggggggtgagccccacatgatcgtcagcaagcaggagcggggcaagagcctgttattcaagaccagcgcgggcgtcaatatgtgcaccctagtggccatggacttaggcgagttctgcgaggatacgatgacctacaagtgcccgcggatcaccgaggccgagcccgacgacgtggactgctggtgcaacgcaactgatacctgggtgacctatgggacctgcagccagaccggcgagcatcggcgcgacaagcggtccgtggccctggcgccccacgtgggcctcgggctggaaacgcggaccgaaacatggatgagctccgagggcgcttggaagcagatccagcgagtggagacctgggccctgcgccaccccgggttcacggtaatagccctcttccttgcacacgccataggcaccagcatcacccagaaggggatcatcttcattctgctaatgttggtcaccccctccatggccatgcggtgcgttggcatcggtagccgcgatttcgtggaggggctatcgggcgccacgtgggtcgatgtggtcctcgagcatgggtcgtgcgtgaccaccatggcaaaggacaagcccaccctggatattgagctgctgaagacggaggtgacgaacccggcggtgctgcggaagttatgtatcgaggccaagatctccaataccaccacggactcaaggtgcccgacccagggcgaggccaccctagtcgaggagcaggacgccaacttcgtgtgtcggcgcaccttcgtagataggggctgggggaacggctgcgggctcttcggcaaagggtccctgatcacgtgcgccaagttcaagtgcgtcaccaaactcgagggcaagacggtacagtatgagaacctgaagtacagcgtgatcgtcaccgtgcacacgggcgaccaacaccaggtaggcaatgaatccacagaacacggcacaaccgcgaccatcacgccgcaggcccctagcaccgagatccagctgaccgactacggggcactcacgctggactgcagcccccggacgggcctggactttaacgagatggtgctcttaaccatgaaggagaagagttggctggtgcacaaacagtggttcctcgatctgccgctgccctggaccagcggtgcctctacctcgcaggagacttggaaccggaaggacctcctggtcaccttcaaaaccgcccacgctaagaagcaggaggtggtggtcctgggctcccaggaaggcgccatgcacaccgccctcacgggggccaccgagattcagacaagcggcaccacgaccatcttcgccgggcacctgaagtgccgattaaagatggacaagctaaccctgaaggggatgtcctacgtaatgtgtaccgggagcttcaagttagagaaagaggtggcggagacgcagcacgggaccgtactcgtacaaatccggtacgagggcaccgacgccccctgcaagatacccttctccacccaggacgagaagggcgtgacgcagaacggccgactgataaccgccaacccgatcgtcaccgataaggagaagccggtgaacatcgaggccgagccgcccttcggggagagctacatcgtgatcggcgcgggtgagaaggcgctaaagctgtcctggttcaagaaggggagctccatcggcaagatgtttgaggccacggcccgcggtgcgcggcgaatggcgattctcggagacactgcctgggactttgggagcatcggcggggtcttcacctccgtaggaaaactggtgcaccaaatcttcggcaccgcctatggggtcctgttctccggcgtgtcctggaccatgaagatcgggatcggcgtgcttctgacgtggctgggcctcaacagccggtccaccagcctgtccatgacatgtatagcggtcgggctcgtgaccctttacctgggcgtgatggtccaggccgacagcggatgcgtaatcaactggaagggcagggagctgaagtgtggaagcggcatcttcgttacgaacgaggtccacacctggaccgaacaatacaagttccaggcggactccccgaagcggctcagcgccgccatcggcaaggcctgggaggagggggtgtgcggcatccgctctgccacacggctggagaatatcatgtggaagcagataagcaacgagctgaatcacatactcctagagaacgacatgaagtttaccgtggtcgtgggcgacgtagcgggcatcctggcacaagggaaaaagatgatccgcccacagccaatggagtacaaatactcctggaagagctggggaaaggccaagatcataggcgccgacgtccagaacacgaccttcatcatcgatgggcccaacaccccggaatgccccgacgaccagagagcatggaacatctgggaggtggaggactacggtttcgggatcttcaccacgaacatctggctcaagctgcgtgactcctacacccaagtttgtgaccaccggctgatgagtgccgccatcaaggatagtaaggccgtccacgccgacatgggctactggatagaaagcgagaagaacgagacctggaagctcgcgagagcctccttcatcgaagtgaagacgtgcatctggcccaagtcccacacgctgtggtccaacggcgtgctggagagtgagatgatcatccccaagatctacggtggcccgatctcccagcacaactaccgccctgggtacttcacccaaaccgccggcccctggcacctcgggaaactggagctggacttcgacttatgcgagggcaccacggtcgtggttgatgagcactgcggcaataggggaccgagcttgcggaccaccaccgtcacgggcaaaatcatccacgagtggtgttgccgctcctgcaccctgccgcccctccggttcaagggggaggacggctgttggtacgggatggagatcaggcccgtgaaagagaaggaggagaatctggtcaagagcatggtctccgccggctccggcgaggtggacagcttttccttagggctcctgtgcatcagcatcatgatcgaggaggttatgcggtcgcgctggagccggaagatgctgatgaccggcaccctcgccgtcttcttccttctgatcatcgggcagctaacgtggaacgacctgatccgcctgtgtatcatggttggggcgaacgcctccgaccgcatggggatgggcaccacatacctcgccctgatggccacattcaagatgcgaccgatgttcgccgtagggctcctgtttcgccggctgacaagccgcgaggtcctgctcctgactatcggtctgtccttggtcgcgtctgtcgagctgcccaactccctggaggagctcggcgacggcctggccatggggataatgatcttgaagctcctgaccgacttccagagccaccagctgtgggccaccctcctgtccctgactttcattaagaccaccttctccctacactacgcgtggaaaacgatggcgatggtgctgtccatcgtgagcctgttccccctctgtctgtccaccacgagtcagaagacgacctggctgcccgtcctcctggggtccctaggttgcaagccgctcactatgttcttaatcgccgagaacaagatctggggtcgtcgcagctggccgctgaacgaggggatcatggcggtgggcatcgtgagcattctcctgtccagcctgctcaagaacgacgtacccctggcggggcccctgatagccggcggcatgctcatcgcatgctacgtgatctccgggagttccgccgatctttcactggagaaggccgccgaagtgagttgggaggaggaggcggagcacagcggagcgtcccataacatcctcgtcgaggtgcaagacgacggaaccatgaagatcaaagatgaggagagggacgacaccctgactatcctgctcaaggctacactgctggccgttagcggcgtctatccgctctccatccccgccacgctgtttgtgtggtatttctggcagaaaaagaagcagcgcagcggcgtgctgtgggacacaccctctccgcccgaggtcgagcgggcagtgcttgacgacggcatttacaggatcatgcagaggggcctgttagggcgaagccaagtgggcgttggggtgttccaggagaacgtgttccacaccatgtggcatgtcacccggggcgcggttttaatgtaccaggggaagcgccttgagccgtcgtgggccagcgtgaagaaggacctgatctcgtacggcggcgggtggagactgcagggcagctggaacacgggtgaggaggtccaggtgatcgccgtggagccaggcaagaaccccaagaacgtccagaccgctccagggacgttcaaaaccagtgagggagaggtgggcgccattgctctcgacttcaagcccgggaccagcgggagccccatagtaaaccgcgagggcaagatcgttggtctgtacggcaacggagtagtgaccacctctggcacctatgtcagcgccatcgcccaggccaaggcgtcccaggaggggccccttcccgagatcgaggacgaagtctttcggaagcgcaacctcacgatcatggacctgcaccccgggagcgggaaaaccaggcggtacctgcccgccatcgtgcgggaggccatcaagcgcaagctcaggaccctgatcttggccccgacacgggtcgtggcctccgagatggccgaggccctaaagggcatgcccatccgctaccagactacagccgtcaagagcgagcacacgggcaaggagatcgtcgaccttatgtgtcacgccaccttcacgatgcgcctgttgtcccccgtgcgcgtgcccaactacaacatgattatcatggacgaagcccacttcaccgatccgagctccatcgcagcccgtggttacatcagcacccgcgtcggcatgggtgaggccgcagccatcttcatgaccgcgacgccgcccggctccgtggaggccttcccccagagcaatgccgtgatacaggacgaggaacgggacataccggagcgctcctggaacagcgggtacgaatggatcaccgacttccccggcaagaccgtctggttcgtgccctccatcaaatcaggcaacgacatcgccaattgcctccggaagaacggaaaacgggtgatacagctgtcccggaagaccttcgacacggagtaccagaaaaccaaaaacaacgactgggactatgtcgtgaccaccgatatcagcgagatgggcgcgaacttccgcgccgaccgggtgatcgaccctagacggtgtctcaagccggttatcctgaaggacgggcccgagcgcgtgatcctcgccggccccatgcccgtcacggttgcctccgccgcgcagcggcgtgggcggatcggtcgcaaccacaacaaggagggcgaccagtacatctacatgggtcagccgctcaataacgatgaggaccatgcccactggacggaggcgaagatgctgctggacaacatcaacaccccagagggcatcatccccgccctcttcgaaccagagcgcgagaagagcgccgcgatagacggggagtaccgtctgcgcggagaggcccggaagacgttcgtggagctgatgcgccggggggatctcccagtctggctgagctataaggtggccagtgagggcttccagtacagcgacagacgttggtgcttcgacggcgagcgcaacaaccaggtgctggaagagaacatggacgtagagatctggactaaggagggggagcggaagaaactccgcccccggtggctggacgcccgcacatactccgaccccctagccctcagggagttcaaggagttcgccgctgggcgaaggagcgtgtccggtgacctcatcctggaaatcggcaagctcccccagcacctgacgcagcgtgcccagaacgccttagacaacctcgtaatgctacacaacagcgagcagggaggtcgggcgtacagacacgccatggaggaactccctgacactatcgagacgctcatgctgctggctctcatcgccgtcctgaccggcggggtgaccctattcttcctctccggccgggggctggggaagaccagcatcgggctgctctgcgtgatggcctccagcgtcctgttatggatggcgtccgtggagccccactggatcgccgccagcatcatcctcgagttcttcttgatggttctgctcatccccgagcccgacagacaacggaccccacaggacaaccagctggcttacgtcgtgatcggcttgctcttcatgattctgacggtggccgccaacgaaatgggcctgctcgagaccacgaagaaggacctgggaatcggccacgtcgccgtggagaaccaccaccacgcagccatgctggacgttgaccttcaccccgcctccgcgtggaccctatacgccgtcgccacgaccatcataacccccatgatgcgacacacgattgaaaacacgaccgccaacatcagcctgacggcgatcgcaaaccaggccgcgatcttgatggggctggacaagggctggcctatctccaagatggacatcggggtgcccctgctcgcactcgggtgttacagccaggtgaaccccctgaccctcacggctgccgtcctgatgctggttgcgcactacgcgatcattgggcccgggctccaggccaaggcgacccgcgaggcccaaaagcggactgccgcgggcatcatgaagaacccaactgtggacgggatcgtcgccatagacctagatcccgtggtgtatgacgcgaagtttgagaagcagctgggccagatcatgctcctgatcctgtgcacctcccagatcctcttgatgcgcaccacctgggccctgtgcgagagcattaccctagccacgggcccgctgaccaccctgtgggaggggagccccggcaaattctggaacaccacgattgcggtcagcatggctaacatcttccgggggagctacctggccggggccggtcttgccttctctttaatgaagtccctcgggggtgggcggcggggcaccggggcccagggcgagaccctgggcgaaaaatggaagcgccagctgaaccaactctctaagtctgagttcaacacttacaagcggtcggggatcatggaggttgaccgcagcgaggcgaaggagggcctgaagcgcggcgaaacgaccaagcacgccgtgtcccgcggcaccgcaaagctgcggtggttcgtcgagaggaacttcgtgaagccggaggggaaggtaattgacctaggctgcggccgcggggggtggagctactactgcgctgggctcaaaaaggtcaccgaagtgaagggctacacgaaaggggggccgggccacgaggagccaatccccatggccacctacgggtggaacctggtgaagctgcactccggcaaagacgtgtttttcatcccgcccgagaagtgcgacaccctcctgtgtgacatcggcgagagctccccaaaccccaccatcgaggaaggccgaacgctgcgagtgctcaagatggtggagccgtggctgcgcgggaaccagttctgcatcaagatcctgaacccctacatgcccagcgtcgtggagaccctcgagcggatgcaacgtaagcacggcggcatgctggtgcgcaaccccctatcccgcaactccacccacgagatgtactgggtctcctgtggtacgggcaatatcgtgagcgcggtgaacatgacttcacgaatgttactaaaccggttcacgatggcccaccgcaagcccacctacgagcgggacgtcgacctcggggccggcacacgccacgtggccgttgaacccgaggtggccaacctcgacatcatcggccagagaatcgagaacataaagcacgagcataagagcacctggcactacgacgaggacaacccatacaagacgtgggcctaccacgggtcatacgaggtgaagcccagcggctcggcctcatctatggttaacggcgtggtcaagctgctgaccaagccgtgggacgtcatccccatggtgacccagattgccatgaccgacacaacgccctttggtcagcagcgcgtgttcaaggagaaagtcgacacccggacacccaaggccaagcgcgggactgcccaaatcatggaggtgaccgctaagtggttatggggatttctgtcccgaaataagaagccacgcatctgtacccgggaggagttcacccgcaaggtgcgcagtaacgcggccataggcgccgtcttcgttgacgaaaaccaatggaactccgcgaaggaggccgtggaggacgagcgattttgggacctggtacatcgtgagcgggagctccacaaacaagggaagtgcgccacgtgcgtgtataacatgatgggcaagcgcgagaagaagctgggggagttcggcaaggccaaggggagccgcgccatctggtacatgtggctgggcgcgcggttcctcgagttcgaggccttaggctttatgaacgaggatcactggtttagtagagaaaatagcctctccggggtagagggcgaggggttacacaagttaggctatatcctacgggacatctcgaagattcccgggggcaacatgtacgccgacgacacggccggatgggacacccggataactgaggacgatctccagaatgaggccaagatcaccgacataatggagcccgagcatgcgctgctggccaagagtatcttcaagctcacctaccagaacaaggtcgtgcgcgtacagcgtccggctaagaacgggaccgtcatggacgtgatcagccgcagagaccagcgcggctccggccaggtgggcacgtatggcctgaatactttcaccaacatggaggcccagctgatccggcagatggagagcgaggggatcttctcccccagcgaactcgagacccccaacctggccggacgggtactagactggctcgagaagcacggggtggagcgtcttaagagaatggcgatctccggcgacgactgcgttgtcaaacccatcgacgataggttcgcgaccgctctgacggccctcaacgatatggggaaggtacgcaaggacatcccacagtgggagcccagcaagggctggaacgactggcagcaggtccccttctgctctcaccacttccatcagctgatcatgaaggatggtcgtgagatcgtcgtaccctgccgcaaccaagatgagctggtggggcgggctcgcgtttcacaaggcgcggggtggagcctccgggaaacagcctgtctgggcaagtcctacgcccagatgtggcagctgatgtacttccaccgccgggacctccgcctggccgcaaacgccatctgcagcgcagttccagtggactgggtccccacctctcggactacatggagcatccacgcacaccaccagtggatgaccaccgaggatatgctgtccgtgtggaatcgagtctggatcgaggagaacccctggatggaggacaagacccatatcagttcctggggcgacgtaccctacctcgggaagcgagaggaccagtggtgcggatcgctgatcgggctgacggctcgggcgacctgggccacaaacatccaggtggccatcaaccaggtgcgccggctaataggcaacgagaactacctggattatatgacctccatgaagcgcttcaagaacgagagcgacccggaaggggccctgtggtag

SEQ ID NO: 24256 - RNA, 9879 nt, synthetic construct
  misc_feature 1..9879: note = derived and/or modified CDS sequence (opt11) from DENV-1__FJ882526__SS-prME
  source 1..9879: mol_type = other RNA
agcgtgaccatgcttctgatgctgatgcccaccgccctggcctttcacctcacgacccggggcggcgagccccacatgattgtgagcaagcaagagcggggaaagagcctgctgttcaagacctccgctggcgtgaatatgtgcaccctcatcgccatggacctgggggagttctgcgaagataccatgacctataaatgcccccgaatcaccgaggccgaaccggacgacgtggactgctggtgcaacgcaaccgacacgtgggtgacttatgggacctgtagccaaaccggggagcaccgtcgggacaagcgctcagtggccctggcgccccacgtcggcctcgggctggaaacgcgaaccgagacctggatgtcttccgagggcgcctggaaacagatacagcgggtcgagacttgggccctccgccatcccgggtttacggtgatagccctcttcctcgcgcatgcgatagggaccagcatcacgcagaaggggataatcttcatcctcctcatgctggtgacccccagcatggccatgcggtgcgtcggcattggctctagggacttcgtggaagggctgtccggcgccacgtgggtagacgtcgtactcgagcacgggagttgcgttaccaccatggccaaggacaagcccaccttggatatcgagctgctcaagacagaggttaccaaccccgcggtactacggaagctgtgcatcgaggccaagatatccaacacgacgacggacagccgctgcccgacccaaggcgaggccaccctcgttgaggagcaggacgccaacttcgtctgccggcgcaccttcgtggatcgaggctggggcaacggctgcgggctgttcggcaaggggagtctaattacttgcgcaaaattcaagtgcgttaccaagctcgagggaaagatcgtacagtacgagaacctgaagtatagcgtgatcgtgactgtccatactggcgaccagcaccaagtgggtaacgaatccacggagcacggaacaaccgccaccatcacaccccaggccccgagcacggaaatccagctcaccgactatggggccttaaccctcgattgcagcccccggaccggcttagactttaacgagatggtactcttaacgatgaaggaaaagagttggctggtgcacaaacagtggttcctcgaccttccgctgccctggacatccggggcctcgactagccaggagacctggaaccggaaggatctcctggtgacgttcaagaccgcgcacgcgaagaagcaggaggtcgttgtgttgggctcccaggagggcgccatgcacaccgccctcaccggggccacggagatccagaccagcgggaccaccactattttcgccggccacctgaagtgtcgcctgaagatggacaagctcaccctgaagggcatgtcttacgtcatgtgcaccgggagcttcaagctggagaaggaggtcgcggaaacccaacacggcacggtcctcgtccaaatcaagtacgagggcacagacgccccatgtaagatcccgttcagtactcaggatgagaagggggtgacccaaaacggccggctgatcacagccaaccctatcgttaccgacaaggagaagccggtcaacatcgaagccgaaccgccctttggagagtcctacatcgtcattggcgcgggcgaacgtgctcttaagttgtcctggttcaagaagggaagctcaatcggcaagatgttcgaggcgaccgcaagaggggcccgccgcatggcgatcctcggcgacacggcgtgggatttcggatcgatcggcggggtgttcacgtctgtcgggaagctggtgcaccagatcttcggcaccgcctacggggtgctgttcagcggcgtctcctggaccatgaagatagggatcggcgtgctcttaacctggctgggcctcaatagccggtccacgagcctcagcatgacttgtatagctgtcgggctggtcaccctctacctgggcgtgatggtgcaggccgatagcgggtgcgttatcaactggaagggccgcgaactgaagtgcgggagcggcatcttcgtgacaaacgaagttcacacctggaccgaacagtacaagttccaggcggactcgccgaaacggctcagcgcagccatcggaaaggcctgggaagaaggtgtatgcggcatccgctctgccactcggctggagaatatcatgtggaagcagatctctaatgagctgaaccacatcctcctggagaacgatatgaagttcaccgtcgtagtaggggacgtagcgggaatcctagcccagggtaaaaagatgatccgcccccagcccatggagtacaagtactcctggaagtcctggggcaaggcgaagatcatcggtgccgacgtgcagaacaccacgttcattatcgacggtcccaacaccccggagtgccccgacgaccagcgtgcctggaacatctgggaggtcgaagactatggattcggcatcttcaccaccaacatttggctcaagctgcgcgactcctacacccaggtctgcgaccaccggctgatgagcgccgcaatcaaggactccaaggccgtgcatgccgacatgggctactggatcgagagcgagaagaacgagacttggaagttagcgagggcctccttcatcgaggtcaagacctgcatctggcccaagagccacaccctgtggtcgaatggtgtactggagagtgagatgatcatccccaagatctacgggggcccgatctcccaacataactatcggcccgggtattttacgcagaccgcgggcccctggcacttagggaagctggagctggactttgacctctgtgaaggcaccaccgtggtagttgacgagcactgcggcaaccgggggccatcactgaggactaccacagtcaccggcaaaatcatccacgagtggtgttgtcgctcctgcacgttaccgcccctgcggttcaaaggagaggacggctgttggtacgggatggagatccgtccagtcaaagagaaggaggagaatcttgtgaagagtatggtaagtgccggctccggcgaggttgacagcttctctctcgggctcctttgcatcagcatcatgatcgaagaggttatgcggtcccgctggagccgaaagatgctgatgaccgggaccctcgccgtattcttcttactgatcatggggcagctcacctggaacgatctgatccggctgtgcatcatggtcggcgcgaacgccagcgatcgcatggggatgggcactacctacctcgccctgatggccacctttaagatgcggccgatgttcgccgtgggtctcctgttccgccggctgaccagccgcgaggttctgctattaacgatcggtctctcgcttgtcgcgagcgtggagttacctaactccctcgaagaactgggagatggactggccatggggatcatgatactgaaactcctgaccgacttccagagccatcagctgtgggccaccctcctgtcactgaccttcatcaagactaccttcagcctccactacgcgtggaagaccatggcgatggttctgtccatcgtgtcgctgttccccttatgcctatccaccacgtcccagaagaccacctggctgcccgtgctcctggggtccctagggtgcaagcccctgaccatgttcctgatcgcggagaacaagatctggggccgcaaatcatggcctttaaacgagggaatcatggccgtgggcatcgtgtctatcttgctgtcagccctgctcaaaaacgacgtgcccctggcggggcccttaatcgccggcggcatgttgatcgcctgttatgtcatcagcggttccagtgctgacctgtccctggagaaggccgccgaggttagttgggaggaagaggcggaacattccggcgccagccacaacatcttggttgaggtacaggacgacgggacgatgaagattaaggatgaggagagggacgacacgctgaccatactgcttaaggccacccttctggccgtttcgggcgtgtatccgctctccatccccgccaccctgttcgtttggtatttctggcaaaagaagaagcaacggtccggggtgctgtgggacacccccagcccacccgaggtagagcgtgcggtactcgacgacggtatttaccggataatgcagcgcggtcttttagggcggagtcaggtgggggtaggtgtcttccaggaaaatgtgttccacaccatgtggcatgtgacccgcggcgcagtcttaatgtaccaagggaaacggctcgagccctcttgggcctccgttaagaaggacctgatcagctatgggggcggttggaggctacagggctcctggaacaccggcgaagaggtgcaggtcatcgccgttgagcccggaaagaaccctaagaacgtccagacggccccaggaaccttcaagacaagtgagggcgaagtcggagctatcgccctcgacttcaagcctgggacatccggcagccccatagtgaaccgggaggggaagattgtgggcctgtacggcaacggggtcgtgactaccagtggcacctacgtgtccgccatcgcccaggcaaaggccagccaggaggggcccctgccggagatcgaggacgaggtctttagaaagcggaacctcaccatcatggatctgcaccccggctccgggaagacgcggcggtacctgcccgcgatcgtgcgcgaagccataaagcgaaaactccgcaccctgatccttgccccgacccgcgtggtagcgtcggagatggccgaggccctcaagggcatgcctatccggtaccagaccacggccgtgaagtccgagcacaccggcaaggagatcgtggatctgatgtgccatgccacgttcaccatgcgcctgctcagccctgtccgggtgcccaattacaatatgatcatcatggacgaggctcactttacagacccgagtagcatagctgcccgcgggtacatctccacacgagtgggcatgggggaggccgccgcaatatttatgacagccacgcctccgggcagcgtggaggccttcccccagagcaacgcggtgatccaggacgaagaaagggacatccctgagcggtcttggaactcgggttacgagtggatcacagactttcctggtaagaccgtgtggttcgtccccagcatcaagtccggcaacgatatcgcgaactgccttcggaagaatgggaaacgtgtgatccagctgagccgtaagaccttcgacaccgaataccagaagacgaagaacaacgactgggactacgtggtcaccacggacatctccgaaatgggagccaactttcgggccgatcgcgtaatagacccccggcgctgcctcaagccggttatcctcaaagacggccccgaacgggtcatcctggccggccccatgcctgtcaccgtagcttccgcggcgcagagacgcgggcgtatcggccggaaccacaacaaggagggtgaccagtacatctatatggggcagccgctcaacaatgacgaggaccacgctcactggacggaagccaagatgctgctggataatataaacacacccgagggcatcatccccgcccttttcgagccagagcgagagaagtccgcggccatcgacggagagtaccgcctgcggggagaggctcgcaagaccttcgtggagcttatgcggcgcggggacctgccggtgtggctaagctacaaggtagccagcgaaggattccaatactccgaccggcgctggtgttttgacggcgagcggaacaaccaggtgctggaggaaaacatggatgtggagatctggaccaaggagggggagcggaaaaagctcagacctcgctggttggatgcccggacgtatagcgacccactggccttacgcgagttcaaggagttcgctgccggccggcgctctgtctcaggcgatttaatactggagatcggcaagctccctcaacacttgacccagagggcccagaacgcgctggacaacctcgtgatgctgcacaacagcgagcagggaggtcgcgcctaccggcacgctatggaggagctgccagacacaatcgagaccctcatgctgctcgccctcatagccgtgctgactggcggggttacgctattctttctctctggccgcgggcttggcaagacctcaatcgggttgctctgcgtgatggccagctccgtgctactgtggatggcatcagtagagccccactggatcgccgcctccatcatcctcgagttctttctgatggtgctcctcatccccgagcccgaccgccagagaaccccacaggacaatcaactggcctacgtggttatcgggctcctctttatgatcttgacagtggcggccaacgagatgggactgctagaaacgacaaagaaggatctagggatcggccacgtggccgtcgagaaccatcaccacgcagccatgctggacgtggacttgcaccccgcgagcgcttggacgctgtacgccgtagccaccacgatcattaccccgatgatgcggcacaccattgagaacactacggccaacatctcccttaccgccatcgccaaccaggccgccatcctcatgggactggacaagggttggccgattagcaagatggacattggcgtcccgctgctcgcgctggggtgctattcccaagtgaatcccctgaccctcaccgctgccgtgctgatgctcgtcgcccattacgcgatcatcggccccgggttacaggcgaaagcgacgcgcgaagcccagaagcgcaccgccgcgggcattatgaagaaccccaccgtggacggaatcgtggcgatcgacctcgaccccgtcgtgtacgacgccaagttcgagaagcaactggggcagatcatgctcctgatcctgtgcacctcacagatactccttatgcggacgacctgggctctgtgcgagtccatcaccctcgctacaggtcccttgacgaccctgtgggaggggagccccggcaaattctggaacaccacaatcgccgtgtccatggcgaacatattccgcgggtcgtacctagccggcgccgggctggcgtttagcctgatgaaatccctcggaggagggagacgtggcacgggggcgcagggcgaaacgctgggcgagaaatggaagcgacagctcaaccagctgtccaagtcagagttcaacacctacaagcgaagcggaatcatggaggttgaccggtccgaggctaaggaaggtctgaaaagaggggaaaccacgaagcacgccgtgagccggggcaccgccaagctgcgctggttcgtggaaaggaacctagtcaagccggagggcaaggtaattgacctgggctgcggcaggggcggctggtcctactactgcgccgggctaaagaaggtgactgaagtcaaggggtacaccaagggtggacccggccatgaggagccgatccccatggcgacctacgggtggaacctggtgaagctccactctggcaaagacgtgttcttcatcccgcccgagaagtgcgataccctgctgtgcgatattggggaaagctcgcctaaccccaccatagaagaggggcggaccctccgcgtcctgaaaatggtggagccgtggctgcgggggaaccagttctgcatcaagattcttaacccctacatgccctccgtggtcgagaccctcgagcaaatgcagcgcaagcatggcggcatgctggttcggaaccccctcagccgcaactccacccacgagatgtactgggtgtcctgcgggacgggcaacatcgtatccgccgtaaacatgaccagcaggatgttgctgaaccgcttcaccatggcccacagaaagccaacttatgagcgcgacgtagacctcggggccggcacccgccacgtggctgtcgagcccgaggtggcgaacctggacattatcggccagcggatcgagaacataaagcacgagcacaagtccacatggcactatgacgaggacaacccctataagacctgggcctaccacgggagctacgaggttaagccatccggtagtgcctcctccatggtgaacggagtcgtgaagctacttacgaagccgtgggacgtaatccccatggtcacccaaatagccatgaccgatacaacgcccttcggtcagcagcgtgtgtttaaggagaaggtggacacccggacccccaaggccaagcgtgggacagcgcagatcatggaggtcactgcaaagtggctgtggggctttctgagccggaacaagaagccgcgcatctgcactcgagaagaatttacccgcaaagttcggtccaatgcagccatcggggcagtgtttgttgacgagaaccaatggaatagcgccaaggaggccgtggaggatgaacgcttctgggacctcgtccaccgggagcgcgagctgcacaagcaggggaagtgcgcgacttgcgtctacaacatgatggggaagcgggagaagaaattaggggagtttggcaaggccaaagggtcccgtgcaatttggtatatgtggctcggcgcccgtttcctggagttcgaggccctgggcttcatgaacgaagatcactggttcagccgagagaacagcctcagcggggtggagggcgagggactgcacaagctgggttatatcttacgggacatctccaagatccccggcggaaacatgtacgcggacgacaccgctggctgggacacccgcatcactgaggacgacctgcaaaacgaggcgaagatcaccgatattatggagccagagcacgccttactcgccaagagcatcttcaaattaacgtaccagaataaggtggtccgggtgcagcgcccggccaagaacgggaccgtgatggacgtcataagccgccgggaccagcgcggcagtggtcaggtaggaacctacggcctgaacaccttcaccaacatggaggcccagctaatacggcagatggagtcagagggaatctttagcccctccgagctggagaccccgaacttagccggccgcgtgctcgattggctggagaaacacggggtcgagcggctgaagcgcatggccatcagcggcgatgactgcgtggtgaagccaatcgatgatcggttcgccaccgccctcactgccctcaacgacatgggaaaggtccgcaaagacatcccgcagtgggagccctctaagggctggaacgactggcagcaggtccctttctgtagccaccatttccaccagctgatcatgaaggacggccgtgagatcgtggtcccctgccgcaaccaggacgagctcgtggggcgagcaagggtgagccagggcgcagggtggtccttgcgggagacggcctgcctaggcaagagctacgcccagatgtggcaactcatgtacttccaccgccgggacctgagactggcggccaacgcgatctgttccgcagtccccgttgattgggtgcccaccagccggaccacctggtccatccacgcccatcatcagtggatgactactgaggacatgctgagcgtatggaaccgcgtttggatcgaggagaacccctggatggaggataagacccacatctccagctggggcgacgtgccgtatttaggcaagcgggaggaccagtggtgcgggtccctgattgggctgactgcgcgcgccacctgggccacaaatattcaggtggctattaaccaggtgcgccgactgatcggcaacgagaactaccttgattatatgaccagcatgaaacgtttcaagaacgaatccgacccggagggggctctgtggtga

SEQ ID NO: 24257 - RNA, 9879 nt, synthetic construct
  misc_feature 1..9879: note = derived and/or modified CDS sequence (opt11) from DENV-1__FJ882527__SS-prME
  source 1..9879: mol_type = other RNA
agcgtgaccatgctgcttatgctgatgcccaccgccttagccttccacctcacaacccgcggaggagagccccacatgattgtgagcaaacaggagaggggcaaaagtctgctgttcaagacgtcggccggggtgaatatgtgcacactgatcgcgatggatcttggtgagttttgcgaagacaccatgacctataaatgccccaggattacagaagccgaacccgatgacgtggattgctggtgcaatgcgaccgatacctgggtcacctacgggacatgcagccagaccggcgaacataggagggacaaaaggtccgtggccctggcgccccacgtggggctggggttagaaacgcgcaccgagacatggatgagcagcgagggcgcctggaagcagattcagcgggttgaaacatgggctctgagacaccctgggttcactgtgatagccctgttcctggcgcacgcaatcggcacttctataacccagaaggggatcatctttatcctgctgatgctggtaaccccatccatggccatgcggtgcgtcggcatcggcagccgcgattttgtggaggggctgagtggtgctacgtgggttgacgtcgtcttggagcacgggtcttgcgtgacgactatggctaaggacaagccaaccctcgacatcgagctgctaaaaactgaagtcacgaaccccgcggtgcttcggaagctttgcatcgaggcaaagatctccaacacaaccaccgacagccgctgtcccacgcaaggagaggccacgctggtggaggagcaagatgcgaacttcgtctgtcgacggaccttcgtggaccggggctgggggaatggctgtgggctcttcgggaagggttctctgatcacatgcgccaagtttaaatgtgtgaccaagcttgagggcaaaaccgtgcagtacgagaaccttaagtactctgtgatagtgactgtacacacaggagaccaacaccaggtagggaacgagtccaccgaacatggcaccacagcgaccatcacgccccaagcacccagcactgagatacagctgactgactacggggcactcaccctggactgcagtccacgtacgggactagatttcaacgaaatggtcttgctgaccatgaaagagaaaagttggctggtgcacaagcagtggttcctcgacttacccctgccgtggaccagcggagcctccaccagccaggagacgtggaacaggaaggatctgctggttacctttaagaccgcgcacgccaagaagcaggaggtcgttgtactgggctcccaggagggcgccatgcacaccgccttaacgggggcaacagagatccagaccagcggaaccactactatctttgcgggacacttgaagtgccgcctgaagatggacaagttaacccttaaggggatgtcctacgtcatgtgcaccggcagcttcaagcttgagaaagaggtcgcggagacgcaacacggtacggtgctcgtgcagatcaaatacgagggcaccgacgctccctgtaagataccctttagcacccaggatgaaaagggcgtgacgcagaatggccggctcatcaccgccaaccccatagtcaccgacaaggagaagcctgttaatatcgaggccgagccaccctttggggagtcatatatcgtgatcggagcgggagagaaagccctgaaattgtcttggttcaaaaaggggtcgtccatcggcaagatgttcgaggccaccgcaagaggggcccgccgcatggcaattctgggagacactgcatgggatttcggtagcatcggcggagttttcacatctgtggggaagctggtccaccagatcttcggtaccgcctacggggtgttattctctggcgtctcatggaccatgaagatcggcattggcgttcttttaacgtggctggggctcaatagcagatcaaccagcctttccatgacctgcatcgcagtggggctggttaccctctacctaggtgtgatggtgcaggcggactccgggtgcgtaatcaactggaaagggcgagagctcaagtgtggcagcggaattttcgttacaaatgaagtgcacacgtggactgagcaatataaatttcaggcggactctccgaagagactcagcgccgccatcggcaaggcttgggaggagggggtctgcggcatcaggagtgctacccgactggagaacatcatgtggaaacagatcagtaacgaactgaaccacatcctccttgaaaacgacatgaagtttaccgtggtcgtcggtgatgtcgcgggcatcctggctcagggaaagaagatgatccggccccagcccatggagtacaagtactcgtggaagtcgtggggtaaggctaagattatcggtgccgatgtgcagaacacgacctttatcatagacgggcccaacaccccggaatgtccggacgaccagcgcgcttggaacatctgggaggtcgaagattatggctttgggattttcaccacgaacatctggctgaagctgcgggacagttacacacaggtgtgcgaccaccgccttatgagtgccgccattaaagactccaaggccgttcacgccgacatgggctactggatagagtctgagaaaaatgaaacatggaagctggcgcgggcgtccttcatcgaggtcaaaacctgcatctggcccaaatctcacacgctctggtccaacggagtgctggagagcgagatgatcattcccaaaatctacgggggtccgatctcccaacacaactatcgccccgggtactttacgcagaccgccggaccctggcatttggggaagttggagctggacttcgacttatgcgagggcactaccgttgtggtggacgagcattgtggcaatcggggccccagcctgcgcaccacgactgtcacagggaagatcatacatgaatggtgctgtcggtcctgtacgctgccgcccctgcgatttaagggggaggatggatgctggtatggaatggagatccgacccgtcaaagaaaaagaggaaaacctggttaagtctatggtgagcgccggctcgggggaggtcgactctttctccttggggcttctgtgcatttcaatcatgatcgaagaggtgatgcgctcccgctggtctcgcaagatgctaatgacgggcacgcttgcggtgttcttcctgttgattatgggccagctgacatggaacgatctgatcaggctttgcatcatggtgggcgcgaacgcctccgaccgcatggggatgggcaccacttatctcgcgcttatggccacgtttaaaatgcgcccaatgctagccgtgggcttactgtttcggcgcctcacgagtcgggaggtgttactcctgaccatcggtctgagcctggtcgcaagcgtggagcttcccaattccctcgaggagcttggggacggtttagccatgggtatcatgatcttaaaactactgacggacttccaatcccaccagctctgggctacccttctgtccttgacgtttatcaagacaaccttcagcctacactacgcctggaagaccatggcgatggttctgtccatcgtcagcctcttccccctgtgcctaagcactacgagtcagaagaccacctggcttccggtactccttggatccctcgggtgtaagccgttagcgatgttcctgatagcagagaacaagatctggggccgtaaaagctggcctctcaacgagggaataatggccgtaggcatcgtgtctattctgctgagcagcctcctgaagaatgacgttcccctggcggggcccctcatcgccggcggtatgcttatcgcctgctacgtcatctctggctctagtgccgacctgagccttgaaaaggccgcggaagtctcgtgggaggaagaggcggagcacagcggagcctcgcacaacatcctagtggaggttcaggacgatgggacgatgaaaataaaggacgaggagagagacgataccctgacgatcctcttaaaggcaacactgctcgccgtgtcaggcgtgtaccccctgtccatcccagctaccctgttcgtttggtacttctggcaaaagaagaaacagcgaagcggggttctttgggatacgccttcaccgcccgaggtggagcgggcggtcttagacgacggaatataccgcatcatgcagagaggcctgctaggtcgctcccaggtgggagtgggggtgttccaagagaatgtgttccacaccatgtggcatgtgacccgcggagccgtacttatgtaccagggaaagcgcctcgagccctcctgggcctctgttaagaaggacctcataagctacggaggcggatggcgtttacagggcagctggaacaccggtgaggaggtgcaggtcatcgctgtagagcccggcaagaacccgaaaaacgtccagaccgcccctgggaccttcaagacgtctgagggtgaggtcggcgcaatcgcccttgactttaagcctgggacctcaggcagccccattgtcaacagagagggaaagatcgttgggctatatggcaacggggtggtgacgacatccgggacctacgtgagcgcaatcgcacaggcgaaggccagccaggaagggcccctcccagagatcgaggatgaggttttccggaagcgcaacctgaccatcatggacctgcatccaggcagcgggaagactcggaggtatctccccgccatcgttcgggaggcaatcaagcgcaagctgcggaccctaatcctcgccccgacccgcgtggtggcgagtgagatggcggaagcattgaagggaatgcccatccgataccagaccaccgccgtcaagtcagagcatactgggaaagagatagttgacctgatgtgccacgcaaccttcacaatgcggttattgtccccagtacgcgtgccaaactataacatgataatcatggacgaagctcacttcacagaccctagctccatcgccgcccgggggtatataagtacacgcgtgggcatgggggaagctgccgcgatattcatgaccgccaccccgcccggctccgtcgaagcgttcccccagagcaatgccgtgatacaggacgaggagcgagacatccccgaacgctcttggaatagtgggtacgagtggataacagacttccctggcaagactgtgtggttcgtaccctccattaagtcgggaaacgacatcgccaactgccttagaaagaatgggaagcgtgtaatacagctcagccgaaagaccttcgacaccgagtaccagaagacgaagaataatgactgggattacgtagtgacaacggacatcagtgagatgggcgctaacttccgcgctgaccgtgtgatagatccccgacgttgcctgaaaccggtgatcctgaaggacgggcccgagcgggtgatactcgccggcccgatgcccgtcaccgtcgcatccgcagcgcagcggcgcgggcggataggccgcaaccacaacaaggagggggaccaatacatctacatggggcagcccctgaacaacgacgaggatcacgctcattggacagaggctaaaatgctcttagataacattaacacccctgaaggaatcatccccgcgctgttcgagcccgaacgggaaaaatccgcggctatagacggtgaataccgcttacgtggggaggctcggaaaaccttcgtggagctaatgagacgcggcgacctgccggtgtggctgagctataaagtcgcctccgagggcttccagtacagcgaccgcagatggtgctttgacggtgagcgtaacaaccaggtgttggaggagaacatggacgttgagatctggaccaaggagggggagcggaagaagctgcggcccagatggctagatgccagaacgtactccgaccccttagccctgcgggaatttaaagagttcgcagcgggccgaagaagcgtttctggggatctaatccttgagattgggaaactgcctcagcacctgacacagcgcgcccagaatgcactcgacaacctggtgatgcttcacaactcagagcagggcgggcgggcgtacagacacgccatggaggagctcccagacactatcgagaccctgatgctgttggccctgattgccgtgctgacgggtggggtaactttgttctttctgtccgggcggggtctgggcaaaacgtctataggcctcttatgcgtcatggcttccagcgtgctcctttggatggccagtgttgaacctcactggatcgccgccagcatcatcctggagttcttcttgatggtgctactgatccccgagcccgaccgccagcgtactccccaggacaaccagctggcctacgtggtcatcgggcttcttttcatgatcctgaccgtggcggccaatgagatgggactcttagagacgaccaaaaaggatttggggataggccacgtcgccgtggagaatcaccaccacgcggccatgctcgacgtggacctgcatcctgcttcagcatggacgctgtacgctgtggccaccacgatcatcacccccatgatgagacataccatcgagaacacgaccgcaaacattagcctcaccgcgatcgcaaaccaggcagccatcctcatggggttggacaagggctggccgatttcgaagatggacatcggggtgccactcctggcactggggtgctacagccaagttaaccccctcactttaacggccgcggtgctaatgctcgtggcccactacgcgataattggccccgggctgcaagcgaaggccacgcgggaggcccagaaacgcactgccgcgggcataatgaagaatccgactgtggacgggattgtggccatcgatttggacccggtagtctacgacgccaaattcgagaagcagttggggcagataatgcttttaatcttgtgcacgtcacaaatcctgctgatgcgcacgacctgggctttgtgtgaaagtataaccctggcaaccggccccctgacgaccttatgggaaggctcccccggaaagttttggaacacgaccatcgctgttagcatggcaaacatatttcgggggagctacctcgctggcgccggcttagccttctccctcatgaagagccttgggggcggaagacggggcacaggggcgcagggcgaaaccctgggagaaaagtggaagcgccagctcaatcagttaagcaagtctgagttcaacacctacaaacggtccgggataatggaggtcgaccgcagtgaggctaaggagggcctaaaacgcggggagacaacgaagcacgcggtaagtcgcgggaccgcaaagctccgatggttcgtagaacggaacctggtcaagccggaagggaaagtgatcgacctgggctgtggccgaggcggatggagctattattgcgccgggctgaaaaaagtgacagaggtcaaggggtacactaagggcgggccggggcacgaagagcccatacccatggcgacgtatggatggaatctcgtcaagctacactccggcaaggatgtattctttatccctcctgagaagtgtgatacactgctttgcgacatcggtgagtcgagtcccaaccccacgattgaagaaggtaggactctgagggtcctgaagatggtggaaccgtggttgcgcgggaaccagttctgcataaagattttgaacccttacatgcctagtgtggtcgagactctggagcagatgcagcggaaacacggcggaatgcttgtgcgcaaccccttatcccgcaacagcacccacgaaatgtactgggtgtcctgcggtaccgggaatatcgtatcggccgttaacatgacctcccgcatgctgttaaaccggtttaccatggctcaccgaaagccgacctatgagcgcgacgtggatctaggggcaggcacgagacacgtcgcagtggaaccagaagtggcgaacctcgacatcatcggccagcgcatcgaaaacatcaagcacgagcacaagtcaacctggcattacgacgaggacaacccctacaagacctgggcctatcacgggtcctacgaagtcaagccaagcggttctgcttccagcatggtgaacggggttgtcaagctcctcacaaaaccatgggatgttatacccatggtaacccagatcgccatgaccgacaccactccgttcgggcagcagcgtgtgttcaaggagaaggtcgacacccgaacacctaaggccaagagaggaactgcacaaattatggaggtcacggccaagtggctttggggcttcttgtcacgcaacaagaaaccgagaatttgtacccgcgaggagttcacccggaaggttcgtagtaatgctgcaataggagcggtgttcgtcgacgagaaccagtggaattcagccaaagaggcagtggaggacgagcggttttgggatttagtgcatagagagcgggagctgcacaagcagggaaaatgcgctacctgtgtctacaatatgatgggcaagcgagagaagaagttaggggagttcggcaaagccaaggggagccgggcgatttggtatatgtggctgggcgcacgcttccttgagttcgaagccctaggcttcatgaacgaggaccactggttctctcgggagaacagcctgtcgggggtagagggcgaggggctgcacaaactgggatacattctacgcgacatctccaagatcccgggcgggaatatgtatgccgacgacacagccggctgggacacgaggattaccgaggacgacctccagaacgaggcgaagataaccgacatcatggaaccggagcatgctttactggccaaatctatcttcaagctgacctatcaaaacaaagtcgtccgcgtgcagaggccggcaaagaacgggaccgtcatggatgtcatctcgcgccgcgatcaaagaggctcgggccaggtcgggacctacggactcaacacattcaccaacatggaagcccagctgatccgccaaatggaaagcgaaggaatcttttccccgagcgagcttgagacgcccaatctggccggccgagtgctggactggttagagaagcacggtgtcgagagacttaagcgcatggcaatttctggagacgactgcgtggtgaagcccatagacgaccgcttcgctacggcgctgacggctctgaacgacatgggtaaggtccgaaaggacatcccgcagtgggaaccaagcaaaggctggaacgattggcagcaagtccccttctgtagccaccacttccaccagttaatcatgaaggatggtcgcgaaatcgtagtcccgtgtcgtaaccaggacgagctcgttggacgcgcacgggtatcccagggcgcggggtggagcctgcgcgagacggcttgcctcggcaagtcctacgcgcaaatgtggcagctaatgtatttccatcggagggatctacggctcgcggccaacgccatctgcagcgcagttccggtggactgggtgccgacctctcgaacgacctggtcgatacacgctcatcaccagtggatgacgaccgaggacatgctgtccgtgtggaaccgggtgtggatcgaagagaacccctggatggaggataagacgcacatcagctcatggggcgacgtgccttacctgggaaagcgcgaggatcagtggtgtgggtcactgattgggctaacggcgagagctacctgggccaccaacatccaggtagccattaaccaggttcggcggctgattggcaacgaaaactacctcgattacatgacctcaatgaagcgcttcaaaaacgagagcgatccggagggggcgctgtggtaa

SEQ ID NO: 24258 - RNA, 9879 nt, synthetic construct
  misc_feature 1..9879: note = derived and/or modified CDS sequence (opt11) from DENV-1__FJ882529__SS-prME
  source 1..9879: mol_type = other RNA
agtgtgacaatgctattaatgctaatgccgaccgcgcttgcatttcacctgacaacacgagggggcgaaccccatatgatcgtttcgaaacaagaaagggggaaaagcctactcttcaagacaagcgcaggagtgaatatgtgcaccctcatcgcaatggacctaggagagttctgcgaagacacaatgacatacaaatgcccgcgcatcacggaagccgaaccggacgatgtcgactgttggtgcaacgcgaccgacacatgggtcacctacggaacatgctcccaaacaggggaacacaggagagacaaaagaagcgtggcactagcgccccatgtcggactaggtctcgaaacaaggacggaaacatggatgagctcagaaggggcgtggaaacaaatacagcgagtcgagacgtgggcacttcgccacccgggattcaccgtaatcgccctctttcttgcgcatgcaatagggacatcaatcacgcagaaaggtatcatcttcattcttctgatgctagtaacaccgagcatggctatgcgctgtgttggcattgggtcaagggatttcgtggaaggactaagcggcgccacatgggtcgatgtcgtactcgaacacgggtcatgtgtaacaacaatggcaaaggacaaaccgactctggacattgaactgctaaaaacagaagtaactaacccagctgtcctgcgcaaactatgcatagaagcgaagatcagcaacaccactaccgattcacgatgtcctacccaaggagaagcaacgctcgtggaagaacaagatgcaaatttcgtgtgccgtagaacgttcgttgaccgaggctggggcaatggctgcggcctctttggtaaaggctccttaataacctgtgcaaaattcaagtgtgtcacaaaactggaaggaaaaatagtacagtatgagaacctgaagtactccgtgatcgtgaccgtgcatactggggaccagcatcaagtaggaaacgagtcaactgaacatgggacgaccgccacgattacaccacaagcaccgagcaccgagatacagctaaccgactacggcgcactgacgctggactgcagcccccggacaggtctggacttcaacgaaatggtgctcctaaccatgaaggaaaagtcatggctcgtgcacaagcaatggttccttgacctacctctgccttggacctccggtgcttcaaccagccaagaaacctggaacagacaggatctcctagtcacattcaagacagcacacgccaagaaacaagaagtcgtagttttaggaagccaagaaggcgcaatgcacaccgccctaacgggcgcaaccgaaatccaaacaagtgggaccacaacgatatttgcaggacacttgaaatgccgtcttaaaatggacaaactaacactcaagggcatgtcgtacgtgatgtgcacaggcagtttcaaactcgaaaaggaagtcgcagaaacgcaacatgggacggtactggtacaaatcaagtacgagggcacagacgcaccatgtaagatcccattctccacacaagacgagaaaggtgtaacgcagaatggccgattgattacggccaatcccattgtgacagacaaggaaaagcccgtcaatatcgaagccgaacccccgttcggtgagtcgtacatcgtaataggggcgggggaaaaagcccttaagttgtcctggttcaagaaaggatcttccataggcaaaatgttcgaagcaacggccagaggggcacgacggatggcgatcctcggtgatacagcctgggacttcggcagcatcggaggcgtctttacctcggtaggcaagctggtacatcaaattttcggaaccgcatacggcgtcttattcagcggcgtctcctggactatgaaaataggcatcggggtcctattgacctggctcgggcttaatagtaggtcaacatcactttctatgacctgtatcgcagtgggactcgtcaccctgtacctgggcgttatggtacaggctgacagcgggtgcgtcattaactggaagggacgggaactcaagtgcgggtccggaatcttcgttactaacgaggtgcatacgtggacggaacaatacaaattccaagccgatagtccgaaacggctgagtgcggcaatcggcaaagcgtgggaggagggagtgtgcggaataaggagtgcgactaggctggaaaacatcatgtggaaacagataagcaacgagttaaatcacatacttctggaaaatgacgtcaagttcacagtcgtagtcggagatgtggcaggaatactagcacaaggcaagaaaatgatccgaccccaacccatggaatacaagtactcctggaaaagctgggggaaggcgaaaataataggcgctgatgtacaaaacacgactttcatcattgatggaccgaatacgccagagtgcccggacgatcagagggcatggaacatctgggaagtggaggattacggattcggaatattcaccactaatatctggttgaagctacgtgactcctacacccaagtttgtgaccacagactgatgtctgcagcgatcaaggactcgaaagccgtacatgccgacatggggtactggatagaatccgaaaagaacgaaacatggaagctagcacgtgccagcttcatagaggtcaaaacctgcatctggcctaaatcacacaccctctggagcaatggcgttctcgagtctgaaatgattatcccgaaaatatacggaggcccaatatcccaacacaactaccggccgggttacttcacacagacggcgggaccatggcaccttggaaaactcgagcttgatttcgacctttgcgaaggcacaacagtggtcgtcgacgaacactgcggcaatagaggaccctcgttgaggaccactacagtcacagggaagataatccatgaatggtgctgcaggagctgtacactgccgccgctccggttcaaaggagaagacggctgttggtacggcatggagatccgccccgtgaaggagaaggaggagaatctagtcaaatcgatggtctcagcaggctcaggggaggtcgacagcttcagcctcggactcctatgcatctccataatgatagaggaggtgatgaggagccgatggagtcgcaagatgctcatgacagggacactggcggtgttcttcttgctgatcatgggccaactcacctggaacgacctaataagattgtgcataatggttggagcaaacgcgtccgacagaatgggcatgggcacgacatatctcgctctgatggccacctttaaaatgagaccaatgttcgcagtgggcctcctcttccgcagattgacatcacgcgaagtcctcctgctaactattggcctcagcttggtcgcttcggtggaactaccgaactcgctagaagaactaggcgatgggctggccatgggaatcatgattctcaagctattgaccgatttccagtcccatcaactatgggcaacgttactttcgctaacattcattaaaacaaccttctcgctacattacgcctggaagacaatggcaatggtactgtccatcgtctccctattcccgctttgcctgtccaccacctcacagaaaacaacgtggctgcctgtgctattgggatccctcgggtgtaagccactcacaatgtttctcattgcagaaaataaaatatggggcagaaaaagttggccattgaacgaagggatcatggcagtcggaatagtgagcatcttactctcctcattactgaaaaacgacgtaccgctcgctggcccgctcatcgcgggtggtatgctcatcgcctgctacgtaatatccggatcgtccgcagacctcagcctggagaaagcagcggaagtatcctgggaagaagaggcagagcattcaggagctagccacaacatccttgtagaggtccaagacgacggaaccatgaaaataaaggacgaggaacgcgacgatacgctaacgatactgctcaaagccactttactggccgtgtcaggagtgtatccccttagtatcccagcaacacttttcgtctggtacttctggcagaaaaagaaacaaagatccggcgtgctatgggacacaccatctccacccgaggtcgaaagggccgtcctcgatgacgggatctaccgcataatgcaacgcggattactaggaagaagtcaagtcggggtcggcgtattccaagaaaacgtcttccataccatgtggcatgtaacacgcggagcagtgctgatgtatcaagggaagaggcttgaaccatcctgggcatccgtgaaaaaggaccttatctcatacggcgggggttggaggttgcagggatcatggaacacaggcgaggaagtgcaagtaattgccgtggaaccgggtaaaaaccccaaaaatgtgcagactgcaccgggaacttttaagacatcagaaggagaggttggggcgattgccttagatttcaagcctggtacatcaggaagtccgatcgtgaaccgggagggaaagatcgtcgggttatacgggaacggggtcgtcacgactagcggaacatacgtcagcgctattgcacaagccaaagcaagccaagagggtcctctaccggaaattgaggacgaagtcttccgaaaaaggaatctcacaataatggacctccacccgggatccgggaagacgcgccgctatttgcccgcgattgtgcgcgaagccatcaaacggaaactgagaacgctcatcctggctcccacgagagtcgtggcctcggagatggcggaagcgctcaaagggatgccgatccgctatcaaacgacggcagtaaagtcggagcataccgggaaagagatcgtagatctgatgtgtcacgcaaccttcaccatgcggctcctcagccccgtaagagtcccgaattacaacatgataatcatggacgaagcacacttcacagacccgagcagcatcgccgcaagagggtacatatccacgcgggtcggaatgggtgaggcagcagccatctttatgacagcgacaccacccggcagcgtcgaggccttcccacaaagcaacgccgtaatacaagacgaggaacgggacattccggaacgctcatggaacagtgggtacgagtggataacggactttcccggtaaaacagtatggttcgtacccagtatcaaatccggtaacgacatagcaaactgcctgcgcaaaaacgggaaacgagttatccagctcagtcggaaaacattcgataccgaatatcagaagaccaaaaataacgactgggactacgtggtcacgaccgacatatcggaaatgggagccaacttccgcgcagaccgagtgatcgacccaagaaggtgcctcaaacccgtcatcctaaaggatggtccagagagagtaattctagcgggacccatgccagtaacagtggcgagcgccgcacaaagacgcgggcgcatagggcggaaccacaacaaagaaggcgaccaatacatctacatgggccaacctcttaacaacgatgaggaccacgctcattggaccgaggcgaaaatgttacttgacaatataaatacaccagagggaatcattccagcgctctttgaaccagaacgagaaaagtctgcagccatcgacggtgaatatcgtctgagaggggaagcccgcaagacattcgtcgaactcatgaggagaggcgacctccccgtttggctaagctacaaggtagcgagcgaaggtttccaatattccgacaggcggtggtgcttcgatggggagaggaacaaccaagtgctcgaggagaacatggacgtcgaaatatggacgaaggaaggggaaagaaagaaactccgaccaagatggctcgacgcacggacatactcagacccgctcgccctgcgggaatttaaggagttcgccgcaggcagacgaagcgtatcaggagacctcatcctggaaatcggaaagctcccccaacacttaactcagcgggcacagaatgcactagacaacctggtaatgctccacaacagcgagcaaggtgggagggcgtaccgacacgcgatggaggaactgccggacaccatcgaaacactgatgttacttgcactgatagccgtactaactggaggggtcacactgttctttctcagcgggagaggcctaggtaagacctcaatcgggctgttgtgcgttatggcctcatccgtcctcctctggatggcaagcgtcgagccgcattggatcgccgcctcgatcatactggagtttttcctaatggtcctcctaatcccggaaccggacagacaaagaactccacaagataaccagctcgcatacgtagttatcggcttactcttcatgatactaacggtcgctgcaaacgaaatgggattgctcgagactacgaagaaagatctagggattggtcacgtcgctgtagagaaccaccaccacgcagccatgttggacgtagacctccatccggcatctgcctggaccctttacgctgtggcgacaacaattataactccgatgatgagacataccatagaaaacacaacagccaatataagtctaacggctatcgcaaaccaggccgccatactcatgggactggacaaaggatggccaatatctaaaatggacataggcgtgccattactggcattggggtgctacagccaagtgaatccgctcacgctcacagcagctgtgctaatgctcgtagcgcactacgcaatcataggtcccggcctacaggcaaaggcaacaagagaggcacaaaaacgcaccgcggcagggattatgaaaaacccgactgtggatggaattgtggcaatagatctggacccggtggtgtatgatgctaaatttgagaaacagttgggtcaaattatgctcctaatcctatgcacatcccaaattctgctgatgagaacaacatgggcactatgtgaatcaataacactggctacaggcccgctaacaacgctgtgggaggggtccccgggtaaattctggaacacaactatcgcagtcagtatggccaatatctttagggggagttatttggcaggcgcaggcttagcattctcactgatgaaatcactaggagggggccgcagaggaacgggagctcaaggcgagacactgggagaaaagtggaagaggcaactaaaccaacttagcaaatctgagttcaacacgtacaagagaagcggtatcatggaagtagaccgctccgaggcaaaagaagggttaaaaagaggagaaacaacgaaacatgcggtttcccgagggactgcaaaactacgctggttcgtcgagcgtaatctggtaaaacccgagggcaaggtaatcgatctcggatgcggaagaggaggatggagttactactgtgcgggactcaaaaaggtcacagaggtgaaagggtacactaaaggcggccctggccacgaagaaccgattccaatggcaacatacgggtggaacctagtaaaactccacagtggcaaggacgtattcttcatacccccggagaaatgcgacacactcctatgcgacataggtgagtccagtccgaacccaaccatagaagagggaagaacactgcgagtgctaaaaatggtggaaccctggctacgagggaaccagttctgtattaaaatcctcaacccctatatgccatcagtggtggaaactctcgaacaaatgcaaaggaaacatggaggcatgctggtaagaaacccgcttagtcgcaatagtacacacgagatgtactgggttagttgtggcacaggtaacatagtttcagcagtaaacatgaccagcagaatgctactcaacaggttcacaatggtacataggaagccgacatatgagagagatgtcgatctaggagcaggtacccgccacgtcgcggtggaaccagaagtcgcaaatctagacataattggccagaggatcgagaacattaagcacgaacacaaatcgacctggcactacgatgaagacaacccatacaaaacatgggcgtaccacggcagctacgaggtgaaacccagcggatcagcctcctcaatggtcaatggagtggtcaagctattaaccaagccgtgggacgtcatacccatggtaacacagattgccatgaccgacacaacgccgttcggacaacaacgcgttttcaaagagaaagtcgacaccagaacgcccaaggcaaaacgtgggaccgcacagataatggaggtcactgcgaaatggttgtggggctttctctcgcgcaacaagaaacccaggatctgcacccgcgaggagttcacgcgtaaagtaagatcgaacgcggccataggcgcagtcttcgtcgacgaaaaccagtggaactcagccaaggaagcggtagaagacgagcggttctgggacttagtccacagagaacgcgagctacacaagcaaggcaaatgcgctacgtgcgtctacaatatgatgggcaaacgtgagaagaagctaggcgaatttggcaaagcaaaaggatctcgagcgatttggtacatgtggctaggagctcggttcctcgagttcgaagcactgggcttcatgaacgaggatcactggttttcgagagagaacagtcttagtggggtggagggagaaggactccataaattaggctacatcctcagagacataagcaagattccagggggcaacatgtacgccgacgacacagcaggatgggacacgagaataacagaggatgatctgcaaaatgaagcaaagataacagatataatggagccagagcacgcgctcctcgcaaagagcattttcaagttaacttaccaaaacaaggtggtaagagtccagcggccggccaaaaatgggacggtgatggacgtgatctcgcgtagggaccaaagaggaagcggacaagtcggcacttatgggctcaataccttcactaacatggaagcacaactgataagacaaatggaatcagagggaatcttcagtccatcagaactagagactcccaacttagctgggcgggtactcgactggctcgaaaagcacggggtggaaaggctgaaacgtatggcaattagcggagatgactgcgtcgtaaagccaattgacgaccgtttcgctacagccttaacagcgcttaacgatatgggcaaagtacgcaaagacatcccgcagtgggagccaagcaaaggctggaacgactggcaacaggtaccattctgttcccaccatttccaccaactgattatgaaagacggtcgagagatagtcgtaccctgtagaaaccaagacgaactggtagggcgcgcccgcgtatcgcaaggcgccggatggtcactccgcgagaccgcatgcttgggaaagtcctatgcacagatgtggcagctaatgtatttccacaggcgcgatctccgactggcggcaaacgcgatctgtagtgccgtacctgtcgactgggtaccgacaagccgcacaacgtggtccatccacgcccaccaccaatggatgacaactgaagacatgctgagcgtctggaaccgggtctggatagaagaaaatccctggatggaagacaaaacgcacatatcctcttggggagacgtcccctacctgggtaaacgagaagatcaatggtgcgggagtctcataggtctgactgcccgggctacatgggccacaaacatccaagtcgcaataaaccaggtaagacgattgataggcaatgaaaactatctagattacatgacatctatgaagcggttcaaaaacgaaagcgacccggaaggagcgttgtggtga

SEQ ID NO: 24259 - RNA, 9879 nt, synthetic construct
  misc_feature 1..9879: note = derived and/or modified CDS sequence (opt11) from DENV-1__FJ882530__SS-prME
  source 1..9879: mol_type = other RNA
agcgtgaccatgctgctcatgctaatgcctaccgcactggcttttcatctgacgacccgagggggggagccccacatgatcgtgtcaaagcaggagcgcggcaagagcctgctgttcaagaccagcgctggggtgaacatgtgcactctcatcgcaatggaccttggcgagttctgcgaggacactatgacttacaaatgtccccgcatcactgaagctgaacctgatgatgtggactgctggtgcaacgccaccgacacatgggtgacctacgggacctgtagccagactggcgagcaccggcgtgacaagcggtccgtggcattggcgccccacgtgggcctcggcctggagacgcgcacggagacctggatgagctccgagggcgcctggaagcagatccagcgggtggaaacctgggcccttaggcatcccgggttcacggtcattgccctcttcctggcgcacgctatcggtaccagcatcacccagaagggcattatcttcatcctgctcatgctggtgaccccctccatggccatgcgctgcgtcggtataggctcgcgagacttcgtggaagggctgtccggcgcgacgtgggtggatgtcgtgctcgaacacggttcttgcgtgaccaccatggccaaggacaaacccactctggacatcgagttgctcaagactgaggtaaccaatcccgcggtactgcggaagctgtgcatcgaggcgaagatcagtaacactaccacggacagccgctgtcccacgcagggcgaggccaccctcgtggaggagcaggacgccaattttgtctgcagaagaaccttcgtagaccggggctgggggaacggctgcggcctattcggcaaagggtccctgatcacatgcgccaagttcaagtgcgtcaccaaactcgagggcaaaaccgtccagtacgagaacctgaagtactcagtgatcgtaacggttcacaccggtgaccagcatcaggtgggaaacgagtccacagagcacgggaccaccgctactattacgccccaggcccccagcaccgagatccagctgaccgattacggcgccttaactttagactgtagcccccggacggggttggatttcaacgagatggtcctcctgaccatgaaggaaaagtcctggctggtgcacaaacagtggttcctggacttgcctttgccttggacaagtggggcttccacgagccaggagacgtggaatcgcaaggatttgctggtaacattcaagaccgcccacgctaagaaacaggaggtagtagtactaggctcccaggagggcgccatgcacaccgccctcacgggggccacggagattcagacctcaggcaccacgaccatcttcgccggtcacctgaagtgccgcttgaagatggacaagcttacgctgaagggcatgtcctacgtcatgtgcaccgggagtttcaagctggagaaggaggtcgcggagactcagcacggcaccgtgctcgttcaaatcaagtacgagggcaccgatgccccctgcaagatccccttcagtacccaggacgagaagggggtgacgcagaacggccgcctgatcaccgccaacccaatcgtcacagataaggagaaacccgtcaacatcgaggcggagccgcccttcggggagagctatatcgtgatcggcgcaggcgagaaagctctgaagctgagttggttcaaaaaggggtcttccatcggcaagatgttcgaggccactgcccggggcgctcggcgcatggcaatcctgggcgatacggcttgggacttcgggagcatcggcggcgtgtttacctccgtggggaaactggtgcaccagatctttggcacggcctatggggtgctgttcagcggcgtctcctggaccatgaagatcgggatcggcgtgctcctaacgtggctgggcctcaacagccgctcgaccagcctctcaatgacctgcatcgctgtggggctggtcaccctctacctgggcgtgatggtgcaggcagacagcgggtgcgtcatcaactggaagggccgcgaactcaagtgcggcagcggcatcttcgtgacgaacgaggtacatacctggacagagcagtataagttccaagcggactccccgaagcggctcagcgccgctatcgggaaagcctgggaggagggcgtatgcggcatccggtctgcaacacgcttagaaaatattatgtggaaacaaataagcaacgagttaaaccatatcctcctggagaacgacatgaagttcaccgtggtggtcggggatgtggcgggcatcctggcccaggggaagaagatgattcggccccaacctatggagtataagtactcctggaaatcctggggcaaagccaagatcattggcgccgatgtgcagaacacgacctttatcatcgacgggcccaacaccccggaatgccccgacgaccagcgcgcgtggaacatctgggaggtcgaggactacggcttcgggatcttcaccacgaacatttggctcaagctgcgggactcccacacacaggtatgcgaccaccgcttgatgagcgccgctatcaaggacagcaaggccgtgcacgccgacatggggtactggatcgagagcgagaagaacgaaacctggaagcttgcgcgggcttccttcatcgaggtcaagacctgcatctggcccaagagccacacactatggtccaatggcgtgctggaaagcgagatgatcatcccaaagatctacggaggccccataagtcagcacaactatcggcccgggtacttcacccagaccgctggcccctggcatctcgggaagttagagctggatttcgacctctgcgagggcacaacagtggtcgtggatgaacactgcggcaaccgggggccgtctctgcgcaccaccaccgtgacgggcaagatcatacacgagtggtgctgtcggtcctgcaccctgccccctctgagattcaagggagaggacggctgttggtatgggatggagatcaggcccgtcaaggaaaaggaggaaaacctggtcaaaagcatggtgagcgccggctccggcgaggtcgatagcttctccttgggattactctgcatcagcatcatgatcgaggaggtgatgcgctcccggtggagccgcaagatgctgatgacgggcaccctcgcagtgttctttctgctaatcatggggcagttaacgtggaatgacctgatacggctgtgcatcatggtcggcgctaacgccagcgaccgcatggggatggggacgacctacctcgccctgatggccaccttcaaaatgcgcccgatgttcgccgttgggctcctgttccggcgcctgacgtcgcgggaagtgctgttgctgaccattgggctgtctcttgtcgcgtcggtggaactgcccaactcgctggaagagctcggtgatgggctcgccatgggcatcatgatcttgaagctactgacagacttccagtctcaccagctatgggcaacccttctgtccctgacgttcatcaagacaaccttctctctccattacgcctggaagaccatggcgatggttcttagcatcgtgagcctgttccccctttgcttgtccacgacgagccagaaaacaacctggctgccagttctcctgggctccttggggtgcaagccgctcaccatgttcctgatcgccgaaaacaaaatctggggccgcaagtcgtggcccctgaacgaagggatcatggcggtcggcatcgtgagcatcctactgtccagcctgctcaagaacgacgtgccactggcagggcctcttatcgcggggggcatgctgatcgcgtgttacgtcatcagcggatcatccgcggacctgagcctagagaaggcagcggaagtgtcctgggaggaggaggcagagcactcaggcgcgtcccacaatatcctcgtggaggtccaggacgacggtactatgaagatcaaagacgaagaacgggacgacaccctgaccatattgctcaaagccaccctgctagcggtgagcggcgtgtatccgttatccatccccgccacgctgttcgtttggtacttttggcagaagaagaagcagcgctcgggggttctgtgggacacccccagcccgcctgaggtggagcgggcggtcctcgacgacggcatctatcggatcatgcagcggggcctgctggggagatctcaggttggcgtgggggtcttccaggagaatgtgttccacaccatgtggcacgtaactagaggtgccgtcttaatgtaccaggggaagcgcctcgagccctcctgggcgagcgtgaaaaaggatcttatctcctacggcggcgggtggcggctccaaggtagctggaacacgggagaggaggtgcaggtcatcgcagtggaacccggcaagaatcccaagaacgtgcagaccgcccccggaaccttcaagacctccgaaggcgaggtgggcgccatagctctggatttcaaacccgggacgtccggatcccccattgtgaaccgagaggggaagattgtgggcctgtacggcaacggggttgttaccacctccgggacctacgtgagtgccattgcacaagccaaggcgtcccaggaaggtcccctaccggagatcgaggacgaggtattccggaaacgcaacctcactatcatggatctgcacccgggtagcgggaaaacccggcgttacctgcccgctattgttcgggaggccatcaagcgaaagctccggaccctgatccttgcgccgacccgcgtggtcgcctccgaaatggcggaagccttaaagggcatgccaatccgataccagacaacggcggtcaagagcgagcacacaggcaaggagatcgtggacctgatgtgccacgctaccttcacgatgcggctattatcccccgtgcgagtgcccaattacaatatgattatcatggacgaagcccacttcactgacccgagctccatagcggccaggggttacatctcaacccgcgtgggcatgggggaggccgccgccatcttcatgaccgcgacgccgccgggctccgttgaggccttcccacaatccaacgccgtgattcaggacgaggagcgggacattccggagcgctcctggaacagtgggtacgaatggatcaccgattttccgggcaagacagtatggttcgtcccctccattaagagcggcaatgatattgccaactgtttgaggaagaacgggaagcgcgtaatccagctgtcgcggaagactttcgacactgagtatcaaaagactaagaataacgattgggactatgtcgttacgaccgatatctccgagatgggagcgaacttccgcgcagatcgtgtgatcgatccgcgccggtgcctcaagccggttatcttaaaggacgggcccgagcgagtcattctagccggccctatgcccgtgacggttgcgagcgccgcgcaaaggagagggcggatcggtcggaaccacaacaaggagggcgatcaatatatctacatggggcaaccgctgaacaacgacgaggaccatgcccactggaccgaggccaagatgctgctggacaatatcaatacccccgagggtatcatccccgctttattcgagccggagcgagagaagtccgccgcaatcgacggcgagtaccggctgcgcggcgaagcccggaagaccttcgtggagctcatgcggcgcggggacttaccggtttggctgagctacaaggtcgcctccgaaggtttccagtacagcgaccgacggtggtgcttcgacggcgaaagaaataaccaggtgctggaggagaacatggacgtggagatctggacgaaagagggggagcggaagaagctccgcccccggtggttagacgccagaacgtattcggaccccttagctctccgcgagttcaaggagttcgctgccggccgccggtctgtctccggagacctgatactggaaatcggcaagctgccccagcacctaacccagcgcgctcagaacgccctggacaacttggtgatgctgcacaacagcgagcaaggcggacgggcttaccgccacgccatggaggagctgcctgataccattgagacgctaatgctgttagccttaatcgccgtgctgaccggcggggtcaccctgttcttcctctcagggcgtggcctgggcaagacaagcatcggcctgctctgcgtgatggcatcctcagtgctgctgtggatggcgtccgtcgagccccattggatcgccgccagcatcatcctcgagttcttcttaatggtcctcctcatccctgagcccgaccgccaaagaacgccgcaggacaaccagctggcttacgttgtcatcggactcctcttcatgatcctgacggtggccgcgaatgagatgggcctgttagagaccaccaagaaggacttagggatcggccacgtagccgtcgagaaccaccaccacgctgccatgctagacgtggatctccaccccgcctccgcgtggaccctttacgccgttgccacgactatcatcacgcccatgatgcgccataccatcgagaacacaaccgctaacatctcgctgaccgctatcgcgaaccaagccgcaatcctcatggggctggacaaggggtggccgatcagcaagatggacatcggcgtacccttgctcgccctggggtgttactcccaggtaaaccccttgaccctcacggcggccgtgttaatgttagtcgcccactacgcgatcatcggcccagggttacaggctaaggccacgcgggaggcccagaaacgcaccgccgccggcattatgaagaatcctactgtggacgggatcgtggccatcgacctggaccccgtcgtatacgacgcaaaattcgagaagcaactgggccagatcatgctcctgatcctgtgcacttcacagatcctgctgatgcgcaccacctgggccttgtgcgagagcatcactttagcgacggggcccctgacgaccctgtgggaaggatcccccggtaagttctggaacactacgatcgccgtcagcatggcgaatatcttccgggggtcgtacttagcgggcgccggcctggctttctctctgatgaagtccctcggtggcggtcgccggggtaccggggcacagggcgagaccctgggcgagaaatggaagcgccagctgaaccaattgtccaagagcgaattcaacacctacaagagatccggcatcatggaggtcgatagatccgaggcgaaggaagggctgaagcgcggggagacgaccaagcacgccgtgagtcgcggcaccgccaagctcagatggttcgtggaacgcaacttagtcaaaccggaggggaaggttatcgacctgggctgcggcagaggcgggtggagctactactgcgccgggctgaagaaggtgaccgaagtcaaggggtacacgaaaggcgggcccggccacgaagagcccatcccgatggccacctacgggtggaaccttgtgaagctgcactccggcaaggacgtgttcttcatcccgcccgagaagtgcgacaccctgttgtgcgacatcggggaaagctcccccaaccctacaatcgaggaaggccgtacgctacgggtcctgaagatggtggagccgtggctgcggggaaatcagttttgcatcaagattctgaacccatacatgcctagcgtggtcgagacacttgagcagatgcagagaaagcacggaggcatgctagtgcggaaccccctgtcccggaacagcacccatgagatgtactgggtgtcctgcgggaccggcaacatcgtcagcgcggtgaacatgacctcccgcatgttgctgaaccggttcacgatggcacaccggaagcctacctatgagcgcgacgtggacttaggcgccgggacacggcacgttgccgtggagcccgaggtggccaatctcgacataattggccagcgcatagagaatatcaagcacgagcacaagagcacatggcactacgacgaggacaacccctataagacgtgggcgtaccacgggtcctacgaggtcaagccctcgggcagcgccagcagcatggttaacggggtcgtgaagctgctcacaaagccgtgggatgtgataccgatggtgacccagatcgccatgaccgacaccacgcccttcggccagcagcgggtgttcaaagaaaaagtggacacccgcactcccaaggccaagcgggggacggcgcaaatcatggaggtcaccgctaagtggttatggggcttcctaagtcgcaacaagaaaccgaggatctgcacccgggaggagttcacccggaaggtgcgcagcaacgctgccatcggcgccgtgttcgtggacgaaaaccaatggaactcggcgaaagaggctgtcgaagacgagcggttctgggacttagtccaccgcgagagagaactgcacaagcaggggaagtgcgccacgtgcgtctacaatatgatgggtaagcgtgagaagaagcttggtgagtttggtaaggccaaggggagccgggcgatttggtacatgtggctcggcgcgcgtttcttggagttcgaggccctgggcttcatgaacgaggaccactggttttcgcgggagaatagcctttccggggtagagggcgaggggctacacaagctgggctacatcctccgtgacatcagcaaaatccccggaggcaacatgtacgctgacgacaccgccggttgggacacccggatcaccgaggatgatctgcagaacgaggccaagatcacggacatcatggagcccgagcacgcgctgctcgccaagtccatcttcaagctaacctaccaaaacaaggtagtccgcgtgcagcgccctgccaagaacgggacggtcatggacgtcatcagccgtcgcgaccagcgggggtcgggccaggtgggcacctacggcctgaacacgttcacaaacatggaggctcagctcatccgacagatggagtctgaagggatcttctcacccagcgagttagaaacccctaacctggccggccgggtgctcgattggctggaaaaacacggagtcgagagactgaagcggatggcgatatccggcgacgactgcgtggtgaagccgatcgacgaccgcttcgccaccgccttgacggccttaaacgacatgggcaaggtacggaaggatatccctcaatgggaaccctcgaagggctggaacgactggcagcaggtccccttctgctcacaccacttccaccaactaatcatgaaggacggccgcgagatcgtggtcccatgccgtaatcaggacgagctcgtgggccgcgctcgggtgagccaaggggcggggtggagcctgcgcgagaccgcctgtctgggcaagtcctacgcccagatgtggcagctcatgtacttccatcgtcgtgacctgcggctggcggcgaacgccatctgcagcgccgtgccggtggactgggtgccaacttcccgcaccacgtggagcatacacgcccaccaccagtggatgaccaccgaggacatgttgtccgtctggaaccgggtgtggattgaggagaacccctggatggaggacaagacccatatctcatcctggggcgatgtgccctacctgggtaagcgcgaagaccagtggtgcggtagcctgatcgggttgacggcacgggcgacctgggccactaacatccaggtcgccatcaatcaggtgcgccgcctgatcggaaacgaaaactacctggactacatgacctccatgaagcggttcaagaacgagagcgacccagagggagctctgtggtga

SEQ ID NO: 24260 - RNA, 9879 nt, synthetic construct
  misc_feature 1..9879: note = derived and/or modified CDS sequence (opt11) from DENV-1__GQ868605__SS-prME
  source 1..9879: mol_type = other RNA
agtgtgaccatgctcctgatgctcatgccgaccgccctggccttccacctcaccacccggggcggtgagccccacatgatcgtcacaaagcaggagcggggtaagtccctgctgttcaagacctcggtgggggtgaatatgtgtaccctaatcgccatggatttgggcgaactgtgcgaggacaccatgacctacaagtgtccccgcataactgaggctgagcccgacgacgttgattgctggtgtaacgccactgatacttgggtgacctacggcacctgctcccagacaggtgagcaccggcgtgacaagcgttccgtggccttggcgccccacgtaggcctggggctggagacccgtaccgagacctggatgtccagtgagggtgcgtggaagcagatccagcgggtggagacgtgggcactacggcaccccggcttcaccgttatcgccctttttctggcccacgcgatcggcacgtccatcacccagaaggggatcatcttcatcctgcttatgctggtcacaccttcgatggcgatgcggtgcgtgggcatcgggtcccgggactttgtggaggggttaagcggcgccacctgggtcgatgtggtgctggagcatgggtcctgcgtcaccaccatggccaaggataaacccactctggacatcgagctcctaaaaaccgaggtaaccaatccggcggtgttaagaaagctctgcatagaggcgaagatatcgaataccactacggactcccgctgcccaacccagggcgaagccaccctaatggaagagcaagacgccaacttcgtctgccggcgcacgttcgtggatcggggctgggggaacggctgcgggctgttcggcaagggcagcctaatcacctgcgcgaagttcaaatgcgtgactaagctggagggcaagattgtccagtacgagaacctgaagtactcagtgatagttacggtccacacgggcgatcagcaccaggtggggaatgagagcaccgagcacggaacgaccgctaccattacaccgcaggcgcccacgtctgaaatacagctcaccgactatggggcccttaccctagattgcagccctcgcacgggccttgactttaacgagatggtcctgcttaccatgaaagaaaagtcatggctcgtacacaagcagtggttcctggacctgccgctcccctggacttctggggcaagcacttcccaggaaacgtggaaccggcaggacctactggtgacctttaaaaccgcgcacgccaagaaacaggaggtagtggtacttggctcccaggaaggcgcaatgcatacggcgctcacgggtgccaccgagatccaaacctccggcaccacgactatcttcgccgggcacctgaaatgccgtctcaagatggacaagttaacgttaaaaggcatgagctatgtgatgtgcaccgggtcattcaagctggagaaggaggtcgcagagacacagcacggaaccgtgctggtccagattaagtacgagggaaccgacgcgccctgcaagatccccttcagcacccaggacgagaagggggtgacgcaaaatggccgcttaataaccgcgaatccgatcgtgaccgacaaagagaagcccgtcaacatcgaagccgaaccgcccttcggagagagctacatcgttataggcgttggcgagaaggctttaaagctctcttggttcaagaaagggtcctcgatcggaaagatgttcgaggcgaccgcccgcggagcccggcgaatggccatcctgggggacacggcctgggacttcgggtctatcgggggcgtgttcacctctgtaggaaaactggtgcaccagattttcggcaccgcgtacggtgtcctattctcaggcgtgtcctggaccatgaagatcgggataggcgtgttactgacgtggctcggcctaaactctcgcagcaccagtctgagcatgacctgtatcgccgtcggtctcgtcaccctgtacttaggcgtgatggttcaggccgactccgggtgcgtgattaactggaagggcagagagctcaagtgcggaagcggcatcttcgtgacgaatgaagtgcacacgtggaccgagcagtacaagtttcaggccgatagccctaagcgcctgtccgccgcgatcgggaaggcgtgggaggagggggtctgtggtatccggtcggccacccgcttagagaacataatgtggaagcagatcagcaacgagctcaaccacatcctgcttgagaacgacatgaagttcaccgtggtcgtgggtgatgtggtcggcatcctcgcacagggtaagaagatgatccggccgcagcccatggagcacaagtacagctggaagtcctgggggaaggccaagatcatcggcgcggacgtgcaaaacacgactttcatcatcgatggccccaatacacccgaatgtcccgacgaccagcgcgcctggaacatttgggaggtggaggactacggcttcggtatattcaccacgaacatttggctgaagttacgggattcatacacccaggtctgtgaccaccgcctcatgagcgccgccatcaaggacagcaaggcggtacacgccgacatgggctactggatcgagtccgagaagaacgacacttggaagctggcacgggcctccttcatcgaggttaaaacctgcatctggcccaagtcccacaccctatggagcaacggcgtgctcgagtccgaaatgatcatccccaaaatctacgggggcccgatttcgcaacacaattaccgcccaggatacttcacacagaccgcaggcccctggcaccttgggaagctcgagctcgatttcgacctgtgcgaggggactacggtagtggttgatgagcactgcggcaaccgggggccgtccctgcgcacgaccaccgtgacgggcaagatcatccacgagtggtgctgccggtcctgtaccctgccccccctccgtttcaaaggggaagacggctgctggtacgggatggagatccggccagttaaagagaaggaggaaaaccttgtaaagtctatggtcagcgcgggtagcggggaggtcgattcttttagcctcggactgctgtccatcagcatcatgatcgaggaggtcatgcgctcccggtggagccgcaagatgcttatgactggaactctcgccgtgttcctgttactgattgtggggcagctgacgtggaacgaccttatccggctatgcatcatggtaggcgcaaacgcctctgatcgcatggggatgggtacaacctatctggccctcatggcaaccttcaagatgagacctatgttcgccgtcggtcttctgtttcggcgattaacgtcacgggaggtgctactccttaccatcgggctctcactggtggcaagcgttgagttacccaactccctggaggaactgggcgacgggctcgccatggggatcatgatcctgaagctgctcaccgactttcagtctcaccagctgtgggccaccctgttatccctcacttttatcaagaccgcactgagcctccactacgcctggaaaaccatggctatggtcctgtccatcgtgagcttattccccctttgcctgtccaccacgtcgcagaaaaccacctggctgcccgtgttattaggctccctgggttgcaagccgctcaccatgttcctgatcgctgagaacaagatttggggccgcaagagctggcccctgaacgagggcatcatggcggtcggcgtggtgagcatcttactcagtagcctgctcaagaacgacgtaccactggccgggccgttaattgctgggggaatgttaatcgcctgttatgtaatctccgggagctcggccgacctgtctctggagaaggctgccgaggtgtcctgggaggaggaagccgagcattcgggtgcgtcccacaacatcctcgtcgaagtccaggacgacggtacgatgaagatcaaggacgaggagcgtgacgacacactgaccatattactgaaagccaccctgttggcggtgtcgggagtctacccgctctcaattcccgcaacattattcgtttggtacttctggcaaaagaagaagcaacgcagcggcgtgctgtgggacacaccctcgccgcccgaggtggaacgtgccgtgctggacgatggcatctaccgcatcatgcagcgtggtttgttagggcgctcacaggtgggcgtaggcgtcttccaggagaacgtattccacacgatgtggcacgttacccgcggcgccgtgctcatgtatcaggggaagcgcctcgagccgagctgggcgagcgtgaagaaggacctgatctcctatggtggagggtggcggctgcaaggtagttggaacaccggggaggaggtgcaggtgattgcggtcgagcctgggaaaaaccccaagaacgtccagacggccccggggacgttcaagactcccgagggcgaagtgggcgcgatcgccctagacttcaagcccgggacctccggtagccccattgtgaatcgagagggaaagatcgtaggcctgtacggcaatggggtggtgacgacctctggaacctacgttagcgccatcgcacaggccaaggcgagccaggagggaccgctgcctgaaatagaggacgaggtgttccgcaaacgcaacttgaccatcatggacctgcatcccggatccggaaagacgagacgctacctgccggcaatcgtgcgggaggcgatcaagagaaagctccggaccctgatcctggctccaacacgtgtcgtggcgagcgagatggccgaggccttgaagggaatgcccatccgataccaaacaaccgctgtgaagtccgagcacacaggcaaggaaatcgttgacctgatgtgccacgccaccttcacaatgaggctactcagcccggttcgcgtgccgaactacaatatgatcattatggacgaagcccatttcacggacccatccagcattgccgcccgggggtacatctccacacgcgttggcatgggggaggcggcagcaatcttcatgacggcgacaccccccggcagcgtggaggcgttcccgcaaagtaacgcagtaatccaggacgaggagcgggacatacccgagcgctcgtggaactccgggtacgagtggataacggacttccccggcaagaccgtctggttcgtgccctccattaagtccggcaatgacatcgccaactgtctgcggaaaaacgggaagcgcgtgatacagctgagccggaagacgttcgaaaccgagtaccagaaaacgaagaacaacgactgggactatgtcgtgactacagacatctcggagatgggcgccaattttcgcgccgaccgggtcattgatccgcgccggtgtcttaagcccgtgattctgaaggacgggagcgagcgcgtcatcctcgcgggccccatgcccgtcaccgtggcaagtgcagcacaaaggcgggggcggatcggccgaaaccacaacaaggagggtgatcaatacatctacatggggcagccgctcaacaacgatgaggatcacgcccactggacggaggcgaagatgttgctggacaatattaacacgcccgagggcatcattccagccctcttcgagcctgagcgggagaaatccgcggcaatcgacggcgagtaccgcctgcgcggcgaggcccggaagacctttgtggagctgatgagacgcggcgacctcccggtctggctgagctacaaggtggcatccgaaggctttcagtatagcgacaggagatggtgtttcgatggcgaacgaaacaaccaggtgttggaggagaatatggacgtggagatctggaccaaggagggtgagcggaaaaagctccgccctcggtggctggatgcccgtacttacagcgaccccctggccctacgggagttcaaagagttcgccgctgggcgccggagcgtgtcgggggacctgataatcgagatcggcaagttgccccagcacctcactcagaaggcgcagaacgccctggacaacttagttatgttacacaacagcgagcaaggcgggcgcgcgtaccggcacgccatggaggagttaccggacacgatcgagaccctgatgctcctcgcgctgattgctgtcctcacgggcggtgtgaccctattcttcctttctggccgcgggttgggcaagacctcgatcggcctgctctgcgtcatggcctccagcgttctcctgtggatggcctccgtagagccacactggattgccgcgtcgataatcctggagttcttcctaatggtgctgctgatacccgagccagaccggcaacgcaccccacaggacaatcaactcgcctacgtcgtaatcgggctgttattcatgatactaaccgttgccgcaaacgagatgggactgctggagacgaccaagaaggacttaggaattggacacgtggccgttgagaaccaccaccacgccactatgttggacgtggatctgcaccccgcctccgcgtggaccctctacgcggttgccacgaccatcattacgcccatgatgcggcacactatcgaaaacacgaccgccaacatcagcctcactgccatcgcgaatcaggccgccatcttgatggggctcgacaagggttggcccatctcaaagatggatatcggcgtccccctgctggcgctcgggtgctacagtcaggttaaccccttaactctgaccgccgccgtcctcatgctggtggcccactacgctataatcggccccgggttacaagccaaagccacccgcgaggcccagaagcggacggccgcgggcatcatgaagaacccgaccgtggacgggatagtcgccattgatctcgaccccgtggtgtacgacgccaagtttgagaagcagctggggcagataatgctgctcatcctgtgcacgtcccagatcctgctaatgcgcaccacttgggccctttgcgaaagcatcacactggccaccggcccccttaccaccctgtgggaggggtcccccgggaagttttggaacactactatcgcggtctcgatggccaacatcttccggggttcgtacttggctggagccggcttggccttctcccttatgaagtccctcgggggtgggcggcgtggtaccggagctcaaggcgaaaccctcggcgagaagtggaagcggcagttgaaccagctgagcaagtccgagttcaacatctacaaaaggtccggtatcatggaggtcgatcggtccgaagccaaggagggcctaaaacggggggagaccactcggcacgccgtgtcccgcgggaccgccaagctgcggtggtttgtcgagaggaacctggttaagcctgaggggaaagtgatcgacctgggctgcgggaggggcgggtggtcatactactgcgccgggttaaagaaagtcacggaagtgaagggatacaccaagggaggccccgggcacgaggagcccatccccatggctacgtacgggtggaacctcgttaagctgcactccggcaaggatgtattcttcaccccccccgagaaatgcgacaccttactgtgcgatatcggggagagctcacccaaccccacaatagaagagggccgcactctccgggtcctcaaaatggtggaaccgtggctgcgcgggaaccagttttgtatcaagatcctgaacccatacatgccgagcgttgtggagaccctcgagcagatgcagcgcaagcacgggggcatgctggtgcgcaaccccctgtcccggaacagcacccacgagatgtactgggtctcctgcgggactggcaacattgtgtctgccgtgaacatgaccagtcgcatgctcctgaaccggttcacaatggcccaccgcaaaccgacctacgagcgcgacgtcgatctgggggccggaacccggcatgtagcggtagagcccgaagtggctaacctcgacatcataggccagcgcatcgagaacataaagcatgagcacaagagcacctggcattatgacgaagataatccttacaagacgtgggcctaccacggctcctacgaggttaagccctcggggagcgcctccagcatggtcaacggggtggtcaagctgctaaccaagccgtgggacgttatacccatggtgacccagatcgccatgaccgacacgacccccttcggccagcagcgggtgtttaaagagaaggtggacacccgcacccctaaggcgaaacgggggacggctcagatcatggaggttaccgctcgctggctctggtcattcctgtctaggaacaaaaaaccccgcatctgcacccgggaggagttcacccgaaaagtgaggtccaacgctgccatcggcgcggtcttcgtggatgagaatcaatggaactctgctaaggaggccgtcgaagacgaaagattttgggatctcgttcagaaagagcgggaactccacaaacagggcaagtgtgccacgtgcgtgtataacatgatgggcaaaagagagaagaagctgggcgagtttgggaaggcaaagggctcccgggccatctggtacatgtggcttggggcccgcttcctcgagttcgaggccctgggctttatgaacgaggaccactggtttagccgggagaactctctgagcggcgtcgagggggagggtctccataagctggggtacatcctacgtgatatctcgaagatacccggcggtaacatgtatgcagacgacacggcgggctgggacactaggattaccgaggatgacctccaaaacgaggctaagataacggatattatggagccagagcacgccctgctcgcgacttcaattttcaagttgacctaccaaaacaaagtcgtgcgcgtgcagaggcctgcaaagaacggaaccgttatggacgtgatatcccgcagagaccagcgggggagtggccaggtggggacttacggcctgaataccttcaccaatatggaggcgcagctcattcgacagatggagtccgagggcattttcctccccagcgagctagagacccccaaccttgccgagcgcgtcctcgattggcttgagaaacatggggtggagagactgaagaggatggccatcagcggcgacgactgtgtggtcaagcccatcgacgatcgcttcgcaacggccctcacagcgctgaacgacatgggtaaggtccggaaggatatcccgcaatgggagccctctaagggctggaacgactggcagcaggtcccattctgcagccaccacttccaccagcttataatgaaggacgggcgcgagatcgtagtgccctgtcggaaccaggacgagctcgtgggccgcgcacgggtttcgcagggcgccgggtggagcttgcgtgaaaccgcatgcctagggaaaagttacgcccagatgtggcagcttatgtacttccatcgtcgtgacctgcggctggcggccaacgccatctgcagcgcggtaccggtggactgggtgcccacatcccgcacgacatggagtatccacgcgcaccaccagtggatgaccaccgaggacatgctctccgtgtggaacagagtgtggatcgaagagaatccctggatggaagacaaaacgcacgtttcttcctggggcgacgttccctatctgggcaagcgcgaggaccagtggtgcgggagcctgataggccttaccgcccgggccacctgggcctccaacatccaagtggccatcaatcaagtccgccgcctgataggcaacgagaactacctggattacatgaccagcatgaagcggtttaagaacgagggggacccggagggagccctctggtag

SEQ ID NO: 24261 - RNA, 9879 nt, synthetic construct
  misc_feature 1..9879: note = derived and/or modified CDS sequence (opt11) from DENV-1__FJ882534__SS-prME
  source 1..9879: mol_type = other RNA
agcgttactatgctgctgatgcttatgcccaccgccctggcgttccatctcacgacccgcggcggggagccgcacatgatcgtatccaagcaggagcggggcaagagcctgctgttcaagacctccgcgggggtgaacatgtgtacgttgatcgccatggacctgggagagctatgtgaggacacgatgacctataagtgcccacgcataaccgaggccgagccagacgacgtggattgctggtgcaacgctaccgacacatgggtcacgtacggcacctgcagtcagaccggcgagcaccgcagagacaagcgctctgtggcccttgcgccccacgtgggcctggggctggagacgcgcaccgagacgtggatgagctccgagggagcctggaagcagatccagcgggtcgagacgtgggcgctccgccatccgggattcacggtaatcgccctgttcctagcacacgccatcggcaccagcatcacacagaaggggatcatttttatactcctgatgctggtgaccccttccatggcgatgcggtgcgtcggcatcgggtctcgcgacttcgtagagggtctctccggcgccacgtgggtcgatgtagtactggaacacgggagctgcgtcacgaccatggctaaggacaagcccaccctggacatcgagctcctgaagacggaggtcacgaaccccgcggtgctgcgaaaattatgcatcgaggccaagatctccaacaccaccactgacagccgctgcccgacccagggcgaggcgaccctggtggaggagcaggatgccaacttcgtgtgtaggcgcacgttcgtcgatcggggctgggggaacggctgcgggctgttcggcaaagggtccctcatcacgtgtgccaagttcaagtgcgtgacaaagctcgagggaaaaattgtacagtacgagaatttgaaatacagcgtgatcgtgaccgtccacaccggcgaccagcaccaggtaggcaacgagtccacggagcacggcaccaccgcgaccatcaccccccaagctcctacaaccgaaattcagctcacagactacggcgcactgaccctggactgcagtcccaggacgggactcgatttcaacgagatggttctgctgactatgaaggagaagagttggctcgtgcataagcagtggttcctggatctcccgctcccctggaccagcggggcctccacctcgcaggaaacatggaatcggcaggaccttttagtgaccttcaagaccgctcacgcgaagaagcaggaggtcgtggtgctcgggccccaggagggcgccatgcacaccgccctcacgggggcaaccgagatccagaccagtggcacgacgactatctttgccggccacctgaaatgccgcctcaaaatggacaagctgaccctgaagggtatgtcttacgtgatgtgcactggtagcttcaagctggagaaagaggtggcggagacacagcacggcacggtgttggtgcagatcaaatacgagggaaccgacgcgccttgcaaaatcccgttttccacacaggatgagaagggagtcacacagaacggcagactgattaccgctaacccaatcgtgacagataaggagaagcctgtcaacatcgaggctgagcccccgttcggggagagctacatagtgattggcgcgggcgagaaggccctgaagctctcatggttcaagaaggggagctccataggcaagatgtttgaggccacagcccgcggtgcgcgccgcatggccatcctgggcgacacggcctgggacttcgggtcaataggcggcgtgtttaccagtgtcgggaagctcgtgcaccagatattcggcacagcctacggggtgctcttcagcggcgtgtcctggacaatgaagatcgggatcggtgtactgctgacgtggctgggactgaacagtcgcagtaccagtttgtccatgacctgtatcgccgttggactcgttacgctgtatctgggcgtgatggtgcaggccgacagcgggtgcgtcatcaactggaagggcagggagctaaaatgcggttctgggattttcgtgacgaacgaggttcacacgtggacggagcagtacaagttccaggcggattcgcccaagcggctatcagccgccatcggcaaggcctgggaggaaggggtctgcggtattcgcagcgctacccgtcttgagaacatcatgtggaagcagatcagcaacgagctcaaccacatacttctggagaacgacatgaagctcaccgtggtcgtcggggacgttgcaggcatcctggggcagggcaaaaagatgatcaggccgcagccaatggaatacaagtactcctggaagagctggggcaaggccaaaatcatcggggccgacgctcagaacacgaccttcatcatcgatggaccaaacactcccgagtgccctgacgatcagcgcgcgtggaacatctgggaggttgaggactacgggttcggcattttcaccacgaatatctggctaaagctcagggactcctacacccaggtatgtgaccaccgccttatgtcagcggcaatcaaggactcaaaggccgtacacgccgatatgggctactggatcgagtcagagaagaacgaaacgtggaaattggcgcgggcctccttcatcgaggtaaagacctgcatctggcccaagagccacacgctttggtcgaacggagtactggagagcgagatgatcataccgaagatctacggcgggcccatatcccagcacaactaccgacccggctacttcacgcagaccgccgggccgtggcatctaggcaagctcgagttagatttcgacctgtgcgagggcacaacggtggtagtcgacgagcattgtgggaatagaggcccctcacttcgcaccaccaccgtgacggggaagatcatccacgagtggtgctgtcggagctgcaccctgccccccctccgcttccggggcgaagacggctgttggtatggaatggagatccgcccggtcaaggagaaggaggagaatctcgtcaaaagcatggtttctgccggcagcggggaagtggacagcttctccctaggcctcctctgtatctctatcatgatcgaggaggtcatgcggtcccgctggagccgcaagatgcttatgaccggaactctggccgtgttcttcctcctaatcatgggccaactgacttggaacgacctgatccgcctttgcattatggtgggggcgaacgcctcagaccgcatgggaatgggcactacctacctggccctcatggccacctttaagatgagacctatgttcgccgtcgggctgctgtttcggcggctaacgagcagagaggtgcttctgctaaccataggcctcagtttagtggcgagtgtagagctccccaacagcctggaagagctgggggacggccttgccatgggcatcatgatactgaagctgttgaccgattttcagtcccaccagttatgggcgactctgctctccctgacttttatcaagaccaccttcagcctgcactatgcttggaagaccatggcaatggtgctcagtatcgtctcactgttccccctttgcctctccacgaccagccagaagacgacgtggttaccggtgcttctaggatccttggggtgcaagcccctgacgatgttcctcatcgtggagaacaagatttgggggcggaagagctggcccctgaacgagggcatcatggccgtagggatcgtgtccatcctgctcagcagccttctgaaaaacgacgtgcccctcgcagggccactgatcgccggcgggatgctaatcgcctgctacgtcatttcgggtagctccgcggacctcagcctagagaaggccgccgaggtatcctgggaggaggaggccgaacatagtggtgcaagccacaacatcttggtggaggttcaggatgatggcaccatgaagatcaaggacgaagagcgcgacgacaccctcacaatactgcttaaggcgaccctactggccgtatctggggtgtacccgctatccatccccgccacgctcttcgtctggtacttctggcagaagaagaagcagcggtcaggcgtgctgtgggacaccccctccccgcccgaggtggagcgcgcggtactggacgacgggatctaccgcattatgcaacgggggctgttgggccggagccaggtcggagtgggtgtgttccaggagaatgttttccacactatgtggcacgtgacgcgtggtgcagtcctgatgtaccagggaaagcggctggagccctcctgggcaagcgtaaagaaagatctcatctcctacggtgggggatggcgcctgcggggttcctggaacacgggagaggaagtgcaagtaatcgcggtggaaccaggaaagaacccgaagaacgtgcagaccgccccgggcaccttcaagacgcccgagggcgaggtcggggccatcgccctggacttcaagcccggtacttctggttcccccatagtaaaccgcgagggcaagatcgtcgggctgtacgggaatggcgtcgtgaccacctccgggacctacgtgagcgcgatcgctcaagcaaaagccagccaggagggtcccttacccgagatcgaagacgaagtcttccgaaagcgcaacttaaccatcatggacctccacccggggtccggtaagacacggaggtatctgcccgcgatcgtgagagaggcaatcaagcgcaagttgcgcactctgatcctggcgcccacgcgggtcgtcgccagcgagatggctgaggcgttgaagggcatgcccataaggtaccagacgactgccgtgaaatcggagcacaccgggaaagaaatcgtggacttaatgtgccatgccaccttcacgatgcggttgttatctccggtcagagtccccaactataacatgattatcatggacgaagcgcacttcactgacccctccagcatcgccgcgcgggggtatataagtactcgcgttggtatgggcgaagcggccgcaatcttcatgaccgctacgccacccgggagcgtcgaggcgttcccccagagtaacgccgttatccaggatgaggagcgggacatacccgagcgctcgtggaacagtggctacgagtggatcacagatttccccggtaaaaccgtgtggtttgtcccgagcatcaagtctgggaacgacatcgccaactgcttacggaagaatggcaagcgtgttattcagctgagccggaagaccttcgacaccgagtatcagaagaccaagaacaacgactgggactacgtggtaaccacagacatttcggaaatgggtgccaacttccgcgctgaccgcgtgatcgacccccgccggtgccttaagcccgtcatcttaaaggatggcccagagcgcgtcatcttagccgggcctatgcccgtgacggtcgcctctgccgcgcaacggcgcggccggatcggtcgcaatcacaacaaagaaggggaccaatacatctatatgggccagccactgaataacgacgaggaccacgcacactggacagaggccaagatgttactggataacatcaataccccagaggggattattcccgcccttttcgagcccgagcgcgagaagtctgccgccgtagacggagagtacagacttagaggggaggcgcggaagaccttcgtggaactgatgcgacggggcgacctgccggtctggctcagctacaaggtcgcctccgagggctttcagtactccgaccgccggtggtgtttcgacggcgagcgcaacaaccaggtgctcgaggagaatatggatgtcgagatttggaccaaggagggagaacggaagaagctgcgcccccgctggctcgacgccaggacctacagcgacccgctcgccctgagagagttcaaggaattcgcagcggggcgccggtccgtgagcggcgatcttattctagagatcggcaaactgccccagcaccttacgcagcgcgcccagaacgccctggacaacctggtgatgctacacaactccgagcaaggaggacgagcctaccgccatgccatggaggagcttccggacacgatcgagacgcttatgctcttagctctgatcgccgtcctcaccgggggcgttaccctctttttcctgtctgggcggggcctgggtaagacctccatcggcctgctgtgcgtgatggccagttccgtccttctgtggatggccagcgtggagccccactggatcgcggcctccatcatcctggagttcttcttaatggtgttgctgatcccagagcctgaccgccagcgtaccccccaggacaatcagctagcctacgtcgtgataggcctactgttcatgatcctcacggtagctgcaaacgagatggggctgctggaaaccactaagaaggacctgggcatcggacacgtggcggtggagaatcaccaccacgcagccatgctagatgtggatctccatccggcctctgcctggaccctctatgccgttgcaacgacgattataaccccaatgatgcgccacaccatagaaaacactaccgccaacatctccctgacggccattgccaaccaagctgccatcctgatgggtctcgacaagggctggcccatttctaagatggatatcggggtgcctctgctggccctcggctgctactcccaggtgaacccgctgactctgacagccgcggtgcttatgctggtagcgcactacgccatcataggtcccggcctgcaggccaaggcgacccgcgaggcgcagaagcggaccgctgccggaatcatgaagaaccctaccgtcgatggcattgtcgccatcgacctggaccccgtggtgtacgacgccaagttcgagaaacaattgggccaaatcatgctgctaatcctatgtacgtcgcagatccttctcatgcgcaccacctgggcgctgtgcgagtctatcaccctggccacggggcctctcactaccctttgggagggcagccccgggaaattctggaataccacgattgcggtctccatggccaacatcttcaggggcagctacctggccggcgcggggctcgccttcagtctaatgaagagcctcggaggaggccggcgggggaccggagcccagggagagaccctcggggaaaaatggaagcgtcaattaaaccagctgagcaaatccgagttcaatacctacaaacggtctggtattatggaggtggatcgcagcgaagccaaggaaggtctgaagcggggtgagacgaccaaacacgcggttagtcgcggtactgccaagctgcgatggttcgtcgagcgcaatttagtgaagcccgagggcaaggtgattgacctgggctgcgggcggggcgggtggtcctactactgcgccgggctcaagaaggtcaccgaggtaaaggggtatacgaaaggcggtccggggcatgaggagccgatcccgatggccacctacgggtggaacctggtgaaattgcactcgggtaaggatgtcttcttcatacccccagagaagtgcgacaccctcctatgtgacatcggcgagtcgagcccgaatcccactatcgaggaggggcgcacgctgcgggtgctcaagatggtggagccctggctgcgcggtaatcagttctgtatcaagatcctaaacccgtacatgccgtccgtcgtggagaccctcgagcagatgcaacggaaacatggcgggatgctggtacgaaaccccctcagccggaactccactcacgagatgtactgggtgtcctgcggcaccggtaatatcgtgagcgccgtaaacatgaccagcaggatgctcctgaacagattcacgatggctcaccggaagcctacctatgaacgcgacgtcgacctgggcaccggcacccgacatgtggcggtggaacccgaggtcgcgaacttagacatcatcggtcagcgcatcgaaaatatcaagcatgagcacaagagtacgtggcactacgatgaggacaacccctacaagacctgggcctaccacggaagctacgaggtgaagccctctgggagcgcctccagcatggttaacggcgtggttaagctgctcacgaagccctgggacgtcatccccatggtgactcagatcgcgatgacagacactaccccgttcgggcagcagcgagtgttcaaggagaaggtagacaccaggacgcccaaggccaagcggggaacggcccagatcatggaggttaccgcccgctggctctggggctttctgagccgtaacaagaaaccccgcatctgcacccgggaagagttcacacgcaaggttagatcgaatgcggcaatcggggccgtctttgtcgacgaaaaccagtggaacagcgccaaggaggctgtggaagatgaacgcttctgggacctcgtccatcgggagagggagctccacaagcaaggcaagtgcgcgacttgcgtgtacaacatgatggggaagcgggagaaaaagctgggtgagttcgggaaggcaaagggctctcgcgcgatctggtacatgtggctgggcgccaggttcctcgagttcgaagccctggggttcatgaacgaggaccactggtttagccgcgagaactctctgagcggcgtggagggggaaggcctccacaagttagggtacatcctgcgggatatctccaagatcccgggcggcaacatgtacgcggacgataccgccgggtgggacacccgcatcacggaggacgatctccaaaacgaggccaagataacggacatcatggagcccgagcacgccctgcttgccaaggcgatctttaagctcacctaccagaataaggtggtgagggtgcaacggcctgccaagaacggcaccgttatggacgtgataagccgtagggaccagcgcgggtctggccaagtgggcacttatgggttgaacactttcacaaacatggaagcgcagctcattcggcagatggagagcgagggaatcttctcgcccagcgagctagagacccctaacctagccgagcgcgccctggactggctcgaaaagtacggggtcgagcggctgaagcgcatggcgatatccggcgacgattgcgtagtgaagcccatcgatgaccggttcgccacggccctcaccgctctcaacgacatgggtaaagtacgcaaggacatcccccagtgggaacctagcaagggctggaacgattggcagcaagtgccattctgttcccaccacttccaccagctgatcatgaaggacggccgggagatcgtggtgccctgccgcaaccaggacgagctagttgggcgagccagggtgagccagggcgcgggctggagtcttcgggaaacggcatgtctcggtaaatcctacgcccagatgtggcaactaatgtacttccaccgtcgagatctcagactggccgctaacgctatctgcagcgccgtccccgttgattgggtgcctacttcccggactacttggtcaatccacgcccaccaccagtggatgaccacggaggacatgctgtccgtttggaaccgcgtgtggatagaagagaacccatggatggaggacaagacacacataagctcctgggaggacgtaccgtatctcgggaagagggaagaccagtggtgcggcagcctgataggcttgaccgcacgagcaacatgggcaacgaacattcaagtagctatcaaccaagtgaggcggctcatcggcaatgagaactacctggattatatgacctccatgaagaggttcaaaaacgagagcgaccccgaaggcgcgctgtggtga

SEQ ID NO: 24262 - RNA, 9879 nt, synthetic construct
  misc_feature 1..9879: note = derived and/or modified CDS sequence (opt11) from DENV-1__FJ882536__SS-prME
  source 1..9879: mol_type = other RNA
agcgtgaccatgttgctcatgctgatgccgacagccctggcctttcacttgaccactcgcggcggggagccccacatgatcgtaagcaagcaggagcgtgggaagagcctactgttcaaaacctccgccggtgtgaacatgtgcaccctcatcgccatggatctgggcgagctgtgcgaggacacgatgacctacaagtgcccccgcatcaccgaagcagagcccgatgacgtggactgctggtgcaacgccacagacacctgggtgacctacgggacctgctctcagaccggcgagcatcggcgcgataagagatccgtggcccttgcgccccacgtgggcctaggactcgagacgaggacagagacgtggatgtccagcgaaggcgcctggaagcagatccagagggtcgagacctgggccctccgccaccccgggttcacggtgatcgccctgttcctggcacatgccatcggcacgagcatcacgcagaagggaatcattttcatcctcctgatgctcgtgactccatccatggccatgcggtgcgtcggaattggcagccgagacttcgtagaggggcttagtggagcgacgtgggtggacgtcgtgctggagcacgggtcttgcgtgacgactatggccaaggataaacccaccctggacattgaactcctgaagacggaggtcaccaacccagcggtgctgcggaagctctgcatcgaagcgaaaatttccaacacaacgacggacagcaggtgtccgacccagggcgaagccaccctggttgaggagcaggacgcgaactttgtctgccggcgcacattcgtggaccgcggttgggggaacggctgcgggctgtttggcaaagggtccttgatcacgtgcgccaaatttaagtgcgtgaccaagcttgagggcaagatcgtccagtacgaaaacctaaagtactcggtgatcgttaccgtccacacaggcgaccagcaccaggtgggtaacgagtccacggagcacggaaccactgcaaccatcacgccccaggccccaacaactgagatccagctcaccgactacggagccctgaccctggactgcagcccccgcacaggcctggacttcaacgaaatggtcctgctgaccatgaaggagaagtcatggctcgtccacaagcagtggttcctagacctccccctcccctggacaagtggggcctctacctcccaggagacgtggaacaggcaggacctgttggtgacctttaagaccgcccacgcgaagaagcaggaggtagtagttctcggctcccaggagggcgccatgcacaccgctctgacgggtgcgaccgagattcagacgtccgggaccacgaccatcttcgccgggcacctgaagtgccgattgaagatggataagctgaccctgaagggcatgtcctatgtcatgtgtaccgggtccttcaaactcgaaaaagaagtggcggagacgcagcacggcaccgtgctagtccagatcaagtatgagggcaccgacgccccctgtaagatccccttcagcacccaggacgagaagggtgtgacgcagaacggccggctgatcaccgccaacccgatcgtgaccgataaggagaagcctgtcaacatcgaggccgagcctccattcggggagtcctacatcgtgataggcgctggcgagaaagccctgaagctgagctggttcaagaagggctccagcatcggcaagatgttcgaggccaccgctcgcggggcccggaggatggcgatcttgggcgatacggcctgggactttggctccatcggcggcgtgttcacttcggtcggtaaacttgtgcaccaaattttcggtaccgcctacggggtcctgttctccggcgtcagctggaccatgaaaataggtataggagtgctgctgacatggctcggcctgaattcgaggagcacctcgctgagcatgacctgcattgccgtgggcctagtcactctgtatctgggagttatggtgcaggcagacagcggatgcgtcatcaactggaagggccgggaactcaagtgcgggagcggcatattcgttacgaacgaagtgcatacctggacagagcagtacaagttccaggcggacagcccgaagcgcctgtcggccgcaattggtaaagcctgggaggaaggcgtctgcgggattcgaagcgctactcgcctggaaaatatcatgtggaaacagatatccaacgaactcaatcatatcctgctggaaaacgatatgaaactgaccgtggtggtcggcgacgtggccggcatactgggtcagggcaagaagatgatccggccccagcccatggagtataagtacagctggaagtcctggggcaaagcaaaaatcataggggccgacgcccaaaacactaccttcattattgacggccccaataccccggagtgccccgacgatcagcgcgcttggaatatctgggaggtggaagactacgggttcggcatctttacaaccaacatttggctgaagctccgggacagctacacccaggtttgcgatcaccgcttgatgtccgcggccatcaaggacagcaaggccgtgcacgccgacatgggctactggatcgagtccgagaagaacgagacctggaagctagcccgagccagcttcatcgaggtgaagacttgcatctggcccaagtcgcacacgctctggagcaatggtgtcctggagagtgagatgatcatcccgaagatctatggagggccgatcagtcaacacaattaccgcccagggtacttcacccaaaccgccggaccttggcacctgggcaagctggaactggacttcgatctatgcgaaggcactacggtggtggtcgacgaacactgcggcaaccgcggtcctagtctccgcaccaccactgtcacgggcaaaatcatccacgagtggtgctgtcggtcctgcaccctgccgccccttcgcttccgcggcgaagacgggtgctggtacggcatggagatccgccccgtgaaggagaaggaggagaacttagtcaagtccatggtcagcgctggcagcggggaggtggacagcttttcactaggccttctctgtatcagtatcatgatcgaggaggtgatgcggagccgctggtcacggaagatgttaatgacagggaccctggccgtgttcttcctcttaatcatgggccagctaacgtggaacgacttaatccgcttgtgcatcatggtgggggcgaacgccagcgatcgcatgggtatgggaaccacctacctggcccttatggccactttcaaaatgaggcctatgtttgccgtcgggctgctgttccgccgcctgacaagccgagaggtgctgttgctcaccatcggcctgagtttggtggcgtccgtcgagctccctaacagtctggaggagttaggggacggcctcgccatgggcattatgatcctgaagttactcactgacttccagtctcaccagctgtgggccactcttctcagcctcacattcataaaaacaaccttcagtctccactacgcctggaaaaccatggcaatggtgctctctatcgtctccctgttccccctgtgcctcagcacgacatcccaaaagaccacctggcttcccgtgcttctcgggtctctgggctgtaagccgttaacgatgtttctcatcgctgagaacaaaatatgggggcggaagagttggcccttaaacgaaggtatcatggccgtggggatcgtcagcatactattaagcagcttgctgaagaatgacgtgcctctcgcggggcccctgatcgccggcggaatgctgatcgcctgttacgtgatttcgggttccagcgcagacctctccctggagaaggccgccgaggtctcatgggaagaggaggcagaacacagtggggccagccataatatcttggtggaggtgcaagacgacggcaccatgaagatcaaggacgaagagcgcgacgacaccctcaccatcttactgaaggccaccctgttagcggtttcgggggtgtacccgctgagtatccccgccaccctcttcgtctggtacttctggcagaaaaagaaacagcgcagtggagtactgtgggacacccctagcccgcccgaggtggagcgagccgtgcttgacgacggcatctaccggataatgcagcgcgggctgctcggccgttcccaggtcggcgtgggggtgttccaggagaacgttttccacaccatgtggcacgtgacccgcggggcggtgctgatgtaccaggggaaacgactggagccgagctgggcctccgtcaagaaagatcttattagctacggcgggggctggaggttgcggggtagctggaacacgggcgaggaggtccaggtgattgctgtcgagcccggaaagaatccaaaaaacgtgcagaccgcccccggaaccttcaagacccctgaaggcgaagtgggtgcaatcgcgctggatttcaagcctggcacgagcgggtcccccatcgtcaaccgcgaaggcaagatcgtgggcctctacgggaacggcgttgttaccacctcaggcacctacgtatccgccatcgcccaggccaaggcgtcccaagaggggccgctgcccgagatagaggatgaagttttcagaaagcgcaacctgacaatcatggacctccacccagggtcaggcaagacccggcgatacttgccagcgatcgtacgggaggccatcaaacgcaagctgaggacgttgatcctggcacccacccgagtggttgcctccgagatggctgaggccctgaagggtatgccgatccgctaccaaacgaccgccgtaaagtcggagcacaccggaaaggagatcgtggatctaatgtgccatgctaccttcacaatgcgtctgctctcccccgtgcgcgtccctaactacaacatgattatcatggacgaggcccacttcaccgaccccagctccattgcggctcggggttacatctccacccgagtggggatgggcgaagccgcagctattttcatgaccgccactccgcctggctccgtagaagccttcccgcagagtaacgccgtcatccaggacgaggaacgggacatccccgagcgctcctggaatagcggctacgaatggatcaccgacttccctgggaagaccgtctggttcgtgcccagcatcaaaagcggcaatgacatcgccaactgccttcggaagaacggcaagcgagtcatccagctgtcccggaagaccttcgacacggagtaccagaagaccaagaacaacgactgggactacgtggtgaccaccgatatcagcgagatgggtgcgaacttccgcgccgaccgggtgattgatccgcgccggtgcctgaagccggtgatcctcaaggacggccccgaacgcgtaattcttgccgggcccatgcccgtcacggtggcctccgcggcgcaacggcgcggccggataggcagaaatcacaacaaggagggggaccagtacatctacatgggtcaacccctgaataacgacgaggaccacgcccactggactgaagcgaagatgctcctggacaatattaatactcccgaggggattatccctgccctgttcgagccggagcgcgagaagtccgccgcggttgacggcgagtaccgtctccgcggggaggcccggaagaccttcgtggagctcatgaggcggggagacttacctgtgtggctctcctacaaggtggcttcagagggcttccagtacagcgatcgccggtggtgcttcgacggagagcgaaataaccaggtgctggaggagaatatggacgtagagatctggactaaggagggcgaacggaagaagctcagaccccggtggctcgacgcaaggacctactccgaccctttggcccttcgagaattcaaagagttcgcggccgggcgccgatccgtatccggcgacctcatcctggagattggcaaactgcctcagcatctcacccagcgcgctcagaacgccctggacaacctagtgatgctccataactccgagcagggcggccgggcgtaccgccacgccatggaggaactgcccgacaccatagagacgctgatgctcttggccctgatcgccgtgctcaccgggggcgttactctctttttcctgtccgggcgcggcctcggaaagaccagcataggcctgctatgcgtgatggcatccagcgtcctcctatggatggcctccgtggaaccccactggatcgccgcctcaatcatcctagagttcttcctcatggtgctgttgatcccagagcctgaccgtcagcgaacgccccaagacaaccagctcgcctacgtggtcatcggcctcctgttcatgatcttaacggtagccgcgaatgagatggggttgcttgagacaaccaagaaggacctcggaatcgggcacgtggcagtggagaaccaccaccacgccgccatgctggacgtcgacctgcaccctgcctccgcgtggaccctctacgccgtggccacgacaatcatcacacccatgatgcgtcacaccattgaaaatacgacagccaacatcagcttgaccgccatcgcgaaccaggccgccattttaatggggttggacaagggctggccgatctccaagatggatatcggcgttcccctgctggccttgggatgctatagccaggtgaaccccctcaccctgacggctgccgttctcatgctggtcgcgcactacgccataatagggcctggactccaggccaaggctacgcgcgaggcccagaagcggaccgccgccgggatcatgaagaaccctaccgtagacgggatcgtggccatcgatctcgaccccgtagtgtatgatgccaagttcgaaaaacagctgggccaaattatgctgctgatcctgtgcacctcccagatcctgctgatgcgcaccacctgggccctgtgtgagagcataactctggccactgggccactcacaactctgtgggagggttcccctggaaagttctggaatacgacgattgcagtcagcatggcaaacatctttcggggctcataccttgcaggcgccggactcgccttcagcctgatgaagtcccttggcgggggccgccggggaacaggcgcgcaaggcgagacgctcggggaaaagtggaagcgccaactaaatcaactgagtaagtcggagtttaacacatataagagatccggcataatggaggtggaccgcagcgaggcgaaggaggggctcaagcggggcgagacgacgaaacacgcagtttctcgaggaaccgcgaagctgcggtggttcgttgagcgcaaccttgtaaagccagaggggaaagtgattgacctgggctgtgggcggggcggctggagctactactgcgccggcctcaaaaaagtgaccgaggtcaaagggtacacgaagggcgggcccgggcatgaggagccaatcccgatggccacatacgggtggaacttagtgaagcttcacagtggtaaggacgtgttctttataccgccggagaagtgcgacacactgctgtgcgacatcggagaaagttcccccaacccgaccatcgaggagggtagaacgctgcgcgtcctcaagatggttgagccctggttacgaggtaatcaattctgtatcaagatcttgaatccctacatgcccagcgtcgtcgaaaccctcgagcagatgcagcgtaaacacggcgggatgttagtgaggaacccgctgtcacggaacagcacccacgagatgtactgggtgtcttgtggcacgggcaacattgtcagtgcggtgaacatgacctcccgcatgctcctcaaccgcttcaccatggcgcaccggaagcccacctatgagagggacgttgatctgggcactggcacccggcacgtggcggttgaacccgaggtggccaatctcgacatcataggccaacgcatagaaaacattaagcacgagcacaagagcacttggcactacgacgaggacaacccctacaagacctgggcctatcacggctcctacgaagtcaagccgagcggctccgcgagcagcatggtcaacggtgtcgtgaagctgctgaccaagccttgggacgtgatacccatggtcacacagatcgccatgacggacaccacacctttcgggcagcagcgggtcttcaaggaaaaggtagacacccgcacgccaaaggcaaagcggggcaccgcccaaataatggaggtcacggcccggtggttatggggattcctgtcacggaacaagaagcctcgcatctgcacccgggaggaattcacacgcaaagtgaggagcaacgcggccatcggggccgtcttcgtagacgagaaccagtggaattctgccaaggaggccgtggaggatgagcgcttttgggacctggtgcatcgggagagagagcttcacaagcagggcaaatgcgcgacctgcgtctacaacatgatggggaagcgggagaagaagctgggcgaattcggcaaggccaaaggcagccgcgccatatggtacatgtggttaggagcccggttcctcgagttcgaggcacttgggttcatgaacgaggaccactggttctcccgtgagaacagcttgtcaggcgtggaaggggagggcttgcacaagctgggttacatcctgcgtgacatcagcaagatccccggtgggaatatgtacgccgacgacaccgcggggtgggacacccgtataacagaggacgatttgcagaacgaggcaaagatcacagatatcatggagccggaacacgctctgctggcaaaggccattttcaagctgacctaccagaacaaggtggtccgtgtgcagcggcccgcaaagaacggcaccgttatggacgtgatctcccgccgggaccagcgcgggagcggccaggtgggtacatatgggctgaacactttcaccaacatggaggcgcagctgatcagacagatggagtccgagggcatcttttctccatccgagttggagacccctaacctggccgaaagggcgctcgactggttggagaagtacggggtggagagattaaagcgcatggccatttcaggcgatgactgcgtcgttaagcctattgatgaccggttcgccacggccctgacggccctcaacgacatgggaaaggttcggaaggacataccgcagtgggagccttccaagggctggaacgactggcagcaagtccccttctgtagccaccacttccaccaactgatcatgaaggatggccgggagatcgtggtgccctgtcgcaaccaggacgagctggtcgggcgggcgagagtgagccagggcgcagggtggagcctccgggagaccgcctgcctgggcaaaagctacgcacagatgtggcagctgatgtatttccaccgccgggacctgagattagcggcgaatgccatctgcagcgccgtacccgtcgactgggtgcctacgagccggacgacctggagcatccatgctcaccaccagtggatgaccactgaggacatgctgagcgtgtggaaccgtgtctggatcgaggaaaacccatggatggaggacaaaacacacatttcgtcctgggaggacgtgccgtacctcgggaagcgcgaggaccaatggtgcggctcgcttatcggcctgacagcacgagccacctgggccacaaacatccaggtggccatcaatcaggtccgccggttaatcgggaatgagaactacctggactacatgaccagcatgaagcgctttaagaatgagtccgatcccgagggcgccctgtggtag

SEQ ID NO: 24263 - RNA, 9879 nt, synthetic construct
  misc_feature 1..9879: note = derived and/or modified CDS sequence (opt11) from DENV-1__FJ882537__SS-prME
  source 1..9879: mol_type = other RNA
agcgtgacaatgctgctcatgctgatgcccaccgccttggcctttcacctgaccacccggggcggggagccccatatgatcgtgtccaagcaggagcggggcaagtctctgctgttcaagaccagcgctggagttaacatgtgcaccctcatcgccatggacctgggcgaactgtgtgaggataccatgacctacaagtgcccccggatcaccgaagtagaacccgacgacgttgactgctggtgtaacaccaccgacacttgggttacatatgggacctgtagccagacgggcgaacaccggcgcgacaagaggtcggtggccctcgcgccccacgtcggcctgggactggaaaccagggcagagacctggatgagtagcgagggggcctggaagcagatacagaaggtggaaacctgggccttgcgtcaccccgggttcacggttatcgccctgtttctggcacatgctattgggaccagcattactcaaaaggggataatcttcatcctcctgatgctggtcaccccctccatggccatgcgctgtgtcgggatcgggagccgggacttcgtggaggggctctctggcgccacgtgggtagacgtggtgctagagcacgggagctgtgttaccacgatggcgaaagacaagccaactctcgacattgagttgctgaagactgaggtcactaacccggctgtgctgcgcaagctctgcattgaggcgaagatctctaacaccacaacggactcgcggtgcccgacccagggcgaggctaccctggttgaggagcaggacgccaacttcgtctgccgcaggacgttcgtagacagaggctgggggaacggctgcggtctgttcggcaaggggagtctcatcacgtgcgctaagtttaagtgcgtcaccaaactagagggaaagatcgtacagtatgagaatttgaaatacagtgtcattgtgaccgttcacaccggtgaccaacatcaggtagggaatgagtccacagagcacggcacgatcgccacgatcacgccccaggctccgaccagcgagatccaactcacggactacggagccctgaccctagactgcagccccagaactggcctcgacttcaacgagatggtcctgctgaccatgaaggagaagagttggttagtgcataaacagtggttccttgacctgcccctaccgtggacgagcggggccagcaccagccaggagacctggaaccgccaggacctactggtcactttcaagacggcccatgctaagaagcaggaggttgtggttctcggctcccaagagggcgctatgcacacagccctgaccggggccaccgagatccagacgacaggtaccaccaccatcttcgccggtcacctgaaatgtcggctaaagatggacaagctaacgctaaagggaatgtcttacgtgatgtgcaccgggtccttcaagctcgaaaaggaagtagccgagacacaacacggcacggtccttgtgcaaataaagtacgagggaactgacgctccttgcaaaatacccttcagtacacaggacgagaaaggggtgacccaaaacggcagattaatcacagccaaccctatcgtcacagacaaggagaaaccagttaacatcgaagccgagccgccgttcggggagtcttacatcgttatcggcgcgggcgagaaggcgctgaagctcagctggttcaagaaagggtccagtattggcaaaatgttcgaggctaccgccagaggcgcccgtcgcatggccatactgggcgatacagcatgggactttgggtctatcggaggcgtattcacctccgttgggaaactggtgcaccaaatcttcggaactgcctacggagtcctcttctccggcgtgtcatggaccatgaagatcggaatcggcgtgctgttgacttggctcggattgaactcccgtagcacatcccttagcatgacctgtatcgccgtcgggctcatcaccctgtacctgggtgtcatggtgcaggccgattccggatgcgttatcaactggaagggccgcgagctcaagtgcgggtctggtatcttcgtaaccaacgaagtgcacacctggaccgaacagtacaagttccaggccgacagcccaaaacggctctcagctgccatcggcaaggcctgggaagaaggggtctgcggcattcgtagcgcaactcggcttgagaacatcatgtggcgccagatctccaacgagttaaaccacatcctcctggagaacgacatgaagttcacagtggtggtaggggacgtggtggggatcctcgcgcagggtaaaaagatggtccggccccagcccatggagcataagtatagctggaagtcctggggcaaggcgaaaatcatcggcgccgacgtacagaacaccacgttcatcatcgacggaccaaacaccccagaatgccctgacgaccagcgcgcctggaacatctgggaggttgaggactacgggtttgggatctttaccaccaacatctggctgaagttacgggacagctatacgcaggtctgcgaccaccgcctgatgtccgctgcgatcaaggacagcaaggccgtgcacgccgacatgggctactggatcgagtccgagaaaaatgagacctggaagctggcccgggcaagctttatcgaggtgaagacctgcatctggcccaagtctcacacactgtggtcaaacggggtccttgagtccgagatgattatacccaagatatacggcggccccattagccagcacaactaccgcccgggctatttcacgcagactgccggtccctggcatctggggaagctggagttggacttcgacctgtgcgagggcacgaccgtagtagtggatgagcactgcgggaaccggggccctagtctgcgcaccacgaccgtgactggcaagatcatccacgagtggtgctgccggtcctgcacgttgccgcctctccgcttcaagggggaggacggctgctggtacgggatggagatccggcccgtgaaggagaaggaggagaacctggttaaaagcatggtatctgcaggctccggcgaggtggattccttctcgctcggtttactctgcatctccatcatgatcgaagaggtgatgagaagcagatggtccagaaaaatgctcatgacaggcacccttgccgtgttcttcctactcatcatggggcagctgacttggaatgacttgatccggagctgcataatggtcggggccaacgcatccgaccgcatgggtatgggcacgacttacctcgcactgatggccacttttaagatgcgcccgatgttcgccgtcggactgctgtttcggcgactgaccagccgggaggttctgttattaacaatcgggctgtccctcgtcgccagcgtggagctgccaaactccttagaggagctcggcgacgggctggccatgggtatcatgatcctgaagcttttgacagatttccagagctaccagctctgggcgaccctcctgtcacttacgttcatcaagactacttttagcttacattatgcatggaagaccatggccatggtgttatcaatcgttagcctgctcccgctgtgcctatccacgacgagccagaagacaacatggctgcccgtgctgctaggctcccttggttgcaagccgctaaccatgtttctgatagccgaaaacaagatctggggccgcaaatcttggccactcaacgaggggatcatggccgtcggaatcgtcagcatactgctgtccagcctactgaagaacgatgtgcccctggccgggcccctgatcgcgggcggcatgttaatcgcctgctacgtgatctccggaagcagtgccgatctgtctctcgagaaagccgccgaggtgtcctgggaggaggaggccgagcactcaggcgcctctcacaatattctggtggaggttcaggacgacggtactatgaagatcaaggacgaagagcgagacgacacgctgaccatactcctgaaagccacactgctcgcagtcagcggcgtgtacccgttatcaattcccgccaccctgttcgtctggtacttctggcagaagaagaagcaacgctcgggggtcctctgggacacgcctagcccgccggaggtggagcgggccgtgctggacgacggcatttaccgcattatgcaaagaggcttactggggcgcagccaggtcggcgtgggtgttttccaagagaacgtcttccataccatgtggcacgtgacccggggagccgtgcttatgtaccaggggaagaggctcgaaccatcatgggcaagcgtcaaaaaggacctaatttcctacggcggcgggtggcggctccagggtagctggaacaccggggaagaggtccaagtgatcgcggtggagcctggcaagaacccaaagaacgtccaaactgcccccgggaccttcaagaccccagagggcgaggtgggcgccattgccctggatttcaagcccgggacctcgggctctccaatagttaaccgagaggggaagatcgtcggcttgtacggcaacggtgtggtcacgaccagcggcacctacgtgtcggcaatcgcccaggctaaggccagccaggaggggccactcccagagatcgaggacgaggtgttccggaaacgcaatctaaccatcatggaccttcaccctggctccgggaagacacggcgctacctcccggccatcgtcagggaagcgatcaagagaaagctaagaaccctgatcctggcgcccacccgcgtggtcgccagcgagatggccgaagccctcaagggcatgcccattcgttaccagacaactgcggtcaagagcgagcacaccggacgggaaatagtggacctaatgtgccacgcaactttcaccatgaggcttctcagccccgtgcgagtacctaactacaatatgatcataatggacgaggcacacttcacggacccctcctcaattgccgcccgcgggtacatctccacccgggtaggtatgggggaggcggccgccatctttatgacggccacgccgcccggcagcgtggaggccttcccacagtccaacgcggttattcaagacgaggaacgcgacattcccgaacggagctggaactccgggtatgagtggattaccgacttcccaggcaaaacggtgtggttcgtgcccagtatcaagtcaggcaacgacatcgcaaactgtcttcgcaagaacgggaaacgggtcatccagctcagccgaaaaactttcgacacagagtaccagaagacgaagaacaatgactgggactacgtggtgacaaccgacatatccgaaatgggcgcgaactttcgggccgaccgggttatcgacccgcggcgctgcctgaagcccgtaatcctaaaggacggacctgagcgggttatccttgcggggcccatgccggtgaccgtcgccagcgccgcccagcgcagagggcgcatcggccggaatcacaacaaggaaggtgaccaatacatctatatggggcaaccccttaacaacgacgaggaccacgcgcattggacggaagcgaagatgctgcttgacaatatcaatacccctgaaggcatcatccccgccctgttcgagcccgagcgagagaagtccgctgccatagacggggagtaccgcctgcggggcgaggcccgcaagaccttcgtcgagctcatgcggcgcggggacctgcccgtctggctgagctacaaagtggcgagcgaggggttccaatattccgaccggaggtggtgttttgacggcgagcggaataaccaagtcctcgaggaaaatatggacgtggagatctggaccaaggagggggaacgtaaaaagctgcgtccccgatggcttgacgctcggacgtacagcgacccacttgccctgcgcgaatttaaagagttcgccgccggaaggcgctccgtgtcaggagatttaatcttagagatcggcaagctgccgcagcatctgacgcagcgggctcagaacgccctcgacaacttagttatgctccacaactccgagcagggcgggcgggcctatcggcacgcaatggaagagctccccgataccatagagacccttatgctgctcgcgctcatcgccgtgttaacaggcggggtgaccctattcttcctatcgggccgcgggttggggaagacctccatcggcctactgtgcgtcatggcaagctccgccttactttggatggccagcgtggaaccccactggatcgcggcctccatcattttggagttcttcctgatggtactcctgattcccgaaccggacaggcaaagaacgccccaagataaccagctggcctatgtcgtgatcgggctcctcttcatgatcctgaccgttgccgcaaacgaaatgggcctcttagagacgacaaagaaggacctggggatcggccatgtcgcagttgaaaaccaccaccacgccaccatgctggacgtggacctgcaccccgcatcggcctggaccctctatgccgtcgcgacaaccatcatcacccccatgatgcggcacaccatagagaacacaaccgccaatatctccttgaccgccatcgccaaccaggccgcgatacttatgggccttgacaagggctggcccatatctaagatggatatcggcgtgccgctcctggctctgggctgctactcccaggtaaacccgttaacccttaccgcggcggtcctcatgctggttgcgcactacgctatcatcggcccaggcctgcaggccaaggccacacgcgaagcccagaagcgaactgcggccggcatcatgaagaaccccaccgtggatgggatcgtcgccattgacctggaccccgtggtgtacgacgccaaattcgagaagcaactcggccagatcatgctgttaatcctctgcacgagccagattctgctgatgcggaccacctgggcgctctgcgaatctatcaccctggccacgggaccgctgaccacgttgtgggaaggaagcccgggcaaattctggaatacaacgatagccgtttccatggccaacatcttccgcgggagctacctggccggcgccgggctggctttcagtctcatgaagtccctcggaggaggccggcgcgggacgggcgcccaaggcgaaaccctcggggagaagtggaagcggcagctcaatcagctgagcaagtcggagtttaatacgtacaaacgcagcggaataatggaggtggatcgctccgaggccaaggagggtctgaggcgcggagagaccactaagcatgcggtaagccgaggcaccgcgaagctccgctggttcgttgagcgcaacctggtcaagcccgaggggaaggtgattgacctcggctgcggcaggggcgggtggtcctactattgtgccgggttaaagaaggtaactgaggtgaaggggtatacgaagggaggccccggccacgaggagccaattccgatggcgacgtacggttggaacctagtgaaactacactcgggcaaggacgtctttttcatcccgcccgagaaatgcgataccctgctctgcgacatcggggaatccagcccgaacccaaccattgaggagggccgcaccctgcgggtcctgaagatggttgagccgtggctacgcgggaaccagttctgcatcaagatcctgaacccctacatgccctccgtagtagagaccctggaacatatgcagcggaagcatggcggcatgctcgtgcgcaacccactgagccggaactccacgcacgaaatgtactgggtcagctgcggtaccggcaacatcgtgtccgccgtgaatatgaccagccgcatgctgctcaaccggttcacgatggcccacaggaagcccacctacgagcgcgacgtcgatctgggggccggcacccggcacgtcgcagtggagccagaggtcgctaacctggacatcatcgggcagagaatcgagaacatcaaacacgagcataagtctacatggcactacgacgaagacaacccctataaaacgtgggcctaccacggaagctacgaggtaaaaccgtccggaagcgcctcctcaatggtcaacggcgtggtgaagctcctcaccaagccgtgggacgtcatccccatggtaacacaaatcgcgatgaccgacacgacccccttcggccaacagcgcgtgttcaaggagaaggtcgacacgcgcacaccgaaggcaaagcggggcacagcccaaataatggaggttaccgcacgctggctgtggggctttctgagccggaacaagaagcccaggatatgcacgcgggaagagttcacacgcaaggtgcggtccaacgccgcgataggcgccgtcttcgtggacgaaaaccaatggaacagcgcgaaggaggccgtggaggacgagagattctgggacctggtccatcgggaaagagagctccataagcaaggtaagtgcgctacttgcgtgtacaacatgatggggaagagggaaaagaaactcggagagtttggcaaagccaaaggcagtagagccatctggtacatgtggctaggtgcccggttcctggagttcgaggccctcggcttcatgaacgaggaccactggttcagccgcgaaaactccctgagcggggtcgaaggcgaggggttacacaagctcggctatatcctgcgggacataagcaaaatcccaggaggcaatatgtacgcggacgacaccgctggctgggacacgcgcattactgaagatgaccttcaaaacgaggccaagatcacggacatcatggagccggaacacgcccttctggccacctctatcttcaagctgacctaccagaacaaagtcgtgcgcgtgcagcggcccgcgaagaacgggaccgtcatggacgtcatcagtcggcgagatcaacgcggcagcggccaggtgggcacctacggcctcaacaccttcaccaatatggaagcccagctgatcaggcagatggagtccgaggggatcttcagcccctccgagcttgaaacacccaacctcgcagagcgcgtcttagattggctggagaagtatggggtggagcgcctcaaacgcatggctataagtggggacgactgcgtggtaaagccgatcgatgaccggttcgccactgcgctgaccgcactgaacgacatgggcaaagtgcgcaaggacataccccagtgggagccctccaagggttggaacgactggcagcaagtccccttttgcagccatcacttccaccagcttataatgaaggacggccgggagatcgttgttccatgccgaaatcaagacgagctagtagggcgggcgcgagtctcccagggagccggctggtccttacgggaaaccgcatgtctggggaagtcctatgcgcagatgtggcaactgatgtacttccaccgccgcgacctgcgcttagcagccaacgctatatgctccgccgttcccgttgactgggtccccaccagccgtacaacctggtctatacacgcacatcaccaatggatgaccaccgaggacatgctgagcgtatggaaccgcgtgtggatcgaggaaaatccctggatggaggacaagacgcacatctccagctggggagatgtaccgtatctcggcaaacgagaggaccaatggtgcggctccttgatcggcttgaccgcccgagccacctgggctaccaacatccaggtcgcgattaaccaagtgcgcaggctaatcggcaatgagaactacttagattatatgacatccatgaagcgcttcaaaaacgagtcggaccccgaaggcgccctatggtga

SEQ ID NO: 24264 - RNA, 9879 nt, synthetic construct
  misc_feature 1..9879: note = derived and/or modified CDS sequence (opt11) from DENV-1__GQ868606__SS-prME
  source 1..9879: mol_type = other RNA
agcgtcaccatgttgctcatgctgatgcccacagccctggcattccacctcaccacccggggcggagagccccacatgatcgtgagtaaacaggagcggggcaagtcactgctattcaagacctccgcaggggttaacatgtgcactctgatcgccatggatctgggggagttctgcgaggatacgatgacgtataagtgcccgcgcatcaccgaggccgagccagacgatgtagattgctggtgcaatgccaccgacacgtgggtgacatacggcacttgcagccagactggcgagcaccggcgggataagcggagcgttgctctggcaccgcatgtgggactgggcctggagactagaacagagacctggatgtcctccgaaggcgcctggaagcaaatacagcgcgttgaaacatgggccctaaggcacccagggttcaccgtgatagctctcttcctggctcacgccatcggtacaagcattacgcagaaggggatcatctttatcctgttgatgctggtgacaccttccatggctatgcggtgtgtcggcataggcagccgcgactttgtggagggtttatccggggctacgtgggtggacgtcgtcttggagcacgggagctgcgtgaccactatggctaaggacaagcccaccctggacatcgagctgcttaagacggaagtgaccaatcccgcggtgttaaggaagttgtgcattgaggcgaaaatctcgaacaccacgacagacagccgatgccctacgcagggcgaggccaccctcgtggaagagcaagatgcgaacttcgtctgtagacgcactttcgtggacaggggatgggggaatggctgcggcctgttcggcaaagggtccctgataacgtgcgcaaagtttaagtgcgtcacgaagttagaagggaagaccgttcaatacgagaacctaaagtatagcgtgattgtgactgtccacaccggagaccaacatcaggtcggtaacgagagcaccgagcacggaaccaccgcgaccatcactccccaggccccttcgaccgaaatccagcttacggactatggcgccctgaccctagactgcagtcctcggaccggcctggactttaacgagatggttttactgactatgaaagagaaatcctggctggtacacaagcagtggtttctcgatctcccgctgccatggaccagtggtgccagtacgagtcaggaaacatggaatcggaaagacttgctggtgacctttaagaccgcacacgccaagaagcaggaggtagttgtgctgggctcccaggaaggagccatgcataccgccctaacgggcgcaaccgaaatccagaccagcggaactacgaccatcttcgccgggcacctgaaatgccgactcaagatggacaagctcactctgaagggcatgtcttacgtgatgtgcacagggtcattcaagctggagaaggaggtggcggaaacccagcatggcaccgtcctagttcagatcaagtacgaaggaaccgacgccccgtgcaagatccccttctcaacccaagatgaaaagggggtcacacaaaacggcaggctgattactgccaatccaatagtcaccgataaggagaagccagtcaacatcgaggccgagccaccgttcggagagagctatatcgtcatcggcgcgggcgagaaggccctgaagctttcctggttcaagaaggggagttccatcggcaaaatgttcgaagccaccgcccgcggggcgcggcgtatggcgatcctcggcgacactgcctgggatttcgggagcatcggtggcgtgttcacctcagttggtaagctcgtgcaccagatcttcggcaccgcttacggagttctgttctcgggcgtctcctggaccatgaagattggcatcggtgtcctgcttacgtggctaggcctcaacagccgtagtaccagcctgagcatgacctgtatcgcggtgggccttgtcaccctctatctgggcgtgatggtacaggctgattctggatgcgtcattaattggaagggccgggagctaaaatgcgggtcgggaatctttgttaccaacgaggttcacacatggaccgagcagtacaagttccaggctgactcccctaagcgcctgagcgcggccatcggcaaggcctgggaggagggcgtctgtgggatccggtctgctacccgtttagagaacattatgtggaagcagatcagtaacgaactgaatcacattcttctggagaatgatatgaagttcaccgtcgtggtcggggatgtggcgggaatcttagctcaaggcaagaagatgattagaccccagcccatggaatacaagtacagctggaaatcctggggcaaggccaaaatcataggggccgacgttcagaacacgactttcatcatagacggacccaatacccccgagtgtccagacgatcagcgcgcgtggaacatctgggaggtcgaagactatggatttgggatctttacaacaaacatctggctcaagctccgggactcctacacccaggtgtgcgatcatcgcctgatgtctgccgccatcaaggactccaaagcggttcatgctgacatgggctactggatcgaatccgagaaaaatgagacatggaagctggcgcgggcttccttcatcgaggtcaagacttgtatttggcccaagagccacacgctgtggagtaacggtgtgttggagtccgaaatgatcataccgaagatttacgggggcccgatctcacaacataaccacagacccggatacttcacgcagactgccggcccctggcacctcgggaagctggagttagactttgacctatgcgaaggcaccaccgttgtcgtagacgagcattgcggtaaccgtgggccttcactgcgcaccaccacggtgacgggcaagattatccacgagtggtgttgccggagctgcaccctgccccccctcaggttcaagggggaagacggctgctggtacgggatggagatccgacccgtcaaggagaaagaggagaatttggttaagagcatggtgagcgcaggttccggagaggtggacagcttttccctgggtctgctgtgtatttcaataatgattgaggaggtgatgcgctcccgttggtcacgcaagatgctgatgaccggcaccctcgccgtgttcttcctccttataatggggcagttgacttggaacgatctgatccggctatgtataatggtcggcgctaatgcaagcgaccgcatggggatgggcacaacctacctcgcgctgatggctaccttcaagatgcgcccgatgttcgcagttggtttactgttccggaggctgacgagcagagaagtgctgctcctaaccatcgggctgtcactcgtcgcgagcgtggagttaccgaattcccttgaagagctcggagacggtctggccatgggcataatgattctcaagctcctgacagacttccaaagccatcagttgtgggcaacgcttctgtccctgacgttcatcaagaccacctttagcctccactacgcatggaagacaatggcgatggtcctatccatcgtttcattgttccccctctgtctatccactacctctcagaagacgacctggctacctgtgctgctgggcagcctggggtgcaagccgctcactatgtttctgattgccgaaaacaagatctggggccgcaagagctggcccttaaacgaggggatcatggcagtaggcatcgtcagcatactcctctccagcttgctcaaaaacgacgttccccttgcagggccactgattgccgggggaatgctgatcgcgtgttacgtcatctccggatcatccgcggacctgagcctcgagaaggcagccgaggtatcctgggaagaggaggccgagcacagcggagcgtcacataacattctggtggaggtccaggatgacggcaccatgaaaataaaggacgaagagagagacgatacactgaccatcctactcaaggcaaccttgctggctgtgtctggggtataccctctcagtataccggccacgctgtttgtctggtacttctggcagaagaagaaacagcgcagcggagttctgtgggacaccccaagccctcccgaggtggagcgggcagtcctcgacgacgggatatacaggataatgcaacgaggccttctggggcgctcccaagtcggcgtgggagtattccaggagaatgttttccacacgatgtggcacgttacccggggcgccgtcctgatgtaccagggaaagcgccttgagccctcctgggcctcagtcaaaaaagatctgatttcgtatggtggcgggtggcggctgcagggcagctggaacactggggaagaggtgcaggtaatcgctgtcgagcccggcaagaaccccaagaacgtgcagaccgccccgggaaccttcaagactagcgagggagaggtcggcgcaatcgcgctcgatttcaagcccggcacgtccggtagccccatagtaaaccgcgaaggtaagatcgtgggcctgtacggcaacggggtggtgaccacctccggaacatacgtgagcgccatcgcccaggccaaggcgagtcaagagggacccctgcccgagatcgaggatgaggtctttcggaaacgcaatctcacgatcatggacttacacccgggcagcgggaaaacgcggaggtatctgccagccatcgtacgggaggctatcaagcgcaagttacggaccttgatattggccccgactcgcgtggtggcctcggagatggcagaggccctcaaaggaatgcctattcgttaccagacaacggccgtcaagagcgaacacaccgggaaagagattgtggatctgatgtgtcacgctactttcacgatgcggttactctcacccgtccgggtgcccaattacaacatgatcataatggacgaggcgcatttcacggaccctagcagcatcgcagccagggggtatattagtacccgcgtggggatgggagaggcggccgcgatcttcatgaccgcgacgccgcccggctccgtcgaggcctttccccagagtaatgccgtgatccaagacgaggagcgggacataccggaaagaagctggaacagcgggtacgagtggatcaccgatttccccgggaagaccgtgtggttcgttccctccatcaaatcgggcaacgacatcgcgaactgcctccggaagaatggtaagcgcgtgatccagctgagtcggaagacctttgacacggagtatcagaagaccaaaaataacgactgggactacgtggtcactacggacatcagtgagatgggagcgaacttccgagcggaccgggtgatcgatcctcgccggtgccttaagcccgtaatcctgaaagacgggcccgagcgcgtcatccttgccggcccgatgcccgtcacggtcgcttccgccgcccagcgcagaggcaggatcggccgcaaccacaacaaggagggtgatcagtacatctacatggggcagccactcaataacgatgaggaccacgcccactggacagaggccaagatgctgctcgataacatcaatacccctgagggcatcattcccgccctcttcgaaccggagagagaaaagtcggccgcgatcgatggggagtatagactgcgcggggaggcaagaaagactttcgtggagctgatgcgtcgcggggacctcccggtctggctgagttataaagtggcctccgagggctttcagtacagcgatcgtcggtggtgcttcgatggcgagaggaataatcaagttctcgaggagaacatggacgtggagatctggacgaaagagggcgaacgcaagaagttacgacctcgctggcttgacgcccgcacctacagcgatcccttggcgcttcgagaattcaaggagtttgcagcggggcgtcggtccgtctccggggacttaatactagagataggcaagctcccccagcatctgacccaacgcgcacagaacgcgctggataacctcgtgatgctgcataactccgagcagggcggtcgcgcatacagacatgcgatggaggaactgccggacaccatagagacgctcatgctgctggcgctgatcgccgtgctgactggaggggtcacactgttctttctaagcggcagagggctggggaagacaagcatcggactgctctgtgtgatggcctccagcgttctgctgtggatggcatccgtggagccccattggatagccgcttcgatcatcttggagttcttcttaatggtgctgcttataccagagcccgatcgccaaagaacgccgcaggacaaccaattagcctacgtcgtgatagggctgctcttcatgatcctgacggtggccgcgaatgaaatgggcctgctcgagaccaccaaaaaggatctggggatcggccatgtagcggtagaaaaccatcaccacgccgccatgctcgatgtggacctacatccagcttccgcgtggacgctgtatgccgtggccacaaccataatcactcctatgatgcgccacacaatcgagaacacgaccgcgaacatcagccttacagccatcgcgaaccaggctgcaatactcatggggctggacaagggctggccgatctccaagatggacatcggggtcccattactggcactaggatgctactcacaggtaaatcccctgacgctaacggccgccgtacttatgctggtcgcccactacgccattattggtcccgggctccaggcgaaggcgacccgcgaagcgcagaaaagaaccgctgccggcatcatgaagaacccgaccgtggacggcatcgttgccattgacctcgatcccgtcgtgtacgacgcaaagttcgaaaagcagctgggccagataatgctactcattctgtgtacgtcccagatcctcctgatgcgcaccacatgggccctgtgtgagagcatcacgctcgccaccggccccttgaccaccttatgggaaggcagccccggcaagttctggaacactacaatcgccgtaagcatggccaacatcttccgggggtcctaccttgccggcgccgggctggccttctcactgatgaagagtctcggcggtggccgtaggggcaccggggcccagggtgaaaccctgggcgaaaagtggaagcgccagttgaatcaactcagcaaatcggaattcaatacctacaagcggtccgggatcatggaggttgaccgcagcgaggcgaaagagggcttgaagaggggggagactacgaagcacgccgtgtctcgcggcaccgccaagctgcgctggtttgtagagcgaaacttagttaagccggagggcaaggtcatcgacctgggctgcggtcgcggcggatggagctactattgtgcgggcctgaagaaggtcacagaggtcaaggggtacacgaagggaggtcccggtcatgaggagcctatccccatggccacatacgggtggaatctggtgaaattgcactccggcaaggacgttttcttcattccgccagagaaatgtgacaccctactatgcgacataggggaatcttcccccaaccccaccatcgaggagggccgcaccttgcgagtactgaaaatggtggagccttggttacgcggaaatcaattttgcatcaagatccttaatccatacatgccatctgtggtagagaccttagagcagatgcagcgaaaacacgggggaatgctggtgcgaaatcccctcagtcggaattccacccacgagatgtactgggtttcctgcgggactggcaacatcgtcagtgcggttaacatgacctcccgcatgctcctcaaccgattcaccatggcacaccgtaagcccacctacgagcgcgacgtggacctcggggcgggcacccggcacgtcgccgtagagcccgaagtggcgaacttagatatcatcggtcagcgaatcgagaatatcaagcatgagcacaagtcaacgtggcactacgacgaggataacccatacaagacatgggcgtaccatgggtcttatgaagttaagcccagcgggagcgcctccagcatggtcaacggggtcgtaaagctgctcaccaagccctgggacgttatccccatggtcacccagatcgcaatgacggatactacccccttcggccagcagagggtgtttaaagaaaaggtggacactcgaaccccgaaggcgaagcgggggacggctcagatcatggaggtcactgctaaatggctgtggggcttcttgagtagaaacaagaagccgaggatatgcacccgggaagaattcacgagaaaggtgcgcagcaatgcagcgatcggagccgtcttcgtcgacgagaaccagtggaacagtgcgaaggaggctgtggaagacgagcggttctgggatctcgtgcaccgcgagcgggagcttcataagcaggggaagtgcgcaacgtgtgtctataatatgatgggcaagcgcgagaagaaactgggagagtttggaaaggccaagggctcgcgggccatatggtacatgtggctgggcgcccgcttcctggaattcgaggctctaggattcatgaacgaggaccactggttctctcgagagaacagcctctccggagtcgagggtgaggggctccacaaactgggctacatcctcagggacatatcaaagatccccgggggcaacatgtacgccgatgatacagccggctgggatactcgtatcaccgaggacgacttgcaaaacgaggcaaagatcacggacatcatggagccagagcacgcgctgctagccaagtctattttcaagctgacataccagaataaggtagtacgcgttcagcgcccggccaggaacggaacagtgatggacgtcatcagccggcgggaccaaagaggctccggccaagtcggcacctacggcctgaacaccttcaccaatatggaggcccagctaattcggcagatggagtcagagggtatctttagcccatcagagctggagacccccaacttagcgggccgcgtcctcgactggctagagaagcatggcgtagagagattaaagcgtatggcgataagcggcgacgactgtgttgtgaagccaatcgacgaccgttttgcgaccgccctcacggccctcaatgacatggggaaggtccgcaaggacataccgcagtgggaacccagcaaaggctggaacgactggcagcaggtaccattctgcagccaccattttcaccagctgataatgaaggacgggcgggaaatcgtggtcccctgtcgcaaccaagacgagctggtcgggcgggcccgcgtctcccaaggtgcagggtggtcactgcgggagacagcgtgtctaggcaagtcctacgcccagatgtggcagctcatgtacttccaccggcgggacctgcgcttagcggcaaacgctatctgtagcgctgtcccggtggactgggtgcccacctccagaacaacatggtcaatccacgctcaccaccagtggatgaccaccgaggacatgctctccgtctggaaccgcgtgtggatcgaggagaacccctggatggaggataagacccatatatccagctggggcgacgtaccctatctgggcaagcgggaagaccagtggtgcggtagcctgatcgggcttacggcacgcgcaacgtgggccaccaatatacaggtcgccattaaccaagttagacggctgatcggaaacgaaaactacctggactacatgacctctatgaagcgctttaagaacgaatcggacccggaaggcgccctctggtag

SEQ ID NO: 24265 - RNA, 9879 nt, synthetic construct
  misc_feature 1..9879: note = derived and/or modified CDS sequence (opt11) from DENV-1__FJ882539__SS-prME
  source 1..9879: mol_type = other RNA
agcgtgaccatgttgctcatgctgatgcccaccgccctggccttccacttaacaacgcggggcggggaaccccacatgatcgtctccaagcaggaacggggcaagagcctgcttttcaaaacctccgccggggtgaacatgtgcaccttaatcgccatggacctgggcgagttctgcgaagataccatgacctataagtgcccgcgcatcaccgaggccgagcccgacgacgtggattgctggtgcaacgccaccgacacctgggtcacctacgggacctgcagccagaccggcgaacacagacgggacaagagatccgtggccctcgcgccccacgtgggtctcgggctggagacgcgcacggaaacctggatgagcagtgagggcgcctggaagcagatccagcgggtcgagacctgggcgctgcgccaccccgggttcacggtgatcgccctcttccttgcgcacgccattggcaccagcattacccagaaggggatcatcttcatcctgctgatgctggtgaccccctcaatggccatgcggtgtgtcggcattggcagcagagacttcgtggaggggctttccggggccacgtgggtggacgtcgtccttgagcacggaagctgcgtgaccaccatggccaaggacaagccgaccctggatatcgaattactgaagacggaggtcactaacccggcggtgttacggaagctgtgcatcgaggccaagatctctaacactaccacggacagccgctgcccgacccagggcgaggccacgctcgtggaggagcaggacgccaacttcgtgtgccggcgcacctttgttgaccggggctgggggaacgggtgcgggctgtttggcaaaggttccctgataacctgcgccaagtttaagtgcgtgaccaagctcgagggcaagaccgtccagtacgagaacctaaagtacagcgtgatcgtgaccgtacacactggcgaccagcaccaggtggggaacgagtccacagagcacggcaccaccgcgactatcacgccccaagcacccagcaccgagatccagctgacagactacggggccctcaccctggactgcagcccacggacgggcctggacttcaacgaaatggtcctcctgaccatgaaggagaagtcctggctggttcacaagcagtggttcctcgacctgccgctaccctggaccagcggggccctagcttcccaagagacctggaaccggaaagacctgctggtgacgttcaagaccgcgcacgccaagaagcaagaggtcgtggttctcggcagccaggagggcgccatgcacaccgccctgacaggggcgacggagattcagacctcaggcaccaccacgatcttcgcggggcacctgaagtgccgacttaagatggacaagctgaccctgaaaggcatgagctatgtcatgtgtaccggctcatttaagctagagaaggaggtggccgaaacccagcacggcacggtgctggtccagatcaagtacgagggcaccgatgccccgtgcaagatccccttcagcacccaagacgagaaagggatcacccagaacggccggctgatcacggccaaccccatcgtcaccgataaggagaagccggtgaacatcgaggcggagccgccctttggggagtcctacatcgtcatcggcgccggcgagaaggccctgaagctcagctggtttaagaaggggtccagcatcggcaagatgttcgaggccaccgcccgcggggctcgccgcatggctatcctaggcgacacggcatgggacttcgggtccatcggcggcgtgttcacgagcgtggggaagctggtacaccagatcttcggcaccgcctacggggtgctgttctccggcgtgagctggaccatgaagatcgggatcggcgtcctgcttacctggctcggcctgaactcccgctctacgtccctgagcatgacctgtatcgccgtggggttagtgaccctgtatctcggcgtcatggtgcaggcggactccggttgcgtgatcaattggaaggggcgggagctcaagtgcggtagcggcatcttcgtgacaaatgaggtgcacacttggacagaacagtacaagtttcaggccgactctccgaagcgcttaagtgccgcaatcggcaaggcctgggaggagggggtctgtggcatccggagcgcgacgcgcctggagaacatcatgtggaagcagatctctaatgagctcaaccacatcctactggaaaacgacatgaagttcaccgttgtggtgggggacgtcgccggcatcctcgcgcaggggaagaaaatgatccggccccaacccatggagtacaagtactcttggaagtcctggggcaaggccaagataatcggcgcggacgtgcaaaacaccacgtttatcatcgacgggcccaataccccggaatgccccgacgaccagcgcgcctggaacatctgggaggtggaggactacggcttcgggatctttaccaccaacatatggctgaagctgagagacagctacacgcaggtctgcgaccaccgcctcatgtccgccgctatcaaggactcaaaggccgtgcacgcggacatgggctactggatcgagtccgagaagaacgagacctggaagctggcccgcgccagcttcattgaagtgaagacgtgcatctggccgaaatcacacaccctgtggagcaacggcgtcctcgagtcggagatgatcatccctaagatctacgggggcccgataagccagcataaccaccgccccggttacttcacgcagaccgccggcccctggcatctggggaagctggagctcgacttcgacctgtgtgagggcaccactgtggtggtcgacgagcactgcggcaaccgggggccgtccctgcgcacgaccacagtgaccggcaagataatccacgagtggtgctgccgcagctgcaccttgccacccctccgcttcaagggggaggacggctgctggtacgggatggagatccggcccgtaaaggaaaaggaggagaacctggtcaagtccatggtaagcgccggcagcggcgaagttgactccttcagcctcgggctgctgtgcatctccatcatgatcgaggaggttatgcgcagccggtggtcgcgcaagatgctcatgacaggcaccctggcggtgttctttctgttgatcatggggcagttgacatggaacgacctgatccggctctgcatcatggtgggcgccaacgccagcgataggatggggatgggcacgacctacttagccctgatggccaccttcaagatgcgcccgatgttcgcggtcggcctcctgttccggcgcctgacgtccagggaagtgttgctgctgaccatcggactctcgttagtggcctccgtcgagttgcctaacagcctcgaggagctgggcgatgggctggccatgggcatcatgatcctcaagctgctgaccgacttccaatcccaccagctctgggctaccctgttgtctctcacctttatcaagacgacgttctccctgcactacgcgtggaagaccatggccatggtgctgagcatcgtctccctcttcccactgtgcctgagcaccacgagtcagaagacgacctggctccccgtgctgttgggtagtctcgggtgcaagccgctgaccatgttcctgattgcagagaataagatctggggccggaagtcctggcccctcaacgaggggatcatggccgtaggcatcgtcagcatcctgttaagttccctcctgaagaacgacgtgcccctggccgggcccctcatcgccggcggcatgcttatcgcgtgctacgtgatcagcgggtccagcgcagacctgtccttagagaaggccgccgaggtctcatgggaggaggaggcagagcactccggcgcctcacacaacatcctagtggaggtgcaggacgacgggacgatgaagatcaaggacgaggagcgggacgacaccttgaccatcctcctgaaggcgaccctgctcgccgtctctggcgtgtacccgctgagcatccccgccaccctgttcgtgtggtacttctggcagaagaagaagcagcgctccggtgtcctctgggacacacccagcccacccgaggtggagcgggcggtgcttgacgacggcatttaccgcatcatgcagcggggtctgctagggcgctcccaggtaggcgtgggggtgttccaggagaacgtctttcacacgatgtggcacgtgacccggggtgccgtgctcatgtaccaagggaagcgcctggagccgagctgggcctccgtcaagaaggacctgatcagttacggcggcgggtggcggctccaggggtcgtggaacaccggggaggaggtccaggtgatcgcggtggagcccggcaaaaaccccaagaacgtgcagacggcccccgggaccttcaagacctctgagggcgaggtgggtgcgatcgccctggacttcaagcccgggacctccggtagccccatcgtcaaccgcgaagggaagatcgtgggtctgtacggcaacggggtggtcaccaccagcggcacctacgtgtccgccatagcccaggcgaaggccagccaggaggggcccctcccggagatcgaggacgaggtgttccggaagcgcaacctgaccatcatggacctgcatccaggctccgggaagacgcgtcgctacctccccgccatcgtccgggaggccatcaaacgcaagctgcggaccctgatcctcgccccgacccgcgtagtggcgagcgagatggccgaggccctgaagggcatgcccatccgctaccagaccacggccgtcaagtccgagcacaccggcaaggagatcgtggacctgatgtgccacgccaccttcaccatgcgccttctgtcacccgttcgcgtccccaactacaacatgatcatcatggacgaggcgcacttcacggacccgtcaagcatcgccgcccgggggtatatttccacacgcgtaggaatgggggaggccgccgcgatatttatgactgcgacaccgcccggctcggtcgaggccttcccgcagtccaacgctgtcatacaggacgaggagcgggacatcccggagcgcagctggaactccggctacgagtggatcacggacttccctggcaagaccgtgtggttcgtgcctagcatcaagtccggcaacgacatagcgaactgcctgcggaagaacgggaagcgcgtcatccagctctcgcggaagaccttcgacacagagtaccaaaagacgaagaacaacgactgggattacgtggtgactaccgacatctccgagatgggcgccaacttcagagctgaccgggtcatcgaccctcgccggtgcctgaagccggttatccttaaggacgggcccgagcgtgtgatactcgccggccccatgccggttaccgtggcaagcgcggcccaacggcgcgggcggatcggccgcaaccacaacaaggagggcgaccagtacatctacatgggtcagccgctgaataatgacgaggaccatgcccactggacggaggcaaagatgcttctcgacaacatcaacacccccgagggcatcatccccgccctgttcgagcccgagcgggagaagtccgctgcgatcgacggggagtaccgcctccgcggcgaggcccggaagaccttcgtggagctcatgcgccgcggagacctgccggtgtggttgagctacaaggtggccagcgagggctttcagtactccgaccgccggtggtgcttcgacggcgagcgcaacaaccaggtcctagaggagaatatggacgtggagatctggaccaaggagggggaacggaagaagctgcgccccagatggctggatgctcgcacgtatagcgaccccctcgcgctgcgggagttcaaggagttcgccgccggccgccgttccgtgagcggggacctgatcctagagatcggcaagctgccccagcacctgacccaacgcgcccagaacgcgctcgacaatctggtcatgctgcacaactccgagcaaggagggcgggcatatcgccacgccatggaagaactaccggacaccatcgaaacactgatgctgctggccctgatcgccgtgctgacgggcggagtgaccctcttcttcctgagcggtcgagggctgggcaaaacctccatcggcctcctgtgcgtcatggccagttccgtgttgctctggatggcctcggtcgagccccactggatcgcggcctccatcatcctggagttctttctgatggtcctcctgatcccggagcccgaccgccagcgaaccccgcaggacaatcagctggcctacgtggtgatcgggctcctgttcatgatcctgaccgtcgcggccaatgagatgggcctcctcgagactaccaagaaggacctggggattggccatgtggccgtggaaaaccaccaccatgccgccatgctcgacgtcgacctgcatcccgcgagcgcctggaccctgtacgccgtggccaccacgatcatcacccccatgatgcgccataccatcgagaacaccacggccaacatctccctaaccgctatcgccaatcaggccgccatcctgatggggctggacaagggctggccgatcagcaagatggacatcggcgtgcccctcttagctctggggtgctattcccaggtcaaccccctcaccctgaccgccgccgtgttgatgctggtggcccactacgcgatcatcggccccggcctgcaggcgaaggccacgcgggaggcccagaagcgcaccgccgccggcatcatgaagaacccgaccgtcgacgggatcgtcgcgatcgacctggatccagtggtctacgacgccaagttcgagaagcagctcggccagattatgctgctgatcctctgcacctcgcagatacttctgatgcggaccacttgggcactctgtgagtccatcaccctggccaccggccccctgacgactctctgggagggttcaccgggcaagttctggaacacaaccatcgccgtgtcgatggcgaacatcttccgcgggagctacctagccggcgccggcctcgccttcagcttgatgaaatccctagggggcgggcgacgggggacgggggcgcagggagagaccctgggcgagaagtggaagcgccagctcaaccaactgagcaagtccgagttcaacacctacaagcggagcgggatcatggaggtggatcgctccgaggccaaggagggccttaagcgcggggagaccacgaagcacgccgtcagccgcggcaccgccaagctccggtggtttgttgagcgaaacttggtgaagccggagggaaaggtcatcgacctaggctgcggccgcggcgggtggtcctactactgcgccgggctgaagaaggtgaccgaggtgaaggggtacaccaagggcggccccggccacgaggagcccatccccatggcgacttacggatggaacctcgtcaagctacacagcggtaaggacgtattcttcataccgcccgagaagtgtgacaccctgctctgcgacatcggggagtcgagcccaaaccccaccatcgaggaggggcgcacgctgcgggtgcttaagatggtcgagccgtggctccgcgggaaccagttctgcatcaagatcctgaacccctacatgccctccgtggtggagacgctggagcagatgcagcggaagcatggcggcatgctcgtccgcaaccccctcagcagaaactccacccacgaaatgtactgggtgagctgcgggaccgggaacatcgtgagcgccgtaaacatgaccagccgcatgctgctaaacaggttcaccatggcccaccgcaagcctacgtacgaaagggacgttgacctaggagccggcacccggcacgtggccgtcgagcccgaggtggcgaatctggacatcattggccaacgaatcgaaaatataaagcacgaacataagtccacctggcactacgacgaggacaacccctacaagacctgggcctaccacgggagctacgaggtgaagccctccggcagtgctagctccatggttaacggggtggtcaagctcctgacgaagccgtgggacgtgatacccatggtgacccagattgccatgaccgacaccacgcctttcggccagcagcgggtcttcaaggagaaggtcgacactcgcacccccaaggccaagcgggggaccgcgcaaattatggaggtgacggccaagtggctgtggggcttcctctcgcgtaacaagaagccgcgcatctgcacgcgcgaggagttcactcggaaagtcagatccaacgccgccatcggggcggtgttcgtggatgagaatcagtggaacagcgcaaaggaagccgtagaagatgagcggttctgggacctggtgcaccgcgagcgggaactgcacaagcaggggaagtgcgcgacctgcgtgtacaacatgatgggcaagcgcgagaagaagctcggagagttcggaaaagcaaaggggagccgggcgatctggtacatgtggctcggggctcgcttcctggagttcgaggccctcggctttatgaacgaggatcactggtttagccgggagaacagcctgtcgggagtcgaaggcgaggggctgcacaagctcggctacatcctgcgcgacatctccaagatccccgggggcaacatgtacgccgacgacacggccggctgggacacccggataaccgaggacgacttacagaacgaggcgaagatcacggacatcatggagcccgaacacgccctcctggccaagagcatcttcaaactgacctaccagaacaaggtggtgcgcgtccaacggccggctaagaacgggaccgtgatggacgtgatatccaggcgcgaccagcggggcagcgggcaggtcggcacctacggcctcaacaccttcacgaatatggaggcccaactgatccgccagatggagtccgaggggatattcagcccctcagaactggagacgcccaacctcgccggccgggtgctggactggctggagaagcatggggtggagcggctcaagaggatggccatcagcggcgacgactgcgtcgtgaagccaatcgacgaccgcttcgcgacggcactgaccgccttgaacgacatggggaaagtaagaaaggacatccctcagtgggagccttccaagggctggaacgactggcagcaagtccccttttgcagccaccatttccaccagctcatcatgaaggacggccgcgaaatcgtggtgccctgcagaaaccaggacgagctggtcgggcgcgcgcgggtaagccagggcgccgggtggtccctgcgcgagacggcctgcctcggcaagtcttacgcccagatgtggcaactgatgtatttccaccggcgcgacctgcggctcgcggccaacgccatctgctccgccgtgcccgtcgactgggtgcccaccagccgaacgacctggtccatccacgcccaccaccagtggatgacgaccgaagacatgctaagcgtgtggaatcgggtctggatcgaggagaacccctggatggaggacaagacacacatctccagctggggcgacgtgccctacctgggcaaacgcgaggaccagtggtgtggctctctcatcgggctgaccgcgcgggctacgtgggcaaccaacatacaggttgccatcaaccaggttcgccgcctgattggcaacgagaactacctcgactatatgaccagcatgaagcggtttaagaacgagtccgatccggagggggccctgtggtga

SEQ ID NO: 24266 - RNA, 9879 nt, synthetic construct
  misc_feature 1..9879: note = derived and/or modified CDS sequence (opt11) from DENV-1__FJ882541__SS-prME
  source 1..9879: mol_type = other RNA
agcgttacgatgctgctcatgttaatccccaccgcattagcattccacctcaccacccggggcggggagccccatatgatagtgtctaagcaagagcggggcaaaagccttctgttcaagaccagtgcgggggtgaacatgtgcacgctcatcgccatggacctgggtgagctatgcgaggataccatgacgtataagtgccctcggatcaccgaggtggagcccgacgacgtcgactgctggtgcaacaccacggatacttgggtgacctacggtacctgttcccagacgggagagcatcgacgcgacaagcggagcgtggcccttgcaccccatgttgggcttgggctcgagacccgcgccgaaacctggatgagctcagagggcgcgtggaagcagatacagaaggtggagacatgggccctccggcaccccggattcaccgtgatcgccctgttcttggcccacgcgatcggtaccagcatcacccagaagggaatcatcttcatcctcctcatgctggtcacaccatccatggccatgaggtgcgtgggcatcggcagccgggacttcgtggaggggctctccggagccacctgggtcgatgtggtactggagcacggtagttgtgtcaccaccatggctaaggacaagccaaccctggacatcgagctcctgaagacggaggtaaccaacccagccgttcttcgcaagctctgcatcgaggctaagatctccaacactaccacggacagccggtgcccaacccagggtgaggccactctggttgaggagcaggatgccaatttcgtttgccgccggacctttgtggaccgcggctggggcaacggctgcggcctgttcggcaaaggatccttaatcacgtgcgccaagttcaagtgcgtaaccaagttagagggaaagatcgtacagtacgaaaacctgaagtacagcgtgatcgtgactgtacacaccggcgaccagcaccaggtcggcaacgagtccacggagcacgggactaccgccaccatcacgccccaagcgcccacgagcgagattcaactcactgactatggagccctaaccctggactgcagcccacggacaggccttgacttcaacgagatggtgctgctgacgatgaaggggaaatcctggcttgttcataagcagtggtttctagacctgcccttgccctggacctccggggcaagtactagccaggagacctggaatcgccaggatctgctggtcacattcaaaaccgcacacgccaaaaagcaggaggtggtggtcctcggtagccaagagggagcgatgcacacagccctgaccggcgcgacggaaatccagactagcgggacaaccactatcttcgccggacacttgaagtgcaggctcaagatggacaagctgacactgaagggcatgtcctacgtgatgtgcacgggatcatttaagttagagaaggaggttgccgaaacccagcacggcacggtcctggttcagatcaagtacgaggggaccgatgcgccgtgcaagattccattctccacccaggacgagaaaggcgtgactcagaacgggcgcctcatcacagcgaatccaatcgtcacggacaaggagaagcctgtgaacatcgaggccgaaccgcccttcggtgagtcatatattgttatcggggccggggagaaggctctgaagctctcatggttcaaaaagggtagctccatcgggaagatgttcgaagccactgcccggggcgctcgccggatggccatactgggggataccgcgtgggacttcggcagcatcggcggggtcttcacgtccgtaggaaagctggtgcaccagatattcggtactgcctacggcgttctcttcagcggggtgtcgtggaccatgaagattggaatcggcgtgctactgacatggcttgggctgaacagccgctccacgtcgctgtccatgacctgcatcgcggtcggcctggtgaccttatacctgggggtgatggttcaggccgacagcggctgcgtaatcaactggaaggggcgtgagttaaagtgcggcagcggcatctttgtgacgaacgaggtccacacgtggaccgagcagtataagttccaggcggactccccgaagcgactgagcgcggccatcgggaaggcctgggaagagggcgtgtgcggtattcgcagcgccacccggcttgagaacatcatgtggagacagatctcaaacgaactcaaccatatcttactggagaacgacatgaagttcactgtcgtcgtcggcgacgtggtggggatcctcgcccagggcaaaaagatgatacgccctcagccaatggagcacaagtacagctggaagtcctggggcaaggcgaagatcataggcgcagatgtgcagaacacgactttcatcatagacggccccaacaccccggagtgcccggacgatcaaagagcgtggaacatctgggaggtggaggactacgggttcgggatcttcaccaccaacatatggctgaagctgcgggactcctacacccaggtttgcgaccaccgccttatgagcgccgcgatcaaggactccaaggccgtgcacgcagacatgggctactggatcgagagcgagaagaacgagacctggaagctagcccgtgcctcgttcatcgaggtgaagacgtgtatctggcccaagagccacaccctttggtccaacggggtcctcgagagcgagatgattatccccaaaatttacggcgggccgatctcccagcacaattaccgcccaggatatttcacgcagacagccggaccctggcacctaggcaagctggaactagacttcgatctgtgcgagggcaccaccgtcgtggtcgacgagcactgtgggaaccggggcccgtctctgcgtacgaccaccgttactgggaaaattatccacgagtggtgctgtcgatcctgcaccctgccgcccttacgctttaagggggaggacggttgctggtacggcatggagatccgaccggtaaaggagaaggaagaaaacctggtgaagtcaatggtgagcgccggaagcggggaggtagactccttctccctcgggctgctgtgcatctccataatgatcgaggaggtcatgcgctcccggtggagccgcaaaatgctcatgaccgggaccctcgccgtgttcttcctgctcatcatgggccaactgacttggaatgacctgattcggtcctgcataatggtgggggccaatgcgagcgaccgcatggggatgggcacgacttatctcgccctgatggctaccttcaagatgcgcccgatgttcgccgtcgggctccttttcaggcgcctgacatccagggaagtgctcctccttactatcggactttcactcgtggccagtgtggaactacctaacagcctggaggagctcggggatggactggctatgggcatcatgattctgaaattacttactgattttcaatcctatcagctgtgggctaccttgctgagcttgaccttcatcaagacgacgttttccctccactatgcctggaagacaatggccatggtcctgagcatcgtatccctactccccctgtgcttaagcaccacatcccaaaagaccacctggttacccgtgctgttggggtcgctcggctgcaagcccctgaccatgttcttaatagctgaaaacaagatctgggggcgcaagagctggcccctcaacgaaggcatcatggccgtggggatcgtctccatattactgagctccttgttaaagaacgacgtgcctcttgccgggcccctcatcgccggcgggatgctgatcgcctgttacgtgataagcggctcctcggctgacctgtccctcgagaaagcggccgaggtgagctgggaagaggaagccgagcactcgggcgcctctcacaacatcctggtcgaagtgcaggacgacggcacgatgaaaatcaaagacgaggagagagacgacaccctgaccatactcctgaaagccactctgctcgcggtctccggggtctacccgctgagcatcccggccactctattcgtgtggtatttctggcagaagaagaagcagagatcgggcgtcctctgggacaccccctcaccgcccgaggtggagagggccgtgctcgatgacgggatctaccgcatcatgcagcggggtttactgggacgatcccaggtcggcgttggcgtgttccaggaaaacgtcttccacaccatgtggcacgtgacccgcggggccgtgctcatgtatcagggcaagcgactagagccctcttgggcctccgtaaaaaaggatctgatcagctatggcgggggatggcggctccagggatcctggaataccggcgaggaggtgcaggtgatcgcagtggagcccgggaagaaccccaagaacgttcagacggcccctggtaccttcaagacccccgaaggcgaggtgggggcgatagccctggacttcaagcccggcacgagtgggagccccatcgtcaatcgcgagggaaaaatcgtgggcctttacgggaacggcgtcgttacgacctcggggacctacgtgtccgccatcgcgcaggcaaaggcctcacaggagggcccgctccctgagattgaggacgaggtgttccggaagcgcaatttgaccatcatggatctgcaccccgggagcggcaaaactcggcgctacttaccggccatagtaagggaggcgatcaagagaaagcttcggacactgatactcgctcccacccgcgttgtggcctccgagatggccgaggccctcaaaggcatgcccatccgttaccaaacgacggcggttaagagcgaacacaccgggcgggagatcgtggacctgatgtgtcacgcaaccttcaccatgagactcctgtcccccgtgcgggtccccaattacaatatgataataatggacgaggcacatttcacggaccctagctcaatcgccgcgcgaggctacatttccacccgggtgggcatgggtgaagcggccgccatcttcatgaccgccacgccgcccgggtccgtggaggccttcccgcagtccaacgcggttatacaggatgaagagcgcgatatccccgaaagatcctggaacagcggctacgagtggataacggactttcccggaaagacagtttggttcgtgccctccatcaagagcgggaacgatatcgccaactgcctgagaaagaacgggaagcgggtaatccaactctctcggaagaccttcgacacggagtaccagaaaactaagaataacgactgggactacgtggttacgacagacatcagcgagatgggcgctaacttccgggcagacagggtcatcgacccacgtcgctgccttaagccggtgatccttaaagacggccccgagcgagtcatcctcgccgggccaatgccggtgactgtggcatccgccgcacagaggaggggccgcatcgggcggaaccataacaaggagggcgaccagtacatctatatgggccaacccctgaacaacgacgaggatcatgcccactggacggaggctaaaatgctgctcgacaatataaacacgcccgaagggataatccccgccctgtttgagccagaacgcgagaaatccgccgctatcgacggagagtaccgcctgcgaggagaagctagaaaaaccttcgtcgaactcatgcggcgcggagatctgcctgtgtggctgagctacaaggtggcgtcggagggcttccagtatagcgatcggcgctggtgctttgacggagagcgaaataatcaggtcctcgaggagaacatggacgtggagatctggaccaaggagggggagcgcaagaaactgcggccgcgctggttagatgcccggacgtattccgatcccctcgccctgcgcgagttcaaggagttcgccgccgggcggaggagcgtgtccggggatctgatcctcgagattggaaagctcccgcagcaccttacccagagggcacagaatgctttggacaacttagtcatgctgcacaacagtgagcagggcgggcgcgcctaccgtcacgccatggaggagttacccgacactattgagaccctgatgcttctcgcgctaatcgcggtgttaaccggcggggtgaccctgttcttcctatccgggcgcgggctgggcaaaaccagtattgggcttctgtgcgtgatggcgtccagcgccctgctctggatggcctccgttgagccccactggatagcggccagcatcatcctggaattcttcctaatggtgctcctgatacccgagccggaccggcagcgcacacctcaggacaaccaactggcctacgtcgtaataggcctcctgttcatgatcctgaccgtggccgccaatgagatgggtcttctggagacgaccaagaaggacctaggtataggacacgtcgcggtggagaaccaccaccatgccacaatgctcgacgtggacctgcaccccgcctcggcgtggaccctgtacgctgtagcgacgaccatcatcacaccgatgatgcgacacactatcgaaaacaccactgctaatatcagcctcacggccattgccaaccaagcagcgatcctgatgggactagataagggctggcccatttctaaaatggatatcggggtgccgctcctggcccttggctgctactcacaggttaaccccctcaccttgaccgcagcggtgctgatgctcgtggcgcactacgccatcatagggccgggcctgcaggccaaggccacccgcgaggcccagaaacggaccgccgccgggatcatgaagaacccaaccgtggatgggattgtcgccattgatcttgaccccgtggtgtacgatgcaaagttcgagaagcagctcggccagatcatgcttctgatcttgtgtacgtcccagatactgctgatgagaacaacctgggctctttgcgagtccatcaccctggccaccgggcccctgaccaccctctgggagggctcccctggcaagttctggaacaccacgatcgctgtcagtatggcaaacattttccgcggcagctacctcgccggagccgggctcgcgttctcccttatgaagtccctgggcggaggccggcgcgggaccggtgcccagggcgagaccctgggagagaagtggaaacggcagctcaaccagctgtcaaagagcgagtttaacacgtacaagcgatccggcatcatggaggtggaccgttccgaggcgaaggagggactgcgacgtggggagacgaccaagcacgccgtatcccgcgggaccgcaaaactacggtggttcgtcgagagaaatttagtgaagcccgagggtaaggtgatcgaccttggttgtgggcggggcgggtggtcgtactactgcgcgggcttgaagaaggtaactgaagtgaaagggtacacaaaggggggccccgggcatgaggaaccaatcccgatggccacctacggatggaacctcgtgaagctccattcgggaaaggacgtcttctttatccctcccgagaagtgtgacaccctgctctgcgacatcggcgaaagctcgcccaaccctaccatagaagaggggcgcaccctgcgggtactgaaaatggttgagccctggctcagaggcaaccagttctgcatcaaaatcctgaacccctatatgccgagcgtcgtggagaccctggagcagatgcagcggaagcacggcggaatgcttgtacgcaacccgctgtccaggaacagtacacacgagatgtactgggtcagctgtggaactggtaacattgtgtcggcagtgaacatgacttctcgcatgctgctcaaccgtttcaccatggcccatcggaagccaacctacgagcgcgacgtcgacctgggcgcgggaacacgccacgtcgcagtggagcccgaggttgccaacttggacataatcgggcagcgcatcgagaacataaagcacgaacacaagagcacctggcactacgacgaggataacccctacaagacatgggcctatcacggcagctatgaagtgaagccgagcggttcggcaagtagcatggttaacggggtggtgaaactgctgaccaagccctgggacgtcattccaatggtgacccaaattgcaatgaccgatacaacacccttcgggcagcagcgggtgttcaaggagaaggtggacacacgcacccccaaggctaagcggggcaccgcccaaataatggaggtcaccgctcgctggctgtggggcttcctctcccgcaacaagaagccacgcatctgcacccgggaggagttcacacgaaaggtgcggagcaacgccgcgatcggagccgtattcgtggacgagaaccagtggaattccgccaaagaggcggtggaggacgagcggttctgggacttggtccaccgggaacgggagttacataagcaaggcaagtgcgcgacgtgtgtgtacaatatgatggggaagcgggagaagaagctcggcgagttcgggaaggctaagggcagccgggctatctggtacatgtggctgggggcccggtttctggagttcgaggctctaggcttcatgaacgaagaccattggttctcccgtgagaacagtctaagtggcgtggagggggaaggcctgcacaagctcgggtacatcctccgggacataagcaagatccccggtggaaacatgtacgccgacgacaccgctgggtgggacacccgcataactgaagacgacttgcagaacgaggccaaaatcacggacataatggagcctgaacacgccctcctggcaacctccatcttcaagctcacctaccaaaacaaggtagtacgcgtgcagcggcccgcgcgtaacggaaccgtcatggatgtgatcagccggcgcgaccagaggggatccggccaggtgggaacgtacggtttgaacacgtttacaaacatggaggcccagctgatccgacaaatggagagtgagggcatttttagcccatctgagctggagacccccaatctcgccgagcgcgtgctggactggctggagaagcacggggtggagcgcctcaaacggatggctatcagtggcgacgattgcgtcgtaaagccgatcgacgataggttcgctacggccctgtctgccctgaacgacatggggaaggtgcggaaggacatcccccagtgggagcccagcaagggctggaacgactggcagcaggtccccttctgctcccaccactttcaccagctgattatgaaagacggccgggagatcgtcgttccgtgcagaaatcaggacgagctggtagggcgcgcccgggtatcccaaggagccgggtggtctctgcgcgagacggcttgccttggaaagtcatacgcgcagatgtggcaactgatgtactttcatcggcgtgacctgcggcttgcagccaatgcaatctgcagcgcagtgcccgtggactgggtccccaccagccgtaccacgtggtcaatacacgcccaccaccagtggatgacgaccgaggacatgctgagcgtgtggaaccgggtgtggattgaggagaacccctggatggaggacaagacccacatcagcagctggggcgatgtcccttacctgggcaagcgggaggaccagtggtgcggctccctaatcggtctgacggcccgtgccacctgggccaccaacattcaggtggcgatcaaccaagtgcggcggctgatcggtaacgagaactatttggactacatgactagcatgaagcggttcaagaacgaatccgaccccgaaggggccctgtggtga

SEQ ID NO: 24267 - RNA, 9879 nt, synthetic construct
  misc_feature 1..9879: note = derived and/or modified CDS sequence (opt11) from DENV-1__FJ882542__SS-prME
  source 1..9879: mol_type = other RNA
tcggtgacaatgctgctcatgctgatgcccaccgcgctggcattccatcttaccaccaggggaggcgaaccccacatgatcgtgactaaacaggaacgggggaagtccctgctctttaaaaccagcgcgggagtgaatatgtgcactctcatcgccatggacctgggcgagctgtgcgaggacaccatgacctacaagtgcccccggatcactgaggccgagcccgacgacgttgattgctggtgcaacgcaaccgacacctgggtgacctacgggacttgcagtcagacaggcgaacaccggcgcgacaagcgaagcgtggccctcgcaccccacgtgggtctagggctcgagaccaggaccgagacctggatgtccagcgagggggcctggaagcaaatccagagagtggagacgtgggccctccgccaccccgggttcacagtgattgccctgttcctggcgcacgccatcggcacttccatcacccagaaggggatcatctttatcctcctgatgctagtaacgcctagcatggccatgaggtgcgtaggcatcggctctcgcgatttcgtggaggggctcagcggcgccacctgggtggacgtcgtgctcgaacacggttcctgcgtgaccactatggccaaggacaagcccacgttagatatcgagctcctgaagaccgaggtcaccaatcctgcggtgctgcgcaagctatgtatcgaggccaagattagcaacaccacgaccgactcacgctgccccacccagggcgaggccaccctgatggaggagcaggacgccaattttgtgtgccggcgcacgtttgtcgaccgtgggtgggggaacgggtgcgggctgttcggcaaggggtctctcattacgtgcgcgaaattcaagtgcgtaaccaagctggagggcaagatcgtgcagtacgagaacttgaagtactccgttatcgtgaccgtgcacacgggcgaccagcaccaggtcgggaatgagagcactgaacacggcacaaccgcgacaatcacgccccaggctccaacctccgagatccaactaactgactacggggccctgaccctggactgcagcccccgcacaggcttagacttcaacgagatggtccttctaactatgaaggagaagtcctggctcgtgcacaagcagtggtttctggacctcccgctcccctggaccagcggggcctcaacctcccaggagacgtggaatcggcaggacctgctagtgacgttcaaaactgcccacgccaagaagcaggaggtcgtcgtcctcggcagccaggagggagcaatgcacaccgccctgacgggggccaccgagattcagacgagtggcaccacgactatcttcgctggacacctcaagtgccgtctaaagatggacaagctgacactgaagggcatgagctacgtgatgtgcacagggtcattcaagctcgagaaggaagtcgcagagacgcagcacgggaccgtgctcgtccaaatcaaatacgagggcaccgatgccccctgcaagatccccttcagcacccaggacgagaagggggtcacgcagaacggccggctgattaccgccaacccgatcgtgaccgacaaagaaaagcccgtgaacatcgaggccgagccgccctttggggagtcttacatcgtcatcggcgctggggagaaggccctgaagctcagctggttcaagaaggggtccagcatcggcaagatgtttgaggcgacggctcgcggggccagacgcatggccatcctgggcgacacagcctgggacttcggctcagtgggcggcgtgttcaccagtgtcgggaagctggtgcaccagatatttggcactgcctatggcgtactgttctctggagtaagctggaccatgaagatcgggatcggggtgttgctgacgtggctcggcttgaactctagatcgacctctctgtccatgacctgtatcgccgtagggctcgtcaccctgtacctgggcgtgatggtacaggccgactccgggtgcgtcatcaactggaagggacgggagctaaagtgcgggagcggcatctttgtgacgaacgaggtgcacacatggaccgagcagtataagttccaggcggatagccccaagcgcctgtccgctgctatcggcaaggcctgggaagagggggtctgcggtatacggagcgccaccagactggagaacatcatgtggaaacagatctctaacgagctcaaccacatcttgctggagaacgacatgaagttcaccgtggtggtgggagacgtggtgggcatccttgcgcaagggaagaagatgatccggccccagcccatggaacacaaatacagctggaagtcctggggcaaggcgaaaatcatcggggccgatgtccagaacacgaccttcatcatcgacgggcccagcacaccggagtgccccgacgaccagcgcgcctggaatatctgggaggtggaggactacggcttcgggattttcaccaccaacatctggctgaaattacgggacagttacacccaagtgtgcgaccacagactcatgagcgcggccatcaaggactccaaggctgtccacgctgacatgggctactggattgaaagcgagaagaacgagacgtggaagctggcccgcgcgtccttcatcgaggtgaagacctgcatctggccaaaaagccacaccctgtggtccaacggcgtgttagagagcgagatgatcattccaaagatatacgggggcccgatttcccaacacaactaccgccccggttattttacccagaccgccggcccctggcacctggggaagctggagttggacttcgatttatgcgagggcaccacggtcgtggtggacgagcattgcggcaaccgggggccttcgctgcgcaccaccaccgtcacgggcaagattatccacgagtggtgctgtcggagctgcaccctgccgcccttacgcttcaagggggaggacggatgctggtacgggatggaaatccggcccgtcaaagagaaggaggagaacctggtgaagtccatggtcagcgccggctccggcgaagtggacagcttctcccttgggctgctgtgcataagcatcatgatagaggaggtgatgcgctcccggtggagccgcaagatgctcatgaccggcaccttagccgtattcctgctcctgattatgggccaactgacgtggaacgacctcatccggctgtgcattatggtgggcgccaacgcgtccgaccgcatggggatgggcactacctatctggccctgatggccacgttcaagatgagaccgatgttcgccgtcggcctgttgttccggcgtctcactagccgggaggtcctgctgctcacgatcgggctctccctggtggccagcgtcgaactccccaacagcctggaggagctgggtgacggtctcgcgatgggaataatgatcctgaagttgctcaccgacttccagagccaccagctgtgggccacactgctctccctgaccttcatcaagaccaccctgagtctccactacgcctggaaaaccatggcgatggtactgtccatcgcgtcgctgttccccctctgcctgtccacgacaagccagaagaccacctggctgcccgtactgctgggctctctcgggtgcaagccgctcacaatgttcttgatcaccgagacaaagatctggggccgcaagagttggcccctgaacgaggggattatggccgtcggagtggtgagcatcctcctgtccagcctgctcaagaatgacgtccccctggctgggccccttatcgccggcgggatgctgatcgcttgctatgtgatctccgggtcaagtgcggacctcagcctggaaaaagccgctgaggtctcctgggaggaggaggccgagcacagcggcgcctcccacaacatcctcgtcgtggtgcaggacgatgggaccatgaagattaaggacgaggagcgtgacgacaccctgacgatcctgctcaaggccaccctgctggccgttagcggcgtgtaccctctctccatccccgccaccttattcgtgtggtacttctggcagaagaagaagcagcgcagcggggttctgtgggatacccccagcccgcccgaggtggagcgggccgtgcttgacgatggcatctacaggatcatgcagcggggcttactggggcgcagccaggtcggcgtgggtgtgttccaggagaatgtcttccacacgatgtggcacgtgacgaggggcgccgtgcttatgtaccagggaaagcgactcgagccttcctgggctagcgtcaaaaaggacctgatctcctacggcggagggtggcggctgcagggcagctggaacaccggtgaagaagtccaggtaattgccgtcgagccaggaaagaaccccaagaatgtgcagaccgcacccgggactttcaagacacccgagggcgaagtgggcgccatagcgctcgacttcaagcccggcacctccggcagccctatcgttaaccgcgaggggaaaatcgtaggcctgtacggcaacggggtggtcacgacgagcggcacatacgtgtccgcgattgcacaggccaaggccagccaggaggggcccctacccgagatcgaggacgaggtgttccggaaaaggaaccttaccataatggacctgcacccaggctccgggaagacccggcgctacctgccggcaatcgtccgagaggccatcaagcgcaagctccggacgctgattctggcccccacccgcgtagtggctagcgagatggccgaggcgctcaagggcatgcccatccgctaccagaccaccgccgtcaagagcgagcatacgggcaaggagatcgtagacctgatgtgccacgccacctttaccatgcggctgctcagccccgtccgagtcccgaactacaacatgattattatggacgaggcacacttcaccgaccccagtagcatcgccgcccgggggtacatctcaacgcgcgtaggcatgggggaggccgccgcaatcttcatgaccgccacacctcccggcagcgtggaagcgttcccgcaatccaacgcggtcatacaggacgaggaacgggacatccccgagcgcagctggaactcagggtacgagtggatcactgatttcccaggcaagacggtgtggttcgtgcccagcattaaaagcggcaacgacatcgccaattgtctgcggaagaacgggaagcgcgtcatccagctgagccggaagacgtttgataccgagtaccaaaagacaaagaacaacgattgggactacgtcgtaacaactgacatctccgagatgggcgcgaacttccgcgcggaccgggtcatcgatccgagacggtgcctgaagcccgtgatactgaaggacggcccagagcgggtcatactggcgggccccatgccggtcaccgtggccagcgccgcacagcgtcgcgggcggatcggccgcaaccacaacaaggagggcgaccagtacatctacatggggcagcccctcaacaatgacgaggaccatgcgcattggacggaagccaagatgttgctggacaacattaacacgcccgaaggcatcatccctgccctcttcgagccggaacgggagaagtccgcggccatcgacggggagtaccgcctgcgcggcgaggcgcggaagactttcgtcgagctgatgcgccgcggggaccttcccgtgtggctcagttacaaggtggcctcagagggctttcagtactccgatcgccgttggtgcttcgacggcgagcgtaacaaccaggtcctcgaggagaatatggatgtggagatctggaccaaggagggggagcgtaaaaagctccgcccccggtggctggacgcccgcacctacagcgatccgctggcactccgggagttcaaggagttcgccgcgggccgccggtcagttagcggggacctcatcctggaaatcggcaagctcccgcagcacctgacacagcgcgctcagaacgccctggacaacctcgtcatgctgcacaactccgaacagggcgggcgggcctaccgccatgcgatggaggagctgcccgacaccatcgagactctcatgctgctggctctcatcgccgtgctgaccggcgggatgacacttttcttcttgagcggcagaggtctgggcaagacgtccatcgggctgctctgcgtcatggccagctccgtactgctttggatggccagcgtggaaccccactggatcgcggcctcgatcatcctcgagttctttctgatggttctgctcatccccgaaccggaccgccaacggacgccccaggacaaccaactggcctacgtcgtgatcggcctcctattcatgatcctgaccgttgccgccaacgagatgggcctgctcgagaccacaaagaaggatctggggatcggccacgtcgccgtggagaaccaccaccacgcgaccatgctggatgtggacctacaccccgccagcgcctggaccctgtacgccgtcgcgaccacgatcataaccccgatgatgcgccacaccatcgaaaacacaacggccaacatctccctgaccgccatagccaaccaagccgcgatcctcatggggctggacaagggctggcccatatctaaaatggacatcggagtgcccctgctcgcgctggggtgctattcccaggttaaccccctgaccctcactgccgccgtcctgatgctggttgcgcactatgccatcataggaccgggcttacaagccaaggccacgcgggaagcccagaagcgcaccgcggccggcatcatgaaaaaccccacagtggacgggatcgtggccattgacctggaccctgtggtctacgacgccaagttcgagaagcagctgggtcaaatcatgctcctgatcctatgcaccagccagatcctcctcatgcggactacctgggccctgtgcgagtctattactcttgcgaccggccccctgacaaccctgtgggagggtagcccgggcaagttctggaataccacgatagccgtttccatggccaacatcttccgggggtcttacctcgccggcgccggcctggcgttcagcctaatgaagtccctcgggggcgggcgccgtggcactggggcccaaggcgagaccctaggtgagaagtggaagcgccagctgaaccagctctctaagagcgagttcaacatctacaagaggagcgggatcatggaagtggatagatcagaggccaaggagggccttaagcgcggcgagaccacccgccacgctgtctcccggggaacggcgaagctacgctggttcgtcgagcggaacctggtgaagcccgaggggaaggtgatcgacctcggctgcggtcgcgggggctggtcctactactgcgccgggcttaagaaggtcacagaggttaagggctatacaaagggcgggcctggccacgaggagccaatcccaatggccacctacggctggaacctggtgaagctccacagcggcaaggacgtcttcttcacgccgcccgagaaatgcgacaccctgctgtgcgacatcggggagtccagccccaacccgaccatcgaggagggccggaccctccgcgtcctgaagatggtggagccctggctgcggggcaaccaattctgtatcaagatcctcaacccctacatgccctcggtcgtggagaccctagagcagatgcagcgcaagcacggcggcatgcttgtccggaacccactctccagaaattccacgcatgagatgtactgggtctcatgcgggaccggcaacatcgtgagtgccgtgaacatgaccagccggatgctgctgaaccgcttcaccatggcccaccgcaagcccacatatgagcgggacgtcgacctcggggcgggcacacgacacgtggcagtggagccagaggtcgccaacctggacatcatcgggcagcggatcgaaaacatcaagcatgaacacaagtccacctggcactacgacgaggacaacccatacaagacctgggcctaccacgggagctacgaggtaaagccaagtggcagcgccagctccatggtgaacggggtggtgaagctgcttactaagccctgggatgtcatccccatggttacccagatcgcgatgaccgacacgacgcccttcggccaacagcgcgtgttcaaggagaaggtcgacacccggaccccgaaggccaagcgcgggactgcccagatcatggaggtaacggcccggtggctgtggggtttcctgagccggaataagaagccacggatctgcacccgcgaagagttcacccgtaaggtgcgctccaacgctgcgatcggcgccgtcttcgtggacgagaaccagtggaacagcgccaaggaggccgtggaggacgagcggttctgggaccttgtacagaaggagcgcgaactgcacaagcagggaaaatgcgcgacctgcgtgtacaacatgatgggcaagcgggagaaaaagctgggggagttcggcaaggccaagggatcccgcgccatctggtacatgtggctcggcgccaggttcttggagttcgaggccctgggcttcatgaacgaggatcactggttcagccgcgaaaactccctctctggggtggagggagaagggctgcataagctgggctatatcctcagagacatcagcaagatccccggcggcaacatgtacgctgacgacacggcaggctgggacacccgcatcacagaagacgacctacaaaacgaggcgaagatcaccgacatcatggagccggaacatgccctgctggccacgagcattttcaagctgacataccagaataaggtagtacgcgtacagcgcccagcaaagaatgggaccgtgatggacgtgatctcccgccgggaccagcgcggcagcggccaagtgggcacctatggcctgaacacattcaccaatatggaggcccagttgatccggcagatggaatccgaagggatcttcctgcccagtgagctggagacccccaacctagccgagagggtcctggactggctggagaagtacggcgtggaacggctcaagcgcatggccatctctggggacgactgcgtggtcaagccgatcgatgatagattcgccaccgcgctgacggccctgaacgatatgggcaaggtgcgcaaggacatcccccagtgggagcccagcaaggggtggaacgactggcagcaagtccccttctgttcccaccacttccaccaactgatcatgaaggacggtcgggagatcgtcgtgccgtgccgcaaccaagacgagctggtgggccgggcccgcgtcagccagggggccggctggagccttagagagactgcctgcctcggtaaatcctacgcgcagatgtggcaactgatgtacttccacagacgtgatctgcgccttgccgccaacgccatctgctctgcagtgcccgtggactgggtccccacctctcggaccacgtggtccatacacgcgcaccaccagtggatgactaccgaggacatgctttccgtgtggaatcgcgtgtggatcgaggagaacccgtggatggaagacaagacccacgtcagctcctggggcgacgtcccgtacctggggaagcgggaagaccagtggtgcggctccctcatcggactaaccgcccgcgccacttgggcctccaacattcaggtggcgatcaatcaggtccgccggctgatcgggaacgagaattacctcgactatatgaccagcatgaagcgcttcaagaacgagggagaccccgagggggccctatggtga

SEQ ID NO: 24268 - RNA, 9879 nt, synthetic construct
  misc_feature 1..9879: note = derived and/or modified CDS sequence (opt11) from DENV-1__FJ882543__SS-prME
  source 1..9879: mol_type = other RNA
agcgtgactatgctgctcatgttgatgccgaccgcgttggcctttcacctcaccacgcgcggcggggagccccatatgattgtcactaagcaggaaagaggcaagagtctgttattcaaaaccagcgcaggggtaaacatgtgcacgttaatcgccatggacttgggggagctgtgcgaggacaccatgacctataaatgcccccggattaccgaggccgaacccgacgacgtggactgctggtgcaacgccacggacacctgggtgacgtacgggacctgtagccagacgggcgagcaccggcgagacaagcggagcgtggccctcgcgccccacgtggggctgggtctcgaaacccgcaccgaaacctggatgtcctcagagggcgcctggaagcagatccagcgggtcgagacctgggccctccgccacccggggttcaccgtgatcgcccttttcctggcgcacgcgatcggaacgtccatcacccagaaggggatcatcttcatcctgctgatgctggtaacaccctccatggccatgcggtgtgtcggcatcgggtcgcgcgacttcgtggagggactatctggagccacctgggtcgacgtcgtgctggagcatggctcctgcgtaaccaccatggcaaaggataagcccacgctggatatagagctactgaagaccgaagtcaccaaccctgcggtactacggaagctctgcatagaggccaagatctcgaacaccactaccgattcccgctgtccgacacagggtgaggcgaccctaatggaggaacaggatgctaacttcgtgtgccggcggacgttcgtcgacagaggctgggggaacggctgcgggctcttcgggaaggggtcgctcattacgtgcgccaagtttaagtgcgtgaccaaactagaaggcaagatcgtgcagtacgaaaacctgaagtattccgtcatagtgaccgtgcacaccggcgaccagcaccaggtaggaaatgagagcaccgagcacggcaccaccgcgactatcacgccccaagcacccacgtcggagatccagttgaccgactacggggccctgaccctagactgctccccccgcacgggcctcgacttcaatgagatggtgctactgacaatgaaagaaaagtcctggctcgtccacaaacaatggttcctggacctcccgctcccctggaccagcggtgcctctacctcccaggagacgtggaaccggcaggacctgctggtaaccttcaaaaccgcccacgcaaagaagcaggaggtagtagtgctcggcagccaagaaggcgccatgcacaccgccctgacaggagccaccgaaatccaaaccagtggcaccaccaccatattcgcggggcacctgaagtgccgcctcaagatggacaagctgacgttgaagggcatgtcatatgtgatgtgcactgggtccttcaagctcgagaaagaggtcgctgagacccagcacgggaccgtgctggtgcagatcaagtacgagggaaccgacgcgccctgcaagatcccctttagcacccaggacgagaagggggtcactcaaaacggccggctgataaccgcaaatccgatcgtgaccgataaagagaagcctgtgaacatcgaggccgagccaccctttggtgagtcctatatcgtaatcggcgcgggtgaaaaggcgttaaagctttcgtggtttaagaaggggtccagtatcggcaagatgttcgaggccaccgcccgcggggcccggcgcatggcgatcctcggcgacacagcctgggacttcgggtccatcggcggcgtattcacgagcatagggaagctggtgcatcagatcttcggcacagcttacggggtcctattctccggcgtgagctggaccatgaagatcgggattggcgtgttgctgacgtggctcggcctgaattcacgcagcacctccctgagcatgacatgcatagccgttgggctcgtcacactctacctgggcgtgatggtgcaggccgacagtgggtgtgtgatcaactggaagggtcgagaactcaagtgtggatctggcatctttgtgacgaatgaggttcacacctggaccgagcagtacaaattccaggcagatagcccgaagcgcctgtccgccgccatcggcaaagcctgggaagagggggtgtgcggaatccggagcgccactaggttagagaatatcatgtggaagcagatctccaacgagttaaaccatatcctgctggagaacgacatgaaattcaccgtcgtcgtgggggacgtggttggcatcctcgcgcaagggaaaaagatgatccggccccagcccatggagcacaagtattcctggaagtcctggggtaaggcaaagattatcggagccgatgtccagaacacgaccttcatcattgacgggcccaacactcccgagtgcccggacgaccagcgcgcctggaacatctgggaagtggaggactacggcttcgggatcttcaccacgaacatctggctgaaaatgcgggactcctacacacaggtgtgcgaccaccgtttaatgtccgcggcgataaaagacagcaaggccgtgcacgccgacatgggctattggatcgagtccgagaagaacgagacctggaagctcgcccgcgcgagctttatcgaagttaagacctgcatctggcccaagtcccacaccctttggtccaacggcgtcctggagtccgagatgatcatacccaagatctacgggggccctatctcacagcacaatcaccgccccggatacttcacccagaccgcaggaccctggcacctcggtaagcttgagctggattttgatctgtgtgagggcaccacagtggtcgtcgacgagcactgcggaaaccgggggccgtccctgaggaccacgaccgtgacgggcaagattattcacgagtggtgctgtcgcagttgcacgctgccgcccctgcgcttcaagggggaggacggctgctggtatgggatggagatacgtcccgttaaggagaaggaggagaacctggtcaagtccatggtaagcgccggcagcggcgaggtggactccttcagcttgggattgctgtgcatctctatcatgatcgaggaggtgatgaggagccggtggtcccgcaaaatgctgatgaccggcaccctcgccgtttttctgttgttgatcatgggacagctgacgtggaacgacctgatccggctctgcataatggtgggcgccaatgcgagcgaccgaatggggatgggaaccacgtatctggccctgatggccaccttcaagatgagaccgatgtttgccgtcggcctcctgtttcgccgcttaacgtcccgggaggtgctactgttgaccatcgggctcagcttagtggcctccgtcgagctgcccaacagcttagaggaactgggcgatgggctggcgatggggatcatgattctcaagctgttaactgacttccagtcgcaccagctctgggccgctctactgagcctcacgttcatcaaaacgaccctgtcactacactatgcgtggaagaccatggcgatggtgctcagcatagtctctctaatccccctgtgcttgagcaccacatcacagaagaccacctggctgcccgtgctgcttggcagcctggggtgcaagccattgacgatgttcctaattgccgagaacaagatctgggggcgcaagagctggccgctgaacgagggaatcatggcagtcggcgtcgttagcatcctattgagctccctgctgaagaacgacgtgcccttagctgggcccttaatcgccggcggcatgttaatcgcttgctatgtaatcagcgggtcaagcgcagacctgtcactggaaaaggctgcagaggtgagctgggaggaggaggccgagcactccggcgccagccacaacatcctggtggaggtccaggacgatgggacgatgaagataaaggatgaggagcgggatgacaccttgaccatcctgttaaaagcaaccttactagccgtgtccggcgtgtaccccctgagcattcccgccacccttttcgtctggtacttctggcagaagaagaaacagagatccggggtgctgtgggatacgccaagcccgcccgaggtggagcgagccgtgctggatgacggcatataccgcatcatgcagcggggcctgctcgggcgctcccaggtgggtgtgggggttttccaggagaacgtttttcacaccatgtggcatgtgacccggggagccgtcctgatgtaccagggtaaacgactggagccgtcctgggcctccgtcaaaaaggaccttatcagctacggcggcggatggcggttacagggatcctggaacaccggggaagaggtgcaagtgattgccgtggagcccggaaagaaccccaaaaacgtgcaaacggcaccggggaccttcaagaccccagagggcgaggtcggcgccatcgcgctggacttcaagccggggacctcaggctcccccatcgtcaaccgcgagggcaagattgtgggcctgtatggcaacggggtcgtcacgaccagcggcacctacgtgtcggccatcgcccaggccaaagcgtcccaggaagggccactgcccgagattgaggatgaggtcttcaggaaacgcaacctcaccataatggacttgcacccgggcagcggaaagactcggcgctacctgccggccattgtgcgggaagccatcaagcggaaactgcggaccctcatcctggcccccacccgagttgtcgcgtccgagatggcggaggccctaaaaggcatgcctatccgctaccaaaccacggctgtcaagtcggagcacacaggcaaggaaatcgtggacctcatgtgtcacgccaccttcaccatgcggctgctgtccccagtcagggtgccgaattacaatatgatcattatggacgaagcgcacttcacggacccgagctccatcgcggctcgggggtacatcagcacgcgggtgggcatgggagaagccgccgccattttcatgacggcgacgcctcccggctccgtcgaggccttcccgcaaagcaacgccgtcatccaggacgaggaacgggacatacccgagcgctcttggaatagtggttacgagtggatcacggacttcctcggcaagaccgtatggtttgtcccctccatcaagagcggcaacgacatagccaactgcctgcggaagaacgggaagcgcgtgatccagttatcccggaagactttcgacacggagtaccagaaaactaagaacaacgactgggactatgtggttaccaccgacatcagtgagatgggcgctaacttccgcgccgacagagttatcgacccccgccggtgtctcaagcccgtgatcctgaaagacgggcccgaacgcgtcattctggccggccccatgcccgtgacagtcgcatcggccgctcagcggcgcgggcggatcggccgcaaccacaataaggagggcgaccagtacatctacatggggcagccgctcaacaacgacgaggaccatgcccactggacggaggccaagatgctgttggacaatatcaatactcccgaggggatcatccccgcgctcttcgaaccggagcgggaaaagtcagccgcgatcgacggggaataccgcctgaggggcgaagcccggaagaccttcgtggagctgatgagacgcggggacttaccggtctggttgtcctacaaggttgctagcgaggggttccagtacagcgaccgccggtggtgcttcgacggggaacgcaataatcaggtactggaggagaacatggatgtggagatctggaccaaggagggagagaggaagaaactcaggccccggtggctggacgcacgcacgtactctgaccccctggcgctccgggagtttaaggagttcgctgccggccgccggagcgtctcaggtgacctgatccttgagatcggcaagttgccccagcatctaacccagcgcgcccagaacgccttggacaacctcgtgatgttgcacaacagcgagcaaggcggccgggcctaccgccacgccatggaggagctgccggatacgatcgagaccctgatgctgctggccctcatcgccgtgctgacaggcggggtcaccttatttttcctcagcggtcgaggcttaggcaaaacctcgatcggcctgctctgcgtgatggcctcctcggtactgctgtggatggcttccgtggaaccccactggattgccgcctctataatcctcgagttctttctgatggttctgctgatcccagagcctgaccggcagagaacaccgcaggacaaccagctggcctatgtggtcatcgggctgctcttcatgatcctgaccgtggccgcaaatgagatgggcctgcttgagacgaccaaaaaggacctggggattggccacgtggctgtagagaaccaccatcacgcgaccatgctggacgttgacctccatcccgcatccgcctggaccctatacgcggtggccacgaccatcatcacccccatgatgcgccacaccatcgagaacacgacggccaatattagcttgaccgccatcgccaaccaggcggccattctcatggggctggacaagggctggccgatctccaagatggacatcggcgtccccctgctcgccttagggtgctacagccaggtgaacccactcaccctcacggccgcggtcctgatgctggtcgcccactacgccatcatcggccccggtctccaggctaaggccacgcgggaggcgcagaagcgcaccgccgccggcatcatgaagaacccgaccgtggatggaatcgtcgccatcgacctggaccccgtcgtgtacgacgcgaagttcgagaagcaactgggacaaatcatgctcctgatcctttgcacgagccagatcctcctgatgcgcaccacttgggctctgtgtgagtctattaccctagccacgggtcccctgaccaccctgtgggaggggtcccccggtaagttctggaacaccacaattgccgttagcatggccaacatcttcagagggtcgtatctcgccggcgcagggctggccttcagcctgatgaagtcgctcgggggcgggcggcggggcaccggggcccaaggcgagaccctgggcgagaagtggaagcgccagctgaatcagctctccaagagcgagtttaacatctacaagcggtccggcattatggaggtcgaccgcagcgaggctaaggagggcctgaagcgaggtgagaccaccagacacgcggtgtcgcgcgggacggccaaactccgctggtttgttgaacggaacctggtaaagccggaggggaaggtcatcgaccttggctgcggccgcggggggtggagctactactgtgccgggctaaagaaggtgaccgaggtcaagggatacaccaagggcgggcccggccacgaggaacccatcccgatggccacgtacggctggaacctggtgaagctccactccggtaaggatgtgttcttcaccccgcccgagaagtgcgataccctgctgtgcgatatcggagagagctcccctaaccccaccattgaggaaggccggacgctccgcgttctgaagatggttgagccttggttacgggggaaccagttctgcatcaaaatcctcaatccctacatgcccagcgtggttgagaccctggagcaaatgcaaagaaagcacggcggcatgctggtacgcaaccccctctcccgcaactcgactcacgagatgtattgggtgtcctgcgggaccgggaacatcgttagtgccgtgaacatgacctccagaatgctgctgaacaggttcaccatggcgcataggaagccgacctacgagaaggacgtggacctcggggcagggacacggcatgtagcagtggagcccgaggtagccaacctcgacatcataggccagcgcatcgaaaacattaagcacgagcacaagagcacctggcactacgacgaggacaacccctacaagacctgggcataccacgggtcctacgaggtcaagccctccggctcggcgtcttccatggtcaacggtgtggtgaagctcctcaccaagccgtgggacgtgatccccatggtcacccagattgccatgaccgacacgacgccatttggccagcagagggtgttcaaggaaaaagtggacacccgcacccccaaggctaagcgtgggacggtccagatcatggaggtgacagcgcgctggctgtggggtttcctgtcgcggaacaaaaagccgcggatctgtacccgtgaagaatttacacggaaagtgaggagcaacgccgcgatcggcgcagtcttcgttgatgagaaccagtggaactccgcgaaagaggccgtggaggacgagcgcttttgggatctcgtcaaaaaggagagggagctgcacaagcaggggaaatgtgccacgtgtgtctacaacatgatgggaaagcgcgaaaagaaactgggggaatttggcaaggccaaggggtcgagggccatatggtacatgtggctcggcgcccgtttcctggaattcgaggcccttggatttatgaatgaggaccactggttctcccgggagaacagcctttccggggtagagggcgaaggtctgcacaagctaggatacatcctacgcgacatcagcaaaattcccggcggcaacatgtacgcggatgacactgccgggtgggacacccgcatcactgaagacgacctgcagaacgaggccaagataacggacatcatggagcccgaacacgcactgctcgccaccagtatctttaagctaacctaccagaacaaggtcgtgcgtgtgcagcgtccggcaaagaatggtactgttatggacgtgattagccgccgcgatcaacgcggctccggtcaggttggcacgtacggtttgaataccttcactaatatggaggcccaactcatccgccagatggagagcgaggggatcttcctgccctctgaacttgaaacgcccaacctggcggagcgggtcctggactggctggagaagtacggcgtggaacgcctcaagcggatggcaataagcggggacgactgcgttgtaaagcccatcgacgaccgctttgctacggcgctgaccgctttgaacgacatgggcaaggtgcggaaggacatcccgcagtgggaaccctccaaggggtggaacgactggcagcaggtccccttctgcagccaccacttccaccagctcatcatgaaggacggacgcgagatcgtcgtgccctgccggaaccaggacgagctggttggcagagcccgggtctcacagggggccggctggagcctgcgcgagaccgcgtgtctcgggaagagctacgcgcaaatgtggcagctcatgtacttccaccggcgcgacctacgtctcgccgccaacgccatctgcagcgcggtgccagtagactgggtgcccaccagccgaacgacgtggtcgatccacgctcaccaccagtggatgacgaccgaggacatgctgtctgtgtggaatcgggtttggatcgaggaaaacccctggatggaagacaagacgcacgtctccagctgggaagacgtgccctacctgggcaagagggaagaccaatggtgcgggtcccttatcgggctgaccgctcgggccacctgggccagcaacatacaagtagcgatcaaccaggtccgccgcctaatcggcaacgagaactacctcgactacatgacctcaatgaagcggtttaaaaacgagggggacccggagggcgcactttggtga

SEQ ID NO: 24269 - RNA, 9879 nt, synthetic construct
  misc_feature 1..9879: note = derived and/or modified CDS sequence (opt11) from DENV-1__FJ882544__SS-prME
  source 1..9879: mol_type = other RNA
agcgtgaccatgttgctcatgctgatgcccaccgccctggccttccacctcaccacccgcggcggggagccccacatgatcgtgtcaaagcaggagcggggcaagagcctgctgttcaagacgtccgccggtgtgaacatgtgcacgctcatcgccatggatctgggcgagctgtgcgaagacactatgacctacaagtgcccccggatcaccgagaccgagcccgacgacgtggactgctggtgcaacgccacggacacctgggttacctacgggacatgcagccagacgggcgagcaccggcgcgataagcggtccgtggcactcgcgccccatgtgggcctggggctagagacccgcacggagacgtggatgagctccgaaggcgcgtggaagcagatccagagggtcgagacatgggctctccgccaccccgggttcaccgtgatcgcccttttcctggcacacgcgattggcacgagcatcacgcagaaggggatcatattcatcctactaatgctggtgacgccctccatggcaatgcggtgcgttggcatcggcaatcgcgacttcgtggaagggcttagcggcgccacctgggtagacgtcgtgcttgagcacgggtcctgcgtgaccaccatggccaaggacaagcccacgcttgacattgagctcctgaagaccgaagtcaccaaccccgccgtactgcggaaactctgcatcgaggcgaagataagcaacactacgaccgattcccgctgcccgacccagggcgaagctaccttagtggaggaacaagacgccaacttcgtctgccggcgcacgttcgtggaccggggctgggggaacggctgcgggctgtttggaaagggcagcctcatcacgtgcgccaagttcaagtgtgtgaccaagctggagggcaagatcgtccaatacgaaaacctgaagtactccgtgatcgtgaccgtccacacaggcgaccagcaccaggtgggtaacgaaagcaccgagcacggcaccaccgccaccatcacgccccaggcccccaccaccgagatccagctcaccgactacggggccctaacactcgactgttcgccccggaccggcctcgacttcaacgagatggtcctgctgaccatgaaggagaagtcctggttggtgcacaagcagtggttcctggatctgcccctcccctggacctccggggccagcacgagccaggagacctggaatcggcaggacctgttggtgacctttaaaaccgcccacgccaagaaacaggaggtcgtggtgcttggctcgcaggaaggcgcgatgcacacggccctgaccggtgccaccgagatccaaacgtcgggtacgaccaccatcttcgccgggcatctgaagtgccgcctcaagatggacaaactgaccctgaagggcatgtcgtacgtcatgtgcacggggagcttcaagctcgagaaggaggtggccgagacccagcacggcacagtgctcgtccagatcaagtacgagggcaccgacgcgccctgcaagatccccttctccacgcaggacgaaaaaggggtgacacaaaacggccgcctgatcaccgccaacccgattgtgaccgacaagggcaagccggtcaacatcgaggccgagccgcccttcggcgagagttatatcgtgatcggcgccggggagaaggcgcttaagctctcctggttcaagaagggatcttccattgggaagatgttcgaggccacggcccgcggcgccaggcgcatggcaatcctgggggacaccgcgtgggacttcgggtcgatcggcggggttttcacctcagtcggcaagctggttcaccagatcttcgggaccgcctacggggtgctgttcagcggcgtctcctggacgatgaagatcggcatcggcgtgctgctgacctggctcgggctgaacagccgctccaccagcctgtcgatgacatgcatcgcagtgggactcgtcacgctgtatctgggggtcatggtccaggcggacagcggctgcgtcattaactggaaggggcgggagctcaagtgcggttctggcatcttcgtcaccaatgaggtgcacacctggaccgagcagtataagttccaggccgacagccccaaacgcctgagcgctgccatcgggaaagcctgggaggagggcgtctgcgggatccggtccgccacccgcttagagaacatcatgtggaagcagatctcaaacgagctcaaccacatactgctggaaaacgacatgaagttcacggttgtggtcggagacgtggccgggatcctcgcgcagggcaagaagatgatacggccccagcccatggagtacaaatactcctggaagtcatggggcaaggcgaaaatcatcggggcggacgtgcagaacaccaccttcatcatcgacggccccaacacgccggagtgccccgacgaccaacgagcttggaacatttgggaagtcgaggactacggatttggtatcttcacgaccaacatatggctgaagctgcgggactcctacacccaggtttgcgaccaccgcctcatgagcgcggccatcaaggactccaaggccgtgcacgccgacatgggttactggatcgagagtgaaaagaacgagacttggaagctggcccgggcgtccttcatcgaggtcaaaacgtgcatctggccaaagagccacaccctgtggagtaacggagttctcgaaagcgagatgatcatccccaagatctacggcgggccgatctcccagcacaattaccgccccggctactttactcagaccgccgggccctggcacctgggcaagctggagctcgacttcgacctttgcgagggcacgactgtggtcgtggacgaacactgcgggaatcggggccccagcttacgaacaaccacggtgaccggaaagatcatccacgagtggtgttgccggtcctgtaccctgccgcccctccgctttagaggcgaggacgggtgctggtacggcatggagatccgacccgtcaaagagaaggaggagaacctggttaagagcatggtatctgccgggagcggtgaggtcgacagctttagcctcggcctgctgtgcatcagcatcatgatcgaggaggtgatgcgcagtcgttggagccggaagatgctcatgaccgggacgctagcggtgttcttcctgcttatcatgggtcagttaacctggaacgacctcattagactctgcattatggtcggcgcaaacgcatccgatcgcatgggcatgggcaccacctacctggccctgatggctacgttcaagatgcgaccgatgttcgccgtggggctcctgtttcgccggctgaccagcagagaggtgctcctgctgaccatcggcctctccctggtcgccagcgtggaactgcccaattccttggaggagctcggcgacggactggcgatggggatcatgatcctgaaactgctgaccgacttccagagccaccagctctgggccaccttactgtccctcaccttcatcaagaccaccttcagcctgcattacgcctggaagacgatggccatggtgttaagtatcgtgagcctcttcccgctgtgcctgtcaaccacgagccagaaaaccacgtggcttcccgtgctgctggggtccctcggctgcaagccgctgaccatgttcctgatcgcggagaacaagatctgggggcggcgctcatggcccctcaacgagggcatcatggcggttgggattgtttccatcctgctgagctcactcctgaagaacgacgtgccgctggccgggcccctcatcgccggcggaatgctgatagcctgctatgtgatttccggcagctccgcggacctgagcctcgagaaggccgccgaggtatcctgggaagaggaggcggagcacagcggagccagtcataatatcctggtggaggtccaggacgacggaaccatgaagatcaaggatgaggagcgggacgacaccttaacaatcctcctgaaggcaacgctgctcgcagtgagcggggtgtacccgctgtccatccccgccaccctgttcgtctggtacttctggcagaagaagaagcagcggagcggcgtgctctgggacacccccagcccgcccgaggtgggacgcgccgtattagacgacgggatctaccggatcatgcagcggggactgttggggcgcagccaggtgggcgtgggggtcttccaggagaacgtgttccacaccatgtggcacgtgacgcggggagccgtcctcatgtaccagggcaagcgcctggagccctcatgggcgagcgtgaagaaggacctgatctcctacgggggcggttggcggctccagggcagctggaacaccggggaagaggtacaggtcatcgcggtggagcccggcaaaaaccccaagaacgtgcagaccgcccccggtaccttcaagacgcccgagggggaggtcggcgccattgccctggacttcaagcccgggacctccggcagccccatcgtgaatcgcgagggcaagatcgtggggctgtacggcaatggggtcgtgaccacctccggcacttacgtgagcgcaatcgcccaggccaaggccagccaggaggggccgctccccgagatcgaggacgaggtcttccggaagagaaacctgaccatcatggacctgcaccccggctccggaaaaacccgacgctacctacccgcgatcgtgcgggaagccatcaagcgcaagctccgcaccctcattctcgcccccacgcgggtggtcgccagcgagatggccgaggcgctgaagggcatgcccatcaggtatcagacaaccgccgttaagtccgagcacaccggcaaagagatcgtggacctgatgtgccatgccacgttcaccatgcggctcctgagcccggtccgcgtgccgaactataatatgataatcatggacgaggcccactttaccgacccctccagcatcgccgcgcgggggtacatctccacccgcgtgggcatgggggaagccgccgccattttcatgacggccacgccacccggcagcgtcgaggcgttcccgcagtcgaacgcggtgattcaggatgaggagcgggacatccccgagcgcagctggaatagcggctacgagtggatcacggatttccccgggaagaccgtgtggtttgtcccctcgatcaagtccggcaacgacatcgccaactgcctgcggaagaacggcaagcgcgtgatccagctcagccggaagacgttcgacaccgagtaccagaagaccaagaataacgactgggactacgtggtcaccacagacatctccgagatgggagctaacttccgcgcggaccgggtgatcgatccgcgccggtgcctgaagcccgtgatactgaaggacgggccggagagagtcatcctcgccggccctatgccggtgacagttgcgagcgcggcacagaggcgcggccggatcgggcgcaaccacaacaaagagggcgatcaatatatctacatggggcagcccctgaacaatgacgaagaccacgcgcactggacagaggccaagatgctgctcgacaacatcaacacccccgagggtatcatccccgccctgttcgagccggaacgcgaaaagtccgctgccatcgatggcgagtaccgtctgagaggcgaggcgcggaagacgttcgtggagttaatgcgcagaggcgacctgcccgtttggctgagttataaggtcgcctccgaggggttccaatacagcgaccgccgctggtgctttgacggtgaaagaaacaaccaggtgctcgaggagaacatggacgtggagatctggaccaaggagggggagcggaagaagttacgcccccggtggcttgacgcccgcacctacagcgaccctctcgccctgcgggagttcaaggagttcgccgcgggccgccggtccgtcagcggcgatctaatcctcgagatcgggaagctgccgcagcacctgacccagcgcgcccagaacgccctcgacaacctggtgatgctgcacaactccgagcagggcgggcgggcctaccgccacgcgatggaggagctccccgacacgatcgagaccctgatgctgctcgccctgatcgccgtgcttaccggtggtgtcaccctcttctttctgagcggccggggcctggggaagacctccattggtctcctgtgtgtaatggcctcctccgtcctgctctggatggccagcgtcgagccccactggatcgcggcctccatcatactggagttcttcctgatggtgctcctgatccccgagccggacaggcagcggacgccccaggacaaccagctggcctatgttgtcatcgggctcctgttcatgatcctgaccgtagctgccaacgagatgggcctcctggagacgaccaagaaggacctgggaatcggccacgtggccgtcgagaaccaccaccatgcagctatgctcgacgtggacctgcaccccgcaagcgcctggaccctgtatgcggtggccaccacaatcatcacgccaatgatgcgccatacgatagagaacaccaccgccaacatcagtctcaccgccatcgccaaccaagcggcgatcctgatgggtctggacaagggatggccgatcagcaagatggacatcggggtccccctcctggccctggggtgctattcccaggtgaaccccctcacgctgaccgccgcggtactgatgctcgtggctcactacgccatcatcggcccggggctacaagccaaggcaacccgcgaggcgcaaaagcggaccgcagccggcatcatgaagaaccccacagtagacggcatagtggccatcgacctggaccccgtcgtgtacgacgccaagttcgagaagcagctggggcagatcatgctgctgatcctctgcaccagccagatcctgctgatgcgcaccacctgggcgctctgcgagtccatcactctggccaccggccccctgacaaccctctgggaagggagcccgggcaagttctggaacacgaccatcgccgtgtccatggcaaacatcttccggggctcgtacctggctggagcgggcttggccttctccctcatgaagtccctcgggggcgggcgccggggaaccggcgcacagggggagaccctgggcgagaagtggaagcgccagctcaaccagctgagcaagtccgagttcaacacgtataagcggagcgggattatggaggtcgaccgctccgaggccaaagaaggcctgaagagaggcgagactactaagcacgccgtgagccgtggcaccgccaagctgagatggtttgtggagcgcaacctggtgaagcccgaaggcaaggtgatcgacttgggttgcggacgcgggggctggtcctactactgcgccgggctgaaaaaggtgacggaagtcaagggctacaccaagggcgggcccggccatgaggagccgatcccgatggccacctacgggtggaatctcgtgaagctgcacagcggcaaagacgtgttcttcatcccgccagagaagtgcgacaccctgctctgtgacatcggggagtccagtcccaacccaacgatcgaggagggacgcaccctgcgggtcctgaagatggtcgagccctggctccgcggcaaccagttctgcatcaagatcctgaacccctacatgccctccgtggtcgagaccctggagcagatgcagcgtaagcacgggggcatgctcgtccgcaacccactgagcagaaattccacacatgaaatgtactgggtgagctgcgggaccggcaacattgtctccgcagtaaacatgacgtcccgcatgctgctcaaccgcttcaccatggcgcaccgtaaacccacatacgagcgcgacgtggatctgggagccgggacccggcacgtcgccgtggagcccgaggtagccaatctggatataatcggccagcgcatcgagaacatcaagcacgagcacaagtccacctggcactacgatgaggacaatccctacaagacatgggcctaccacgggagctatgaggtcaagccgtccggcagcgcgtccagcatggtgaatggggtcgtgaagctcctgactaagccctgggacgtgatccccatggtcacccagatcgccatgactgacaccacccccttcggccagcagcgggtgttcaaggagaaggtggacacgcgcacaccgaaggccaagcggggcaccgcccagatcatggaggtcacagccaaatggctgtgggggttcttgagccgcaacaagaagccccggatctgcacccgcgaggagttcacgcggaaggttcgctccaacgcggccatcggcgccgtgtttgtagacgagaaccagtggaacagcgcaaaggaggcggtggaggacgagcggttctgggacctggtgcaccgcgagcgggagctgcacaagcaggggaagtgcgcgacctgcgtctacaacatgatggggaagcgcgaaaagaagctcggtgagttcggcaaggcaaagggctcccgggccatttggtacatgtggctgggggccagattcctggagttcgaggcgttgggcttcatgaacgaggaccactggttctcaagggagaactccctaagtggggtggagggagaggggctgcacaagctcggctacatcctgcgtgacatcagtaatatccccggcgggaatatgtacgccgacgacaccgccggctgggacacccggatcacggaggacgacctgcagaacgaggcacgcatcaccgacatcatggaaccggagcacgccctcctggccaagagcatcttcaaactgacctaccagaacaaggtggtccgcgtgcagcggcccgccaagaacgggaccgtgatggacgtcatctcccgccgggaccaacgcggtagcggccaggtgggcacgtacggcctcaacacctttaccaacatggaggcccagctgatccggcagatggagtccgaggggatcttcagcccctccgagctggagacccccaacctcgccgagcgcgttctggactggctggagaagtacggcgtcgagcggctcaagcgcatggccatctcaggggacgactgcgtggtgaagcccattgacgacaggttcgcaacggccctgactgccctgaacgacatgggcaaggtacgcaaggacatcccccagtgggagccctcaaagggctggaacgactggcagcaggtcccgttttgcagccaccacttccaccagctcatcatgaaggacggccgggagatcgtagtcccgtgccgcaaccaggacgagctggtgggccgggcccgcgtgtcccagggggccggctggagcctgcgggagactgcttgcctaggcaagagctacgcccagatgtggcagctgatgtactttcaccgccgggacctgcgcctggccgccaacgcgatctgctccgccgtccccgtggattggatccccaccagccggacgacctggtccatacatgcccaccaccagtggatgaccacggaggatatgctgagcgtttggaaccgcgtctggatcgaagagaacccctggatggaggacaagacgcacatatccagctggggcgacgtgccgtacctgggcaagcgcgaggatcagtggtgtgggtccctcattggcctgacggcccgggccacctgggcgaccaacatccaggtggccatcaaccaggtccgccggctgatcgggaacgagaactacctcgactacatgaccagcatgaagcgattcaagaacgaatccgaccccgagggcgccctgtggtga

SEQ ID NO: 24270 - RNA, 9879 nt, synthetic construct
  misc_feature 1..9879: note = derived and/or modified CDS sequence (opt11) from DENV-1__FJ898371__SS-prME
  source 1..9879: mol_type = other RNA
agcgtgaccatgctcttaatgcttatgcccaccgccctcgccttccacctcaccacaaggggaggggaaccccacatgatcgtgaccaaacaggaacggggcaagagcttgttgtttaaaacgagcgcaggggttaacatgtgcaccctcatcgccatggatttaggcgaactctgcgaggacaccatgacttacaaatgtccccggatcaccgaagccgaacccgacgacgtggactgctggtgcaacgccacagacacgtgggtgacctatggcacgtgctcccagacaggcgagcatcggcgagacaaacggtccgtggccttggcgccccatgttggcctggggctagagacaagaactgagacgtggatgtcaagcgagggggcctggaagcagatccagagagtagagacgtgggccctccgtcacccggggttcaccgtgatcgccctctttctggcccacgccatcggcacttccataacccagaaaggtatcatcttcattctcctcatgcttgtgacaccctctatggctatgcgatgcgtcggcatcggctcccgcgactttgtcgagggcctcagcggcgccacatgggtggacgtcgtgctggagcacgggtcctgtgtaacgaccatggccaaagacaaacccacattagacatagaactgctgaaaaccgaggtcacgaaccccgcagtgctgcggaagttatgcattgaggctaagatttcgaacaccacgacagactcccgctgccccacccaaggcgaggctactctgatggaggagcaggacgcgaactttgtgtgtcgacgcacgttcgtcgaccggggctgggggaacggctgtgggctgttcggcaaggggagccttatcacgtgcgcaaagtttaagtgcgtgaccaagctggagggcaagatcgtgcagtacgagaacctgaagtactccgtcatcgtgaccgtgcacaccggggaccagcaccaggtgggcaacgagagcactgaacacggcaccaccgcgaccataacaccgcaggcccccacaagtgagatccagctgaccgactacggggccttaaccctggactgttcgccccgcacgggcctggacttcaacgagatggtgctcctgaccatgaaggagaagtcctggttggtccacaaacagtggttcttggaccttccactaccctggaccagcggtgccagtacctcccaagagacctggaaccggcaggacctgcttgtgaccttcaagactgcacacgcgaagaaacaagaagtcgtagtacttgggtcccaggaaggcgccatgcacaccgctctgacgggtgccaccgagatacagaccagtggcaccacgaccatcttcgccgggcatctcaagtgtcgactcaagatggataagttgacactgaagggtatgagctacgtgatgtgcacaggttccttcaaactcgaaaaggaagtcgcggagacgcagcacggcactgtgctggtgcagataaaatacgaggggacagacgccccgtgcaagattcccttcttgacccaggatgagaagggggtgacacaaaacggacggctgatcaccgccaacccaatcgtgaccgataaggagaagcccgtgaacatcgaggctgaaccgcccttcggtgagagttacattgtcattggagcgggtgaaaaggccctcaaactctcgtggtttaaaaaggggtcttccatcggcaagatgttcgaggccacagccagaggggcccggcgcatggcaatcctgggtgacaccgcctgggactttgggagcatcggcggcgtgttcacatccgtcggaaagttagtccatcagatctttggaacagcctatggggtactcttcagcggagtgagctggaccatgaagatcgggatcggcgtgcttcttacgtggctaggcttaaacagccgaagtaccagcctctccatgacctgcatcgccgtcgggcttgtcaccctgtacttaggcgtcatggtgcaagccgacagcgggtgtgtgatcaactggaagggccgggaactgaagtgcggaagcggcatctttgtcacaaacgaagtccacacctggaccgagcaatataagttccaggcggacagcccgaagcgcctgagcgccgccataggcaaagcgtgggaggaaggggtatgtgggatccggtcagccaccagactcgagaatatcatgtggaaacagatctcgaacgagctgaaccacatattactagagaacgacatgaagttcactgtcgtggtgggggacgtcgtgggcatcctagcccaggggaagaagatgatccggccccagcccatggaacataaatactcatggaaatcctggggtaaggccaagatcataggcgcggatgtacaaaacacgaccttcatcatcgacggacccaacacgccggagtgtccggacgatcagcgagcctggaacatatgggaggttgaagactacggcttcgggatcttcaccacgaacatttggctgaagctccgtgatagccacacgcaggtatgcgaccaccgcttgatgagcgcggcaattaaggactccaaggccgtgcacgccgacatgggttattggattgaaagcgaaaagaacgagacctggaaactcgcccgggcgtccttcatcgaggtgaagacctgcatctggcccaagagccacacgctctggtccaatggcgtgctggagagcgagatgatcatcccaaagatctacgggggccctatctcccagcacaactaccgtcccgggtactttacccagaccgccggcccctggcacctggggaagttagaactggacttcgacctgtgcgagggaaccactgtggtcgtggacgagcactgcggcaatagagggccgagcctccgcaccaccaccgtgacgggcaagatcatacatgaatggtgctgccggtcatgcaccctaccgccccttcgcttcaagggtgaggacggctgctggtacgggatggaaatccgcccggtgaaggagaaggaagagaacctagtcaagtcgatggtgtccgcgggcagcggcgaggtcgacagcttcagcctggggttgctctgtatcagcatcatgatcgaggaggtgatgcgcagcagatggtcgcggaagatgctcatgaccggaaccctggctgtgtttctcctgctgatcatggggcagcttacctggaacgatctgatccggctgtgtatcatggtcggcgcaaacgcatccgatagaatgggtatgggcaccacgtacctcgccttgatggcgactttcaagatgcggcccatgttcgccgtggggctactgtttcggcgcctgacgagccgcgaagtactgttactgactattggtctctccctcgtcgccagcgtcgagctgcccaactcccttgaagaactcggcgacggattagcgatgggcataatgatcttaaagctactcacagatttccagagccaccagctgtgggctactctcctctccctgacgttcatcaagactaccttaagtttgcactacgcctggaaaaccatggccatggtcctgtccatcgtcagcttattccccttatgcctgtcaacaaccagccaaaagacgacctggctgcccgtattactgggtagcctcgggtgcaaaccgctcactatgtttctgatagcggagaacaagatatgggggcgcaaaagctggcccctaaacgaggggatcatggccgtaggcgtggtgtccatcctactgagctcattgctgaagaatgacgtccccctggccggccccctcatagccggtggaatgttaattgcctgttacgttatctctggatcgtccgctgacctaagtctcgagaaagcggctgaggtatcctgggaggaggaggccgagcacagcggtgcctcccacaacatcctggtggaggtgcaggacgacgggaccatgaagatcaaagacgaagaaagagacgacactttaactattttgctcaaggcgaccctccttgccgtgagcggggtctaccctctgtctattcccgccacgctgtttgtatggtacttctggcagaaaaagaaacagcgcagtggcgttttatgggacaccccaagcccgcccgaggtcgagcgggcagttctcgacgatgggatttaccgcatcatgcagaggggcctgctcggtcgcagccaggtgggcgttggggtgtttcaggagaatgtgttccacacgatgtggcacgtcaccaggggcgccgtgttaatgtaccaggggaagcgccttgagccctcctgggcgtccgtaaagaaggatttaatctcctatggcggcggctggcggctccagggtagctggaacacgggcgaagaggtccaagtaattgccgtggagccaggcaaaaaccccaagaacgtgcagaccgcccctggcacattcaaaacccccgagggcgaggtgggcgccatcgccttagatttcaagcccgggacgtcggggagccccatcgtgaaccgcgaagggaagatcgtcggcttgtacggaaacggggtggtgaccaccagcggcacatacgtctccgcgatcgcccaggccaaggccagccaagagggcccgctcccggagatcgaggatgaagtgttccgcaagagaaacctgacgataatggatttacatcccggcagcgggaaaacgcggcgctacttacctgcaattgtgcgggaggccattaagcggaaacttcgtacccttatcctcgcccccacacgagtcgtggcctcagagatggccgaggcgctgaagggcatgcctatccgataccagaccaccgccgtgaagtccgagcacaccgggaaggagatcgtcgacctgatgtgccacgccaccttcacgatgcgcctcctgtcacccgtacgcgttccgaactacaacatgattatcatggacgaggctcacttcaccgacccctcaagcatcgcagcgcgggggtatatcagcacccgcgtgggcatgggggaggccgcagccatcttcatgaccgccacgccccctggcagcgtggaggcttttccgcagtcgaatgctgtcatccaggatgaagaacgggatatacctgagcgcagttggaactccgggtacgagtggatcaccgattttccgggcaagaccgtttggttcgtgccaagcatcaagtccggcaacgacatcgccaactgcctcaggaagaacggaaagcgcgtcatacagttaagccggaagaccttcgacacagagtaccagaagacgaagaataacgactgggactacgtcgtcaccaccgatatctccgagatgggtgcgaacttcagggcggatcgggtcatcgacccgcgcagatgcttaaagcccgtcattctgaaggacggtcccgagcgcgtgatactcgctgggcccatgcctgtcacggtggcttcagcagcccagcggcgcgggcggatcggcagaaaccacaacaaagagggagaccaatacatctacatgggacaacccctgaacaacgacgaggaccatgcgcactggacggaagccaaaatgctgttagataacataaatacccccgagggcatcatccccgcccttttcgaacctgagagggagaagtctgccgcgattgacggggagtaccggttgcgcggagaggcgaggaagacatttgtggaactcatgcgccgcggtgatctgcccgtctggctgtcttacaaggtagcctccgagggcttccaatatagcgacaggcggtggtgcttcgatggcgagcgcaacaaccaagttctcgaggaaaatatggatgtcgagatctggacgaaggagggggagcggaagaaactgcgcccccgttggctggatgcccgcacctactctgacccgctcgcccttcgggagttcaaagagttcgcagcggggcgcagaagcgtgtcgggcgaccttatcctggagatcggcaagctgccgcaacatctcacgcaacgcgcccaaaacgcgctcgacaacctggtcatgctgcacaactctgagcaaggagggcgagcctaccgccacgctatggaggaattgcccgataccatcgagacgctgatgctcctcgcactcatcgctgttctgaccggcggggtgaccctatttttcctaagcggccgggggctgggcaagacgagcatcggcctcttatgcgtgatggcctcgagtgtgttattatggatggcaagtgtagaaccccattggattgcagcctccatcatcctcgagttcttcttgatggttctcctaatccccgagcctgaccgccaacgtacgccacaggataaccaactggcctatgtcgtgatcgggctcctgtttatgatcctcacggttgccgccaacgagatgggcctcctggaaacgaccaagaaagacctggggatcggccatgtcgcggtggagaaccaccatcacgccacgatgctcgatgtggacctgcacccagccagtgcgtggacgctgtatgccgtggcgaccacgatcatcaccccgatgatgcgccacacgatcgagaacaccaccgccaacattagtctcaccgccatcgctaaccaagccgcgatcctgatggggctggacaaaggctggcccatctctaaaatggacatcggcgttcccctgctggcccttggttgttactctcaagtgaatccgctaactctgacggccgccgtcctgatgctcgtagcgcactacgccatcatcggcccaggtctgcaagccaaggcgacccgggaggcccagaagcgcaccgcggcgggaataatgaagaaccctacggtggatggaatcgtcgcgatagacctggaccctgtagtttacgacgcgaagttcgaaaaacagctcggccagatcatgctgttgatcctctgtactagccagatcctgctgatgcgcacaacgtgggctttgtgcgagtccattacgctggctaccggtcccctaaccaccttgtgggaggggagcccgggcaagttctggaacacgaccatcgccgtttccatggcaaatatctttcgggggtcttatctggccggcgccggactagcattctccctaatgaaatccctagggggcggcaggagggggactggggcccagggcgagaccctgggggaaaagtggaagcgccagctgaaccagcttagtaagtcggagttcaatatctataaacggtccgggatcatggaggttgatcgctccgaggccaaagagggcttaaagcgcggagagacaacccgccacgccgtgtctcggggcaccgctaagctacgctggttcgtcgaacggaatctcgtgaagcccgaggggaaggtcatcgatttgggctgcggacgtggaggttggtcctactattgcgccgggctaaagaaagtcacagaggtgaagggttatacgaagggcgggccaggtcacgaagaacccattcccatggccacctacggatggaatttggtgaagctacactcaggtaaggacgtcttcttcacgcctcccgagaagtgcgacacgctgctatgcgacatcggggagtcaagtcccaacccgacgatcgaggaaggtcggaccttaagggtgctgaagatggtagagccctggctccgggggaaccagttctgcatcaagatcctgaacccctacatgccctcagtcgtcgagaccctggagcaaatgcaacggaagcatggcggcatgctagtgcgcaacccgctgagccgcaacagcacacacgagatgtactgggtcagctgtgggaccggcaacatcgtgtcagccgtcaacatgacgagcaggatgttgcttaatagattcacaatggcacaccgcaagcccacctatgaacgcgatgtcgacttgggggccggcacccgccacgtggccgtggagcctgaggtcgccaacctggacataataggccagaggattgaaaacatcaagcatgaacacaagtccacgtggcattacgacgaagacaacccttacaagacctgggcgtaccacggaagctacgaggtgaaaccgtcaggctcggcctcaagcatggttaatggcgtagtgaagctccttaccaagccctgggatgtcatccccatggtgacccagatcgcaatgactgacacaacgcccttcggacagcagagggtcttcaaagagaaagtcgacacaaggacgcctaaagccaaacgagggaccgcgcagatcatggaggtgaccgcccggtggctgtggggcttcctcagccgcaacaagaaaccccgcatctgcactcgcgaggagttcacgcggaaggtgcgctcgaacgccgcgatcggtgccgtgttcgtggacgagaatcagtggaatagcgccaaagaagcagtagaggacgagcggttctgggacctggtccagaaggagcgcgaactacacaaacaggggaagtgtgcaacttgcgtgtataacatgatggggaagcgggagaagaagctcggagagttcggcaaagcgaaggggtcccgcgctatttggtacatgtggttgggtgcccggttcctggagttcgaggcgcttggcttcatgaacgaagaccactggttcagccgcgaaaactccctgtctggggtggagggggaaggcctacacaagttaggctacatcctaagagacatctccaagatcccagggggcaatatgtacgcggacgatactgccggatgggacacccgcatcacggaggacgacctgcagaacgaggccaagattaccgacatcatggagccagagcacgccctcctggccaccagcatcttcaagctgacctaccagaacaaggtcgtgagagtgcagagacccgcgaagaacgggacggtcatggacgtgatctccagacgggaccagcgcggaagcggtcaggtgggaacctacggcctcaacaccttcaccaacatggaggcccagctaattcggcaaatggagtccgaggggatcttcctgcccagcgagttagagactcagaacctggcggagcgcgtcctcgactggctcgagaagtacggcgtggagcggcttaagcggatggccatctccggggacgattgtgtagtaaagcctatagatgatcgtttcgccaccgccctgaccgccctgaacgacatggggaaggtccgcaaggatataccacaatgggagcccagtaaggggtggaacgactggcaacaggtgcccttctgctcccaccatttccaccagcttatcatgaaggacgggcgggaaatcgtcgtgccatgccgcaaccaggacgaactggtcggccgggccagggtctcgcagggggccggatggtcgctccgggagaccgcgtgcctgggcaagagctacgcccagatgtggcagctaatgtatttccatcgcagagaccttagactggcagccaacgccatctgcagcgcagtaccagtggactgggtccctacgagccggaccacctggtcaatccacgctcatcaccagtggatgaccactgaagatatgttgagcgtctggaaccgcgtgtggatcgaggaaaacccatggatggaaaacaaaacccacgtaagctcttggggcgacgtgccctacttgggtaagcgagaggaccagtggtgtggctcattaatcggcctcaccgcgcgcgccacctgggcgtccaacattcaggttgcgatcaaccaagtccgccgccttatcgggaacgaaaactacctggactacatgacctcaatgaagcgcttcaagaatgagggcgatccagaaggggccctgtggtaa

SEQ ID NO: 24271 - RNA, 9879 nt, synthetic construct
  misc_feature 1..9879: note = derived and/or modified CDS sequence (opt11) from DENV-1__FJ882545__SS-prME
  source 1..9879: mol_type = other RNA
tcagtgaccatgctgttgatgctaatgcctaccgcgctggccttccacctcaccacaaggggcggtgaacctcatatgatcgttagcaagcaggaacggggcaagagcctgctattcaagactagtgctggcgtgaacatgtgcactctcatcgccatggatctaggggagctgtgcgaagacacgatgacctacaagtgcccgcgcatcaccgaggccgagccagacgacgtggactgctggtgtaacgccaccgacacgtgggtgacctacgggacctgctcacagacgggcgaacaccggcgcgacaagcggtctgtcgcactcgccccccacgtaggactgggactagagactagaaccgagacctggatgagctcagaaggagcatggaagcagatccagcgggtcgagacctgggccctccgccaccctgggttcacggtcatcgccctgttcttggcgcacgccatcggcaccagcatcacccagaagggtatcatcttcatcctcttaatgctggttaccccttcaatggccatgcggtgcgtgggcatcgggagccgcgactttgttgagggactctccggcgcaacgtgggtggacgtcgtacttgagcacgggagctgtgtgacaaccatggccaaagacaagcccaccctcgacattgagctcctgaaaaccgaggtgacaaaccccgctgtgctgcggaagctctgcatcgaagccaaaatctctaacacaaccacggatagcaggtgcccgacccagggcgaggccactctggtggaggagcaagatgccaacttcgtttgccggcggaccttcgtggacaggggctggggaaacggctgcgggctgttcggcaaagggtccctcatcacgtgtgccaagttcaagtgtgtgaccaagctggagggaaagattgtgcagtacgagaatttaaagtatagcgttattgtgaccgtccacaccggcgatcagcatcaggtggggaacgagtccacagagcacggcaccaccgcgactattacgccgcaggccccgactaccgagatacagctcaccgattacggtgcccttaccctggactgctcgcccagaacaggcctcgacttcaacgagatggttctcttgaccatgaaggagaaaagttggctcgtacacaagcagtggttcctggatttgcccttaccctggacaagcggggcaagcacgtctcaggagacgtggaaccggcaggatctgctggtgacatttaagaccgcccacgcgaaaaagcaggaggtcgtagttctaggctcccaggagggcgccatgcacaccgccttaacgggggccaccgaaatccagacgagtggcaccactaccatcttcgccgggcacctgaagtgccgcctaaagatggacaagctgaccctgaaaggcatgagctacgtcatgtgcaccggttcattcaagcttgaaaaagaggtagcggagacgcaacacggcaccgtgctggtgcaaatcaagtacgaagggaccgacgctccctgtaaaatccccttcagcacacaggacgagaagggtgtgacgcagaacggccggcttatcaccgcaaatccgatcgtaacagacaaggagaagccggtcaacatagaggctgagcctccgttcggggagtcctacatcgtaattggcgcgggggagaaagcccttaagctcagctggtttaagaagggctcctccatcggcaagatgttcgaggccacggcccgcggagcgcggcgcatggcgatcctcggtgacacggcctgggactttgggtcgatcggcggcgtgttcaccagcgtcgggaagctggtccatcagattttcggcaccgcctacggggtcttattctccggcgtttcctggaccatgaagattggaatcggcgttcttcttacgtggctgggcttaaattcccgatccacatccctgtctatgacatgcatcgccgtggggctcgtcactctgtacctaggcgtcatggtgcaagccgactccgggtgtgtcataaactggaaaggccgggagctgaagtgcgggtcaggtatctttgtgacgaacgaggtccacacctggaccgagcagtacaagttccaggcggactccccgaagaggctatccgccgccatcggcaaggcctgggaggaaggcgtctgcggcattcggagcgccacccgcctggagaacatcatgtggaagcagatctccaatgagctcaaccacatcctgcttgagaatgacatgaagctcaccgtggtggtcggggacgtggcgggtatcctggggcaaggcaagaagatgatccgcccccagcccatggagtacaagtacagctggaagtcctgggggaaggccaagatcatcggggccgatgcacagaacacgaccttcatcattgacgggcccaacacgccggagtgccccgacgaccaacgcgcgtggaacatatgggaagtggaggattacgggttcggcatcttcaccactaacatctggctaaagctgcgggacagctacacccaggtctgcgaccaccgcctgatgagtgccgccataaaggacagcaaagcggtgcacgccgacatgggttattggatcgagtccgaaaagaatgagacttggaagctggcgcgggcctcattcatcgaggtgaagacttgcatctggcccaagtcccacacgctgtggagcaatggggtccttgagtccgagatgatcatccccaaaatctacggcgggccgatctcgcagcataattaccgcccagggtacttcacacagaccgccgggccctggcacctgggcaagctcgagctggacttcgacctgtgtgagggtactacggtggtggtcgacgagcactgcggtaaccgaggaccctccctccgcaccaccacagtgacggggaagatcatccatgagtggtgctgccggtcctgcaccctgccgcccctgcgcttcaggggcgaagatggttgctggtacggcatggagatacggcccgtaaaggagaaggaggaaaatctcgtaaagtccatggtgagcgccgggagcggcgaggtagactcgttcagcctcgggctgctttgtatctccataatgatcgaggaagtaatgcgatcccgctggtcacggaagatgttaatgacggggaccctcgccgtgttcttcctgctgataatgggccaattgacgtggaacgacctaatccgcctgtgcatcatggtcggggcgaacgccagcgaccgcatgggcatgggcactacctacttggcacttatggccacctttaagatgcgtccaatgtttgctgttggtctgctcttccgacgtcttacgtcccgcgaggtgctgcttctcaccatcgggcttagcctggtcgcgtccgtagagttgcccaacagcctggaggaactgggggacgggctcgctatgggcataatgatcctgaagctgctcaccgacttccagtcccaccaactatgggcgaccctgctaagcctgacgttcatcaagaccactttcagtctgcactacgcttggaagaccatggcgatggtactcagcatcgtcagtctgttccccctgtgcctcagcacgacctcgcagaagaccacatggctcccagtactgctcgggtctctgggctgcaagccgctcacgatgttcctcatcgccgagaacaagatttggggtcgtaagagttggccactgaacgagggcatcatggccgtggggatcgtaagcatcctgctttcgtccctactgaaaaatgacgttccactcgccggacccctgatcgccggcgggatgctcattgcatgttacgtgatctcgggctccagcgccgacctctccttagagaaggccgccgaagttagctgggaggaagaggccgagcacagcggggcgagccacaacatcctggtggaggtgcaggacgacggtaccatgaagatcaaagacgaggagcgagacgacaccctcaccatcctgctcaaggctaccctcctagctgtatcgggtgtgtacccgctaagcatccccgccaccctcttcgtgtggtacttttggcagaagaagaagcagcggtccggcgtgctatgggacactcccagccctcccgaggtggagcgggccgtgctggacgacggcatctaccggatcatgcaacgcgggctgctcggccgctcgcaggtcggggtgggcgtgttccaggagaacgtcttccacaccatgtggcatgtgacccgcggggcggtgctgatgtaccaaggcaagcggctggagcccagctgggcgtccgtaaagaaggacctcatctcatacggcgggggctggcgtcttcgggggtcctggaacaccggcgaggaagtacaggtgatcgccgtcgagccggggaaaaatcccaaaaacgtgcagactgcacccggcacttttaagacacccgaaggcgaggtaggggccatagcgctagacttcaagcctggcacgagcgggtcacccatcgtaaacagggagggaaagatcgtgggcttgtacgggaacggtgtggtcactaccagtgggacctatgtgagcgcgatcgcccaggccaaagcgtcccaggagggtccactgccagaaattgaggacgaggtgttccggaagcgaaacctgacaataatggacctacatcccggcagcggcaagacccggcgctacctccccgcaatcgtccgtgaagccatcaaaaggaaactgagaaccctcatcctggctcccacccgggtggtggcctccgagatggcggaggccctgaagggtatgcccatccgctaccagacaacggcagtcaaaagcgagcatactgggaaggaaatcgtcgacctcatgtgccacgcaaccttcacgatgcggttgctgagtcccgtgcgcgtcccgaactacaacatgatcatcatggacgaggcccatttcaccgaccccagctccatcgcggcccggggctatatctccacccgcgtggggatgggtgaggccgcagccatattcatgacagcaaccccgccagggtccgtagaagccttcccgcagagcaacgcggtcatccaggacgaggaacgggacattcccgagcgctcatggaacagcggctacgaatggatcaccgacttccccggcaaaacggtctggttcgtaccgtcaattaagagcgggaacgacatcgctaattgtttacggaagaacggcaagcgcgtcatccaactgtcccggaagacttttgatacggagtaccagaagaccaagaacaacgactgggactatgtggtcactaccgacataagtgaaatgggggcgaacttccgcgccgaccgggtgattgacccaagaagatgcctgaagcctgttatactcaaggacgggcccgagcgcgtcatcctggccggccccatgccggtcacggtggccagcgcggcgcagcggcgcggccggatcggccgcaaccacaacaaggagggtgaccagtacatatacatgggccagccgctgaacaacgacgaagaccacgcccactggactgaggccaagatgctcctagacaacattaacacccccgaggggattatccccgccctgttcgagccagaacgcgagaagtccgccgccgtagatggcgagtaccggctcaggggtgaagcccgaaagaccttcgttgagctgatgcgccggggcgacctgcccgtgtggctctcctataaggtcgccagcgaggggttccagtacagcgaccgccggtggtgcttcgacggggagcgcaataaccaggtgctcgaggagaacatggacgtggagatttggacgaaggagggcgagcggaaaaaactgaggccacggtggctcgacgcccgcacctactccgaccccctggccctccgggagttcaaagagtttgcggccgggcgccggtcagtctccggagacctcattctggagatcggcaaactgccgcagcacctcacgcagcgcgcccagaacgctctggataacctggtgatgttgcacaacagcgagcaaggagggcgggcgtaccgccacgccatggaggagctgcccgacacgatagagacgcttatgctcctggccttaatcgccgtattgacgggcggagtcaccctgtttttcctttccgggcggggtctcggaaagaccagcatcgggctactttgcgtcatggcctcctcggtgttgctgtggatggcgagcgtcgagcctcactggatcgccgcatccatcatcctggagttcttcctcatggttctgctgatccccgagccggaccgccagcgcacgccacaggacaaccaactcgcatacgtcgtaataggcttgttattcatgatcctgactgttgccgcgaacgaaatggggctgctcgagaccacgaagaaggatctcgggatcgggcacgtagccgtcgaaaaccaccaccacgcggccatgctggacgtggatctgcaccccgcctcggcgtggaccctctacgcagtggcaacgacgatcatcacgccgatgatgagacacaccatcgagaacacgacggccaacatctctctgactgctatcgccaaccaggccgccatcctgatgggtctcgataagggctggcccatctcaaagatggacatcggggtgccattgctggccctcggctgctacagccaggtgaaccctctgacccttacggcagccgtactcatgctagtcgctcactacgccatcatcgggccgggcctgcaggccaaggcgacgagggaggctcaaaaaaggacggccgccgggatcatgaagaaccccaccgtggacggtatcgtggccatcgacctcgaccccgtcgtgtacgatgcgaagttcgagaagcagctggggcagatcatgctgctcatcctctgcacgtcccagatcctgctcatgcgaaccacttgggccctgtgcgagagcatcaccctggccacggggccgctcaccacactgtgggagggctcccccggcaaattctggaacactactatcgctgtgagcatggcaaacatcttccggggctcctatctggcgggcgccggcctcgccttcagcctgatgaagtccctggggggggggcgacgagggaccggcgcccagggcgagactctcggggagaagtggaagaggcagctcaaccagctgtccaagagcgaatttaatacttacaagcggtccggtatcatggaggtggaccgcagcgaggcgaaagaggggctcaagcggggcgagacaactaagcacgccgtgtccaggggtaccgccaagctgcgctggttcgtggagcgcaacctggtcaagccggagggcaaggtgattgacctgggctgcggacggggcggctggagctattactgcgcaggcctcaagaaggtgaccgaagtcaaggggtacaccaagggcggccccgggcacgaagagcccataccgatggccacgtacggctggaacctggtgaagctgcattctgggaaggacgtattctttatcccgcccgagaagtgcgataccctcctgtgcgacatcggcgagagctcccccaacccgacgatcgaggagggtcgcaccctgcgggtgctcaagatggtggagccttggttgcgcggcaaccagttctgtattaagatcctgaacccctacatgccgagcgtggtcgaaaccctcgagcagatgcaacggaaacacggcgggatgctggttcgcaacccgctgtcgcggaactccacccatgagatgtattgggtgtcctgcggcaccgggaacatcgtcagcgcggttaacatgaccagtcgcatgctcctgaatcgcttcaccatggcccacagaaagcccacctacgagcgcgacgtggacctgggcaccggtacccggcacgtcgcggtggagcccgaggtggccaatctcgacatcatcgggcagcgcatagaaaacatcaagcacgagcataagagcacgtggcactacgacgaggacaacccctacaaaacctgggcctaccacgggtcctacgaggtgaaacctagcggttccgcgtcgagcatggtgaacggcgtagtcaaactgttgaccaagccctgggacgtgatacccatggtcacccagatagctatgacggacaccacccctttcgggcagcagcgggtgttcaaggagaaggtagacacccgcacgccgaaggcaaagcgtggaactgcgcaaatcatggaggtcaccgcccgatggctctggggcttccttagtcgcaataaaaagccccgcatctgcacccgggaggagttcacgcgcaaggtgcggtctaacgcggccatcggggccgtctttgtcgacgagaatcaatggaactccgccaaggaggccgtggaggatgagcgcttttgggacctggtacaccgggagagggagctccataagcaaggcaagtgtgcgacctgcgtgtacaacatgatggggaaacgtgagaaaaagctgggcgagttcgggaaggctaaaggcagccgcgcaatctggtacatgtggttaggagcccggttcctcgagtttgaggcgctggggttcatgaacgaagatcattggttctcaagggagaactcactgtccggggtggagggagagggcctccacaagctggggtacatcttacgggacatatctaagatccccggcggcaacatgtacgccgacgacaccgccgggtgggacacccgcatcacggaggacgaccttcaaaacgaggcaaaaatcaccgacataatggagccagaacatgccctgctcgcgaaggccatcttcaagctcacataccagaacaaggtggtccgcgtgcagcggcccgccaagaacggcactgtgatggatgtcatctcccgccgtgaccagcgcgggtccggtcaagtgggcacctacggcttgaataccttcaccaacatggaggcgcagctgattaggcagatggagtcagagggcatcttctctccttctgagctcgagacccccaacctggccgaacgggcgcttgattggttgggtaagtatggcgtggaaaggctgaaacgcatggccatcagcggggacgactgcgtcgtaaagccgattgatgataggttcgccacggcgctgaccgccctcaacgacatgggaaaggtccgcaaggacataccacaatgggaaccctccaaggggtggaacgactggcagcaggtgcccttctgtagccaccactttcaccagctcatcatgaaagacggtcgggagatcgttgtgccgtgccgcaaccaggatgagctagtgggccgggcgcgtgtatcccaaggtgccggctggagcctacgggaaaccgcctgcctggggaagtcgtatgcacagatgtggcagctgatgtacttccaccgcagggatctccgcctagccgccaacgccatctgctccgccgttcccgtggattgggtgcccaccagccggacgacgtggagcattcatgcccaccaccagtggatgaccaccgaggacatgctgtctgtgtggaaccgcgtctggatcgaggagaatccgtggatggaggacaagacccacatctccagctgggaggacgtgccctacctcggcaaacgcgaggaccaatggtgtggctcactgatcgggctgaccgcgcgggccacctgggccacgaacatccaggttgccatcaaccaggtccgccggcttatcggaaacgaaaactacctagactacatgacctccatgaagcgcttcaagaacgagtcggaccccgagggtgccttgtggtga

SEQ ID NO: 24272 - RNA, 9879 nt, synthetic construct
  misc_feature 1..9879: note = derived and/or modified CDS sequence (opt11) from DENV-1__FJ898372__SS-prME
  source 1..9879: mol_type = other RNA
agcgtgaccatgctgctcatgctgatgcccaccgccctggcatttcacctcaccacgcgcggtggcgagccccacatgatcgtgagcaagcaggagcggggcaaaagcctgctgttcaagaccagcgcgggggtgaatatgtgcaccctcatcgccatggacctgggcgagctctgtgaggacacgatgacctacaagtgcccccggatcaccgaggccgagccggacgacgtggactgctggtgtaatgcgactgacacgtgggttacctacgggacctgtagccaaaccggcgaacaccggcgggacaagcggtcagtggctcttgcgccgcacgtaggtctgggcttggagactcgaacggagacgtggatgagctccgaaggcgcctggaagcagatacagcgggtcgagacctgggccctccgacaccccgggttcacggtcattgccctgttcctggctcatgccattggcacctcaatcactcagaaggggatcatcttcatcttgctgatgctggtaactccctccatggccatgcggtgcgtgggcatcgggtcccgcgacttcgtggaagggttatccggcgcgacctgggtggacgtcgtcctcgagcacgggagctgcgttaccaccatggcccgggacaagcccaccctggatatcgagctcctgaagaccgaggtcaccaaccccgcggtcctgcgcaagttgtgcatagaggcaaagatttccaacacaaccacggacagccggtgccccacccagggcgaggccaccctggtcgaggagcaggacgccaactttgtctgccgacggactttcgtggacaggggttgggggaacggctgcgggctgttcggcaagggttccttgatcacgtgtgccaaattcaagtgcgtgacgaagctggagggcaagatcgtccagtacgagaacctgaagtactccgtgatcgtgactgtccatacgggggaccagcaccaggtcgggaatgaaagcacggagcacggcacaaccgccaccatcacgccacaggcccccactacggagatccagctcaccgactacggtgctctgaccctggactgcagcccccggacggggctcgacttcaacgaaatggtcttactgacgatgaaagagaagtcctggctcgtgcacaagcagtggttcctggacctgcccttgccctggaccagcggcgccagcacttcccaggagacgtggaatcgccaggacctgctggtgaccttcaagaccgcacacgcgaagaagcaggaggtcgtggtgctcggcagccaggagggtgccatgcacaccgcactgaccggggcaaccgagatccagacttcaggcaccacgaccattttcgccgggcacctaaagtgccgcctcaagatggacaaacttaccctgaagggcatgagctacgtcatgtgtaccggttcattcaagctcgagaaggaggtggcagagacgcagcacggcacagtgctggtccagatcaagtatgagggcaccgatgccccttgcaagatccccttcagcacccaggacgagaagggtgtgacgcaaaacggacgtttaatcaccgcaaacccgatcgtgacggacaaggagaagcccgtcaatatcgaagcggagccgcctttcggggagtcctacatcgttatcggcgcgggggagaaggccctcaaactaagctggttcaagaaggggtccagcatcggcaagatgttcgaggccaccgctcgaggggcccgacgcatggccatcctgggcgacacggcttgggacttcgggtccatcggcggcgtgttcaccagcgtgggcaagctggtccaccagatcttcggcaccgcctacggcgtgctcttttcaggcgtgtcctggactatgaagatcgggatcggtgtactgctgacgtggttgggcctgaactcccggagcacctccctgagcatgacctgcatcgccgtggggctcgtcaccctatatctgggggtcatggtgcaggccgacagtgggtgcgtcatcaactggaaaggccgagagctcaagtgtgggagcggcatcttcgtcactaacgaagtccacacctggaccgagcagtataagttccaggcggactctccgaaacggctgtccgccgccatcggcaaggcgtgggaggagggcgtctgcggtatccgcagcgctaccaggctggagaacatcatgtggaaacagatctccaatgaactaaaccacatcctcctcgagaacgacatgaagttaaccgtggtggtcggggacgtggccggcatcctgggtcagggcaagaagatgatccgtccccagcccatggagtacaagtacagctggaagtcctggggcaaggcgaaaatcataggcgccgatgcgcagaacactaccttcattatcgacggacccaacaccccagagtgccccgacgaccagcgcgcgtggaacatctgggaggttgaagactacgggttcgggatcttcactacgaatatctggctgaagctccgcgactcttacacccaggtctgcgaccaccggctgatgtccgccgccatcaaggacagcaaggccgtgcacgcagacatgggctactggatcgaatccgagaagaacgagacctggaaacttgcgcgtgccagcttcatcgaggtgaagacctgcatctggcccaagtcccacacgctctggagcaacggggtcctggagtccgagatgattatccccaagatctacggagggccgatcagccagcacaattatcgacccggctacttcacccagaccgccggaccctggcaccttggtaaactcgagcttgactttgacctatgtgaaggcaccaccgtggtggtcgacgagcactgcgggaacagaggcccatccctccgaaccacaactgtgacgggtaagatcatccatgagtggtgctgccgcagctgcaccttgccgcccttgcggttccgcggcgaggacgggtgctggtacggcatggaaatacggccagtgaaggagaaggaagagaatctcgttaagagcatggtgagcgccggtagcggggaggtcgactccttcagcctgggcctgttgtgcatttccatcatgatcgaggaggttatgcgtagtaggtggagtcgcaagatgctgatgacgggcaccctggccgtgttcttcctcttgatcatgggccaactcacatggaacgatctaatccgcctgtgcatcatggtcggggcgaacgccagcgatcggatgggcatgggcacgacatacctggccttgatggctacattcaagatgcgcccgatgttcgctgtcggactgctgttccgccgcctcacttcccgggaggtgctgctgctgactatcggccttagcctggtggcgtctgtggagctccccaacagcctggaggaactgggagacggattagcgatgggcatcatgatcctgaaactgctcaccgacttccaaagccatcaactgtgggcgacgctgttaagcctgacgttcattaagaccaccttctccctccactacgcctggaaaaccatggcgatggtgttaagcatcgtaagtctgttccccctgtgcctgagcacgacctcccagaaaaccacctggctccccgtcctgctggggtccctgggctgcaagccgctgacgatgttcctcatcgctgagaataagatctgggggcgaaagtcgtggcccctgaatgagggcatcatggccgtcgggatcgtaagcatcttgttgagctccctgttaaagaatgacgtacccctcgcaggccccctcatcgccggtggaatgctgatcgcgtgctacgtgatttcaggttccagcgctgacctctcactggagaaggccgctgaagtcagctgggaggaagaggctgagcactccggcgcgagccacaacatcctggttgaggtgcaggacgacggtaccatgaagatcaaggacgaggaacgagatgacacgttaactatcctgctcaaggccaccctcttagccgtgtcaggggtgtacccgctttcaatccccgccaccctcttcgtgtggtatttctggcagaagaagaagcagcgctccggggttctgtgggacacccccagtccgcctgaggtggagcgggccgtgttggacgacgggatttatagaatcatgcagcgggggctgctcggccgaagccaggtgggggtgggggtgttccaggagaacgtcttccacaccatgtggcacgtaacacgaggggccgttctgatgtaccaaggcaagcgcctagaaccctcgtgggccagcgtcaagaaggacctcatcagctacggcgggggctggcggctgcgcggatcctggaacacgggcgaggaagttcaagtgattgcagtcgaacctgggaagaaccccaagaacgtccaaacagcccccggcactttcaaaacgccggaaggcgaggtgggggcgatcgcgctggatttcaagccaggtacgagcgggtcccccatcgtcaaccgggaaggtaagatcgtcgggctttacgggaacggagtggtcaccactagcggcacctacgtgagcgctatcgcccaggccaaggcgtcccaggaaggaccgttgcccgagatcgaggacgaggtgttccgcaagcggaacctgacgatcatggacctccatccgggtagcggcaagacccgccgctacctgccggcaatcgtccgcgaagccatcaagaggaagttgcggaccctaatccttgcccccaccagggttgtcgcctccgagatggccgaagccctgaagggcatgcccatccgttaccagacgaccgcagtcaagagcgagcacactggtaaggaaatcgtggacctcatgtgtcacgccaccttcacgatgcgactgctgtccccagtccgagtcccaaactacaacatgatcatcatggatgaggcccactttaccgatcccagctccatcgcggcccgcggctacatcagcacccgggtggggatgggtgaggccgccgccattttcatgactgcgacgccgcccggcagcgtagaggctttcccgcaatctaatgccgtcatccaggacgaggagcgcgacatccccgagcgatcctggaactctggctatgagtggatcaccgacttccctggtaagaccgtatggttcgtgccctctatcaaaagcgggaacgacatcgccaactgcctgcgcaagaacggcaagcgggttatccagctgtcccgcaagacgttcgacacggaatatcagaaaaccaaaaacaacgactgggactacgtggtaaccaccgacatcagcgaaatgggcgcgaacttccgggccgaccgtgtcatcgacccgcgtcgatgcctgaagcctgtgatcctcaaggacggccccgagcgggtgatcctggctgggcccatgcctgtcaccgtggcctccgccgcgcaacgccgcggccgcatcggccgcaaccacaacaaggaaggggaccagtacatctacatgggccagcccttgaataacgacgaggaccacgcccactggactgaggccaaaatgctactggacaatatcaacacacccgaggggatcatccccgccctgttcgaaccggagcgggagaagtccgccgcagtcgacggcgagtaccgactccgcggggaggcccgcaagacctttgtggaactgatgcggcgcggcgaccttcccgtgtggctatcctacaaggtcgcctcggaaggcttccaatacagtgatcggcggtggtgcttcgatggggagcgtaacaatcaggtgttagaggagaacatggacgtggagatctggaccaaggaaggggagagaaagaagctgaggccccgctggctcgacgcccgtacctattccgatcccctggcactgcgcgagtttaaggagttcgcagccgggcggcgcagcgtctcgggcgatttgatcctggagatcggaaaactgccacagcatctcacccagcgggcccagaacgccctggacaacctggtgatgctccacaacagcgagcagggcgggcgggcctaccggcacgccatggaggagctgcctgacacgatcgagaccttaatgctcctggcactgatcgccgtgttaaccgggggcgtcacactcttcttcctgtcggggcggggcctcggtaaaactagcatcggtctgctgtgtgtgatggccagcagcgtgctcctgtggatggcgtccgtcgagccccactggatcgccgccagcatcatcctagaatttttcctcatggtgctgttgatccccgagccggaccggcaacggacgcctcaagacaaccagctagcctacgtggtcattggactgttattcatgatcctcacggtagccgcgaatgagatggggctgcttgagacgacgaagaaggacctcggcatcgggcacgtggcagtcgagaaccatcaccacgccgccatgctggacgtcgaccttcaccccgcctccgcgtggaccctctatgcggtagccactacgatcattacgccgatgatgcgccacaccatcgagaacacgaccgccaacatcagcctgactgccatcgcgaaccaggccgccatactgatgggcctcgacaagggctggcctatctccaagatggacataggggtacccctgttagcccttggttgctacagccaggtgaaccccctaaccctgacggcggccgtgctcatgctggtcgcccactacgccattatcggccccggcctgcaggccaaggcgactagggaagcacagaaacgcaccgcagccgggatcatgaagaaccccacagttgacggcattgtggccatcgacttagaccccgtcgtatacgatgcgaagttcgaaaagcaattgggccagatcatgctgctcatcctgtgcaccagccagatcctacttatgcgaaccacgtgggccctgtgtgagagcatcaccctggccacggggcccctcaccaccctgtgggagggctcccccgggaagttctggaacaccacgatcgccgtgagtatggccaacatcttccgcggcagctatctggctggtgcagggctcgccttcagcctgatgaagtccctgggcgggggtcggcgcggaaccggcgcccaaggcgagacgctcggggaaaagtggaaacgacagctgaaccaactgagtaagagcgagttcaacacctacaagcggtccggcatcatggaggtcgaccggagcgaggcgaaggaggggctgaagagaggcgagacaaccaagcacgccgtaagtcggggaaccgccaagctgcggtggttcgtggagagaaacctggtcaagcccgaagggaaagtgatcgacctgggctgtgggcgcggcgggtggagctactactgcgctggcctcaagaaggtgactgaggtcaaggggtacaccaaaggcggtcccgggcacgaggaacccatcccgatggccacctacggatggaacctggtgaaacttcactccgggaaggacgtgttctttatcccgcccgagaagtgtgacactctcctttgcgatatcggcgagagctcccccaacccgaccatcgaggaggggaggacactgagggtcctcaaaatggtcgaaccctggctgcggggcaaccagttctgcattaagatcctgaacccctacatgcccagcgttgtcgagaccctcgagcagatgcagcgcaagcacggcggcatgttggtgcggaacccgctgtcccgcaattccacccacgagatgtactgggtgtcctgcggaaccgggaatatcgtcagcgcggtgaacatgacctcccgaatgctcctgaaccggttcacgatggcacaccgcaaacccacctatgagcgggacgtggacctgggcaccggcacccgccacgtcgccgtggagcctgaagtggccaacctcgacatcatcggtcagagaatcgagaatatcaaacacgagcacaagtctacctggcactacgacgaggataacccctacaagacctgggcgtaccacggttcatacgaggtcaagccgagcggttccgcgagctctatggtaaatggagtcgtcaagctgctaaccaagccgtgggacgtaatccccatggtcacccagatcgccatgacggacaccacgcccttcgggcagcagcgcgtcttcaaggagaaggtggacacccggacgccgaaggccaagcgcggcaccgcacaaatcatggaggtaactgcgcggtggctctggggcttcttgtcccgcaacaagaaaccccggatctgtacccgcgaggagttcacgcggaaggtccgctccaacgcggccattggggccgtcttcgtcgacgagaaccagtggaactccgccaaggaggcggtggaggatgagcggttctgggatttggtgcaccgcgagcgggaattgcacaagcagggcaagtgcgcgacgtgcgtatacaacatgatggggaagcgcgagaagaagctgggcgagttcgggaaggccaagggcagccgggcaatctggtatatgtggctgggcgcgcgattcctcgagttcgaggcgctggggtttatgaacgaggaccactggttctcccgggagaacagcctctcaggcgtggagggggagggcctccacaagctggggtacatcctgcgcgacatcagcaaaatccccggcggcaacatgtatgccgacgacaccgccgggtgggatacccgcataacggaagatgacctccagaacgaggccaagatcaccgacatcatggagccggaacacgccttgctggcgaaggccatcttcaaactaacctaccaaaataaagtggtacgggttcagcgccccgccaagaacggaaccgtgatggacgtcatctcccggcgcgatcaaagagggagcggccaggtgggcacctacgggctgaacacattcaccaatatggaagcccagctgatccgccagatggagtccgagggcatcttcagcccatcagagctcgaaacccccaacctggctgagcgggcgctggactggctcgagaagtacggggtggagcgcctgaagcggatggccatctctggcgacgactgtgtcgtgaaaccgatcgatgatcgtttcgccactgctctgaccgccctcaacgacatggggaaggtacggaaggacatccctcagtgggagccctccaagggctggaatgattggcagcaggtccccttctgctcacatcacttccatcagttaatcatgaaggacggtcgcgagatcgtcgtgccgtgcaggaaccaggatgagctggtcgggcgcgcgcgggtatcacaaggcgccgggtggtctttacgcgagaccgcctgcctggggaaaagctacgcccagatgtggcagctgatgtatttccaccggcgggacctccgattagctgccaacgccatctgctccgcggttcccgtcgactgggtgcccaccagccgcacaacctggtccatccatgcccatcaccagtggatgaccaccgaggacatgcttagtgtgtggaaccgcgtctggattgaagaaaacccgtggatggaggacaaaacgcacatcagctcgtgggaggatgtaccgtacttggggaagcgtgaggaccagtggtgcggctctcttataggtttaaccgcgcgtgccacttgggccaccaacatccaggtagccataaaccaggtccggagactcatcgggaacgagaactaccttgactatatgacgagcatgaaacggtttaaaaacgagtcagacccagaaggagccctgtggtga

SEQ ID NO: 24273 - RNA, 9879 nt, synthetic construct
  misc_feature 1..9879: note = derived and/or modified CDS sequence (opt11) from DENV-1__FJ898373__SS-prME
  source 1..9879: mol_type = other RNA
agcgtaaccatgcttttgatgctcatgcccaccgcattggccttccacctcacgacccgaggcggtgaacctcacatgatcgtctcaaaacaagaacgcggcaagagcttattattcaaaactagcgcaggcgtcaacatgtgcacgctcatagcaatggatcttggcgaactctgcgaagacactatgacgtataaatgcccacgaataactgaagttgaacccgacgatgtcgactgctggtgcaacacaacggatacatgggtgacctacggcacgtgttcccagacgggagaacatcggcgcgacaaacgctccgtggcgctcgctccccatgtgggcctcgggctagagacacgagccgaaacatggatgtcaagcgagggggcctggaaacagatccaaaaagtagagacgtgggcgctacggcacccaggattcaccgtcattgccttgtttctagcccacgccataggtacaagtatcacccagaaaggaataatcttcattctacttatgctagtgactccgtcgatggccatgaggtgtgtaggaataggaagcagggactttgtagagggcctaagcggggccacatgggtggacgtcgttttggaacacggcagctgcgttacaacaatggctaaagacaaaccgacattagatatagagctattgaaaacagaagtaacaaaccccgctgtcctgagaaaactctgtatagaggcgaaaatatccaacacaaccaccgattcccgctgtcccacccaaggggaggcaacactggtagaagaacaggacgcgaattttgtatgtaggcggacgttcgtagatcgaggctggggcaacggttgcggactattcggcaaaggcagtctaatcacttgcgccaaattcaaatgcgttacgaaactagaaggtaaaatcgtacaatacgagaacctaaaatatagcgtaatagtcaccgttcatacaggggaccaacaccaagtaggcaatgagagcacagagcacggcaccatagcaacaataacaccgcaagcgcccacctcggaaatccagcttacagactacggtgccctgaccctggactgcagtcctagaactggactagacttcaatgaaatggtcttgctgacaatgaaagagaaatcctggctagtacacaaacagtggtttctggacctaccattaccctggacatccggcgcaagcacatctcaagagacgtggaaccgccaagacctgctcgtcacatttaaaacagcacatgcgaagaagcaggaggtcgtagtcctcggaagccaggaaggcgcgatgcacactgcgcttacgggcgcgactgaaatccagaccacgggcacaaccacaattttcgcgggacatctcaagtgccgattgaagatggacaaactgacactcaagggcatgagttacgtgatgtgcacgggatccttcaaactcgaaaaagaagtagcggagacacagcacggcacagtactggtacaaatcaaatatgaaggcaccgacgcgccctgtaagataccctttagcacgcaagacgagaaaggagtgacccaaaacggcagattaataaccgctaacccaatagtcacggataaggagaagcccgtgaatatcgaagctgaaccgccttttggtgagagttatatagtcataggggctggggagaaagcacttaaattaagctggtttaagaaaggcagctcaatcggcaaaatgttcgaagccacggccaggggtgcgagacggatggctatactcggcgataccgcatgggacttcgggtcaatagggggagtctttacaagcgtaggtaagctagtccaccagatattcggcacggcctacggggttctgttcagcggagtcagctggacaatgaaaataggcatcggagtcctactgacctggttgggactaaacagccggtccacttcactaagcatgacgtgcatagcggtcggtcttataacactttatctcggagtcatggtacaagcggacagcggatgcgtaataaactggaagggacgcgaactaaaatgcggttcggggatcttcgtaacaaatgaggtgcatacgtggactgaacaatacaaattccaggccgactctcccaagagactcagcgccgccgtaggtaaagcctgggaggagggcgtgtgtggtatccggtcagccacgcgactcgaaaatatcatgtggcggcaaatctccaacgaactaaaccacatactgctagaaaatgacatgaaatttactgtagtagtcggggacgtggtaggtatattggcacaaggaaagaaaatggtcaggccgcaaccaatggaacacaagtatagttggaaaagctggggcaaggccaagataattggcgcagacgtgcagaacacgacatttataatagacgggccaaacaccccagagtgccctgacgaccaacgagcatggaacatatgggaagtggaagactacggattcggaatcttcacaacaaatatttggctcaaattacgggactcgtatacacaagtctgcgaccacagactcatgtcagccgcgatcaaagactcgaaagcggtgcacgcagacatgggatactggatagagtcagagaagaacgaaacttggaagctcgcgcgagcaagtttcatagaagtaaaaacatgcatatggccaaaatcgcacacgttatggagcaacggggtacttgaaagcgaaatgatcattcctaaaatctatggtggccccatctcccaacacaactatagaccaggctactttacccaaacggcgggcccgtggcatttggggaaactggaactagactttgacctttgtgaaggaaccaccgtagtagtagacgaacattgtggcaatagagggccctcgctacggacgactactgtcaccggaaagatcatccacgagtggtgttgccgaagttgtacgctcccgccgttgaggttcaaaggagaagacggctgttggtatggaatggagatccgtccggtaaaggagaaagaagagaatctagttaagagcatggtgagcgcaggatcgggcgaagttgactccttctccctcggcttgctatgtatatctataatgatagaagaagtgatgcgaagtcgttggagtcgaaagatgctcatgacgggaacccttgccgtgttcttcctattgattatggggcagttgacttggaatgacctcatacgctcctgcatcatggtcggtgctaacgcatcagaccgaatggggatgggaacaacctacctcgcattgatggccacctttaaaatgcggccaatgttcgcggtgggcctgttgttccgtagactcacatctcgcgaagttctcctcttgacgataggcctatcccttgtagccagtgtagaactaccaaactccctggaggaattgggagacggactagcgatggggattatgatattgaaactactcactgactttcagagttaccaactctgggcaacactgctaagcctaaccttcataaagacgacattctcgcttcactacgcgtggaagacaatggcaatggtcctaagtattgtaagcctgcttcccctctgtttaagcacaacttcgcaaaagaccacatggctgccagtcctcctagggagcctagggtgcaagccgctcacgatgttcctcatcgcggaaaataaaatttggggacgcaaaagttggccactcaatgagggtatcatggccgtcggaatagtatcaatacttcttagcagtctgctgaaaaacgatgtgcccctagccggacctcttatcgccggaggcatgttgatagcatgctacgtaatcagcggctcaagtgctgacctgtcgctagagaaggccgcggaagtatcgtgggaggaagaggcggaacacagcggagcaagccataatatactcgtagaggtacaagacgatggtacgatgaagatcaaagacgaagaacgcgacgacacgctgacaatactcttaaaagcgacgcttctggccgtgagcggtgtgtaccccctcagtattccggcaacactattcgtgtggtacttctggcagaagaaaaagcagagaagcggcgtcctgtgggacacacccagtccgccggaagtagaacgtgcggtgcttgacgacgggatttaccgcatcatgcagaggggactgctaggaaggtcccaagtaggtgtaggagtcttccaggagaacgtgtttcacacaatgtggcacgtcacccgaggcgcggtacttatgtaccagggaaaaagactcgaaccaagctgggcctccgttaagaaagatctaatatcctatggcggcggctggcgccttcaaggatcatggaatactggcgaagaagtacaggtaatcgcagtcgagccagggaagaatcccaaaaacgtacaaacagcaccagggactttcaagacacctgagggggaggtgggagcaatcgccctggattttaaacccggcacgagcggctcacccattgtgaaccgagaaggaaaaatcgtcggactgtacggcaacggcgtcgtaaccacttcagggacctacgtgtctgcaatagcgcaggccaaggccagtcaagaagggccactcccagaaatcgaagacgaggtcttccggaagcgcaacctgacgataatggacctacacccagggagcggtaagacaaggaggtatttgccggccatagtacgggaagcaatcaagaggaagttgcggacccttatactagcgccaacgagggtcgtagcaagcgagatggcggaagcacttaagggaatgcccatacgctaccagactactgcggtgaagtcggagcacacggggagagaaatcgtagatttaatgtgccacgcgacattcacaatgcgtttgctgtcgcccgtccgcgttccgaactataacatgataataatggacgaagcgcacttcacagacccctcctcgatcgccgcacggggatatatctccacaagagtcggaatgggagaggcagcagcgatcttcatgacagcaacgccaccgggcagcgtcgaggctttcccccaaagcaatgcagtgatccaagacgaggagcgggacataccagaacgtagctggaatagcgggtacgaatggatcacagattttccaggaaagacggtctggtttgtaccatccatcaaatcgggcaatgacatagccaactgcttgcgaaagaatggtaaaagggttattcaactctcgcggaaaacattcgatacagaataccagaagacgaagaacaatgattgggattatgttgtcacaaccgacatctcagaaatgggggctaacttccgcgcagaccgcgtaatcgatcccaggcgatgcttgaaaccggtcatcttgaaggacggacccgaaagagtaatcctggctggtccgatgcctgttacggtggccagcgcggcacaacgacggggccgaatcgggagaaaccacaacaaagagggagatcagtacatatatatgggccagcccctcaataacgacgaagaccacgcgcattggacagaggcgaaaatgctcctggacaatatcaacacccccgaaggaatcatcccagcgctgttcgagccagagcgagagaaatctgcagcgatcgacggcgaataccgcctgaggggcgaggcacgtaaaaccttcgttgagctgatgcgcagaggcgacctcccggtgtggctgtcatacaaagttgcgtcagaaggattccaatacagcgaccgacgatggtgctttgatggagaacgcaacaaccaggttctggaagaaaacatggacgtagagatatggacgaaggagggcgaaaggaagaaacttcgtccgagatggctcgacgcacgaacgtactccgaccctctcgcgctaagagagttcaaagagttcgccgcgggtagaagatctgtgtcgggagacctcatactcgagataggaaaactgccgcagcaccttacacaacgcgcacagaacgcactcgacaatctagtaatgctccataactcggaacaaggaggtagggcatatagacacgcaatggaagaactaccagacacgatcgaaaccctaatgctcctggccctgatcgccgtcctcacgggtggcgtgacactgtttttcctctcagggcgaggcctgggcaaaacatccataggccttctatgcgtgatggcgagcagcgcactattatggatggcatcagtagaaccacactggatcgcagcaagcattattctcgagttcttcttaatggtcctactgattccggagccagaccgacagcgtacaccccaagacaaccagctagcgtacgtggtcattggactattattcatgatccttaccgtcgccgcaaacgagatggggcttctcgaaacaaccaagaaggacctaggcatcggacatgtagctgttgaaaaccatcaccatgccaccatgctagatgtagaccttcatccagcgtcggcgtggacattatacgcggtagccacgacaatcataacgccaatgatgcgacacacgatagaaaataccaccgcgaacatctccttaactgccatagccaaccaagcagcaatactaatggggctcgacaaaggttggccaatatcgaagatggatatcggggtccccctcttagcactgggctgctactcgcaagtaaacccattaactctcacggcagctgtcctgatgctagttgcccattacgcaataatcggccctggcctccaagccaaagccaccagagaggcacaaaaacgtacggcagccgggataatgaagaatcccacagtcgacggcattgtagctatcgatctagatcctgtggtatacgatgcgaaatttgaaaaacaacttgggcagataatgcttctcatattatgcacatcccaaatcctgctcatgcgcacaacctgggcactatgtgaaagtataaccctcgcgacaggcccgctcaccaccctatgggaaggaagcccgggaaaattctggaacacaacaatagcagtatctatggcaaacatattccgagggtcatacctagcaggcgcagggctcgcgttcagcctaatgaagtccttaggaggcggccgaagagggacaggcgcgcaaggagaaactctgggagagaaatggaaacgtcaactcaaccaattaagcaaaagtgagttcaacacatataaacgctccggaatcatggaggtagaccgcagtgaggcaaaagaagggctacgaagaggcgagacaacaaagcacgcagtcagcagggggaccgcaaaattacgatggttcgtggaacgtaacctggtaaagccggagggcaaagtgatagatctcggatgtgggcgcggagggtggagctattactgtgcagggctgaagaaagtgacggaagtcaaaggatacacaaaaggaggtccgggccacgaagaaccgatccccatggccacctatgggtggaacctcgtcaaactgcactcagggaaagacgttttcttcataccaccagaaaaatgcgatacgcttctttgtgatatcggcgagtcgtccccaaacccaacaatagaggagggaagaaccctacgtgtcctaaaaatggtagaaccatggctgcggggaaatcaattctgcataaaaattctaaacccgtatatgccgtcagtagtcgaaaccctcgagcacatgcagcgcaaacatggcgggatgttagtaaggaacccactatcacgaaactcgacgcacgagatgtactgggtatcgtgtggaacggggaatatagtgtccgcagtcaatatgacatcccgcatgctgctgaataggtttaccatggcccaccgaaaaccaacctacgaacgagacgttgacctcggcgcgggcaccagacacgtcgccgttgaaccagaagtcgcgaatctggatatcataggtcagcgaattgaaaacataaaacacgaacacaagtcgacatggcactacgacgaggacaatccctacaagacgtgggcctaccatgggagctacgaggtaaagcccagtggaagcgcttcctcgatggtcaacggagtagtaaaactgttgaccaaaccctgggacgtgatccccatggtgacgcaaatagcgatgacggacacgacaccatttgggcaacaacgggtatttaaggagaaggtggatacgcgtacgcctaaggcaaagcgcgggaccgcacaaataatggaagtcaccgcacgctggctatggggcttcctaagtcgcaacaagaaacctagaatatgcacgagggaggagttcacgagaaaagtaagaagcaatgcggcaatcggcgctgtatttgtggacgaaaaccaatggaactcagctaaggaagcagtagaagatgaaaggttctgggacctcgttcatcgggagagagagctccacaagcaaggcaaatgcgccacgtgcgtatacaacatgatgggcaagagagagaagaaactcggcgagttcggcaaagcaaaagggagccgggcaatttggtacatgtggctgggagctcgcttcctggagttcgaagccttaggctttatgaacgaagatcactggttcagccgggaaaactcactgtctggagtagagggagaaggattgcacaagttaggctacatactacgggacatctccaaaatcccaggaggcaatatgtatgccgatgacacagcaggctgggacacacgaataaccgaggacgacttacagaatgaagcgaaaatcacggatatcatggagccggagcacgcactcctcgcgacgagtatattcaaactaacctaccaaaataaggtcgttcgcgtccaaaggccggccaaaaacgggaccgtgatggatgtaatcagccgccgcgaccaacgcgggagcggccaagtaggaacatacgggctcaataccttcaccaacatggaggcccaactgataaggcagatggaaagtgagggcatattttccccctctgaacttgagacaccgaatttggcggaaagagtactagactggctcgagaagtacggggtggagaggctaaagagaatggcaataagcggggacgactgtgtagttaaacccatagacgaccggttcgcgaccgcccttacagcactcaacgacatgggaaaggtcagaaaagacatcccccaatgggaaccatcgaagggctggaatgattggcaacaggtccctttctgcagtcatcacttccaccagctaatcatgaaagacgggcgcgaaatagtggtaccatgccggaaccaagacgaactggtcggccgagcacgagtaagccagggcgcgggctggagtctccgagaaaccgcgtgcctaggtaaatcttacgcacagatgtggcaattaatgtatttccaccggagagatctaagactcgctgccaatgcaatctgcagcgcggtgccagtagattgggtgcccaccagccgtactacgtggagtatacatgcacaccaccaatggatgaccactgaagacatgctatcagtatggaaccgggtctggatagaagagaacccatggatggaggacaaaacacatataagcagttggggcgacgttccctacctgggaaaaagagaagatcagtggtgcgggtcgcttatcggactcaccgcgcgagcaacctgggcgacaaatatccaagtagcaatcaaccaagtccgacgattaatagggaacgaaaactacttggattacatgacgagcatgaagagatttaagaacgaatctgatccagaaggggcactatggtag

SEQ ID NO: 24274 - RNA, 9879 nt, synthetic construct
  misc_feature 1..9879: note = derived and/or modified CDS sequence (opt11) from DENV-1__FJ898374__SS-prME
  source 1..9879: mol_type = other RNA
agcgttacgatgctgctaatgcttatgccgaccgcgttggccttccacctcaccacacggggcggggagccccacatgatcgtcactaagcaagaacgtggcaagtcactgttgttcaaaaccagcgcaggggtgaacatgtgcacgctcatcgcgatggacttaggggagctgtgtgaggataccatgacctacaagtgcccccggattacggaggccgagccggacgacgtggattgctggtgcaacgccaccgatacgtgggtgacttacgggacctgctcgcagaccggggagcaccggcgcgacaagcggtcagtggccctcgcgccccatgtgggcctggggctagagacacgcaccgagacctggatgtccagcgaaggcgcctggaagcagatccagcgggtggagacgtgggctctccgccaccccgggtttaccgtgatagccctgttcctggcgcacgccatcggcacctcgatcacccagaagggaattatcttcatcttactgatgttggtgacgcccagcatggccatgcggtgcgttggaatcggcagtagagacttcgtggaaggtttgagcggcgccacttgggtggacgtcgtcctggagcacgggtcctgcgtgacgacaatggccaaggataagcccacgctggacatagagttactgaagaccgaggtcaccaacccggctgtactgcggaaactgtgcattgaagccaagatatcaaacaccacgaccgacagccgctgccccacccagggcgaagccaccttaatggaagagcaggacgcaaacttcgtgtgccggcgcacgttcgttgatcggggctgggggaacggctgcggtctgttcggcaaggggagcttaatcacgtgcgccaagttcaagtgcgtgacgaagctcgagggcaagatcgtgcagtacgagaacctgaagtacagcgtcatcgtgaccgtgcacacgggcgaccagcaccaggtcggaaacgaaagcaccgaacacgggaccacggcgaccatcacgccccaggcccccacctcggaaatccagctcacagactacggggccctgaccctggactgcagtccccgcacggggctcgacttcaacgagatggtactgctgaccatgaaggaaaagtcatggctcgtccacaagcagtggttcctggaccttcctctcccgtggaccagcggggccagcacctcccaagagacgtggaaccggcaggacctgctggtgaccttcaagaccgcccacgcgaagaagcaggaagttgtcgtgctcggaagccaagagggcgccatgcacaccgccctgaccggggccaccgaaatccagacctcgggcaccacgaccatcttcgctgggcacctcaagtgccgcctgaaaatggacaagctgacgctaaaaggcatgagttacgtgatgtgcacaggatcctttaaactcgagaaggaggtcgcggaaacgcagcacggcaccgtactggtgcagatcaaatacgagggtaccgatgccccgtgtaagatccccttctcaacccaggacgagaagggggtgatccagaacggacggctcatcactgccaacccgatcgtgaccgacaaggagaagcccgtaaacatcgaggccgaaccgcccttcggggagagctatatcgtcatcggcgtgggcgagaaggcgctgaaactcagctggttcaagaaagggtccagcatcggcaagatgttcgaagcgacagcccgaggggctcggcgcatggcgatattaggagacaccgcgtgggacttcgggtccattggcggcgtgttcacgagcgtcgggaaactggtgcaccagatcttcggcaccgcctacggggtcctgttctccggcgtcagctggaccatgaagatcggtatcggcgtgctgctgacctggctcggactgaattcgcgcagcacgtctctgagcatgacctgcatagccgttgggctcgtcactctttatctgggcgtgatggtgcaagctgactcggggtgcgtcatcaactggaagggcagagagctcaagtgcgggagcggcatcttcgtgacgaacgaagtgcacacgtggaccgaacagtataagttccaagccgacagcccgaaacgcctgtccgctgccatcggcaaggcctgggaggaaggtgtctgtggcatccgaagcgtgacccgcctggagaatatcatgtggaagcagatctcgaacgagctcaaccacatcctgctggagaacgatatgaaattcaccgttgtcgtaggggacgtggtgggcatactcgcacaggggaagaagatgatccggccccagcccatggagcacaagtacagctggaagtcctgggggaaagccaagatcattggcgcggacgtgcagaacaccacgttcatcatcgacgggcccaacaccccggagtgccccgacgaccagcgcgcctggaacatctgggaggttgaggactacggattcggcatattcaccaccaacatctggctgaagctgcgggacagctacacgcaggcctgcgaccacaggctcatgtccgccgcaatcaaggacagcaaggctgtccacgccgacatgggctattggatagagagtgagaagaacgagacctggaaactggcgcgggccagcttcatcgaggtgaagacgtgcatatggcccaagtcccacaccctctggagcaacggggtgctagagtccgagatggtcatcccaaagatctacggggggccgatcagccagcacaactatcgccccgggtacttcactcagaccgcgggcccctggcacctggggaagctggagctcgacttcgacctgtgcgagggcaccaccgtggtggtcgacgagcactgtggcaacagagggccgtcactgcgcacgaccacggtgaccggaaagattatacacgagtggtgctgccggagctgcacgctacctcccctccgcttcaagggggaggacggctgctggtacgggatggagatccgcccagtgaaggagaaagaggagaacctggtcaagtcgatggtgagcgccggcagcggcgaagtggacagcttcagcctcgggttactgtgcatctccatcatgatcgaggaggtcatgcggagccggtggtcccgcaagatgctaatgaccggcaccctggccgtgttcttgctcctgatcatgggccagctgacttggaacgacctcatccggctgtgcatcatggtgggcgccaacgcctccgaccgcatgggcatgggtacgacctacctggcactcatggccaccttcaagatgcgcccgatgttcgctgtaggcctgcttttccggcgcctcactagccgggaggtactgctgctcacgatcggtctgagcctggtcgcttccgttgagctccctaacagcctggaagaattaggcgatgggctcgcgatgggcatcatgatcctgaaactgctcaccgacttccagtcccaccaactgtgggcgaccctgctctcgctgacttttatcaagacgacgttgtccctccactacgcctggaagacgatggccatggtgctgagcattgtctccctgttccccctctgccttagcacaacgtcccaaaagaccacctggctgccggtgctcctgggcagcctggggtgtaagccgttaacgatgtttctgatcgccgagaacaagatctgggggcgcaagtcctggcccctgaacgagggaatcatggctgtgggcgtcgtgagtatcctcctgagctccttgctcaagaacgacgtgcccctggccgggcccttaatcgccggtggtatgctcatcgcctgctacgttatctctgggtccagcgccgacctgtccctggagaaggcggccgaggtgtcatgggaggaggaggccgagcactcgggcgccagccataatatcctcgtggaggtccaggacgatggaacgatgaagatcaaggacgaggagcgggacgacaccctaactatcctgctcaaggccaccctgctggccgtgagtggagtgtaccctctcagcatccccgctaccctgttcgtgtggtacttctggcagaagaagaagcagaggtccggggttttgtgggacacacctagtccgcccgaagtggagagggccgtcctggacgacggcatctaccgcatcatgcagcggggcctgctggggcgctcccaggtgggcgtgggcgtcttccaggagaacgttttccacaccatgtggcacgtgactcggggcgccgtgctgatgtaccaagggaagcggctcgagccatcatgggcttccgtcaagaaggacttaatcagctacggaggcgggtggcggctgcaggggtcctggaacaccggggaggaggtgcaagtcatcgcggtggagccaggcaagaaccccaagaacgtgcagacggcccccgggaccttcaagacgcccgaaggtgaagtcggtgccatcgccctcgacttcaaaccgggtaccagcggatcccccatcgttaaccgcgaggggaagatcgtgggcctgtacggcaacggagtagtgacaaccagcggcacctatgtaagcgcgatcgcgcaggccaaagcctcgcaggaggggccactgcccgagatcgaggacgaggtattccggaagcgcaacctcaccatcatggacctgcaccccggcagcgggaagacgcggcgctacttgccggcaatcgtgcgtgaggcaatcaaacgcaagctccggaccctgattctggcccccaccagagtggtcgcctccgagatggccgaggcgctcaaggggatgcccatccgctaccagaccacggcggtcaagagcgagcacaccggcaaggagatcgtggacctgatgtgccacgccactttcacgatgaggctcctctcccccgtccgagtgccgaactacaacatgatcatcatggacgaagcccacttcaccgaccccagctccatcgccgcccggggctacatctccacccgcgtgggcatgggggaggcagccgccatcttcatgaccgccactcccccgggctccgtggaggccttcccgcaaagcaacgctgtgatccaggacgaggaacgggacatccccgagcgctcgtggaacagcgggtacgaatggatcactgactttcccggcaaaaccgtttggtttgttccctccatcaaaagcggcaacgacatcgccaactgcctgaggaaaaacgggaagcgcgtgatccagctgtcgcgtaagacctttgacacggagtaccagaagacgaagaacaacgactgggattacgttgtcaccaccgacattagtgagatgggcgccaacttccgcgccgacagagtgatcgacccgcgccgttgcctcaagcccgtcatattgaaggacgggcccgagcgcgtcatcctagcgggccccatgccggtgaccgtcgcttccgccgcccagcggcgcgggcggatcggccgcaaccacaacaaggagggggaccagtacatctacatgggccagcccttaaacaacgacgaggaccacgcccactggacggaggcgaagatgctgctggacaatatcaacacccccgagggaatcatccccgccctctttgagccggagcgggagaagtccgctgccatcgacggtgaataccgcctgcgaggcgaggcccgaaagaccttcgtggagctgatgcgccgcggggacctacccgtgtggctatcctataaggtagcgtctgagggcttccaatactctgaccgccggtggtgttttgatggggagcgcaacaaccaggtgctggaggagaacatggacgtagagatctggaccaaggagggggagcgtaagaagctccgcccccgttggctagacgcccgcacgtactccgaccccctggccctccgggagttcaaggagtttgccgcgggccgccggagcgtatccggagacctgattctggagatcggcaagctcccacagcacctgacccagcgcgcacagaatgccctggataacctagtgatgcttcacaacagcgagcagggggggcgggcctaccggcacgcaatggaggagctgcccgacacaatcgagacactcatgctgctggcgctcatcgccgtgctgactggtggggtcaccctgttcttcctctctggaagagggctgggcaagaccagcataggtctgctctgcgtgatggccagtagtgtgctgctttggatggcctccgttgagcctcactggatagccgcgtcaatcatactcgagttctttctaatggtccttctgatccccgagccggaccgccagcggacgccgcaggacaaccagctggcctacgtggtcattggcctcctcttcatgatcctaaccgtggcagccaacgagatgggcctgctagagactaccaagaaggacctggggattgggcatgtggccgttgagaaccaccaccacgcaaccatgctggacgtggatctacaccccgcttccgcctggaccctgtacgccgtggccacgaccatcatcaccccgatgatgcgacacacgatcgaaaacacgacggcgaacatcagcctgaccgccatcgccaaccaggccgccatactgatggggctggacaaaggctggccgatctccaagatggacatcggcgtccccctgctcgcgctggggtgctacagccaggttaaccctctgacactcacggcggccgtgctgatgctggtggcccattacgcgatcatcggcccgggcctccaggccaaggccacccgggaggcgcaaaaacggaccgccgctgggataatgaagaacccgaccgtagacggtatcgtggccatcgacttggaccccgtcgtgtacgacgccaaattcgagaagcagctgggccaaattatgctcctaatcctgtgcacgtcccaaatcctcttgatgcgcacgacctgggccctgtgcgaatcgataacgctagccacgggccccctgaccaccctgtgggaagggtctccgggcaaattctggaataccacgatcgcggtgagcatggccaacatcttccgggggtcctacttagccggggccggcctggcgttcagcctgatgaagtcattgggtggcgggcgccggggtaccggggcgcagggcgagactctgggggagaagtggaagcgccagttgaatcaactctcaaagagcgagttcaacatctacaagcggtccgggatcatggaggtcgaccgcagcgaggccaaggagggcctgaaacgcggagagacaacgcgccacgccgtgtcccggggcaccgctaaactgcgatggttcgtagagcggaacctggtcaagcccgaggggaaagtgatcgacctcggctgcggacgcgggggttggagctactactgcgcggggctgaagaaagtgaccgaggttaagggctacaccaagggcgggcccggtcacgaagagcctatcccgatggccacgtacggatggaacctggtgaagctccactccggcaaggacgtgtttttcacgccacccgagaagtgcgacacactgctgtgcgacataggggagagctctccaaacccgaccatagaggagggccggacgctccgagtcctgaagatggttgagccgtggctccgggggaaccaattctgtatcaagatacttaacccctacatgcccagcgtggtcgagaccctggagcagatgcagcgcaagcacgggggcatgctggtacggaaccctctctcccgcaatagcacccatgagatgtactgggtgtcctgcgggaccggcaacatcgtcagcgctgtgaacatgacctcccgaatgctattaaaccgcttcacgatggcccaccgcaagcccacctacgaacgggacgtcgacctcggtgccggcacccgccacgtcgcggtggagcctgaggtggcgaacctggacatcatcggtcaacggatagaaaacataaagcacgagcacaagtctacctggcactatgacgaggacaacccctacaagacgtgggcctaccatggatcctacgaggttaagccgagcggctccgcttcaagcatggtaaacggcgtcgtgaagctgctcaccaaaccctgggacgttatccccatggtcacgcagatcgccatgaccgacactaccccctttggccagcaacgcgttttcaaggagaaggtggatacccgaacaccgaaggcgaaaagagggactgcccagatcatggaagtcaccgctcggtggctgtggggattcctgtcccgcaacaagaagccccggatctgcacccgcgaagaattcacccggaaggtgaggtcaaacgccgccatcggcgcggtgttcgtcgacgagaaccagtggaactccgccaaggaggccgtggaggacgagcggttttgggatctcgtgcaaaaagagcgagagctgcacaagcagggtaagtgcgccacgtgcgtatacaacatgatgggaaagcgtgagaagaagctgggtgagttcggcaaggcgaaagggagccgcgctatatggtacatgtggctcggcgcccggttcctcgagttcgaagcattgggcttcatgaacgaggaccattggttctcccgagagaactccctttccggggtagagggcgaggggcttcacaagctaggctacatactcagagatataagcaagatcccaggtggcaacatgtacgcagacgacaccgcgggttgggacacccgcatcaccgaggacgaccttcagaacgaggccaagatcacggacatcatggaaccggagcacgccctgctcgccacctccatcttcaagctaacctaccaaaacaaggtggtccgggtgcagcggcccgccaagaacgggacggtgatggacgtcatcagccgccgggaccagcgcggctccggccaggtgggcacgtacggactgaatacgttcaccaacatggaggcacagctcatccggcagatggagagcgaggggatcttcctgccctccgaactggagacacccaacctcgccgagcgcgtgctggactggctggagaagcacggcgtcgagcggctcaagcggatggccatcagtggggacgactgtgtggttaagccgattgacgaccggttcgccacggcactgaccgccctgaacgacatgggcaaagtgcgcaaggacataccccaatgggagccctccaaggggtggaacgactggcagcaggttcccttctgcagccaccacttccaccagctcattatgaaagacggcagagagatcgtagtcccgtgccgcaaccaggacgagttggtgggccgtgcccgcgtgtcccagggggccgggtggagcctgcgggaaaccgcctgcctcggcaagagctacgcccagatgtggcagcttatgtacttccaccgccgcgacctgcgcctcgcggcgaacgcgatatgctctgcggtccccgtggactgggtaccgaccagccggacgacctggtcaatccacgcgcaccaccagtggatgaccaccgaggacatgctgagcgtctggaatagagtgtggatcgaggagaacccctggatggaggacaagacgcatgtgagctcttggggcgatgtcccgtaccttgggaagcgggaggatcagtggtgcgggtccctcatcggtctgaccgcccgcgccacctgggccagcaacatccaggtggcgataaaccaggtgcgacggctgatcgggaacgagaactacctcgactacatgacatccatgaagcgtttcaagaacgagggcgaccccgagggagcactgtggtga

SEQ ID NO: 24275 - RNA, 9879 nt, synthetic construct
  misc_feature 1..9879: note = derived and/or modified CDS sequence (opt11) from DENV-1__FJ898375__SS-prME
  source 1..9879: mol_type = other RNA
tcggtgaccatgctgctcatgctgatgcccaccgccctggcctttcacctcactacccggggaggggaaccgcacatgatcgtgagcaaacaggaacgtgggaaaagcctcttattcaagacgtctgcgggagtgaacatgtgcaccttaatcgcgatggacctgggcgagttctgcgaggacacgatgacctacaagtgcccccgcatcacggaggccgagcccgacgacgtggattgctggtgcaacgccaccgatacgtgggtgacctacgggacctgttcacagaccggcgagcaccggcgcgacaagcgctccgtagccctggcaccccacgtggggctcgggctggagacacgtaccgagacctggatgagctccgagggcgcctggaagcagatccagcgtgtcgagacttgggctttacgccaccccgggttcacggtgatggccctcttcctggcgcacgccattggcaccagcatcactcagaaggggatcatcttcatcctgctcatgctggtgaccccctccatggcgatgcggtgcgtcggcatcggcagccgtgacttcgtggaagggctgtccggcgccacgtgggtcgacgtcgtgctggagcacggcagctgcgtgaccactatggctaaggacaagcctacactggacatcgagctactcaagaccgaggtcaccaaccccgcggtactgcggaagctgtgcatcgaggcaaaaatctccaatactaccacggactcccgctgcccgacccagggcgaagccaccctcgtggaggagcaagacgccaatttcgtatgcagacgcaccttcgttgatcggggctgggggaacggctgcgggctgttcggcaaggggtccctgatcacgtgcgccaagttcaagtgcgtgaccaagctagaaggcaagaccgtacagtacgagaatctgaaatatagcgtgatcgtgaccgtccacaccggcgaccaacaccaggtggggaacgaatccaccgagcacggcaccactgccaccatcacgccccaagcccccagcaccgagatccagctgaccgactacggggccttgacactggactgttcgccccggacgggcctggactttaacgaaatggtcctccttacgatgaaggaaaaatcctggctggtgcacaagcagtggttccttgatcttccccttccttggaccagcggggcgtccactagccaggaaacgtggaatcggaaagatctcctggtcaccttcaaaaccgcccatgcgaagaagcaggaggtcgtggtgctcggatcccaagagggcgctatgcacacggcgctcacgggggcgaccgagatccaaactagcggcaccacgaccatctttgccgggcacctgaagtgccgcctgaagatggacaagctcaccctgaagggcatgtcctatgtcatgtgcaccgggtccttcaaattggagaaggaggtggcggagacgcagcatggcaccgtgctcgtccagatcaagtacgagggaacggacgccccctgcaaaatccccttctctacccaggacgagaagggcgtgacgcagaacggccggctgatcaccgccaacccaattgtgaccgacaaagagaagcccgtaaacatcgaagcggaaccgcccttcggtgagagctacatcgtgatcggagcaggcgagaaagccctgaagctgagctggtttaaaaagggaagctccattggcaagatgttcgaggccacggcacgcggcgccagaagaatggcgatcctcggtgacacggcctgggacttcgggagcatcggcggcgtcttcacgtccgtcgggaagctggtgcaccagatcttcggcaccgcctatggggtgctgttttctggcgtcagttggacgatgaagatcgggatcggcgtcctcctgacgtggctgggcctgaactcccgctccacctctctttccatgacctgcatcgccgtggggctggtcaccctctacctgggcgttatggtgcaggcggacagcgggtgcgtaatcaactggaaaggccgggaactcaaatgcgggagtggcatcttcgtgacgaacgaggtccacacctggacggagcagtataagttccaggcggattccccgaagcgcctcagcgccgccatcggcaaggcctgggaagaaggggtctgcggcattcggtcggccactcgcctggagaacatcatgtggaagcagatcagcaacgagcttaatcacattctcctggagaacgatatgaagttcaccgtggtggtcggggacgtagcgggcatcctggctcaaggcaagaaaatgatccggccacagcccatggagtacaagtactcatggaaatcctggggcaaggccaagatcatcggtgccgacgttcagaacacgaccttcataatcgatgggcccaacaccccggagtgccccgacgaccagcgcgcgtggaatatctgggaggtcgaggactacggcttcgggatattcaccacaaatatctggctcaagctaagagactcctacactcaggtgtgcgaccacagactgatgagcgccgcgatcaaggactccaaggccgtgcacgccgacatgggctactggatcgagagcgagaagaacgagacttggaagctcgcgcgtgcctccttcatcgaggtcaagacctgcatctggcccaagagccacacgttgtggagtaatggcgtattggagagcgagatgataatccccaagatctacgggggcccgatcagccagcataactaccgccccggctacttcacccagacagcgggcccctggcacctcggaaagctggaattggacttcgacctctgcgagggcaccacggtcgtcgtggatgagcattgcggcaacagggggccgagcctgcgcaccaccacagttacgggcaagatcatccacgaatggtgctgccgatcctgcaccttgccacccctgcgcttcaaaggggaagacggctgctggtacgggatggagatccggcccgtcaaggagaaggaggagaacctggtcaagagcatggtgagcgccggctccggcgaggtcgatagcttctccctggggctcctgtgtatctcaatcatgatcgaggaagtgatgcgctcacgctggtcccgaaagatgctgatgaccggaacgttggcagtattcttcctgctgattatggggcagctcacgtggaatgacctgattcgactgtgcataatggtcggcgcgaacgcctccgaccgcatggggatgggcaccacctacctcgccctaatggccaccttcaagatgcgcccgatgttcgccgtaggcctcctattcaggcgcctgacgtcgcgggaggtgcttctactgacaatcgggctgtcccttgtcgcgagcgttgagctgccgaactccctggaggagctcggtgacgggctggcaatgggcattatgatcctgaagttgctgaccgacttccagagccaccagctgtgggccaccctcctgtccctgacttttatcaagaccaccttctccctccactacgcttggaagaccatggcgatggttctgtccatcgttagcctgttccccttgtgcctgtctacgaccagccagaagaccacctggctgccggtgctgttgggctcgctcgggtgtaagcctctcacgatgttcctgatcgccgagaacaagatttggggccgcaagagctggcccctgaacgaggggatcatggccgtcggcatcgtttccatcctcctgtctagcctgctcaaaaacgatgtgcctctggcggggcccctgatagccggcggcatgctcatcgcttgctacgtcatctccgggagctccgccgacctgagcctcgagaaggccgccgaggtgtcctgggaggaggaggccgagcacagcggcgctagccacaatatcttggtggaagttcaggacgacgggaccatgaagataaaggacgaggaacgggatgacaccctgaccattctgctcaaggccaccctgttggcagtgtcaggcgtatacccgctgtccatcccggccacgctgttcgtctggtacttctggcagaagaagaagcaacgcagcggggtactgtgggacaccccaagtccgcccgaggtggagcgggccgtgctcgacgacggcatctaccgaatcatgcagcggggcctgctcgggagaagccaggtgggcgtgggggtcttccaggagaacgtcttccataccatgtggcacgtgacccgcggcgcggtcctgatgtaccaggggaagcgcctcgagccctcttgggccagcgtcaagaaggatctgatctcctacggcggcgggtggcggttgcagggcagctggaacacgggggaggaagtgcaagtcatcgccgtggagcccggtaagaaccccaagaacgtccagaccgctcccgggacctttaagacctccgagggcgaagtcggcgccatcgcgctcgacttcaagccggggacgagtggctctcctatcgtgaaccgcgaagggaagatcgtgggcctatacggcaacggggtcgtgaccacctccggaacctacgtgagcgccatcgcccaggccaaggcgtcccaggaggggccactgccggagatcgaggacgaggtgtttcggaagcggaacctcacgatcatggatctgcaccccggcagcgggaagactaggagatatctgcccgccatcgtccgcgaggccataaaacgcaagctccggacactgatcctggccccgactcgcgtcgtagccagtgagatggcagaggccctcaagggcatgcccatccgctaccagacaaccgccgtcaagagcgagcacaccggtaaggagatcgtggatctgatgtgccatgcaaccttcacgatgcggctgctttcacccgtccgcgtgcccaattacaacatgataatcatggacgaggcccatttcaccgacccgagctccatcgcggcccgggggtacattagcacccgcgtgggtatgggggaggccgccgccatcttcatgaccgcgaccccgcccggctccgtcgaggccttccctcagagcaacgccgtaatccaggacgaggaacgggacatcccggagcgctcgtggaacagcggctacgaatggatcacagactttcccggcaagaccgtttggttcgtccccagtattaagagcggcaatgatatcgccaactgtttacggaagaacgggaaacgcgtgatccagttatcccgaaagacgttcgacacggagtaccagaagaccaaaaacaacgactgggactacgtggtcaccacagatatcagcgagatgggggcgaacttccgcgccgaccgggttatagatcctcgccggtgcctcaagccggtgatcctgaaggacgggcccgagcgcgtcatcctggccggccccatgccggtgacagtagcctccgccgcccagagacgcgggcggatcggccgcaatcacaacaaagagggcgaccagtacatctacatggggcaaccactcaacaacgacgaagaccacgcccactggaccgaggcgaagatgctgctggacaacataaatacccccgagggcataatccccgcccttttcgagcccgagcgggaaaagtccgccgcgatcgacggggagtaccgtctgcgcggcgaggcgcgaaagacattcgttgagctgatgagacgcggggatctcccggtgtggttgagccataaagtcgcctccgagggcttccagtacagcgaccgtcggtggtgcttcgacggcgagcgcaacaatcaggtgctggaagagaatatggatgtggagatttggacgaaggagggggagcggaagaaactacgaccccggtggctggacgcccgaacgtactccgaccccctggcactacgggagttcaaggagttcgccgccggccgccgtagcgtctccggggacctgattctggaaatcggaaagctcccccaacacctgacccagcgggctcagaatgcactggacaacctcgtgatgctgcacaacagcgaacagggcgggcgggcgtaccgtcacgcgatggaggaactgccggacaccatagagacgctgatgctactggccctaatcgccgttcttaccggcggggtgaccctgttctttctctccggccgcgggcttgggaagaccagcatcggcctgctctgtgtgatggcctccagcgtgttgctttggatggcgtcggttgagccccactggatcgccgcgagcattatcctcgagttcttcctgatggtgctgctcatccccgagcccgaccgccagcggaccccacaggacaaccagctggcctatgtggtcataggactcctcttcatgatcctgaccgtggccgcaaacgagatgggcctgctcgaaactaccaagaaggacctggggatcggccacgtggccgtagagaagcaccaccacgccgccatgctggacgtggacctacacccagcatccgcgtggacactgtacgccgtggccacgacaatcatcacccccatgatgcgccacacaatcgagaacactacagccaacataagcctgaccgccatcgcgaatcaggccgccatcctcatggggctggacaagggttggccaatctccaagatggacatcggcgtccccctgctcgcgctggggtgttattcacaggtgaatcccctgacgctcacggctgccgtgctgatgctggttgcccattacgctatcatcggccccggcctccaggccaaggcgaccagagaggcccagaagcgcaccgccgcgggcatcatgaagaacccgacggtggacgggatagtggccatcgatctggatccggtcgtgtacgacgcgaagttcgagaagcagctgggccagatcatgctcctgatcctgtgcacctcccagatcctcctgatgcgcaccacttgggccctgtgcgagtcaataacactcgccactggccccttgaccacactgtgggaggggtcccccggtaagttctggaacaccactatcgcggtgagcatggccaacatcttccgagggagctacctcgcgggggctggcctggccttcagcctgatgaagtcgctcggaggcgggcgccgggggaccggggcccagggcgagaccctgggcgagaagtggaagcgccagctgaatcagctctccaaaagcgagttcaatacctacaagcggtccgggattatggaggtcgaccgcagcgaggcgaaggaaggcctcaagcgcggggagacgaccaagcacgccgtaagccgcggcaccgcgaagttgcggtggttcgtggagcgcaacctcgtcaagccggaggggaaagtaattgacttaggctgcggccgcggcgggtggagctattactgcgccgggttaaagaaggtgaccgaggtcaagggatacacgaagggcgggcccggccacgaggagcccatccccatggccacttacgggtggaacctggttaaacttcactcaggcaaggacgtgttcttcattccgcccgagaagtgcgataccctgctgtgcgacattggcgagagcagtcccaaccccaccatcgaggaaggccgcacgcttcgggtcctgaagatggtagagccgtggctgcgcgggaaccagttctgcatcaagatcctcaacccctacatgccctctgtcgtggagaccctagagcaaatgcagcggaagcatggaggcatgctagtgcgcaacccgctctcccggaacagcacccacgagatgtactgggtgtcttgcgggaccggcaacatcgtcagcgcggtgaacatgacgagcaggatgctgctgaatcgtttcacgatggcccatcgtaagccgacctatgagcgcgacgtggacctcggggccgggacccggcacgtcgccgtggagcccgaagtggccaacctggacatcatcggtcagcgcatagagaacatcaaacacgagcacaaaagcacctggcactacgacgaggacaacccctacaagacgtgggcgtaccacgggtcttacgaggtcaagcccagcggttctgcgtccagcatggtgaacggggtcgtgaagctgctcactaagccgtgggacgtgatacccatggtgacccagatcgccatgaccgatacgaccccctttgggcagcagcgggtgtttaaagagaaggtggacacccgcacccctaaggctaagcggggtacggctcagatcatggaggtcaccgcgaaatggttgtggggcttcctgtcccgcaacaagaagcctcggatatgcacgcgcgaggagttcacccggaaggtgaggagcaatgccgccatcggcgccgtgttcgttgacgagaaccaatggaactccgcgaaggaggccgtagaagacgagcgattctgggacctagtgcatcgagagcgggagctgcataagcaggggaagtgcgctacgtgtgtctacaacatgatgggcaagcgcgaaaagaaactgggggagttcggcaaggccaaggggagccgggccatctggtacatgtggctcggggcgcgcttcctggagttcgaggccctggggttcatgaacgaggaccactggttctcccgggagaacagcctctctggggtggagggcgaagggttacacaagctgggctatatcctccgcgatatcagcaagatccccggagggaacatgtacgccgacgacaccgccggctgggacacccggatcactgaggacgacctgcagaacgaggctaagatcacggacataatggagcccgagcacgcgctgctcgccaagtcgatattcaagctgacctaccagaacaaagtcgtccgcgtccaaagaccggccaagaacgggaccgtgatggacgtcatctctcgtcgcgaccaacggggcagcggacaagtgggtacctacggcctgaacacgttcactaacatggaggcccagctcatccgccagatggagagcgagggaatcttcagtccctccgagctggagacccccaatctggccggccgggtactcgactggctggagaagcacggggttgagcgtctgaagcgtatggcgatcagtggcgacgactgcgtggtgaagcccatcgatgaccgcttcgccaccgccctcacggccctcaacgatatggggaaggtccggaaggacatcccgcagtgggaaccctcgaagggctggaacgactggcagcaagtccccttctgcagccaccactttcatcagcttatcatgaaagacggccgcgagatcgtggtcccctgccggaaccaggacgagctcgtggggcgtgcccgggtgagtcaaggcgccggttggagcctgcgtgagaccgcctgcctgggcaagagctatgcccagatgtggcagctcatgtactttcaccggcgcgacctgcggctggccgcgaatgcaatctgttcggccgtccctgtggactgggtacccacctcccgcaccacgtggagcatccacgcccatcaccagtggatgaccaccgaggacatgctctccgtctggaatcgggtgtggatcgaagagaacccctggatggaggataagacccacatcagctcctggggcgacgttccctacctgggcaagagggaggatcagtggtgcggcagcctgatcgggctcacggcccgtgcgacctgggccaccaacatccaggtagccatcaatcaggtgcgccgcctgatcggcaatgagaattacctggactatatgacctccatgaagcgattcaagaacgagtctgatccggagggggccctctggtag

SEQ ID NO: 24276 - RNA, 9879 nt, synthetic construct
  misc_feature 1..9879: note = derived and/or modified CDS sequence (opt11) from DENV-1__FJ898376__SS-prME
  source 1..9879: mol_type = other RNA
agcgtgaccatgctgctcatgctgatgcccacagcattagccttccacttgaccacccggggcggggagccccatatgatcgtaacgaagcaggagcggggaaagagcttgttattcaagaccagcgcgggggtgaatatgtgcaccctcatcgcgatggacctgggtgagctgtgtgaggacaccatgacgtacaagtgcccccgaatcaccgaggccgaacccgacgacgtggactgctggtgcaacgctaccgacacctgggtgacgtacggtacctgcagccagaccggcgagcaccgtagggacaagcggagcgtagccctcgcgccgcacgtgggcctgggcctggagacccgcacagagacctggatgtccagcgagggcgcctggaaacagatccagcgggtcgaaacgtgggcccttcgccaccccgggttcaccgttattgccctgttcctagcgcacgtgattggcaccagtatcacccaaaaggggatcatctttatcctcctgatgctggtcacgcccagcatggcgatgcggtgcgtgggcatcggctcgcgggatttcgtggagggcctcagtggcgccacctgggtcgacgtcgtgctggagcacgggtcatgcgtcaccaccatggccaaggataaacccacgctggacatagagctcttaaaaaccgaagtgaccaatcccgccgtgctgcggaagctctgcatcgaggcgaaaatctccaataccacgaccgacagtaggtgccccacccagggtgaggccaccctgatggaggaacaggacgccaacttcgtctgtcggcgcacgttcgtggaccggggctgggggaacggctgtgggctgttcggcaaagggagcctcatcacgtgcgccaagttcaagtgcgtgacgaagctggaaggcaaaatcgtgcagtacgagaacctgaagtactccgtgatcgtgaccgtacacacgggcgaccagcaccaagtggggaacgagagcacggagcacggcacgacagccacaataacaccgcaagcgcccacctccgagatccagctcaccgactacggggccctgaccctggactgttcaccccgcacgggcctggacttcaacgagatggtcctgttgaccatgaaggagaagtcctggctcgtgcacaagcagtggttcttggacctgccattaccctggacgagcggggccagcacatcccaggagacgtggaatcggcaagacctgctggtgacgttcaagaccgctcacgcgaagaagcaggaggtcgtggtgctcgggagccaggagggcgcgatgcacaccgcactgactggggccaccgagatccagacctccggcaccactaccatcttcgcagggcacctcaagtgccgcctcaagatggacaagctgaccctgaaaggcatgagttacgtgatgtgtaccgggtcattcaagcttgagaaggaggtggcagagacgcaacacggcaccgtgctcgtccagatcaagtacgagggcaccgacgcgccctgcaagatcccctttagcacccaggacgagaagggggtgacgcagaatggccgactgatcacggccaatccgattgtgaccgacaaggagaagcccgttaacatcgaggcggaaccgcccttcggggagtcctatattgtgatcggcgccggcgaaaaggctctgaagttatcatggtttaagaaggggtcctcgataggtaagatgttcgaggccaccgcccgcggcgcccgtcgcatggccatcctaggtgacacggcgtgggacttcgggtccatcggcggcgtgttcaccagcgtcgggaagctggtgcatcagatcttcggtaccgcctacggggtcctgttctcaggggtcagctggaccatgaagatcgggatcggcgtactgctgacctggctcggcctgaactcccgaagcacctccctgtctatgacgtgcatcgctgtggggctcgtaacgctatacctgggggtgatggtgcaggccgactccgggtgcgtcatcaactggaagggacgggagctcaaatgtggttctggcatcttcgtgacgaacgaggtccacacatggacagagcagtacaagttccaggccgacagcccgaagcgcctgtccgcggccatcggcaaggcctgggaagagggggtctgcggcatccgttctgccacccgcctggagaacatcatgtggaagcagatctccaacgagctcaaccatatcctgctggagaacgatatgaaattcacggtggtggtcggggacgtggttggcatcctcgcccaggggaagaaaatgatacggccccagcccatggagcacaagtactcttggaagtcatggggcaaggcaaagatcatcggcgcggacgtccagaacacgacttttataatagacgggccgaacaccccggaatgtcccgacgaccagagagcctggaatatctgggaggtggaggactacggcttcgggatcttcaccacgaacatatggctgaagctgcgggactctcacacccaggtgtgcgaccaccgcctcatgtcggccgcgatcaaggacagcaaggctgtccatgcggacatgggttactggatcgagagtgagaagaacgagacctggaagctggcccgggccagcttcatcgaggttaagacctgtatctggcccaagtcccacacgttatggagcaacggcgtgctcgaatccgagatgatcatccccaagatctacggcggcccgattagccagcacaactaccgccccggatacttcacccagacagcgggcccctggcacttagggaagctggagctcgacttcgacctgtgcgaggggaccaccgtcgtggttgacgagcactgcggcaaccgggggccctccctgcgaaccaccaccgtcacgggcaagatcatacacgagtggtgctgtcggagctgcacgctaccaccccttcgcttcaagggggaggacggctgctggtacgggatggagattcggcctgtgaaggagaaggaagagaacctggtgaagagtatggtctcagccggcagcggcgaagtggactccttcagccttgggctcttatgcatctccataatgatagaagaagtgatgcgcagccggtggtccaggaagatgttgatgaccggaactctggcagtctttctgctcctgatcatgggacaactgacgtggaatgacctcattcggttgtgcatcatggtgggcgcaaacgcaagcgaccgcatggggatgggtacaacatacctcgcgttgatggccaccttcaagatgcgccccatgttcgccgtggggctgctgttcagacggctcacgtcgcgggaggtcctgctgctcaccatcgggctgagcctggtggcctcggtcgaactccccaactcactggaggaactgggcgacggtctcgccatgggcatcatgatactgaagctgctcaccgacttccagtctcaccagctgtgggcgacgttactcagcctgacgtttatcaaaacaaccctgtccctacactatgcctggaagaccatggcgatggtactcagcatcgtcagtctgtttcccctctgcctgagcacgacgtcccagaaaactacttggctgcccgtattactgggcagccttgggtgcaagccgctcgctatgttcctaatcgcggagaacaaaatctggggccgcaaatcctggcccttgaacgaggggataatggccgtgggggtggtcagcatcctcttgagctccttactcaagaacgacgtgcccctggctggtcccctgatcgccgggggaatgctcatcgcctgctatgtaatctcggggtccagcgcagacctgtccctggagaaggcagccgaggtcagctgggaggaggaggccgagcactccggcgcctcacacaacatcctcgtggaggtgcaggacgatggtacaatgaagatcaaagatgaggagcgcgacgataccctgaccattctgcttaaggctaccttgctggccgtctccggcgtgtacccgctcagcatccccgccaccctgttcgtgtggtacttctggcagaagaaaaagcagagatccggggtcctgtgggacacgcccagccctcccgaggttgaacgcgccgtgcttgatgacggtatatacaggataatgcagcggggcctcctggggcgctcccaggtcggagtgggtgtgttccaggagaacgtcttccacaccatgtggcacgtgacccggggcgccgtgctgatgtaccaggggaagcgcctcgagccctcctgggcgtccgtcaagaaggacctgatctcttacggcggtgggtggcgcctgcagggctcctggaacaccggcgaggaggtgcaggtaatcgccgtcgagcccggcaagaaccccaagaacgtgcaaacggcacccgggaccttcaagacccccgagggcgaggtcggcgccatcgccctcgatttcaaacccgggacaagcggcagccccatcgtcaaccgcgaggggaagatagtcggcctgtacggcaacggggtagtaacgacgagcggcacctatgtgtcggcgatcgctcaggctaaggcctctcaggaggggccgttgcccgaaattgaggacgaggtgttccggaagagaaacttgaccatcatggacctacatcccggcagcggcaagacgcggcgctacctgccggcgattgtccgggaggccatcaagcgcaagctccggacactgattctggctccgacccgcgtggtggcctccgaaatggccgaggcgctcaagggcatgcccatccgctaccagaccacggccgtcaagtcggagcacaccggcaaggagatcgtggacctgatgtgccacgccaccttcaccatgcggctactatcccccgtcagagtcccgaactacaacatgatcatcatggacgaggcccactttacggaccccagctccatcgccgcgcgggggtacataagcacgagagtgggcatgggagaggctgccgccattttcatgacggcaactccgcccggctccgtggaggcattcccgcagagcaatgccgtcatccaggacgaggagcgggatatccccgagcgctcctggaacagcgggtacgagtggatcacggacttccccggcaagaccgtgtggttcgtgccgtccattaagagcggaaacgatatcgctaactgcctgcggaagaatggaaagcgcgttatccagctgtcacgtaagaccttcgacaccgagtaccagaagacgaagaataacgactgggactacgtggttaccacggacatcagcgagatgggcgccaacttccgcgcggaccgggtcatcgatccgcgccggtgcttgaagcccgtaatcctgaaggacgggcccgagcgcgtgatcctagccggtcctatgccggtgaccgtggcctccgccgcgcagcgtcgcgggagaatcggcagaaaccacaacaaggagggcgaccagtacatctatatggggcagcccctcaacaacgacgaggaccacgctcattggactgaagccaagatgctgctggacaacatcaatactcccgagggcatcatccccgccctcttcgagccggagcgggagaagtccgccgctatcgatggggagtacagactgagaggcgaggcgcggaagaccttcgtcgagctgatgcgccgcggagacctccccgtgtggctctcctacaaggtagccagcgagggcttccagtacagcgataggcggtggtgcttcgatggcgaacgcaacaatcaggtcctggaggagaatatggacgtagagatctggaccaaggaaggggaacgcaagaagctccgcccccggtggctggacgcccgtacgtactccgaccccctggccctccgggagttcaaggagtttgccgccggccgacggagcgtgtccggggacctgatcttggagatcggcaagcttccgcagcacctgacccagcgcgcccagaacgccctggacaacctcgtcatgctgcacaacagcgaacagggcgggcgggcctaccgccatgcgatggaggagctgcccgacaccatcgagaccctcatgctgctggccctcatagccgtgctgacgggcggggtgaccctgtttttcctctccggccgggggttaggcaagacgagcatcggcctgctctgcgtcatggcctccagcgtgctgctgtggatggcctccgttgagccccactggatagcggccagcatcatcctcgaattcttcctgatggtactgctgattcccgagcctgaccgccagcggacgccccaggacaaccagctggcatacgtggtgatcggcctcctcttcatgatcctgaccgtcgccgccaacgagatgggactgctcgagaccaccaagaaggaccttgggatcggccacgtggcggtggagaaccaccaccacgccaccatgctggatgtcgaccttcaccccgcctccgcctggacactgtacgccgtggcgacgaccatcatcaccccgatgatgagacacaccatcgaaaacacgacggccaacatctcactgacagccattgccaaccaggccgcgatcctcatgggcctggacaagggatggcccatctccaagatggacataggcgtgcccctgctcgccctgggttgctacagccaggtcaaccccctaaccctcacggctgcggtcctgatgctggtggcgcactacgccatcataggcccaggactccaggccaaggcaacccgggaggcccagaaacgtaccgcagccggcatcatgaagaaccccaccgtagacgggatcgtggccattgacctggaccccgtggtctacgacgccaaattcgaaaagcagctgggacagatcatgctcttgatcttatgcacgtctcagatcctcctgatgcgcaccacctgggccctttgcgagtcaatcaccctcgctacgggccccctgactaccctgtgggaagggtccccgggcaagttctggaacaccacgatcgccgtgagcatggcaaacattttccgggggtcctaccttgcaggcgccggactggcattcagccttatgaagtccctcggcggcgggcgccggggcacaggggcccagggcgaaacgttaggcgagaagtggaagcgccagctaaaccagctctccaagagcgagttcaacatctacaagcgttccgggatcatggaggtggaccgcagcgaggccaaggagggtctgaaacgcggggagaccacgagacatgccgtcagcaggggcacggcgaagctgcgctggttcgtcgaacggaacctggtgaagcccgaggggaaggtaatcgaccttgggtgcggcagggggggatggagttactactgcgccgggctgaagaaggtgaccgaggtgaaagggtacaccaagggcgggccaggccacgaggagcccatcccaatggctacttacgggtggaacctggtcaagctccactccggtaaggacgtcttctttacgcccccggaaaagtgcgacactctgctgtgcgatatcggggagagctcccccaacccgaccatcgaggagggccggacgctccgcgtgctgaagatggtggagccctggcttcggggaaaccagttttgcatcaagatcctcaacccgtacatgccttcagtggtcgagaccctcgaacagatgcagcgcaagcacggcggaatgcttgttcgaaacccgctctcccgcaacagcacccacgagatgtactgggtatcctgcgggacaggcaacatcgtaagcgccgtcaatatgacctcccggatgctgcttaaccgcttcacgatggcccatcgcaaacccacctatgagcgggacgtggacctcggggccggcacccgccacgtggccgtggagcccgaggtcgccaatctggacatcatcggccaacggatcgagaatatcaagcacgagcacaaaagcacctggcactatgatgaggacaacccctataaaacgtgggcctaccacgggtcctatgaggtcaagcccagcggttccgcctccagcatggtgaacggtgtcgttaaactacttaccaagccgtgggacgtaatccccatggtgacccagattgcgatgactgacacgacaccctttggacagcagcgcgtcttcaaggagaaggtggatacccggaccccaaaggccaagagagggaccgcacagatcatggaggtgaccgcccggtggctgtggggcttcctgtcccgcaacaagaaaccacggatctgcactagggaggagttcacccggaaggtccgcagcaacgccgctatcggagccgtgttcgtggacgagaaccagtggaactccgccaaggaggccgtcgaggacgagcggttctgggacctcgtgcagaaggaacgcgagcttcacaagcaggggaagtgcgcaacgtgcgtgtacaacatgatgggcaagcgagagaagaaactgggtgaattcggcaaggccaaggggagccgcgccatctggtacatgtggctcggcgcccggtttctggagttcgaggcccttggcttcatgaacgaggaccactggttctcccgcgagaacagcctttccggggtagagggggaggggttacacaaattgggatacatcttacgggacatcagcaagatacccgggggcaacatgtacgccgacgataccgccggctgggatacccgaatcaccgaggacgacctgcagaacgaagccaaaatcacggacatcatggaaccggagcacgccctgctcgccacctccatcttcaagctgacctaccaaaacaaggtggtgcgggtccagcgcccggcgaagaacgggaccgtgatggacgtgatcagccgccgggaccagcgcggctccgggcaggtcggcacctacggcctcaacaccttcacgaacatggaagcccagctcattcggcaaatggagagcgaggggatcttcctgccatccgagctggagacccaaaacctcgccgagcgagtgctggactggctggagaagtacggtgttgagagattgaagcgcatggcgatcagcggtgacgactgcgtcgtgaaaccaatagatgataggttcgcgacggctctgaccgccttaaatgatatgggcaaggtgcgcaaagacatcccgcagtgggagcccagcaaaggctggaacgactggcagcaggtccctttctgcagtcaccacttccaccaactcatcatgaaagatggccgggagatcgtggtaccctgcaggaaccaggacgagctggtcggccgggcccgcgtttctcagggggccggctggagcctgcgggagacggcctgcctcggcaagagctacgcgcagatgtggcaactgatgtacttccatcgccgggacctacgcctcgccgccaacgccaattgcagtgcggtaccggtcgactgggtgcccaccagccggacgacctggtccatccacgcgcaccaccaatggatgacgaccgaggacatgctgagcgtgtggaaccgcgtctggatcgaggagaacccctggatggaggacaagacgcatgtgagcagctggggcgacgtcccctacctgggcaagcgggaggaccagtggtgcggctccctaatcggcctgaccgccagagccacctgggccagcaacattcaggtagcgatcaaccaagtgcgcaggcttattgggaacgagaactacttggactacatgacttccatgaagcgcttcaagaacgagggcgacccggagggggcactgtggtga

SEQ ID NO: 24277 - RNA, 9879 nt, synthetic construct
  misc_feature 1..9879: note = derived and/or modified CDS sequence (opt11) from DENV-1__FJ898379__SS-prME
  source 1..9879: mol_type = other RNA
agcgtgacgatgttgctaatgctgatgcccaccgccctcgcgttccacctcaccacccgcggcggggaaccccacatgatcgtgagcaaacaagaacgtgggaagagtctcttgtttaaaacgagcgcgggcgtgaacatgtgcacactcatcgccatggacttgggcgagttatgcgaggacactatgacctataagtgcccgcgtatcaccgaaaccgaacccgacgatgtggattgttggtgcaacgctacggatacgtgggtaacctacgggacctgctcgcagacgggcgagcatcggcgggacaagaggtccgtagcgctcgcaccccatgtaggcttaggcctggagacacgcacagagacctggatgagcagtgagggcgcgtggaagcagatccaacgagtagagacatgggccctccgccaccccgggttcaccgtgatcgccttgttcctggcccacgtgatcggcaccagcatcacccagaaggggatcatcttcattctgttaatgttagtaacgccctcaatggcgatgcggtgcgtgggtattgggagtcgagactttgtggaaggcttgtcaggcgccacctgggtcgacgtcgtgctggagcatgggagctgcgtaactactatggcaaaggacaagcccaccctggacatcgagctcctgaaaaccgaggtgacgaaccccgctgtcttacggaagctgtgcatcgaggctaaaatatcgaacacgactaccgactcacgctgcccgacccaaggtgaggctaccctggtagaggaacaagatgcaaactttgtgtgccggcgcacgttcgtcgaccgtggttggggaaatgggtgcgggctgttcgggaaaggatcactcatcacgtgcgctaagttcaaatgtgtcactaagctggagggtaagattgtgcagtacgaaaacctgaagtacagcgtcatagttaccgtgcacacgggcgaccagcaccaggtcgggaatgagtccaccgagcacggcacgacagccacaataacgcctcaggcccccaccaccgagattcaactgactgactacggggcgttaacgctggattgctcgccccgtacggggctcgacttcaacgaaatggtgctccttaccatgaaagagaagtcctggctcgtgcacaaacagtggttcttggatttacctctcccttggaccagcggggcttcgacgtcccaggagacctggaatagacaggatctgctggtgacctttaagacagcccatgcaaagaagcaggaagtggtggtcctcggcagccaggagggcgccatgcacacggcactgaccggggccaccgagatccaaacttccggcacgacaacaatttttgccggccacctaaagtgcaggctaaagatggacaaactaaccctcaagggcatgtcttacgtcatgtgcacgggctcgtttaagctcgaaaaagaggtagccgagacgcaacacggcaccgttctggttcagatcaagtatgagggaactgacgccccatgcaagattcccttttccacccaggacgaaaagggcgttacgcagaacggccggctgatcaccgcgaacccaattgtcaccgacaaggaaaaacccgtaaatatcgaggcagagccgccattcggcgagtcctacatcatcatcggtgccggtgagaaggccctgaaactaagctggttcaagaagggtagctcgatcggcaagatgtttgaggctacagcaaggggcgctcgacgaatggctatcctgggagacaccgcctgggatttcggctcaattggcggcgtgttcacaagcgtagggaaactggttcaccaaatcttcggcacggcgtatggggtcctgttttccggcgtaagctggactatgaaaatagggattggtgtgctgctgacatggctcgggctgaactccaggtcgacctccctgagcatgacctgtatcgccgtgggactcgtcacgttatacctgggggtaatggtgcaggctgattctgggtgcgttatcaattggaaaggccgggaattaaaatgcggtagcggaatcttcgtaacaaacgaggtgcacacctggaccgagcagtacaaatttcaggccgacagccctaaacgcctgtccgccgctatcggcaaggcatgggaggagggagtctgtgggattcggagcgctacccgcctcgaaaacatcatgtggaaacagatctccaacgagctcaatcatattctgcttgagaacgacatgaaattcaccgtggtggtcggggacgtagctggcatcctcgcccagggcaaaaagatgatcaggccccaaccgatggagtacaagtactcttggaagtcctggggaaaagcaaagatcatcggcgccgatgtccagaacaccacgttcataatagacggacccaataccccggagtgtccagacgaccaaagggcctggaacatatgggaggtcgaagactacggcttcgggatcttcacgacaaacatctggctgaaactgcgggactcctacacccaggtgtgcgaccaccgcctcatgagtgccgcaataaaggatagcaaggcagtacacgccgacatgggctattggattgagtccgagaagaatgagacttggaagctggctcgagccagcttcattgaagtcaagacttgcatatggcctaagtcgcacaccctgtggtccaacggcgtgctggaatctgagatgattatccctaagatctatggtggtccgatctcgcagcacaattaccgccccgggtacttcacccagaccgccgggccctggcatctgggcaaactagaacttgatttcgacctctgcgagggaacgacggtggtcgtagatgagcattgcggtaacagagggccgtcgttgcgcaccacaacggttacaggaaagatcatacacgaatggtgctgtcggtcttgtaccttacctcccctcaggttcagaggcgaagatggctgctggtacggaatggagatccgccccgtcaaggagaaggaagagaacctggtaaagtccatggtcagcgccggctcaggagaggtcgattccttcagcctcggcttactgtgtatatcaatcatgatagaggaggtgatgcgcagtcgctggtcacggaagatgctgatgacaggcactctggccgtattctttttgctcatcatgggccagctaacgtggaacgatctgatccgtctctgcattatggttggcgccaacgccagcgataggatggggatggggaccacttaccttgcgctgatggccacgttcaaaatgcggccgatgttcgccgtgggcctcctgttccgccgcctgacctcccgtgaggtgctcctactaaccattgggctgagcttagtcgcgtcggtggagctccctaacagcttggaggaactgggtgacgggctcgcaatgggcattatgatacttaaattgctgacagacttccaatcccatcagctttgggccacgctgttgagcctcacgtttatcaagaccaccttctcgctgcactatgcttggaaaacgatggccatggtcctgagcatcgtgtccctcttccccctgtgcctgagcacgaccagccagaagaccacgtggcttccagtattactaggatcactcgggtgcaaaccgctgaccatgtttctgatagctgaaaataaaatctggggccgtaggagttggccgctcaacgagggtattatggcggtaggcatagtgagcatcctcttaagctccctcttgaagaacgacgtgccactcgcggggcctctaatcgcgggcggaatgctgattgcctgttatgtgatttcaggctccagcgccgacctgtcactcgagaaggcggccgaggtgagctgggaggaagaggccgagcattcaggtgcatcacataacatccttgtcgaggttcaggacgatgggaccatgaaaatcaaagacgaggaaagagacgacaccctgacaatactcctgaaagctacgctactggcggtctcaggcgtatatccactgagcatccccgcgacactattcgtctggtacttttggcagaagaaaaagcagcgctcaggtgtgctctgggataccccttctccgcccgaggtcgaaagggccgtgcttgatgacggcatctacagaattatgcagcgaggcctactggggcgctcccaggtgggggtgggggtcttccaggagaacgtattccacacgatgtggcatgttactaggggagccgtactaatgtatcaggggaagcgattggaaccgtcttgggcgtccgtcaaaaaggacctgatcagctacggtggcgggtggagactccagggctcctggaacaccggggaggaggtgcaggtcatcgcggtggagcccggaaagaaccccaaaaacgttcagaccgccccgggtacctttaaaacgcccgagggcgaagtcggcgccatcgctctagacttcaagccagggaccagcggatccccgatcgttaaccgggaggggaaaatagttggcctttacggaaatggcgtcgtcactaccagtggcacgtacgtgagcgccattgcgcaggccaaggcctcacaggaagggccgctcccggaaatagaggatgaagttttccggaagcgcaatttaaccatcatggacttacaccccggcagcgggaagacgcggcggtacctccccgccatagtacgagaagcgatcaagcgaaaactcagaaccttgatactcgcacccacacgagtggtcgcttcagaaatggccgaagcgttaaaaggcatgcccatcagataccagactaccgccgtcaagagtgagcacacgggcaaagaaatcgttgatctcatgtgtcacgccacgttcaccatgaggctcctgtcacctgtccgcgtaccgaattacaacatgataatcatggatgaagcccacttcacagaccccagttccatcgccgcccgggggtatatcagtacacgagtggggatgggtgaagcggccgcaatcttcatgacagcgacgcccccgggctctgtagaagcctttcctcagtcaaacgcggtaatccaagacgaggagcgcgatatcccagagcgatcttggaacagtggttacgagtggatcacagacttccccggcaagaccgtgtggttcgtaccctccataaagtcaggcaatgatatcgcaaactgcctgcggaaaaatgggaagcgggtaattcaactgagtagaaagacattcgataccgagtaccagaagaccaagaataacgactgggactacgtagtcacaactgacataagcgagatgggcgccaactttagagccgaccgggtaatcgacccccggcggtgcttaaagcccgtgattctgaaggacgggcccgaacgcgtcatcctcgcgggccccatgccagttaccgtggcctccgctgctcaacggcgcggtcgcatcggccgaaaccataataaagaaggcgatcagtacatctacatggggcagccgctaaataacgatgaagatcacgcgcactggaccgaagccaagatgctacttgacaatatcaatacacctgaagggattatccccgcgttgtttgagcccgaacgcgagaagagtgccgctatcgacggtgagtaccgcctacggggcgaggcccggaaaacgttcgtggagctcatgcggcgcggggatctgcctgtgtggctatcctataaggtcgcgagcgagggcttccagtacagcgataggcggtggtgtttcgacggggagcggaacaaccaggtgttagaggagaacatggacgtcgaaatctggaccaaagagggggagagaaagaaactacgcccgcgttggctggatgcccgcacctactctgatcccctcgccctgcgggagttcaaggagttcgccgccgggcgtagaagcgtctccggagatctgatcctcgaaatcgggaagctgcctcaacacctgacgcagcgagcacaaaacgcgctcgataacctggtgatgctgcataatagcgagcagggagggcgggcgtaccgacacgcgatggaggagctccccgacactatagagaccctgatgctgctggccctgatcgccgtgttaacaggtggggtcaccctgttcttcctatcgggccggggactgggcaagacgtcgatcggcctcctatgtgtaatggcttccagcgtgcttctctggatggcctctgtcgagccccattggatcgccgcgagcatcatcctggagttcttcttgatggttctcttaatacctgagccagatcgacagagaacgcctcaggataatcagctagcctacgtagtcatcgggctcctgttcatgatcctaaccgtggcagctaacgagatgggcctcctggagactactaagaaggatctggggatcggccacgtggccgtcgagaaccatcatcacgcggccatgctcgacgtggacctgcatcccgcgtccgcctggacgttatacgctgtggcgacaaccataatcacccctatgatgcgccataccatcgagaacaccaccgccaatatcagcttgactgccatcgccaaccaggccgcgatcttgatgggtctggacaagggctggccgatctccaaaatggacatcggggttcccctcctggcactgggctgctactctcaggtgaaccccttgacgctgaccgccgcggtgctgatgctcgtagcgcactacgccataatagggcctgggctgcaggccaaggcgacccgcgaagcccagaagcggacagcggcaggcattatgaaaaatccgacagtggacgggatcgtggcaatcgacctcgaccctgtcgtgtacgacgccaagttcgagaagcagctcggccaaataatgctgctaatactgtgtacgtcccagatcctgttaatgcgcactacatgggccttgtgcgaaagcatcacgctggccacaggcccccttaccacattgtgggaaggctctcccggaaaattctggaacacgaccatcgccgtgagcatggccaacatattccgtgggtcctacctggccggcgccggcctagcgttcagccttatgaagtcactcggaggcggtcgaagaggaaccggagcccaaggagaaaccttaggcgagaagtggaaacgccaactcaaccaactcagcaagtcggagtttaacacgtacaaacgctccgggatcatggaagttgaccgaagcgaggccaaggagggcctaaagcgcggggagactacaaagcatgctgtgtcccgaggcacggcgaagttgcggtggtttgttgagcgaaatctggttaaacccgagggtaaggtcatagacctgggatgcggccgtggcggctggtcatactactgcgccgggttgaagaaagtaaccgaggtcaagggttacaccaaaggtggccccgggcatgaggagcccataccgatggcaacatatggctggaacctcgtaaaactacactcgggcaaggacgtcttcttcataccgccggagaaatgtgacaccctgctctgcgacatcggggagagcagtccaaatcctacaatcgaggaaggacgcaccttgcgggtgctcaagatggtcgaaccctggctcagaggtaaccagttttgcatcaagatcctaaacccttacatgccttcggtggtggagaccctggagcagatgcagcggaagcacggcggcatgctcgtccgcaacccgctgtcccgaaacagcacccacgagatgtactgggtcagttgcggtacgggtaacatcgtcagcgccgtaaacatgacgtcgcgcatgctgctgaacaggtttacgatggcccatcgaaagccaacgtacgagcgcgatgtggacttgggggcgggaacccggcacgttgcggtggaacccgaggtggccaacctggacatcatagggcaacggatcgagaacattaagcacgaacacaagagcacgtggcactacgacgaggataacccgtacaagacgtgggcctaccacggctcctacgaagtcaaaccgtctggctccgccagcagtatggtgaacggagtcgtaaagctcttaaccaagccgtgggacgtgatcccgatggtaacgcaaatcgcgatgacggatacgaccccgttcggccaacagcgcgtgttcaaggaaaaggtggataccagaacgccgaaagccaagcgggggacggcgcaaattatggaagtgaccgctaaatggttgtggggcttcctctccagaaacaaaaagccccgaatatgcacgcgcgaagaatttacgcggaaggtacgcagcaatgccgcgattggcgcggtgttcgttgatgaaaaccagtggaatagcgccaaggaagctgtggaagacgagagattctgggacttagtgcaccgcgaaagggagttacataagcagggtaaatgcgcgacttgcgtgtacaatatgatggggaagcgcgaaaagaaattaggtgaatttggtaaagcaaaagggtctagagcaatttggtacatgtggctgggcgcccgcttcctcgagttcgaggctcttgggttcatgaatgaggaccactggttctccagagaaaacagcttgagcggtgtagaaggtgaggggctccataagctcggctacatattgcgcgacatctccaagatccccgggggcaacatgtatgcggacgacaccgccggttgggacaccaggatcacggaggacgatctgcagaacgaggcccgaattacagatattatggagccggaacacgcccttctggctaagtccatattcaagctgacatatcagaataaggtggtccgcgtgcagaggcctgcgaagaacggaaccgtgatggacgtcataagccgccgggaccagcgcggctccggtcaagtcggaacatatggcttaaataccttcaccaacatggaggcgcagctgattcgtcagatggaaagcgaaggcatattctcgccaagcgaactggagacccccaacctggccgagcgcgtgctcgattggctggagaagtatggcgtggaacgattgaagcgcatggccatttctggagacgattgcgtcgtgaaaccgatcgacgatcggttcgccacggccctaacagcactgaatgacatgggaaaggtccgcaaggacatcccccagtgggagcctagcaaaggttggaatgactggcagcaggtacccttctgcagccatcacttccaccagcttattatgaaagatggtcgggaaattgtggtaccctgtcgtaatcaggacgagctggtaggacgggcccgcgttagccagggggccggctggagcctgcgggagaccgcttgcctcgggaaatcctacgcgcagatgtggcagctgatgtacttccaccgacgtgatctacgattagccgccaatgcaatttgcagtgcggtcccggtggactggataccgacttcccggacaacctggagcatccacgcccatcaccaatggatgactaccgaggacatgctgagtgtgtggaaccgcgtctggatcgaggagaatccatggatggaagacaagacccatatcagctcatggggcgatgtgccgtacttgggtaagagagaggaccaatggtgcgggtcgctcatcggccttaccgctcgggcgacatgggctacgaacatacaggtagcgatcaaccaggtccgccgtctcatcgggaacgagaactacctggactatatgactagcatgaaacgcttcaaaaatgagtctgaccccgagggcgcactttggtaa

SEQ ID NO: 24278 - RNA, 9879 nt, synthetic construct
  misc_feature 1..9879: note = derived and/or modified CDS sequence (opt11) from DENV-1__GQ199773__SS-prME
  source 1..9879: mol_type = other RNA
tcagttaccatgctcctgatgctgatgcccaccgccctggccttccacttgaccactcggggcggggagccccacatgattgtgagcaagcaggagcggggcaagagcctgctgttcaagaccagcgccggcgtgaacatgtgcaccctcatcgccatggacctgggcgaattctgcgaagacacgatgacctacaagtgcccccgcattaccgaggccgagcccgacgacgtggactgctggtgcaacgccaccgacacctgggtgacatacggaacctgcagccagaccggcgagcacagacgcgacaaacggtctgtggccctggcgccccacgtgggcctcgggctcgagacgagaaccgagacctggatgagctccgagggtgcctggaagcagatccagcgggtggagacttgggccctgcgccaccctgggttcacggtgatcgctttgttccttgcgcacgccatcggcaccagcatcacccaaaaaggaatcatcttcattctgctcatgctggtgacgccctccatggccatgcgttgcgtcgggatcggcagcagagacttcgtggaggggcttagcggcgccacgtgggtggacgtcgtgctcgagcacggtagctgcgtgacaaccatggccaaggacaagcccaccctggacatcgaacttctcaagactgaggtcaccaaccccgcggtgctgcggaaactgtgcatcgaggccaagatcagtaacaccacaaccgactcaagatgcccgacccaaggagaagccaccctcgtggaagaacaggatgccaacttcgtatgccggcgcacctttgtggaccggggctgggggaacggctgcgggctgttcggcaagggttccctcatcacgtgtgccaaattcaaatgtgtgacgaagctcgagggcaagaccgtacagtacgagaacctgaagtacagtgtgactgtgacggtccataccggcgaccagcatcaggtcgggaacgagtccaccgagcacgggaccaccgcgacgatcacgccccaggccccgagcaccgaaatccagctgaccgattatggggccctcacgctggactgctcgccccggaccggactggattttaacgaaatggtcctcctgaccatgaaggagaagtcctggcttgtgcataaacagtggtttctcgacctgccgctaccctggacaagcggcgcctccacgagccaggagacctggaaccggaaagacctactggttacctttaagacagcccacgcgaagaagcaggaggtcgtggtcctgggatcccaggagggcgccatgcatacggcactcaccggggcaaccgagatccagaccagcggaacgaccacgatctttgccgggcacctgaagtgccgcttgaagatggataagctcaccctgaaggggatgtcctacgtcatgtgtacggggagttttaagctggaaaaggaggtggcagagacccagcacggaaccgtgctcgtccagattaagtacgagggcacagacgccccctgcaagatccccttctccacgcaggacgaaaagggagtgacacagaacggccggctgatcaccgccaacccgatagtcaccgacaaggagaagcccgtcaacatagaggccgagccgcctttcggggagagctacatcgtgattggcgcgggcgagaaggcccttaaattaagctggttcaagaagggaagcagtatcggcaagatgttcgaggccacggcccgcggggcccggcgcatggcgatcctcggcgacaccgcctgggacttcgggtcgatcggcggcgtgttcaccagcgtcgggaagctggtgcatcagatcttcggcaccgcctacggggtactgttcagcggagtgtcgtggacgatgaagatcgggatcggcgtcctcctgacctggctcggcctcaacagcagatccaccagcctgtccatgacctgcatcgccgtggggctggtcacgctctacttaggcgtgatggtgcaggccgactcggggtgcgtcataaactggaaaggccgcgagctgaagtgcgggagcggcatcttcgtgaccaatgaagtgcacacctggaccgagcagtacaagttccaggcggattccccgaagcgcctcagcgccgctatcggcaaggcctgggaagagggggtatgtggcatacggtcggccaccagactcgagaacattatgtggaagcagatcagcaacgagctgaaccacatcctcctggaaaacgacatgaagttcacggtcgtggtcggggacgtggcgggcatcctggcccaagggaagaagatgatccggccccaacctatggagtacaaatactcctggaagtcctggggcaaggccaagatcatcggcgccgacgtgcagaacaccacgttcatcattgacgggcccaacaccccggagtgcccagacgaccagcgggcgtggaacatctgggaggtcgaggactacggctttggtattttcacaaccaatatctggctcaagctgcgggattcctacacccaagtgtgcgaccatcgcctgatgagcgccgcaatcaaggactcgaaggctgtgcatgccgacatgggctactggatcgagtcagagaaaaacgagacttggaaattagcgcgggcctccttcatcgaggtcaagacttgcatctggcccaagagccacacattatggagcaacggcgtgctggagtccgagatgatcatccccaagatctatggcggccctatatcccagcacaactaccgccccgggtatttcacccagaccgccggcccctggcacctcggtaagctggagctcgacttcgacctctgtgagggcaccaccgtggtcgtggacgagcactgtggcaaccgggggccaagcctacgaacaaccacggtgactggcaaaatcatccatgagtggtgttgccggtcatgcaccctgccgccgctgcgcttcaaaggggaggacggttgctggtacgggatggagatccggcccgtcaaggagaaggaggaaaacttggtcaagagcatggtctcggccgggtcaggcgaggtcgacagcttctccctggggctgttatgcatcagcatcatgatagaggaggtgatgaggtcccggtggagccgcaaaatgctgatgacaggcacgctcgccgtgttctttctgctcatcatggggcagttaacctggaacgacttaattcggctgtgcatcatggtcggcgcgaacgcgtctgaccgcatggggatgggcaccacctatctcgcactgatggcaacattcaagatgcgcccgatgtttgccgtggggctcctgtttcggcggctgaccagccgggaggtcctgctcctgaccatcgggttatcgctcgtcgcgagcgtggagctgcccaacagcttagaggagctcggggacgggttagccatgggcatcatgatcctgaagttgcttacagacttccagagccaccagctgtgggccacgctcctgtccctgacgtttatcaagaccacattcagcctccactacgcctggaagaccatggcgatggtattgtccatcgtgagcctgttccccttgtgtctgtcgactacgtcacagaagacaacgtggctgcccgtgctgctgggctccctgggttgcaagccgctgaccatgttcctgatcgccgagaacaagatctggggccgcaagtcttggcccctgaacgaggggatcatggccgtcggcatcgtatcgatcctcctgtccagcctgctcaagaacgacgtgcccctggccgggcccctgatagccggcggcatgcttatcgcgtgctacgtcatctcggggagctccgccgacctgagcttagagaaggccgccgaggtgtcctgggaagaggaggccgagcacagcggcgcgtcccataacatcctggtggaggtgcaggacgacggcaccatgaagataaaggatgaggagcgggacgacaccctgaccatcctgctcaaggccacgctgttagccgtgagcggcgtgtacccgctctccataccagccaccttattcgtctggtacttctggcagaagaagaagcagcgcagcggtgtgttgtgggatacccccagcccacctgaggtggagcgggccgtcttagatgacgggatctaccgcatcatgcagcgcggcctgctggggaggagccaggtgggcgttggggtcttccaagaaaacgtgtttcacaccatgtggcacgtcacgcggggcgctgtactgatgtaccaggggaagaggttagagccctcctgggctagcgttaagaaggatctgatctcgtacggcggcgggtggcgcctacaagggagctggaacaccggtgaggaggtgcaggtcattgccgtggagcccggcaagaaccccaagaacgtgcagaccgcccccgggacgttcaagacgagtgagggcgaagtcggcgcgatcgcgctcgacttcaagcccgggaccagcggcagccccatcgtgaatcgcgaggggaaaatcgtgggcctatacggcaacggggtcgtgaccacctccggcacgtacgtgagcgccatcgcccaggccaaggcgagccaggaggggcccctgccggagatcgaggacgaggtcttccggaagcgtaacctcaccatcatggatctgcaccccgggagcgggaagacccggcgctacttgcccgccatcgtgcgggaagccatcaaacgcaaactccggaccctgatcctggctccgacccgcgtggttgcctccgagatggcggaagccctcaaaggcatgcccatccgctaccagaccaccgcggtcaaaagcgagcacaccggaaaggagatcgtagacctgatgtgtcacgccacgttcaccatgcggctgctcagccccgttcgagtgcccaactacaacatgatcattatggacgaggcccatttcaccgacccgtcatccatcgcggcccgtgggtatatttccaccagggtgggcatgggtgaggccgccgccattttcatgacggcgacgccgcccggttccgtcgaggccttccctcagagcaatgccgtgatccaggatgaggagcgggacatcccggaacgctcatggaacagcgggtacgagtggatcaccgactttcccggcaagactgtgtggttcgtcccctccatcaagagcggtaacgacatcgcgaactgcctgcggaagaatgggaagcgcgtgatccagctgtcacggaaaacattcgacaccgagtaccagaagaccaagaacaacgactgggactacgtggtcaccacggacatcagcgagatgggtgcgaacttccgcgccgaccgggtcatcgacccccgccggtgcctcaagccggtaatcctgaaggatgggcccgaaagagtcatcctggccggccccatgcccgtgaccgtcgcctccgccgcgcagcggcgcgggcgtattggccgaaaccacaacaaagagggggaccagtacatttacatggggcagccgttgaataacgacgaggaccacgctcactggaccgaagccaagatgctgctcgacaacatcaacacccccgagggcatcatccccgccttattcgagcccgagcgggagaagtccgccgcgatagacggggaataccgcctgcgcggcgaggcccggaagacgttcgtagagctgatgcgccgcggggacttgccggtgtggctgagctacaaggttgcttcagaaggcttccagtactctgaccgcaggtggtgtttcgacggcgagcgcaacaaccaggtgctggaggagaacatggacgtggagatctggaccaaggagggggagcggaaaaagctacgcccccgatggctggacgcacgcacgtactccgacccgctggcactcagagagttcaaggagttcgcagccggccgccggagcgtctccggcgacctcatcctcgagatcggcaagctcccccagcatctgacccagcgcgcccaaaacgccctggacaacctcgtgatgctgcacaactcggagcaaggcgggcgcgcgtatcgccacgccatggaggagctgccggacacaatcgagaccctcatgcttctagccctcatagccgtgctgaccggcggggtcaccctgttctttctctccgggcgggggctgggtaagaccagtatcggccttctctgcgtaatggcctcgagcgtgctgctgtggatggcctctgtcgagccacactggatcgccgcaagcatcatcctcgagttttttctgatggtgctgctcattcccgagcctgaccgccagcggacgccgcaggacaaccagctggcctacgtggttatcggcctccttttcatgatcctgactgtggccgcaaacgagatgggcctgctcgagaccaccaagaaggacctgggaatcggccacgtcgccgtcgagaaccaccaccacgccgcgatgctcgacgtggatctccaccccgcctcggcgtggacactgtacgccgtggctaccaccatcataaccccaatgatgagacacacaatcgagaacaccacggccaacatcagcttgacagccatcgcgaaccaggcagccatacttatggggctggacaagggctggccgatcagcaagatggacatcggcgtcccgttgctcgcattaggctgctactcacaagtgaatccccttacgctcacagcagcagtcctcatgctggtagcccattacgcaatcatcggccccgggctccaggccaaggcgacccgggaagcccagaagcgcaccgccgccggcatcatgaagaacccgacggtggacggtatcgtcgccattgacctggaccccgtcgtgtacgacgcaaagttcgaaaagcaactgggccagataatgttgctgatcctatgcacctcccagatcctcctgatgcgcaccacctgggccctttgcgaaagcatcacgctcgctaccggtcccttgaccaccctgtgggaggggtcccctggcaaattctggaacacgaccatcgccgtcagcatggcaaacatcttccgtgggagctacctcgcgggcgctgggctggccttctcactgatgaagtccctcgggggggggcgccggggcaccggggcacaaggcgagaccctgggcgagaagtggaagcgccagctgaaccagctctccaagagcgagttcaatacgtacaagcggtccggcatcatggaggtagaccgcagcgaggcgaaggagggactgaagcgcggcgagacgaccaagcacgctgtgtcccgcggcaccgccaagctacgctggttcgtggagaggaacctagtcaaaccggaggggaaagtaatcgatctgggctgcgggcgcggcgggtggagctactattgcgccgggctgaagaaggtgacggaggtaaaggggtacacaaaggggggtcccggccacgaggagcctatcccaatggccacctacgggtggaaccttgtgaagttgcactccggcaaggacgtctttttcatcccgcccgagaagtgcgataccctgctctgcgacatcggtgagtcctcccccaaccccacgatcgaggagggtcgcaccctccgggtcttaaaaatggtcgagccgtggctgcgcgggaaccaattttgtatcaagatcctcaacccctacatgcccagcgtggtcgagaccctagagcagatgcaacgtaagcacggcggcatgctggtgcgcaaccccctcagtagaaacagcacccacgagatgtactgggtgagttgtgggacgggcaacattgtctcggcggtgaacatgacctcccgcatgctcctgaatcggttcactatggcccaccgcaagccgacctacgagcgtgacgttgacttaggagccggcacccggcacgtcgccgtggagcctgaagtggccaatctggacatcatcggtcagcgcatagagaacataaaacacgagcacaagagcacgtggcactacgacgaagacaacccctacaagacctgggcgtaccacgggtcctatgaggtcaagccctccggcagcgcttccagcatggtgaacggggtcgtgaagctgctcaccaagccgtgggacgtgattccgatggtcacacagatcgccatgacggataccacccccttcggtcagcagcgggtttttaaggagaaggtggacacccgaacgcccaaggcgaagcgggggaccgcccagatcatggaggtcaccgcgaagtggctgtggggttttctgtcccgcaacaagaagcctagaatatgcacccgagaggagttcacgcggaaggttcgcagcaacgccgcaatcggcgccgtgttcgtagacgagaaccagtggaactcagctaaagaggccgtggaggacgagcggttttggaacttagtgcatcgcgagcgggagctgcacaagcagggaaagtgtgcgacctgcgtttataacatgatgggcaagcgcgagaaaaagctgggtgagttcggcaaggccaaggggtcccgggctatctggtacatgtggctcggggcgcggttcctggagtttgaggccctgggcttcatgaacgaggaccactggttcagtagggagaactcactctccggggtggagggcgaggggcttcacaaactgggctacatactcagggatatcagcaagatccccgggggcaacatgtacgccgacgacacagccggctgggacacacggatcacggaggacgacctgcagaacgaagccaagatcaccgacatcatggagcccgagcatgcgctgctagcgaagtccatctttaagctcacataccagaacaaggtggtccgagtccagcgaccggccaagaacggcaccgtaatggatgtcataagccgccgagaccagcggggctccggccaggtgggcacttatggcctgaataccttcaccaacatggaggcccagctcatccgccaaatggagagcgaggggatcttctcccccagcgaactggagacccccaacctggccggccgggtgctcgactggctggagaagcacggcgtcgaacgcctgaagcggatggcgatctccggcgacgattgcgtggtgaagcccatcgacgaccgcttcgccactgccctcaccgccctgaacgacatgggtaaagtcaggaaagacatcccgcagtgggagcccagcaagggctggaacgactggcagcaggtcccattctgctcgcaccatttccaccagctgataatgaaagacggcagagaaatcgtggtaccctgccggaaccaggacgaactcgtcgggcgcgcccgcgtgagtcagggcgcggggtggagcctgcgtgagaccgcctgcctgggcaagtcctacgcccagatgtggcagctgatgtatttccaccggcgcgacctgcgtctggccgcgaacgccatttgcagtgccgtcccggtagattgggtgcccacctccaggacgacctggagcatccatgcacaccaccagtggatgaccaccgaagacatgctctccgtctggaaccgggtatggattgaagagaacccctggatggaggacaagacacacatcagctcctggggcgacgtcccctacctcggcaagcgcgaggatcaatggtgcggcagtctgatcgggctcaccgcccgggcgacctgggccaccaatatccaggtcgccataaaccaggtgcggcgcctgatcggcaacgagaactatctggactacatgacctccatgaagcggtttaagaacgagagcgacccagagggggccctctggtga

SEQ ID NO: 24279 - RNA, 9879 nt, synthetic construct
  misc_feature 1..9879: note = derived and/or modified CDS sequence (opt11) from DENV-1__JF937596__SS-prME
  source 1..9879: mol_type = other RNA
tccgtcacaatgctgctcatgctgatgccaaccgccctggccttccacctcacgacccggggcggggagccccatatgattgtgaccaagcaagagcgtggaaagagcctgctgttcaaaaccagcgcgggggtaaacatgtgcaccctcatcgccatggacctgggcgaactatgcgaggacactatgacctacaaatgcccccggatcaccgaggccgagcccgacgacgtggactgctggtgcaacgccacggacacatgggtgacctacggaacctgctctcagacaggcgaacatcggcgcgacaagaggagcgtggcccttgcaccgcatgttggtctggggctggagacccggacagagacctggatgtcctccgagggcgcatggaagcaaatacaacgggttgagacgtgggccctgcgccacccggggttcaccgtgatcgccctcttcctggctcacgctatcggcacctccatcacccagaagggaatcatattcattttactcatgctcgtgacacccagcatggcgatgcggtgcgtaggcataggcagccgcgacttcgtagagggtctcagcggcgccacctgggtggacgtagtactggagcatgggagttgcgtgacgacaatggcgaaggataagcccacactggacatcgagctcctcaagacagaagtcaccaacccggcggtgctacggaagctctgtatcgaggcgaagatatcaaacacaacgaccgactctcgttgtcccacccagggagaggccaccctgatggaggagcaggacgccaacttcgtgtgccgccgaacattcgtagaccgggggtgggggaatggatgcgggttgtttggcaaaggtagcctcatcacgtgtgcgaagtttaagtgcgtgaccaagctagagggcaaaattgtacaatacgaaaacttgaagtactcggtcatcgtgacggtccatacgggtgaccagcaccaggtcggaaacgagagcaccgagcacggaaccaccgcgaccatcacaccccaggccccaacctcagaaatacagttgaccgactatggcgccctgactcttgactgcagcccccgcactggattggactttaacgagatggtgctgctgactatgaaagaaaagtcctggctcgtccacaagcagtggtttctggacctgccgctcccgtggacttccggggcctccacctcccaagagacgtggaaccgtcaggatttattagtgaccttcaaaaccgcccatgcgaaaaagcaagaggtggtcgtattaggcagccaggaaggcgccatgcataccgccctgacgggggccacagagattcaaacctccggcaccacgaccatcttcgccggacatcttaagtgcagacttaagatggacaagctgaccctgaagggcatgtcctacgtgatgtgtaccgggagctttaaactagagaaagaggtagcggaaacccaacacggtaccgtgttggtccagatcaagtatgagggtaccgacgcaccttgcaagatccccttcagcactcaggacgagaagggagtcatccagaacggccgcttaatcacggcgaaccctatcgtgaccgacaaagagaaacctgtcaacatagaggccgagccacccttcggggagtcctacatcgtcatcggtgtaggagaaaaggcgctgaagctaagctggtttaagaagggtagcagcattggcaaaatgttcgaggccaccgcccggggtgcgcggcgcatggcgatcctgggcgacaccgcgtgggattttgggtcgatcggcggggtgttcactagcgtcgggaagctggtgcaccagatattcggtaccgcctacggggtcctgttttcaggcgtcagctggaccatgaagatcgggatcggcgtgctgttgacctggctcggtctgaactcaagaagcacttccttgtccatgacttgcatagcggtggggctcgtcacgctgtacctgggcgtgatggtgcaggctgactcagggtgcgttattaactggaaggggcgtgagctcaagtgcgggagcggcatattcgtgacaaatgaggtgcacacgtggacggagcagtataagttccaggccgacagcccgaagcgcctgtccgctgccatcggcaaagcctgggaggagggggtttgtggtataaggagcgcaacaaggctggagaatatcatgtggaagcagatctccaacgagctcaatcacatactacttgagaacgacatgaagttcaccgtggtggtgggagacgtggtgggtatcctcgcccaggggaagaaaatgatccggccccagccgatggagcataagtacagttggaagagctggggaaaggcgaaaatcatcggcgccgacgtacagaatactacgttcatcatcgacggaccaaacacccccgagtgcccagacgaccagcgcgcatggaatatctgggaagtggaggactacggcttcgggatcttcaccacaaatatatggttaaagctgcgagacagctatacgcaagcatgcgaccaccgtctcatgtcagcagcgatcaaggactcaaaggcagtgcacgcggatatggggtactggatcgagtctgaaaagaacgaaacctggaagctggcccgggcgtccttcatcgaggtaaagacctgtatctggccgaagtcacatacactgtggagcaacggtgtgcttgagtccgaaatggtaattcccaaaatctatgggggccctatcagtcagcacaattacaggcccgggtatttcacgcagaccgcagggccctggcatctggggaagctggagctcgacttcgacttgtgtgaaggcaccaccgtagttgtggatgaacattgtggaaaccgggggcccagcctgcggacgaccacagtcaccggcaagataattcacgaatggtgctgtcggagttgcacgttgccgcctctccgcttcaagggcgaggacggctgttggtacgggatggaaatccgacccgtgaaggaaaaggaagagaacctcgttaaatccatggttagcgcaggtagcggcgaggtggactccttctccctcggactactatgcatcagtatcatgatcgaggaggtgatgcgcagccggtggagtcgcaagatgctcatgaccggcaccctggccgtattcctgttattgatcatgggacagctgacctggaatgacctcatccggctgtgcatcatggtaggcgccaacgcatctgaccgcatggggatgggcacgacctacctggccctcatggccaccttcaagatgagacctatgttcgcggtggggctgttgtttcgacggctcacctcacgggaagtcctgctgctgacgatcgggctgagccttgtggcatccgtcgaactccccaacagcttagaggaactgggagacggcctcgcaatgggcatcatgatattaaagctgctcaccgatttccagtcccatcagttatgggcgaccctgctatctctgacctttataaagactaccttgtccttacattacgcctggaagacaatggccatggtactgagcatcgtatctcttttccccttgtgcctgtcgaccacttcccagaagacaacctggctgcccgtccttttgggatcactggggtgcaagccgctcaccatgttcctaatagcggaaaataagatctggggccgtaaatcctggcccctaaacgagggtatcatggcagtgggcgtggtctctattctcctgagcagcctgctcaagaacgacgtgcccttagcggggcccctcattgcgggaggcatgctcatcgcctgctatgtgatatcggggagctccgcggacctgtcccttgaaaaagccgccgaagtctcctgggaggaggaggctgaacacagtggcgcaagccataacattctagtggaggtgcaggatgacgggacgatgaagattaaggacgaggaacgggacgacacgttgaccatcctcctcaaagccaccttactagctgtatcaggcgtttacccgttgagcatcccagctaccctgttcgtttggtacttctggcagaagaagaagcagcgctccggtgttctgtgggacacgcccagcccgcccgaggttgagcgtgccgttctcgatgacggcatctaccgcatcatgcaacggggccttttggggcgctcacaggtgggcgtgggggtattccaagagaacgtcttccatacgatgtggcatgtgacccggggcgctgtactgatgtaccaaggcaagcgactcgagcccagctgggcatccgtcaagaaggacctgatttcctacgggggcgggtggagactgcagggatcctggaacactggggaagaggtccaagtaatcgccgtcgaacccggcaagaatcccaaaaacgtgcagacggctcccgggacctttaagacccccgagggtgaggttggtgccattgccttggacttcaagcccgggaccagtggctcccccatcgtcaaccgcgaggggaagatcgtaggtttatacggcaacggggtggtgacgaccagcggcacctacgtgtcagcgattgcccagaccaaggctagccaggaaggcccacttcccgagatcgaagacgaggtgttccggaagcgcaacctgacaattatggacctgcaccccggcagcgggaagaccaggcgctaccttccggccatagtcagagaggcgattaagaggaagctccggactctgatccttgcccccacccgcgtcgtcgccagtgaaatggcggaggctctcaagggcatgcccattcgctaccagacgactgcggtcaagagcgagcacaccggcaaggaaattgtggacctgatgtgccacgcaacgtttacaatgcgtctgctctcgcctgtacgcgtaccgaactacaacatgatcattatggatgaggcccactttactgaccccagctccatcgcagcccgcgggtacataagtacgcgcgtgggaatgggggaggcggcggccatctttatgactgccacgccgcccggctccgtggaggccttcccgcagagtaacgcggttatccaggacgaggaacgggatatccccgaacgctcttggaatagcggtcacgagtggattaccgacttccccggcaagactgtgtggttcgtcccctccatcaagagcggcaacgacattgccaattgcctgcggaaaaacggaaagcgcgtcatccagctctctaggaagaccttcgacaccgaataccaaaagaccaagaacaatgactgggactacgtggtgaccaccgacatcagcgagatgggagccaacttcagagccgaccgggtaatcgacccacgccggtgcctcaagcccgtcattctgaaggatgggccagagagagtcatcctcgcgggccccatgcccgtgacggtggcgtccgctgcacagcggcgaggccggataggccgcaatcataacaaagaaggcgaccagtacatctatatggggcagcccctcaacaacgacgaagaccatgcccactggacggaagctaagatgctgctggacaacatcaatacccctgagggaatcatccccgcccttttcgaaccggaacgggagaagtccgctgcgattgacggagagtacagactccgaggcgaagcccggaagacttttgtcgagctaatgcggcgcggcgatctcccggtttggctgtcctataaggtcgcttcagagggttttcagtactcggatcgccggtggtgctttgacggcgaacggaacaaccaggtgctggaagagaacatggacgtggagatatggaccaaagagggggagcggaagaagttacgcccccgctggctggacgcccgcacctacagtgaccccctggccctccgggaattcaaagagtttgccgctggccgacgcagcgtgagtggggacctgatcttagaaattggcaaactcccgcaacatctgacccagagagcccaaaacgcgctagacaacttagtcatgctgcataacagcgaacagggcggccgggcctacaggcatgcgatggaagagctgccggataccatcgagacacttatgctgctggcgctcattgcagtgctgaccggaggggtgaccctattcttcctttctggccgggggctcgggaagaccagcataggtttgctttgcgtcatggcatcctctgtcttgctgtggatggcttccgtggagccccattggatcgccgctagcatcattctggagttcttcttgatggttcttctcatccccgaaccggaccgccagagaacgccccaggacaaccaactagcctacgtggtaataggcctactcttcatgatcctgacggtggccgccaatgagatgggcctgttagagaccactaaaaaggacttggggatcggccatgtggcggtggagaaccaccaccacgcgacaatgctggacgtcgatcttcatcccgcttctgcctggacattgtacgccgtggccaccacgatcattacaccgatgatgcgccacaccatcgagaacaccaccgcgaatatctcactgacggccatcgccaatcaggcagcaatcttgatgggactggacaagggttggcccatctccaagatggatatcggcgtgcccctcttggcgctggggtgttacagtcaggtaaaccccttgacccttacagcggctgtgctgatgctcgtggcccattacgctatcatcgggcccgggttgcaggccaaagccacccgggaggcccaaaagcgcactgcggcgggcatcatgaaaaaccctacagtcgacggcattgttgccatcgacctggatcccgtggtctacgacgccaaattcgaaaagcagctgggccagataatgctccttattctgtgcacctcccaaatcctcctaatgcgaaccacctgggcgctatgcgagagcatcacgctcgccaccggccccctgaccacactatgggagggttccccgggcaagttttggaacacgaccatcgcggtgtcaatggccaacatcttccggggttcctatctcgccggagccgggttagccttcagtctcatgaagtccctcgggggagggcggcggggtaccggcgcacagggcgagacgctgggtgaaaaatggaagcgtcagctgaaccagctctccaaatctgagttcaacatctacaaaaggtccggcattatggaagttgatcgcagcgaagccaaggagggcctgaagcgcggggagacgacccgccacgctgtctcccgaggcaccgctaagttacggtggttcgtggagcggaaccttgtgaagccggagggcaaggtgatcgatctcggttgtgggcgcggtggctggagctattattgcgctggactgaaaaaggtaacagaggtgaagggctacacgaagggcgggcccgggcacgaagagccaatacccatggccacctacgggtggaacctggtgaagctccattccggcaaggacgttttcttcgcaccgcccgaaaagtgcgacaccctgttgtgtgatatcggggagtcatcaccaaacccgaccatcgaggagggccggacactcagagtcctgaagatggtcgagccctggctgagggggaatcagttttgcatcaagatccttaacccctatatgcctagcgtggtggaaaccctggagcagatgcaacgcaaacatggcggaatgctggtcaggaacccgctctcgcgtaacagcacccacgaaatgtactgggtcagctgcgggacaggcaacatcgtgagcgccgtaaacatgacctcccggatgttgctaaaccgcttcactatggctcatcgcaagcccacatacgagcgcgacgtggatttgggggccgggacccgtcatgttgcggtcgagccggaggtggccaatttggacattataggccagagaatcgagaacataaagcatgagcacaagtcgacatggcactacgacgaggacaacccttataaaacatgggcatatcacgggtcctacgaggtcaagccgtcaggcagcgctagcagcatggtgaacggggtggtcaagttgctcacgaagccttgggatgtgatccccatggtaacccagattgcgatgactgacaccactccattcggacagcagagagtcttcaaggagaaagtggacacccgtacaccgaaggccaagcgcgggacggcccagatcatggaagtgacagcccggtggctgtggggcttcctgtccagaaacaagaagcccagaatttgtacgcgcgaagagtttactaggaaagtccgctcaaacgctgcgatcggcgccgtgttcgtggatgaaaaccagtggaacagtgcaaaggaggccgtggaggacgagcggttctgggacctcgtgcagaaggagcgggagctgcacaagcaggggaagtgtgctacgtgcgtgtacaacatgatgggcaagcgcgaaaagaagctaggggagtttggtaaggcaaaggggagcagggcaatctggtacatgtggctgggcgcccggttcttggaattcgaagcactgggttttatgaacgaggaccactggttctcacgcgagaacagcctctccggggtcgagggcgaaggactgcacaagttgggctacatcctacgggacattagcaagatccccgggggcaacatgtatgcggacgacaccgccggctgggacacccgcatcacagaggatgatttgcagaacgaagcaaagatcaccgacatcatggagccggagcacgccctgcttgccacctccatctttaagttgacctaccagaacaaggtggtgcgggttcagcgccccgcgaagaacgggaccgtgatggatgtcatctcacgcagagatcaaagaggctccggtcaagtcggcacgtacggcctaaataccttcaccaatatggaggctcagttaatacggcaaatggaaagcgagggcatattcctgccctccgagctggagacgccgaacctcgccgagagagtgctggactggcttgagaaacacggcgtcgagcggctcaagcgcatggcgatcagcggggacgactgcgtcgtgaaaccgatcgacgacagattcgccactgcactgaccgccctaaacgacatgggcaaagtacgcaaggacataccccagtgggagccgtccaaggggtggaatgactggcagcaggtcccattctgctcgcatcactttcaccagcttatcatgaaggatggccgagagatcgtggttccgtgcaggaaccaggacgagctggtcggccgggcccgcgtaagtcagggggcaggctggagtctgagggagaccgcctgcttgggcaagagctacgctcagatgtggcaactgatgtattttcaccgccgggaccttagactcgcagctaacgccatatgctccgcggtgcccgtggactgggtgcccacgtcacggacgacctggtccatccacgctcaccaccaatggatgacaactgaagatatgttgagtgtgtggaaccgcgtctggatcgaggagaacccctggatggaggacaagacgcacgtgtctagctggggcgacgtaccttacctggggaaacgggaggaccagtggtgtgggagtctgatcggcctgaccgcccgggccacgtgggccagcaatatccaggttgccataaatcaagttcgtcgattaatcgggaacgagaactacctcgattatatgacctccatgaagcgcttcaaaaacgaaggagaccccgaaggcgccttatggtga

SEQ ID NO: 24280 - RNA, 9879 nt, synthetic construct
  misc_feature 1..9879: note = derived and/or modified CDS sequence (opt11) from DENV-1__FJ898380__SS-prME
  source 1..9879: mol_type = other RNA
tccgtgaccatgctcctcatgttgatgcccaccgccctggcttttcacctcaccacaaggggaggggaaccccatatgatcgtgtcgaagcaggaacggggcaagagcctgctgttcaagacctccgccggcgtgaacatgtgcaccctgattgccatggatttaggtgagctctgcgaagatacaatgacatataagtgccctcgtatcaccgagaccgagcccgacgacgtggactgctggtgcaacgctacggacacttgggtgacctacgggacctgctcacagacgggcgagcacaggcgagacaagaggtccgtcgccttggcgccgcacgtggggctagggttggagacacgcaccgagacgtggatgtcatccgagggcgcgtggaagcagatacagagggtcgagacctgggctctcagacatcccgggttcaccgtaattgccctgttcctggcacacgcaatcggcacctctatcacccagaagggaatcatcttcatcctcctgatgctggtgacgcccagtatggcgatgcggtgcgtaggcattggcagccgagacttcgttgagggactctccggcgccacttgggtggacgtcgtgttagagcacggaagctgcgtgaccaccatggccaaggacaagcccacgctagacatcgagctcctgaagaccgaggtgaccaaccccgccgtactgcggaagctctgcattgaggcgaagatctccaataccacgacagacagccgctgcccaacccagggagaggccaccctggtcgaggagcaggacgcaaacttcgtctgccggcgcacgttcgtagacagggggtggggcaacggctgcgggctgttcggcaaggggtctttgattacgtgtgcaaagttcaagtgcgtgaccaagctggagggcaagattgtccagtacgagaacttaaagtacagcgtgatcgtgaccgtacacactggcgaccagcaccaggtcgggaacgaatcaaccgagcacggcaccaccgctaccatcacaccccaagcacccacgaccgagatccagctcaccgattatggggccctgactctggactgctcgccccgcaccggcctcgacttcaatgagatggtgctgctcactatgaaggaaaagagctggctcgtgcataagcagtggtttctggatctgcccctcccctggaccagcggagccagcacgtcccaggagacctggaaccggcaagacctgctggtaaccttcaagaccgcacacgcaaagaagcaggaggtcgtggtgctcggcagccaggagggcgcgatgcacacggcgctgaccggggccaccgaaatccagacctccggcacgaccactatcttcgccggacacctaaagtgccgcctcaagatggataagctgactctgaagggcatgtcctacgtgatgtgcacggggtccttcaaacttgagaaggaggtcgccgagacccagcacgggaccgtgctggtccagatcaagtacgaaggcaccgacgcgccctgcaagatccccttcagcacgcaggacgaaaagggggtgacgcaaaacggccggttgatcacggccaacccgatcgtgaccgacaaggagaagcccgtcaacatagaggccgagccccctttcggggagtcctacatcgtgatcggcgctggcgagaaggcactgaagctctcgtggttcaagaagggctcctcgatcggcaagatgtttgaggccacggccagaggggcccggcgcatggccatcctgggcgacacagcctgggattttgggtccataggcggcgtgtttacttcagtaggcaagctggtgcaccagatcttcggcacggcctatggagtactcttctctggcgtctcctggacgatgaagatcgggattggtgtactactgacctggctcgggctgaactctcgcagcacttctctgagcatgacatgtatcgcggtgggtctggtcacgctatacttgggcgtgatggtgcaggccgattccgggtgcgttatcaactggaagggccgggaattaaagtgtggcagcggcatatttgtgacgaacgaggttcacacatggacagagcaatacaagttccaggccgactcacctaagcgattgtctgcggccataggcaaggcgtgggaggaaggtgtctgcggcatacggagcgccacccgtctggagaacatcatgtggaagcagatctccaacgaactcaaccacatcctgctggagaacgacatgaagttcaccgtggtcgtcggggacgtggcgggcatcctagcgcaagggaagaagatgatccggccccagccaatggagtataaatacagctggaagtcgtggggcaaggccaagattatcggcgccgacgtgcaaaacactaccttcatcatcgacgggcccaacacaccggagtgccccgatgaccagagggcgtggaacatatgggaggtcgaggattacggctttggtatctttacgaccaacatctggctgaagctgcgggacagctacacccaggtgtgtgaccaccgcctcatgtccgcggccatcaaggacagtaaggccgtgcacgccgacatgggctattggatcgaatccgaaaagaacgagacatggaaactggcccgggctagcttcattgaagtcaagacatgcatatggcccaagtcccacacactgtggagcaatggcgtgctcgagtcagagatgatcatcccaaagatatacggaggacccatctcccagcataactaccgccccgggtacttcacgcaggccgccggcccttggcacctgggcaagctggagctcgacttcgacctatgcgagggtactacggtggtcgtggatgagcattgcggcaacagagggccgtccctgcgaaccaccacagttacgggcaagatcatacacgagtggtgctgccgcagctgcacgctgccgcccctccgattcaagggggaggacggatgctggtacgggatggagatccggcccgtcaaggagaaggaggagaacctggtgaagtcgatggtgagcgccgggtccggcgaggtcgactccttcagcctgggtctgctgtgcatctccatcatgatcgaggaggtgatgcggagccggtggtccagacggatgttgatgaccggcaccctggccgtgtttttccttctcattatggggcagttgacgtggaacgatctgatcaggctctgcatcatggtcggcgcgaacgccagcgaccgcatggggatgggtaccacctacttagccctcatggccaccttcaagatgcgaccgatgttcgccgttggcctcttattccgacggctgacgtcccgcgaggtgctcctgctgaccatcgggctctctcttgttgcgtccgtggagctgcccaacagcctcgaggagctcggcgacgggctggccatgggcattatgatcctcaaactgctaaccgacttccaatcccaccagctctgggcaaccttgctgagcctcacgttcataaagaccaccttctccctgcactatgcctggaaaacgatggcgatggtcctgagcatcgtgtccctctttcccctgtgcctcagcactacgtcccagaagaccacctggctccccgtgctgctggggagcctagggtgcaaaccgctgacgatgttcctaatcgcagagaacaagatctggggcaggcgctcctggcccctgaacgagggtataatggccgttggaatcgtgagcatcttgttaagctccctcctgaagaatgacgtgcctctggctgggccactcatagccggcggcatgcttatcgcgtgctacgtcatcagcgggtcatcagcggacctgtcgctcgaaaaggcagctgaggtgagctgggaagaggaggccgagcactccggcgcgagccataacatcttggtggaggtccaggacgacgggaccatgaagatcaaggatgaggagcgtgacgacacccttaccatcctgctcaaagcgaccctgctcgcggtgtccggcgtgtatccgttgtccattcccgcgacgctattcgtctggtacttctggcagaagaagaagcagcgctccggggtgctctgggacaccccaagcccacccgaggtggagcgcgccgtcctggacgacggcatttaccgcataatgcagcggggattgctggggcgctcacaggttggcgttggggtctttcaggagaacgtcttccacaccatgtggcacgtgaccaggggcgcggtcctcatgtaccaggggaagcgcttagagcccagctgggcatctgtgaagaaggacctgatctcctacggcggtggttggcggcttcagggctcctggaacacgggagaggaggtgcaggtcatcgcagtggaaccaggtaagaaccccaaaaacgtgcagactgcccccgggactttcaagactcccgagggcgaggtcggcgccatcgcgctcgacttcaaaccaggcacaagcggctcgcccattgtgaaccgcgaggggaagatcgtgggcctgtacggcaacggggtcgtgaccaccagcggcacctacgtgagcgccatcgcccaggccaaggcgtcccaggagggtcccctcccagagattgaggatgaggtctttcgcaagagaaacctgacgatcatggatctgcacccggggagcggcaagacccggcgttaccttccggccatagttcgggaggccattaagcgcaaactgcggacccttatcctcgcccccacacgggtcgtagcatccgagatggcggaggccctgaagggcatgcccatccgttaccagacgaccgccgtaaagagcgagcacactggcaaggagatcgtagacctgatgtgccacgccaccttcactatgcggctcctgtctcctgttcgcgtgcccaactataacatgattatcatggacgaggcccacttcactgaccccagctccatagcggccagggggtacatcagtacgcgcgtgggcatgggggaggccgcggccatcttcatgaccgccacgccgcccgggagcgtcgaggctttcccgcagagcaatgccgtaatccaggacgaggagcgagatatccccgagaggtcctggaacagcgggtatgagtggatcaccgatttccctggaaagaccgtgtggttcgtccccagtatcaaatctggaaacgacatcgccaattgcctgcggaaaaatgggaagcgcgtgatccaactctcccggaagaccttcgacacggagtaccagaagaccaagaacaacgactgggactacgtcgtcacaaccgacatcagcgagatgggggcgaacttccgcgccgaccgggtgatcgacccgcgccggtgcttgaagcccgtgatactcaaagacggtcccgagcgtgtcatcctcgccggccctatgccggtgacagttgccagcgccgctcaacggcgcgggcggatcggccgcaaccacaacaaggagggcgaccaatacatttatatggggcagcctctgaacaacgatgaagaccatgctcactggacggaggcaaagatgctgctggacaacattaacacccccgagggcatcattcccgccctgttcgagccggagcgcgagaagtccgcggcgatcgacggggagtaccggctacgcggggaggcgcggaaaaccttcgtggagctcatgcgccgcggtgacctgcccgtgtggctatcctacaaggtcgcgagcgagggcttccagtacagcgaccgtaggtggtgtttcgacggcgagcgcaacaaccaggtgcttgaggagaacatggacgttgaaatctggaccaaggagggtgagcgaaagaagctgcgcccacggtggctggacgcccgcacctactccgaccccctggccctgcgggagttcaaggagttcgcggcaggccgcagaagcgtctccggggaccttatcctcgagatcgggaaactcccgcaacacctcacccagcgcgcccaaaatgcgctcgacaacctagtgatgctgcacaacagcgaacagggcgggcgggcttatcgccacgcgatggaggagttgccggacaccatagagaccctaatgctgctcgccctgatcgccgtgctgaccggtggggtcactctattcttcctttcaggaagagggctgggcaagaccagtatcggcttgctgtgtgtgatggcctccagtgtactgctttggatggcatccgtcgaaccccactggatcgccgcaagcatcatcctggagttcttcctgatggtgctcctgatccccgagccggaccgccagcggacgccgcaggacaaccagcttgcatacgtggtcatcgggctcctgtttatgatcctgacggttgccgcgaacgaaatgggcttactggagactaccaaaaaggacctgggaatcggccacgtggccgtcgagaaccaccaccacgccgctatgctcgacgttgacctacaccccgcctccgcgtggaccctatacgcagtggccacgacaatcatcacgcccatgatgcgccataccattgagaacacaaccgccaacatcagcctcacggccatcgcgaatcaggccgcaatactgatggggttagacaagggttggcccatatccaagatggatattggcgttcccctcttggctttagggtgctatagccaggtgaaccccctcactctgacggctgctgtgcttatgctcgtcgcccactacgccattatcggcccggggctgcaggccaaggctacccgcgaagctcagaagcggaccgccgccggcatcatgaagaaccccaccgtggacgggatcgtggccatcgacctcgacccggtcgtgtacgacgcgaaatttgagaaacagctgggccagatcatgctgctaatcctctgcacgagtcagatattacttatgcgcacgacgtgggccctctgtgagtcgattacgctggcgacgggccccctgaccacgctctgggagggatccccgggcaagttctggaacaccacgatcgccgtaagcatggccaatatctttcggggatcctatctggcaggcgcaggcctagccttcagccttatgaaaagcctcggagggggacgccgggggacgggggcacagggagagacgctaggcgagaagtggaagcgccagttaaaccaactctccaagagcgagttcaacacctacaagcggtccgggatcatggaagtcgaccgcagcgaggcaaaggagggccttaagcgcggggagacgaccaagcacgcagtctcccgcggtaccgcaaagctccggtggttcgtggagcgcaacttagtcaagccggaggggaaggtgatcgacctgggctgcgggcgaggcgggtggagctattattgcgcgggtctgaagaaagtgaccgaggtcaagggatacacgaaaggcggccccggccacgaggagcccatcccgatggcgacctacggctggaacctagtgaagctgcactcagggaaggatgtgttcttcatcccgcctgaaaagtgcgataccttgctctgcgacatcggagagtcttccccgaatccgaccatcgaggaggggcgtactctgcgcgttctaaagatggtggagccttggctccgtgggaaccagttctgtatcaagatcctgaacccctatatgccaagcgtcgtcgaaactctggaacaaatgcagagaaagcacggcggcatgttagtccgcaacccgctttcccggaatagtacccatgagatgtactgggtgtcctgcgggacgggaaacatcgtctcggccgtaaacatgacctcccgcatgctgctcaaccgcttcacgatggcccacaggaagcccacgtacgaacgcgacgtggacctgggggccggcacccggcacgtcgcagtggagcccgaggtggccaacctggacattataggccaacgcatcgaaaacatcaaacatgaacataaaagcacctggcactacgacgaggacaacccctacaagacctgggcgtaccatgggtcctacgaggtcaaaccgagcggaagcgccagtagcatggtgaacggggtcgtgaagctcctcaccaagccgtgggacgtgattcccatggtcacccaaattgccatgacagacacgacccccttcggtcagcagcgggttttcaaggagaaggtggatacccgcaccccgaaggccaagcgagggacagcacagatcatggaggtcacagcgaagtggctgtggggcttcctctctcgcaacaagaaaccgaggatctgtaccagagaggagttcacccggaaagtgcgcagcaacgccgccatcggagcagtgttcgtcgatgagaaccagtggaactccgcgaaggaggccgtcgaggacgagcggttctgggaccttgtccaccgagagcgggaactgcacaagcagggtaagtgcgctacgtgcgtctacaacatgatgggcaagcgcgaaaagaagctaggggagtttggcaaggccaaggggagcagggccatctggtacatgtggttaggcgcacgctttctggagttcgaggccttgggtttcatgaacgaggaccactggttctcccgggagaatagcctgtccggggtcgaaggcgaggggttgcacaagctgggatacatcttgcgggacatcagcaaaatcccgggcggcaatatgtacgcggacgacaccgcgggctgggatacccgcatcaccgaagacgatctgcagaatgaggccaggatcacggacattatggagcctgagcacgcgctcctggcgaaatccatcttcaagttaacctaccagaacaaagtagtccgcgtgcaacgaccggccaagaacgggaccgttatggatgtcatatcacgcagggaccaacgcgggtctggtcaagtgggcacgtacggcctaaacacattcaccaacatggaggcccagttaattcggcagatggaaagtgaggggatcttctctccttctgagctggagaccccgaacctcgccgagcgcgtgctggactggttagagaagtacggggtcgagcgcctcaagcgcatggcgatcagtggggatgactgtgtagtgaagccgatcgacgaccggttcgctaccgccctgacggctctgaatgacatgggcaaagtccgcaaggacatcccccagtgggagccctctaaggggtggaacgattggcagcaggtccccttttgcagccaccactttcatcaattaatcatgaaggacggccgggagatcgtagtcccatgtcgcaaccaggacgagctggtgggacgtgcgcgcgtgagccagggggctggctggtccctgcgggaaaccgcgtgcctggggaagtcctatgcccagatgtggcagttgatgtacttccaccgccgggacctgagactcgcagccaacgccatctgcagcgctgtgccagtggactggatccccacatcccggaccacctggagcatccacgcccaccaccagtggatgaccactgaggatatgctgtccgtgtggaaccgcgtctggattgaagagaatccctggatggaagacaagacccacatcagctcctggggcgacgtgccgtacctggggaaacgcgaggaccagtggtgcggcagcctcataggcctgaccgcccgagcgacctgggccaccaacatacaggtcgccatcaatcaggtgcgcagactgatcgggaacgagaactacctcgactacatgaccagcatgaagcggttcaagaacgagtcggaccccgagggcgctctgtggtga

SEQ ID NO: 24281 - RNA, 9879 nt, synthetic construct
  misc_feature 1..9879: note = derived and/or modified CDS sequence (opt11) from DENV-1__FJ898382__SS-prME
  source 1..9879: mol_type = other RNA
agcgtaaccatgttactcatgctgatgccaaccgcacttgccttccacctcaccacccggggcggcgaaccccacatgatcgtgagcaagcaggagcgcggcaagagcctgctgttcaagaccagtgcgggcgtgaatatgtgtaccctcatcgccatggatctaggcgagctgtgcgaggacaccatgacctacaagtgcccccgcatcaccgagaccgagcccgacgatgtggactgctggtgcaacgccacggacacctgggtgacttacgggacctgcagccaaaccggcgagcaccgcagagacaagcggagtgtagcacttgcgccccacgtgggcctcggccttgagacccgtacagagacctggatgagctccgagggcgcgtggaagcagatacagcgggtggagacgtgggccctccgccatccgggattcaccgtgatcgccctgttcctggcccacgcaatcggcaccagcattactcagaaggggataatcttcatcctcttgatgctggtgacgccgtccatggccatgcggtgcgtcggcatcggcagccgcgacttcgtggaggggttgtcgggggccacctgggtggacgtggtattggagcacggttcgtgcgtgactaccatggccaaggacaagcccacgctagacatcgaactcttgaagaccgaggtcaccaaccccgccgtactgcggaagctctgcatcgaggcgaagatttccaacaccacgacagacagccgctgcccgacacagggtgaggccaccctggtggaggagcaggacgccaatttcgtctgccggcgcacattcgtggaccggggctgggggaacggctgcggactgttcggcaaggggtcccttatcacgtgcgctaagttcaagtgcgttaccaagctggagggcaagatcgtacaatacgagaacctcaagtacagcgtgatcgtgaccgtccacacgggcgatcaacaccaggtagggaacgagagcaccgaacacggcacgaccgccaccatcacgccccaagcgcccacaaccgagatccagttaaccgactacggggccctgacgttggactgcagcccccgtaccggtctcgacttcaacgagatggtcctgctgaccatgaaggaaaagtcctggctcgtgcacaagcagtggttcctggacctgcccctcccctggacgtcaggggccagcacgtcccaggagacctggaaccggcaggacctgctggtgaccttcaagaccgcccacgccaagaagcaggaggtcgtggtgctcgggagccaggagggcgcgatgcacacggccctaaccggggccacagaaatccagacctctggcacgaccaccatcttcgccgggcacctgaagtgccgcctcaagatggacaagctgaccctgaagggcatgagttacgtcatgtgcactggatccttcaagctagagaaagaggttgcagagacccagcacgggaccgtgctggtccagatcaagtacgagggcaccgacgcgccctgtaagatcccgtttagcacgcaggacgagaagggggtgacccagaacggccggctgatcaccgccaacccgatcgtgactgacaaagagaagcccgtcaacatcgaggcagagccgcccttcggggagtcctacatcgtaatcggcgccggggagaaggcactgaaactcagctggttcaagaaggggtcgagcattggtaagatgttcgaggccaccgcccgcggtgcccggcgcatggccatcttaggcgacaccgcgtgggacttcgggtccataggcggcgtattcacctcggtcgggaagctggtccaccaaatctttggaaccgcctacggggtcctcttctcgggcgtcagctggaccatgaagatcgggattggcgtgctgctgacctggctcggtctgaactcccgcagcacctccctgagcatgacctgtatcgccgtggggctcgtcacgctgtacctgggtgtgatggtgcaggccgactcaggctgcgtcatcaattggaagggccgggaactcaagtgcggctccggcatcttcgtaaccaacgaggtgcacacgtggaccgagcagtacaaattccaggccgacagcccgaagcgcctgtccgcggccatcggcaaggcctgggaggagggggtatgcggtatccggtccgccacccgcctggaaaacatcatgtggaagcagatctcaaacgagctcaaccacatcctgctggagaacgatatgaagttcacggtggtggtcggggacgtggccggcatcctcgcacaggggaagaagatgatccggccccagcccatggagtacaagtacagctggaagtcctggggtaaggccaagataatcggcgccgacgtgcagaacaccaccttcatcatcgacggacctaacaccccggagtgccccgacgaccagagggcctggaacatctgggaggtcgaggactatggcttcgggatattcacgaccaacatctggctgaagctacgggacagctacacccaggtttgcgaccaccgcctcatgtccgcggccatcaaggactccaaggccgtgcacgccgatatgggctactggatcgagtccgagaagaacgagacctggaagctagcccgggcgtcttttatcgaagtcaagacgtgcatctggcccaagtctcacaccttgtggagcaacggcgtgctcgagtccgagatgatcatccccaagatctacgggggcccgatcagccagcacaactaccgccccgggtacttcacccaggccgccggcccctggcacctggggaagctggagctcgacttcgatctgtgcgaaggcaccacggtggtcgtagacgaacactgcggcaaccgggggccgtccctgcgcaccaccaccgtgacgggcaagatcatccacgagtggtgctgccggagctgcaccttaccccccctacgcttccgcggggaggacggctgctggtacgggatggagatccgccccgtcaaggagaaagaggaaaacctggtgaagtccatggtgagcgccggcagcggcgaggtcgactccttcagcctcgggctgctgtgcatctccatcatgatcgaggaggtgatgcggagcagatggtcccggcgcatgttgatgaccggcaccctagccgtgttcttcctgctcatcatgggccaactgacgtggaacgacctaatacgtctctgtatcatggtcggcgcgaacgcgtcggaccggatgggtatgggcactacctacctggccctgatggccaccttcaagatgcgcccgatgttcgccgtggggctcctgttccggcgtctgacgtccagagaagtgctcctgctcaccatcgggctctcactggtcgcatccgtagagctgcccaacagcctcgaggagctgggcgacgggctggccatgggcataatgatcctcaagctgctgaccgacttccagtctcaccagctctgggccaccctgctgagcctcacgtttatcaagacgaccttctccctgcactacgcctggaagaccatggcgatggtcttaagcatcgtgtccctctttcctctgtgcctgagcacgacctcccaaaaaaccacctggctacccgtgttactgggcagcctcgggtgcaagccgctgacgatgttcctgatcgcggagaataagatctggggcaggcggtcttggcccctcaacgaggggatcatggccgtcggcatcgtgagcattctgctgagcagtctgctgaagaacgacgtgcccctagccggtcccctcatcgccggcggtatgctgatcgcgtgctacgtaatctctggatccagtgccgacctgtccctcgagaaggccgccgaggtgagctgggaggaggaggccgagcactcgggcgcgagccataacatcctggtggaggtccaggacgacgggaccatgaagatcaaggacgaggagcgtgatgacaccctgaccatcctcctaaaggccaccctgctggccgtgtcaggcgtctacccgctgagcatccccgccactctgttcgtctggtacttctggcagaagaagaagcagcggtcaggagtgctatgggacacccccagcccgccagaggtggaacgcgccgtcctggacgatgggatttaccggatcatgcagcgcggcctgctcgggcggagtcaggtgggtgtgggtgtcttccaggagaacgtgttccacaccatgtggcacgtgacgaggggcgcggtcttgatgtaccaggggaagcggctggaacccagttgggcctcagtgaagaaggacctgatcagctacggcggcgggtggcgcctgcagggctcctggaacacgggggaagaggtgcaagtcatcgccgtggagcccggcaagaaccccaagaacgtgcagacagcccccgggaccttcaagacccccgagggcgaggtcggcgccatagcgctggactttaagcccgggacgtcagggtctcccatcgtgaaccgggaggggaagatcgtgggcctgtacggcaacggggtcgtgaccaccagcggcacctacgtgagcgccatcgcccaggcgaaggcaagccaggaggggccgctgcccgagatcgaggacgaagtcttccgcaagcgcaacctgacgatcatggacctccacccgggcagcgggaaaacccggcggtacttaccggccatcgtgcgggaggccatcaagaggaagctgcggaccctgatcctcgcgccaacccgcgtagtcgcctccgagatggcggaggccctgaagggcatgcccatccggtaccagacgacggcggtcaaaagtgagcacaccggcaaggagatagtggacctgatgtgccacgccaccttcacgatgagactcctgagtcccgttcgggtcccgaactacaacatgatcataatggacgaggcccacttcaccgaccccttcagcatcgcggcccgtgggtacatctcgacccgggtaggtatgggggaggctgcagccatcttcatgaccgccacgccgccaggcagcgtcgaagccttcccccagtccaatgcagtgatccaggatgaggagcgcgacatacccgagcggagctggaactcggggtacgagtggattacagacttcccgggcaagaccgtgtggttcgtccccagcatcaagtccggcaacgacatcgccaactgcctgcgcaagaacggcaagcgggttatccagctcagccgcaagaccttcgacacggagtatcagaagactaagaacaatgactgggactacgtggtcacaaccgacatctccgagatgggcgcgaacttccgggccgatcgcgtgatcgaccctcggcgctgcctaaagcccgtgatcctgaaggacggccccgagcgggtcatcctcgccgggcccatgcccgtgacggtcgccagcgccgcgcaacgccgggggcgcatagggcgcaaccacaacaaagagggcgatcagtacatctacatggggcagccccttaacaacgatgaggaccacgcccactggaccgaggcgaagatgctgctcgacaacatcaacacacccgagggcatcatccccgccctgttcgagccggagcgggagaagagtgccgcgatcgacggggagtaccgcctgcggggcgaggcgcgcaagactttcgtagagctcatgcggcgcggcgacctgccggtgtggctgagctacaaggtcgcctccgagggattccagtacagcgatcggcgctggtgcttcgacggcgaacggaacaaccaagtgctcgaagagaacatggacgtcgagatctggacgaaggagggtgagcgcaaaaagctgcggccccgctggctggacgcccggacctacagcgaccccttggccttacgagagtttaaggagttcgcggccggccggagatccgtcagctccgacctgatcctcgagatcgggaagctgccgcagcacctgacccagagagcccagaatgccctcgacaacctcgtcatgcttcataacagcgaacagggcgggcgcgcgtaccgacacgccatggaggagttgcccgacaccatcgagacgctgatgcttctcgccctgatagccgtattgacagggggggtcaccctcttcttcctgtccgggcgcggcctggggaagacctcgatcggcctcctttgcgtcatggcctccagcgtgctactgtggatggcgagcgtcgagccccactggatcgccgccagcataatcctggaattcttcctgatggtgctcctgattcccgagccggatcggcagcgcacgccccaggacaaccagctggcctacgtggtcattggcctcctgttcatgatcctgacggtggcggcaaacgagatggggctcctggagactacaaagaaggatctgggtatcgggcacgtggcagtcgaaaaccatcaccacgccgccatgttagacgtagacctgcaccccgccagtgcgtggaccttatacgcggtagccacgaccatcatcaccccgatgatgagacacaccatcgaaaacacgaccgccaacatcagcctcacagccatcgcgaaccaggccgccatcttgatgggcctggataaggggtggcccatctccaagatggacatcggcgtcccactcctagccctgggctgctacagccaagtcaacccactcacgctgacggcggccgtgctaatgctcgtagcccactacgccatcatcgggccgggcctgcaggccaaggcgacccgggaggcccagaagcgcaccgcggccgggatcatgaagaaccccaccgtggacggcatcgtggccatcgacctggaccccgtcgtttacgacgcgaagttcgagaagcagctcgggcagataatgctgctgatcctctgcacgtcccagatcttactgatgcgtaccacatgggccctctgtgagtcgatcaccctggccacaggccccctgaccaccttgtgggagggctccccggggaagttctggaacaccactatcgctgtgtcaatggccaacatctttcgcggatcctacctggcgggagccgggcttgccttcagcctcatgaagtccctgggcgggggccggcgcggaacaggcgctcagggagagaccctgggtgagaagtggaagcggcagctcaaccagctgtccaagagcgagttcaacacctacaagcgctccggcatcatggaagtggaccgcagcgaggcgaaggaggggctgaagcgcggcgagacgacgaagcacgccgtgtcccggggcaccgccaagctcaggtggttcgtggagcgcaatctggtcaagcccgagggcaaggtgatagacctggggtgcggccgcggcgggtggagctactactgcgccggcctgaagaaggttaccgaggtcaaggggtacacgaagggcgggcccggccacgaggagcccatcccgatggccacgtacggctggaacctggtgaagctgcactctggcaaggacgtgtttttcatcccgcccgagaagtgtgacaccctgttgtgcgacatcggcgagagctcccccaacccaaccatcgaagaagggcggacgctgcgcgtcctgaagatggtggagccctggctccgcggcaaccagttttgtatcaagatcctgaacccctacatgcccagcgtggtcgagaccttagagcagatgcagcgcaagcacgggggcatgctcgtgcggaacccgctgtcccgcaatagcacccatgagatgtactgggtgtcctgcggcaccgggaacatcgtcagcgcggtgaatatgacctcacgcatgctactcaaccgattcacgatggcccaccgcaagcccacctacgagcgggacgtggatctgggcgctgggacccgccacgtcgcggttgagcccgaggtggctaacctggacatcatcggccaacggatcgagaatatcaagcacgaacacaagagcacctggcactacgacgaggacaatccgtacaagacgtgggcataccatggctcttacgaggtcaagccgagcgggtccgccagcagcatggtaaacggtgtcgtgaagctcctaaccaaaccctgggacgtgattcccatggtcacccagatcgccatgacggacacgacgcccttcggccagcagcgggtgttcaaagagaaggtggacacccgaaccccgaaggccaagcgcggcactgcccagatcatggaggtcactgcgaaatggctgtgggggttcctctcccgaaacaagaagccccgaatctgcacccgggaggagttcacacgcaaggtgcgtagcaacgccgccatcggcgccgtgttcgtcgacgagaaccagtggaactccgcgaaggaggccgtagaggacgaacgcttctgggatctggtgcaccgggagcgcgagctgcacaaacagggtaagtgcgccacgtgcgtttacaacatgatggggaagcgggagaagaagctcggggagttcggaaaggccaagggtagccgcgctatctggtacatgtggctgggagcgaggttcctggagttcgaggccttaggctttatgaacgaggaccactggttctcccgcgagaacagcctgtccggcgtggagggggagggcctgcacaagctcgggtacatcctgcgggacatctctaagattcccggcggaaacatgtacgcggatgatactgccggctgggacacccgcatcaccgaggacgacctgcagaatgaggcccgcattacggacatcatggaacccgaacacgcgctcctcgccaagtccatcttcaagctgacctaccagaacaaggtggtccgggtgcagcgccccgcgaagaacggcaccgtgatggacgtcatcagccggcgcgaccagcgggggtccggccaggtaggcacctacggcctcaacacgttcaccaacatggaggcccagttgatccgccagatggaaagcgagggcatcttctccccctcagagctggagacccccaacctcgcggaacgtgtcctggactggctggagaagtacggggtcgagcggctcaaacggatggcgatctccggcgatgattgcgtggtgaaaccgatagacgaccgcttcgccactgccctcacggccctgaacgatatggggaaggtccggaaggacatcccccagtgggagccaagcaagggctggaacgactggcaacaggtcccattctgctcccaccactttcaccagctcatcatgaaggacgggcgcgagattgtcgtcccgtgccgaaaccaggacgagctggtgggccgcgcccgggtgagccagggtgcggggtggagcctgcgtgagaccgcctgcctcggcaaatcctacgcacagatgtggcagctgatgtacttccaccggcgcgacctgcgactcgccgcgaacgccatctgcagcgccgtacccgtggactggatccccacctccagaaccacgtggtctatccacgcccaccatcagtggatgacgaccgaagacatgctgtccgtgtggaaccgcgtgtggatcgaggagaacccctggatggaggacaaaacccacattagctcctggggcgacgtgccttacctaggaaagcgggaggaccagtggtgcgggagcctcataggcctgacagcgcgcgcgacctgggccaccaacatccaggtggccatcaaccaggtccggcgcttgatcggtaacgagaactatctcgactacatgacctccatgaagcgattcaagaacgagagcgatcccgagggtgccctgtggtag

SEQ ID NO: 24282 - RNA, 9879 nt, synthetic construct
  misc_feature 1..9879: note = derived and/or modified CDS sequence (opt11) from DENV-1__FJ898383__SS-prME
  source 1..9879: mol_type = other RNA
agtgtgaccatgctgttaatgctgatgccaaccgccctcgctttccacctcaccacccggggcggggaaccccatatgattgtgagcaagcaggaacggggcaagagcctcctgtttaagacgagcgcgggggtgaacatgtgcaccctcatagccatggacttgggtgagttatgcgaggacaccatgacctataagtgcccccgcatcaccgaaaccgaacccgatgacgtggactgttggtgcaacgccacggacacctgggtcacgtacggaacctgcagtcagactggcgaacatcggcgtgataagcggtctgtggccctcgccccgcacgtgggcttggggttagaaaccaggaccgaaacgtggatgagcagcgaaggcgcgtggaaacaaatccagcgcgtcgagacatgggccctccgccatcctgggttcactgtgattgccctgttcctggcccatgcgattggcaccagcatcactcagaaggggatcatatttattctcctgatgctggtgaccccctccatggccatgcggtgcgtcggcatcggcagcagggacttcgtggaggggctctcgggcgccacctgggtcgatgtcgttttagaacacgggagctgcgtaacaaccatggctaaagacaaacccacactggatatagagttactgaagaccgaagtcaccaacccggccgtcctgcggaagttgtgcatcgaggcaaagatatcaaacaccactaccgacagccggtgccctacgcagggcgaggccaccctggtcgaggaacaggacgcgaactttgtctgccggcgtaccttcgtggaccgtggctgggggaacggttgcgggctgtttggcaaagggtcactcatcacgtgcgccaagttcaaatgtgtgacgaaactggagggcaagatagtccaatacgagaacctgaagtacagcgtgatcgtgacggtccacacgggcgaccaacaccaggtggggaacgagtcaaccgagcacggcaccaccgccaccataacgccacaggcgcccactaccgagatccaactaaccgattacggggccctgacgttggattgctccccaaggaccggcctcgacttcaatgagatggtcctgctgaccatgaaggagaaatcttggctcgtgcacaagcagtggttcctggacctgcccctcccgtggaccagcggggccagcacgtcccaggagacatggaatcggcaggatctactggttactttcaagacggcccatgccaagaagcaggaggtcgtggtgctcggctcacaggagggcgcgatgcacacggccctaaccggtgcaaccgaaatccagacctccggcaccaccaccatcttcgctgggcatctgaagtgccgcctcaagatggacaaactgactctgaagggcatgtcttatgttatgtgtactgggagcttcaagctcgagaaggaggtggctgagacccagcacggtaccgtgttagtccagatcaagtacgaaggcaccgatgcgccctgcaagatccccttcagcacgcaggacgagaagggggtaacccagaacggcagactgatcaccgccaacccgatcgtgactgataaggagaaacccatcaacattgaggccgagccacctttcggagagtcatacatcgtcatcggcgccggcgagaaggcgctgaaactcagctggttcaagaaggggtccagcatcggaaagatgtttgaggcaaccgccagaggggcccggcgcatggccatactaggcgacacggcgtgggacttcgggtccatcggaggggtgttcactagcgtgggcaagctggttcaccagatcttcggcacagcgtacggcgtgctattctcgggtgttagctggacgatgaaaatagggatcggggtcttgctgacttggctcggactaaattcccgctccacctccctgagcatgacctgcatcgccgttggcctcgtgacgctctatctgggggtgatggtgcaggctgactccggatgcgtgatcaactggaagggtcgggagctgaagtgtgggagcggaatattcgtaaccaacgaggtgcacacctggacggagcaatacaagtttcaggccgacagccctaagcgcctctccgccgccatcggcaaagcctgggaggagggcgtctgtggcatacggagcgccacccgcctggagaacatcatgtggaaacagatatccaacgagttaaaccacatcctgctggagaacgacatgaagtttactgtcgttgtaggtgacgtggccggcatcctcgcgcaaggaaagaaaatgatccggccccagccaatggagtacaagtattcctggaagtcgtggggcaaagccaagatcatcggagccgacgtgcagaacaccacctttatcattgacggccccaacacccctgaatgccccgacgaccagcgcgcctggaatatctgggaggtggaggactacggtttcgggatcttcacgaccaacatctggctgaagctacgggactcgtacacccaggtgtgcgaccaccgattgatgtccgcagctatcaaggacagcaaagccgtgcacgcagacatgggctactggatagagagcgagaagaacgagacttggaagctggcacgagcgtcattcatcgaagtgaagacgtgcatctggccaaagtcccacaccctgtggtcgaatggggtcttagagtccgaaatgatcatccccaagatatacgggggtccgatcagccagcacaattaccgtcctgggtacttcacccaggccgccggcccctggcacctggggaaattagagctcgacttcgatctgtgtgaaggcacgactgtagtggtcgacgagcactgcggcaaccgggggccatccttaagaaccaccactgtaacaggcaaaatcatccacgaatggtgttgccggagttgcacactgccgcccctccgcttcagaggggaagacggttgctggtacgggatggagataagacccgtgaaggagaaggaggagaacctggtaaagtccatggtgtctgccggctctggcgaagtcgactcattcagcctcggactgctgtgcatctccatcatgatcgaggaggtcatgagaagccgatggtcccgccgcatgctcatgaccggcaccttggccgtcttcttcttacttatcatggggcagttaacatggaacgacttgatacgcctctgcatcatggtgggcgcgaacgcgagcgacagaatggggatgggcactacctacctggccttaatggccacgttcaagatgcgcccgatgttcgccgtcgggttgctattccggaggctgacgtcccgggaagtgctcctgctaaccatcgggctcagcctggtggcctccgtcgaactcccaaacagcctcgaggaactgggcgacgggctggccatgggcataatgatcctcaaacttctgacggattttcagagccaccagctctgggccaccctgctgagcctcacattcatcaagaccaccttctccctgcattatgcctggaagacaatggcgatggtgctaagcattgtctccctcttccccctgtgcctgtcgacgacctcccagaaaaccacctggctccccgtcctactcggcagccttgggtgcaaaccgctgacgatgtttctgatcgctgaaaacaaaatctggggccgccgttcctggccgctaaacgaggggatcatggcagtgggcatcgtcagcattttactgagcagtctccttaagaacgatgtgcctttagccggaccgctcatcgccggcggcatgctgatcgcgtgctatgtgatatcggggtcctcggccgacctgagtctagagaaggcagccgaagtctcctgggaggaggaggcagagcactccggcgcgagccacaacatcctggtggaggtccaagacgacgggaccatgaaaattaaggacgaggagcgcgacgacaccctgaccatcctcctgaaggctacgctgctcgccgtcagcggcgtgtaccctttaagcatccccgccacgctgttcgtatggtacttttggcaaaagaagaagcagcgtagtggggtcctctgggacaccccatctccgcccgaggtagagcgggccgtgctggacgacggtatctaccgcatcatgcagcgcggactacttggcaggtcccaggtcggcgtgggtgtgttccaagagaatgtcttccatacgatgtggcacgtgacccgcggagcggtgctcatgtatcaagggaagcgtctggaaccctcttgggcctccgtcaagaaggacctaatcagctacggtggcggatggcgtctccagggctcctggaacaccggggaggaagttcaggtgattgcagttgagcccggcaagaacccgaagaacgtgcagaccgctcccgggaccttcaagacccccgagggcgaggtgggcgcgatcgcgttagatttcaagcccgggacgagcggatcccccatcgttaaccgggaggggaaaatcgttgggctgtacggaaacggggtggtcaccacaagcggcacctacgttagcgccatcgctcaggcaaaggcctcccaggaggggccgctcccggagatagaggatgaggtgttcagaaagcggaacctgacgatcatggatttacaccccgggagcgggaaaacccgtagatacctcccggccattgtccgcgaggccattaagaggaagctgcggacactgatactcgctcccacccgcgtagtagcctccgagatggccgaggccctgaaaggcatgcccatcagataccagacaaccgcagtcaagtcggagcacaccgggaaggagatcgtggacctgatgtgccacgccaccttcacgatgcggctcctgtcccccgtccgagtccctaactacaacatgatcataatggacgaggctcacttcacggaccccagctcaatcgcggcgagagggtacatcagcacccgggtgggtatgggcgaggccgctgcaatcttcatgacagcgacgccgcccggatccgtggaggcctttccgcagtcaaacgccgtaatccaggacgaggaacgcgatatccccgagcggtcctggaactcaggctatgagtggatcaccgacttccccggtaagaccgtgtggtttgtgccctccatcaagtctggcaacgacattgccaattgtctgcgcaagaatgggaagcgggtcatccaactctccaggaagactttcgacacggagtaccaaaagaccaaaaacaacgactgggactacgtggtcaccaccgacatcagcgaaatgggcgcgaacttccgggccgatcgcgtcatcgacccgcggcgctgcctgaagcccgtcattctgaaagatgggcccgagcgtgttatcctcgccggcccgatgccggtcacagtcgcctccgctgcgcagcgaagagggcggatcggccgcaaccataacaaggaaggagaccagtacatctacatggggcagcccctgaacaacgacgaggatcacgcccactggaccgaagccaaaatgttgctggacaacatcaacacccccgaaggcatcataccggccttgttcgagcccgagcgggagaaatccgccgcgatcgacggggagtaccgcctgcgcggcgaagcgcgcaagaccttcgtcgagctcatgcggagaggggacttacctgtgtggctgtcctacaaggtggcatccgagggcttccagtacagcgaccggcgctggtgtttcgacggggagcggaacaaccaggtgctcgaagagaacatggacgtagagatatggacgaaggagggggaacgcaagaaacttcggccccgatggctagacgcccggacatattccgaccccctcgccctgcgggagttcaaagagtttgcagccggccgacgcagcgtgagcggtgatctgatactcgagatcgggaagctgccccagcacttgacccagcgggcacagaacgccctcgataacctggtcatgctgcataacagcgagcaaggcggccgtgcttatcgacacgccatggaggagctccccgacaccatagagacgctaatgctgctcgcccttatcgctgtgctcacaggaggggttactctcttcttcctgtccggccgcgggctgggaaagacgagcatcggcctcctttgcgtcatggccagcagcgtgctgctctggatggcctccgtggagccccactggatcgccgcctctatcatcctggagttcttcctgatggtcctcctgatcccagagcctgataggcagcgcacgccccaggacaaccagctcgcctacgtagtgatcgggctcctattcatgatcctgacggtggccgcaaacgaaatgggcttgctagaaaccacgaagaaagacctaggaataggccacgtcgccgtggaaaaccaccaccatgccgctatgctcgatgtcgatctgcaccccgcgtcagcgtggaccttatacgccgtggcaacaacgatcatcacaccgatgatgcggcataccattgagaatacgaccgctaacatcagcctcaccgctatcgcgaaccaagcagccatcttgatggggctggacaagggctggcccatctcgaaaatggatataggcgtacctctcctggccttagggtgctacagccaagtcaaccccctgaccctgacagcggcagtgctgatgctcgtggcccactacgccatcatcggccctggcctacaggccaaggcgacccgggaagcccagaagcgcaccgccgccggcatcatgaagaaccccaccgtcgacgggatcgtggccatcgacctggaccctgtggtatacgatgcgaagttcgagaaacaactcggccaaatcatgctactgatactctgcacttcccagatcctgttaatgaggaccacctgggccctctgcgagtccattaccttggccacgggcccgctgactaccctttgggaggggagcccaggcaagttctggaataccaccatcgcggtatcaatggccaatatcttccgcgggtcctacctagcgggcgccggattagcgttttcgctcatgaagtccctcgggggcgggcgccgcgggaccggggcccagggcgagaccctgggcgagaagtggaagaggcaattaaaccagctatccaagagtgagttcaacacctacaagaggtccggcattatggaggtagacagaagcgaggctaaggagggcctgaagcggggcgagacgacaaagcacgcggtctcccggggcaccgccaagttacgctggttcgtggaacggaaccttgtcaagcccgaagggaaggtcatcgacctgggctgcggtcgcgggggatggagctactactgcgccgggctgaagaaggttactgaggttaagggttatacgaaagggggtcccggccatgaagaacccatccctatggccacctatgggtggaacctcgtcaaactgcactccggcaaggacgtgtttttcattccacccgagaagtgcgataccctgttatgcgacatcggtgagtcatcccccaaccctacaatcgaggagggccggacgctacgtgtgctgaagatggtcgagccctggctccgggggaaccagttctgcataaaaatcttaaacccctacatgccctcagtggtggaaaccctggagcaaatgcagaggaaacacggcggaatgctcgtccggaacccgctgtccaggaacagcacccacgaaatgtattgggtgtcctgcgggactggcaacatagtgagcgcggtcaatatgacctcacgcatgttactcaatcgcttcactatggcccaccgcaagccgacttatgaacgagacgtggacctgggagccggcacccgccacgtggccgtcgagcccgaagtggcaaacctggacatcataggccaacggatcgagaacatcaagcacgagcataagagtacctggcattatgacgaagacaacccctataagacatgggcgtaccacgggtcttacgaggtaaaacctagtggctccgccagcagcatggtcaacggtgtcgtcaagctcctcaccaagccgtgggacgtgatcccaatggtgacccagatcgcgatgaccgacactacccccttcggccagcagagagtcttcaaggagaaggttgacaccagaacccctaaagccaagcgagggacggctcaaataatggaggtgaccgcgaaatggttgtggggatttctatcccgtaacaagaagccccgtatctgcacccgggaggagtttacaagaaaggtccggtcgaacgccgccataggcgcagttttcgtggacgagaaccagtggaactctgctaaggaggcggtcgaggacgaaaggttctgggacctggtgcatcgggagcgggaactgcacaaacaggggaagtgcgccacttgcgtttacaacatgatgggtaaacgggagaagaagctcggggagttcggaaaagccaagggttctcgcgccatctggtacatgtggctgggtgctcgattcctggaatttgaggccctcgggtttatgaacgaggaccactggttttcccgcgagaactcactgtccggtgtcgagggggaggggctgcataagctcgggtacattctgcgggacatctctaagataccagggggcaacatgtacgccgatgacacagccggctgggacactcgcatcaccgaggatgaccttcagaatgaggcccgcatcacagacattatggagcctgagcacgcactccttgccaagagcattttcaagctgacctaccaaaacaaggtggtgcgggtacagcgtcctgcgaagaacgggaccgtcatggacgtcattagccggcgcgatcaacggggctccgggcaggtcggtacctacggcctcaacacgtttacgaacatggaggcccagctgatacgccagatggagagcgagggcattttctccccctcggaattagagaccccaaaccttgccgagcgggtgttagattggctggagaaatacggcgtggagcgcctcaagcggatggccatctcgggggacgactgcgtcgtcaagcccatcgatgaccgctttgccaccgccctgacggcactgaacgacatgggcaaggtgcggaaggacattcctcagtgggagcccagcaaggggtggaatgactggcagcaggtcccattctgctcgcaccacttccatcagctcatcatgaaggacggccgtgagatcgtggtgccgtgccgtaatcaggacgagctggtcgggcgcgcccgggtgagccagggggcggggtggagcctgcgcgagacagcgtgcctgggaaaatcctacgctcagatgtggcagttgatgtactttcaccggcgcgacttacggctagccgcgaacgccatctgtagcgcagtgcccgtcgactggatacccacatccaggaccacatggagcattcacgcccatcaccaatggatgaccacagaggacatgcttagcgtctggaaccgcgtgtggatagaagaaaacccttggatggaggacaagacccatatctcgagttggggcgacgtcccctatctggggaagcgggaggaccaatggtgcggcagcctcataggcctgacggcccgcgctacctgggccactaacatacaggtggcaataaaccaggttcggcgcctgatcgggaacgagaattacctcgactatatgacgtcaatgaagcggttcaaaaatgaaagcgaccccgagggcgccctgtggtag

SEQ ID NO: 24283 - RNA, 9879 nt, synthetic construct
  misc_feature 1..9879: note = derived and/or modified CDS sequence (opt11) from DENV-1__FJ898384__SS-prME
  source 1..9879: mol_type = other RNA
agcgttactatgctgctcatgctgatgcccaccgcgctggccttccacttgactaccagaggcggggagccccacatgatcgtgagcaagcaggagagaggcaagagcttactgttcaaaaccagcgccggtgtgaacatgtgcaccctcatcgccatggacctgggcgagttctgcgaggacacgatgacgtataagtgcccccggatcaccgaggcagaaccagacgacgtggactgttggtgcaatgccaccgacacatgggtcacctacgggacctgcagccagacaggggagcacagacgggataagcgatccgtggcgctggcgccccacgtgggactaggcctggagacaagaacagagacctggatgtcgtccgagggtgcctggaagcagatccagcgcgttgagacctgggcgctgaggcaccccgggttcacagttatcgccatttttctcgcgcacgcaatcggcaccagtatcacccaaaaggggattatctttatactgctgatgttggtaaccccctccatggccatgcggtgcgtcggcatcggcagccgcgacttcgtggaggggctgagtggcgccacgtgggtggacgttgtgttggagcacggttcatgcgtgaccaccatggccaaggacaagcccaccctcgacattgagctgctgaagacggaggtcacaaaccccgcggttctccgaaagctttgtatcgaggccaagatctccaacacaaccaccgacagtagatgtccaacccaaggcgaggcgaccctggtggaggaacaggacgccaacttcgtctgtagacggactttcgttgatcgtggctggggaaacggctgtggccttttcggcaaggggtccctgatcacttgcgccaagttcaagtgcgtcaccaaacttgagggaaagatcgtccagtacgaaaacctcaagtacagtgtaatcgtgacagttcacaccggcgatcaacaccaagtgggcaacgagtccacggagcatggcaccactgcgaccatcaccccacaggctcctagcacggagatccagttaaccgactacggcgccttaactttagactgctcaccccggactggcctggacttcaacgaaatggtcctgctcacgatgaaagagaaatcctggttggttcataaacagtggtttctggacctcccgctcccctggacctccggagcctccactagccaggagacctggaaccggcaggacttgctcgtgacgttcaagaccgcccacgccaagaagcaagaggtcgtggtgctgggatcccaggaaggcgccatgcacaccgcccttaccggggcgactgagatccagacgtcaggcaccacaactatcttcgccggtcatctcaagtgtcgccttaagatggataagctgacactcaaggggatgagctacgtcatgtgcacgggttccttcaagctggagaaggaggtggcagagacccagcatggcacggtgttggtccagattaaatacgaaggcaccgatgccccctgcaaaatcccattcagtacccaggacgaaaagggcgtgacccagaacggcagactcattaccgccaacccaatcgtgaccgacaaggagaaaccagtcaatatcgaggccgagccgcctttcggggaaagctacatcgtgatcggtgcgggcgaaaaggccctgaagctatcctggttcaagaaagggagctccataggaaagatgtttgaggcaacagcccgcggggctcggcgtatggcgatactgggcgacaccgcttgggatttcgggtcgatcggcggtgtgtttacgtcagttggcaagctcgtgcatcagatcttcggcaccgcatacggggtactgttcagcggagtatcctggaccatgaagatcggtatcggcgttttactcacctggctgggcttaaacagccgctccacgagtctatccatgacctgcatagcagttgggcttgtcaccctgtaccttggagtgatggtacaggctgactccggttgcgtcatcaattggaagggacgggagctgaagtgcggtagcggaattttcgtcactaacgaggtgcatacatggacggagcagtacaagtttcaggcggattcaccgaaacgcctatctgcagccatcggcaaagcctgggaggagggggtctgcggcatccggagcgccacccgcctcgagaacatcatgtggaagcagattagcaacgagttgaaccatatactgctcgagaacgacatgaagctgaccgtggtagtcggcgatgttgctggcattctggcccaaggtaagaaaatgatccggccccaacccatggaatacaaatattcatggaagtcatggggcaaggcgaagattatcggcgccgacgttcagaataccacgttcatcatcgatgggcccaacacccccgagtgccccgacgaccaacgggcgtggaatatatgggaggtcgaagactacggcttcgggattttcactaccaacatctggctcaaactacgggactcctacacccaggtttgcgaccatcggctgatgtcagccgccataaaggactcaaaggccgtgcacgcggatatgggctactggatcgagagcgagaaaaacgaaacgtggaagctcgcacgggcttccttcatagaagtcaagacatgcatctggcccaagagccatacactgtggtccaacggagttctggagtcggagatgatcataccaaaaatctatgggggcccaatttcccaacacaactaccgacccgggtacttcacgcagaccgccggcccctggcacctcggcaagctcgagctggacttcgacctctgcgagggcaccaccgtggtcgtcgacgagcactgcggcaaccggggaccgagcctacgaacgaccacagtgactggcaagatcattcacgagtggtgctgccggtcctgtacgctgccgcccctaaggttcaagggtgaagacggctgttggtatggtatggagatccggcctgtgaaggagaaagaggagaacctggtaaagtccatggtaagtgctgggtcgggagaggtcgactcgttctccctcggactcctgtgtattagcatcatgatcgaagaagttatgcgttctcggtggagccgcaaaatgctgatgaccgggaccctcgccgtgttcttcctattgataatggggcagcttacctggaacgatttaatcaggttatgcattatggttggcgccaacgcttccgaccgcatgggaatgggaacgacctacctggccctgatggccacgttcaagatgcgcccaatgttcgcggtcggactcttattccggcggctcaccagccgggaggtgttgctcttgacgatcgggctgtccctagttgctagcgtggaactgccgaactccttggaggagctgggcgacgggcttgccatgggcattatgatactgaagttgctgaccgactttcaaagccatcagctgtgggccacgctactgtcgctgacattcatccggacgaccttctctctgcactacgcctggaagaccatggcgatggtcctgtccatcgtaagcctgtttccgctctgcctttcgaccacgagccaaaagaccacctggctacccgtactcctgggctccctggggtgcaagcccctcaccatgttcctgatcgcagagaacaaaatctggggccgcaagtcatggcccctcaacgagggtataatggccgtaggcatcgtcagtatcttgctatcatctctgctgaaaaacgacgttccccttgccgggccgctcatcgccggcggtatgcttatagcgtgctatgtcatttccgggtccagtgccgatttatccctggaaaaggcagctgaggtgtcctgggaggaggaggccgagcacagcggcgcctcccacaacatcctcgtggaggtccaggacgatgggacgatgaaaatcaaggacgaggagcgcgacgatactctgaccattctgctcaaggccaccctgctcgctgtcagtggcgtctacccgttgtccatcccggccactctgttcgtctggtatttctggcagaagaagaaacagagaagcggtgtcctgtgggatacgccctcgccgcccgaggtggagcgcgcagtcctcgacgacggcatctacaggataatgcagcgcggtttgttggggcgtagccaggtgggagtgggggtcttccaagagaacgtgttccataccatgtggcacgtcaccaggggcgcggttctgatgtatcagggcaagcggctcgagccctcctgggcctcagtgaaaaaagatttaatctcctacggtggcggatggcgactacaggggagctggaacaccggggaggaagtgcaggttatcgccgtggaacccggtaagaaccccaagaacgtgcagacggcccccgggacattcaaaacttctgagggcgaggtaggtgccatcgcgctcgatttcaagcctgggaccagtggcagccccatcgttaaccgggaggggaagatcgtgggcctgtacggcaacggggtcgtgacgacctcggggacctacgtctccgccatcgcccaagccaaggcgtcccaggaggggcccttgccggagatcgaggacgaggtgttccgcaagagaaacctgacgatcatggacctgcaccccggtagcgggaagacgcgccgttacctgcctgcgattgttcgcgaggccataaagcggaggctccgcaccctgatactcgcacccacccgggtcgtagcatccgagatggcggaggccctcaagggaatgcccatccgctaccagaccacagcagtcaagagcgaacacaccggcaaagagattgtggaccttatgtgccatgccaccttcaccatgcggctgctcagccccgtccgtgtgccaaactacaacatgattatcatggacgaggcccactttacggacccgtcgtctatcgcggctagaggttacatcagcacccgtgtgggcatgggagaggctgcagccattttcatgaccgcgacgccgccaggcagcgtcgaggccttcccccagagcaatgccgttatacaggacgaggagcgggacattccagagcgttcctggaactccgggtacgaatggatcacggacttccccggcaagaccgtctggtttgtcccatccatcaagagcggcaacgatatcgccaactgcctgcggaagaacggaaagcgcgtgatacagttatcacggaaaacattcgataccgagtaccagaaaacaaagaacaacgactgggactacgtggtcaccaccgatataagcgagatgggcgcgaacttcagagccgaccgagtgatagatccccgcagatgcctaaagccggtcatcttgaaagacggtcctgagagggttattctcgcgggccccatgccagttacggtcgcctctgctgcgcagcggcgtgggaggatcggccgcaaccacaacaaggagggcgaccagtatatttacatggggcagccgctcaacaacgacgaggaccacgcccattggacagaggccaagatgctccttgacaatataaacacccctgagggaataatccccgcgctgttcgagcccgagcgcgagaaatccgccgcaatcgacggggagtaccggttgagaggcgaagcccggaagaccttcgtagagctgatgcgccgcggagacctccccgtgtggctgtcctacaaggtcgcgtccgagggattccagtactcggaccgccgctggtgtttcgacggcgaacggaacaatcaagtgctggaggagaacatggacgtggagatctggactaaggagggcgagcggaagaagctccggccccggtggctggacgcaaggacctacagcgacccactggctctccgggagttcaaggagttcgcggcaggccggcgcagtgtgtccggggacctcattctggagatcggcaagctccctcagcacctgacccagcgcgcacagaacgcattggacaacctcgtaatgctacacaacagcgagcaaggtgggcgcgcgtaccggcacgccatggaggagttacctgacaccattgagactctcatgctgctagcactcatagccgtgttgacgggcggggtcaccctgttcttcctcagtggtcgggggctggggaagacgagcatcggcctgctctgcgtgatggccagcagcgttctcctgtggatggcgtctgtcgagccccactggatcgccgcctcaatcatcctcgagttcttcctcatggtgctactcataccagagccggacagacagcggaccccgcaggacaaccaactggcatacgtggtcatcggcctcctcttcatgatccttaccgtggccgcgaacgagatgggcctcctagagacgaccaaaaaggacttagggatcggccacgtggccgtcgagaatcaccaccacgctgccatgctcgacgtggacctccatcccgcctccgcgtggaccctgtacgcagtggccacgacgataataaccccaatgatgcgccacaccatcgaaaacaccactgccaacatctctctgaccgccatagcaaatcaggccgcgatcctgatggggctggataagggctggccgatcagtaaaatggacatcggtgtccccttgctcgccctgggttgctactctcaggtcaatccactgaccttgacagcggccgtcttaatgctggttgcccactatgccataatcggcccgggattgcaagccaaggctacacgcgaggcccaaaagcggacggccgccggcataatgaaaaaccccactgtcgacggcatcgtagctatcgacctggaccccgtcgtatacgatgccaagtttgagaagcaattaggccagatcatgctcctgattctgtgcacctcccagatccttctgatgcgcacgacatgggccctgtgtgaaagcattaccctcgccaccgggccattaaccaccctgtgggaggggtcccctggcaagttctggaacaccacaatagccgtgagcatggccaatattttccgagggagctacttggcgggcgccggactggctttctccctgatgaagtccctcgggggcgggcgtcggggcacgggggcccagggagaaacgctaggcgagaaatggaagcgacagctcaatcaattatccaagagcgagttcaacacctacaagcggagtgggatcatggaagttgaccggagcgaggcgaaggagggtctgaagcgcggggaaaccacaaagcacgccgtttctcgcggcacagccaagcttcggtggttcgtggagcgcaacctcgtgaaacctgaggggaaggttatcgacttgggatgcggccgcggcggatggagctactactgcgccggtcttaagaaggtgaccgaggtcaaggggtacaccaaaggcggacccggccacgaggagcccatccccatggccacatatgggtggaacctcgtgaagttacactctggtaaggacgtgttcttcatcccgcccgagaaatgcgacaccctcctatgtgacatcggggaaagttctcccaatccgactatcgaagagggccgtactctccgtgtactgaagatggtagaaccgtggttgcgagggaaccaattctgcatcaagatcctcaacccctatatgcccagcgtggtcgagacattagagcaaatgcagcgaaagcacggtgggatgctggtccgcaatcccctctcccgaaacagcacccacgaaatgtactgggtgtcctgcgggaccggcaacatcgtgtccgccgtgaacatgacctccagaatgctgctgaaccgcttcaccatggcgcaccggaagccaacgtacgagcgcgacgtcgacctcggggccggcacccggcatgtagccgtagagcccgaggtagccaacctcgacataattggtcaacggatcgagaacatcaagcacgagcacaagtccacgtggcactacgacgaagacaacccctataagacctgggcgtaccacgggtcctacgaggtaaagcctagcgggagtgccagtagtatggtgaacggggtcgtgaagctactgactaagccatgggacgtgatcccgatggtcacgcagatcgcaatgaccgacaccacgcccttcggccagcagagagtgttcaaagagaaggtggatacccgcactcccaaggccaaacgtgggaccgcccagataatggaggtgacggcgaagtggctatggggctttctgtcccgcaacaaaaaaccgcgaatctgtactagggaggaattcactcggaaagtcagaagcaacgccgccatcggcgctgtgttcgtcgacgagaaccaatggaattccgccaaggaggccgtggaggacgagcgcttctgggacctcgtgcaccgcgagcgggagttgcacaagcaggggaagtgcgcaacttgcgtctacaacatgatgggcaaaagagagaaaaagctgggtgagttcggcaaggccaaggggagccgggcgatttggtatatgtggcttggggcgcgcttcctggaattcgaggctttgggcttcatgaacgaggaccactggttctctcgagaaaattctctctccggcgtggagggggaggggttgcacaagctgggctatatcttgcgtgatatcagcaagatcccggggggcaatatgtacgccgatgataccgcagggtgggacacccggatcactgaagacgacctgcagaatgaggccaagatcacggacatcatggagcccgaacacgcgctgctcgctaagtccatcttcaagcttacctaccagaataaggtcgtccgggttcagcgcccggcgaaaaacgggacggtgatggacgtcatcagccggcgcgaccaaaggggatcaggtcaggtgggcacgtacggcctcaataccttcacgaacatggaagcacagctcattcgccagatggaatctgaggggattttttcccccagcgagctggagacccccaacctggccggccgcgtactcgactggcttgagaagcacggggtcgagcgcctgaagcgcatggcgataagtggtgatgactgcgtggtaaagccaattgacgaccgctttgccaccgcgctcaccgccctgaacgacatgggtaaggtccgtaaggatatcccccagtgggagcccagcaagggctggaatgactggcagcaggtccccttctgctctcatcattttcatcagctgatcatgaaggacggccgcgagatcgtggtaccctgccggaaccaggacgagctcgtagggcgcgctagggtgtctcagggcgcgggctggagcctgcgcgaaacggcctgcctagggaagtcctacgcccagatgtggcagttaatgtatttccatcggcgcgacctgcgtctggcggcgaacgcgatctgcagcgccgtcccggtggattgggtgccaacttccaggaccacgtggagcatccatgcgcaccaccagtggatgacgaccgaagatatgttgtctgtctggaaccgggtgtggatcgaggagaacccctggatggaggataagacccacgtttcttcctggggcgatgtcccctatctggggaagcgcgaggaccagtggtgcgggtccctgatcgggctcaccgccagggcgacttgggccaccaacattcaggtcgccataaatcaggtccggcgccttctggggaatgaaaattacttagattacatgacctccatgaagcgctttaagaacgagtcagacccggaaggggccctgtggtga

SEQ ID NO: 24284 - RNA, 9879 nt, synthetic construct
  misc_feature 1..9879: note = derived and/or modified CDS sequence (opt11) from DENV-1__FJ898385__SS-prME
  source 1..9879: mol_type = other RNA
agcgtgaccatgctgttaatgttaatgccaacggccctcgctttccatcttactacccggggcggggagccccacatgattgttacgaagcaggaacggggcaaaagcctgcttttcaagaccagcgcgggggttaacatgtgtaccttaatagccatggatctgggcgaactatgcgaggacaccatgacctataagtgcccccgcatcaccgaggctgagcctgatgatgttgactgctggtgcaatgccacggatacctgggttacctacgggacctgttcccaaactggcgagcaccggcgtgacaagcggagcgtggccctcgccccacacgtgggcttggggctggaaacaaggactgagacctggatgtcgagcgagggcgcctggaagcagatccaacgggtagaaacgtgggccctccgccaccccgggttcaccgtgatagcccttttccttgcccacgccataggtacgtccatcacccagaaagggataatcttcatcctcttgatgttggtgacgcctagcatggcaatgcggtgcgtgggcataggttcccgcgacttcgtggaggggctctctggtgccacctgggtggacgtagtgctggagcatgggagttgcgtgaccaccatggccaaggacaagcccaccctggatattgagctcctgaagaccgaggtcaccaaccccgctgtgctgcgtaagctctgcatcgaggccaaaatcagcaacacaaccaccgactcccgctgtcccacccagggtgaggccacactgatggaggagcaggacgccaacttcgtgtgccggcgcacgttcgtagaccggggctgggggaatggctgcgggctgttcggcaaagggagcctcattacgtgcgcgaaattcaagtgtgtaacaaaattagagggcaagatcgtgcagtatgagaacctgaagtactccgtcattgtgaccgtgcacaccggagaccagcaccaagtcggcaatgagtccacagagcacgggaccaccgcgacgattacgccccaggcccccacgagtgaaatccagctcacagactacggtgctttaactctggactgcagcccccggacgggccttgatttcaacgaaatggtgcttctgaccatgaaggagaagtcatggttggtccacaagcaatggtttttggacttgccgctcccctggacgtccggggcgtccacctcacaagagacgtggaaccggcaagatctgctagtgactttcaagaccgcccatgcgaagaagcaggaggtcgtcgtactcggcagccaggagggcgccatgcacaccgccctgactggggccaccgagatccaaacctccggcacgacgacgattttcgccggacacttgaaatgcaggctcaagatggataagctgactctgaagggaatgagctacgtgatgtgcaccgggtccttcaagctcgaaaaggaggtcgcggagacgcaacacggcaccgtgctggtgcagatcaagtacgaaggcaccgacgccccgtgcaagatccccttcagcacgcaggacgagaagggggtaacgcagaacggccgcctgataaccgccaatccgattgtgaccgacaaggaaaagcctgtgaatatcgaggctgagccgccgttcggggagtcctacattgttatcggggcgggggagaaggccctgaagcttagctggttcaaaaaggggagcagcataggaaagatgttcgaggccacggcccgcggcgcacggcgcatggcgatcctgggcgacacggcctgggatttcggctcaatcggcggcgtgttcaccagcgtggggaaactcgtccaccagatattcggcacagcctacggggtcctgttctccggcgtcagctggaccatgaagatcgggatcggcgtcctgctgacgtggctcggactgaactctcgcagcacctccttaagcatgacctgtatagcagtagggctcgtgaccctctatctaggcgtcatggtgcaggccgattccggctgcgtgataaattggaagggccgggagctcaagtgcggatcaggcatcttcgtcacgaacgaggtccacacctggaccgaacagtacaaattccaagctgatagcccgaagagactgtccgcggccatcgggaaggcgtgggaggagggcgtgtgcggaatccggagcgctacccgccttgagaacatcatgtggaagcaaatcagcaacgagttgaaccatatccttctggaaaacgacatgaagttcaccgtggtcgtcggcggtgtcgtggggatcctcgcacaggggaagaaaatgatccggccccagcccatggaacacaagtatagctggaagtcatggggtaaggcaaagatcatcggcgccgacgtgcagaacactaccttcatcatcgacggacccaataccccggagtgcccagacgaccagcgcgcgtggaacatctgggaggtggaggactacggatttggaatcttcaccacgaacatctggctgaagctgcgagactcttacactcaagtgtgcgaccacaggctaatgtccgcggccatcaaggacagcaaggccgtgcacgccgatatgggctactggatcgagtccgagaagaacgagacttggaagctggccagggcgagcttcatcgaagtcaagacctgcatatggccgaaaagtcacacactgtggagcaatggggtactcgagtccgagatgatcatccccaagatctacggcgggccaatcagccaacataactaccgccccggatacttcacgcagaccgctggaccctggcatctgggtaagctggagctcgacttcgatctttgcgagggaactacggtggtcgtagacgagcactgcgggaaccggggcccgtctcttcgcaccaccaccgtaacggggaagatcatccacgaatggtgctgccggagctgcaccctgcctccgttgaggtttaagggcgaagatgggtgctggtacggaatggagatccggccggtcaaagagaaggaggagaacctggtgaagtccatggtgagcgccggcagcggggaggttgactccttctccctcggcctgctgtgcatctctatcatgatagaggaggttatgcgtagccggtggagccgcaagatgctcatgaccgggaccctagccgttttcctgctccttatcatggggcaattgacttggaacgatctcattcggctgtgtatcatggtcggggctaacgcaagtgatcgaatgggcatgggcaccacctatctggccttaatggccacgttcaagatgcgccctatgtttgccgtagggctgctgttcagaagactcacgtcccgggaggtactgctgctcactatcgggctgtcactggtcgcctcggttgaactccccaacagccttgaggagctgggcgacggcctcgccatggggattatgatcctaaagctattgactgactttcagagtcaccagctgtgggcgaccctgctcagcctaacgttcatcaagaccaccctatccttacactacgcctggaaaaccatggccatgatcctaagtatcgtctccctgtttcccctttgtctcagcacgacctcgcagaagaccacctggctgcctgtgctactggggtcgttaggatgcaagccgctcacgatgttcctaatagcggagaacaaaatctggggtcggaagtcctggccgctgaacgagggcattatggcagtgggggtggtgagcatccttttaagctccttgcttaagaacgacgttcccttagccggacccctgatcgccggcggcatgctcatcgcctgctacgtcataagcggctctagcgctgacctgtctctagagaaagccgccgaggtgagctgggaggaagaagcagagcactccggggccagccataacatcttggtggaagtacaggacgatggaaccatgaagatcaaggacgaagagcgggacgacaccctgactatcctgctcaaggcgaccctgctagctgtgtccggggtgtaccccctcagcatacccgctacgctgttcgtctggtatttctggcagaagaagaaacagcgatcgggggtgctgtgggacaccccctccccgcccgaagtggaacgagccgtcctggacgatggcatctaccgcatcatgcagcgggggctactgggacgatcccaagtgggtgtgggggtcttccaggagaacgtgttccacacgatgtggcacgttacccgtggggctgtcctgatgtatcaggggaagcgattggagccaagctgggcgtcagtgaagaaggacctaatttcctatggcggggggtggcgcctgcaggggtcctggaacatgggcgaggaggtacaagtcatcgccgtggagcccgggaagaaccccaaaaacgtacagacagcccccggaactttcaagacccccgagggcgaggtaggcgcgattgctctcgatttcaagccgggcaccagcgggagccccattgtcaaccgtgaaggcaagattgttggtctgtacggtaacggagtcgtgacgaccagcggaacctatgtgtcggcaatcgcccaagccaaggcctcccaggagggcccgctccccgagatagaagacgaggtcttccgcaaacgcaacctcaccatcatggatttacacccggggagtggcaagacgcggagatatctcccggcgatcgtgagagaagctatcaagcgcaagctccggacactgatcctggcacccacccgcgtggtggcctccgagatggcagaggcgctcaagggcatgcccatccgctaccagactacagccgtaaagagcgagcacaccggtaaagaaatcgtggacctgatgtgccacgcaactttcacaatgcgactgctctcccccgtccgagtgccgaactacaatatgataataatggacgaggcccacttcacggaccctagctccattgccgcacggggctacataagcacgagagtggggatgggcgaggccgccgcgatcttcatgaccgccacgccgccggggtcggtcgaagccttccctcagagcaatgccgtgatacaagacgaggaacgtgacatccctgagaggtcctggaactctggctacgagtggatcacggacttccccggcaagacagtgtggttcgtccccagtatcaagagcgggaacgacatcgccaactgcctgcggaaaaacggcaagagggtgatccaattgtcgcggaagactttcgacacggagtatcagaagacgaagaacaacgactgggactacgtggtcacgaccgacataagcgaaatgggggctaacttcagagcggaccgagtcatcgacccgcgccgctgcctaaaacctgtgatcttgaaggacgggccagagcgcgtcatcctagctggccccatgcccgtaaccgtcgctagcgccgctcagcggcgcgggcggatcggccgcaaccataacaaggagggggatcaatacatctacatgggccaaccgctcaacaacgacgaggaccacgcgcactggacggaagccaagatgctgctggacaacataaatactccggagggcatcattcccgccttgttcgagcctgagcgggagaagagtgccgctatcgatggcgagtacaggttgcgcggggaggcgcggaagaccttcgtggagctgatgcgccggggcgacctccccgtgtggctgtcctataaggtggcttctgagggctttcagtactcagacagacggtggtgcttcgatggggagaggaacaaccaggtactggaggagaatatggacgtagagatctggaccaaggagggcgagcggaagaagctccgcccccgctggctggatgcacgcacgtactctgatcccctggcgctcagagagtttaaggagtttgcagcggggaggcggtcggtctcaggcgaccttatcctggagattggcaagttgccgcagcatctgacccagcgggcccaaaacgctctggataacctcgttatgctccacaacagcgagcagggcgggcgggcctaccgccatgccatggaggagctgccggacaccatcgagaccctcatgctgctggccctcatcgccgtgctgaccgggggagtcaccctgttctttcttagcgggcggggcctaggcaagacgagcatcgggttattgtgtgtgatggcctcctccgtgctcctgtggatggcctccgtcgagcctcactggatagcggccagcatcatactcgagttcttcttaatggtgctgctcatcccagagccggatcgccagcggactccccaggacaatcagctcgcctacgtggtcatcggcctcctcttcatgatactgaccgtcgctgccaacgagatgggcctgctcgagacgaccaagaaagacctgggcatcggccacgtggcagttgagaaccaccaccacgcaaccatgttagatgtggacctccaccccgcctccgcttggacgctgtacgccgtggcgaccaccatcatcactccgatgatgcgtcacaccatcgagaacactactgccaacatctctttgaccgccatcgccaatcaagctgcgatcttaatgggactcgacaaaggctggccaatcagcaaaatggacatcggagtccccctcctcgccttaggttgctacagccaggttaaccctctcaccctcacggctgcggtgctgatgctggttgcgcactatgcaatcatcgggccgggcttacaggccaaggccacgcgggaggcccagaagcggaccgcggccgggattatgaagaaccccacggtggacggcatcgtggcaatagacctggaccccgtcgtgtatgacgcaaagttcgaaaagcagctgggccaaatcatgctcctgatcctctgcacgtcccagatcttactgatgcgcaccacctgggcgctgtgtgaaagcatcaccctcgcgacggggcccctgaccaccctctgggaaggaagccctgggaagttctggaacaccacgatcgctgtgtctatggccaacatcttccggggctcatacctcgccggcgccggactggcttttagcctgatgaagtccctcggtgggggacgccgcgggaccggcgcacagggcgagacactgggggagaaatggaagcggcagctgaatcaactctccaagtccgagtttaatatctacaagcgctccgggatcatggaagtggaccgcagcgaggcaaaggaggggctgaagagaggcgaaaccactcgccacgccgtgtcccgcggcaccgcgaaactgaggtggttcgttgagaggaacttagtcaagcccgagggcaaagtgatcgacctgggatgcgggcggggcggttggagctactactgcgcgggactgaagaaggtaaccgaggtcaaagggtacaccaaaggcggacccgggcacgaggagcccatcccgatggcgacgtacggctggaacctggttaagttacactccgggaaagacgttttcttcacgcctcccgagaagtgcgatacactgctgtgcgacataggagagagctccccgaaccctaccatcgaagaggggcggacacttcgcgtcttgaaaatggtggagccttggctgcggggtaaccagttctgtattaagatcctcaatccatacatgccctcggtggttgaaacccttgagcagatgcagcgcaagcacggtgggatgcttgtgcgcaacccgctctcccgcaactcaacccacgagatgtactgggtgtcctgcggcacaggaaacatcgtgagcgccgtcaacatgacgtcaaggatgctgctgaaccgctttacgatggctcaccgcaagccaacctatgagagggacgtagacctaggcgcgggcacccgccacgtcgcggtcgagcccgaggttgccaacctcgacataatcggacagcggatcgagaacatcaagcacgagcacaaaagcacctggcattacgacgaggacaacccctacaagacgtgggcctaccatggttcatacgaggttaaaccgagcggctccgccagcagcatggtcaacggcgtagtcaagctgttaacaaagccttgggatgttatccccatggtcactcagatcgcgatgactgacacgacgccatttggacagcagcgcgtattcaaggagaaggtggacacccgaaccccgaaggccaaacgcggcacggcccagatcatggaagtcacggcccggtggctctggggcttcctgtcccgcaacaagaagccccggatttgcacccgcgaggagttcacccggaaggtccgcagcaacgctgcgatcggggctgtgtttgtcgacgagaatcagtggaactctgccaaggaggctgtggaggatgagcggttttgggacctcgtacagaaggagcgcgaactgcacaagcaggggaagtgcgcgacgtgcgtctacaatatgatggggaagcgagaaaaaaagctgggcgaattcgggaaggccaagggctctcgagccatctggtatatgtggctgggcgcccgattcctggagtttgaggccttggggttcatgaatgaagaccattggttctccagagagaacagtctatccggcgtggaaggggaaggcttacacaagctggggtacatcctccgggacatatctaagatccccggcggcaacatgtacgcggacgacactgccgggtgggacaccagaataacggaggacgatctgcagaacgaggccaagatcacagacatcatggagccggagcacgccctgttagccacctccatctttaagctgacttaccagaacaaggtggtccgggtccagcggcccgctaagaatggcaccgtgatggatgtcatcagcaggcgcgaccagcgcgggtccggtcaggtggggacgtacgggcttaacaccttcacaaatatggaggcgcagctcattcggcagatggagagcgagggcatcttctccccaagcgagctggaaatccccaacctagccgagagggtgctcgactggctggagaagtatggggtcgaacggctcaagcggatggcaatcagcggtgacgactgcgtggtgaaaccgatcgacgatcggttcgccacggcgctcacggcactgaatgatatggggaaagtacgcaaagacgtccctcagtgggagccctccaagggctggaacgactggcagcaggtccccttctgctctcaccacttccaccaattaattatgaaggatggccgggagatcgtcgtgccgtgccgcaaccaggacgagctcgtggggcgggcccgcgtctcccagggcgcgggatggagcctgcgagagaccgcgtgccttggaaagtcgtacgcgcaaatgtggcagctgatgtacttccacaggcgggatttacgcctggcagccaacgccatctgcagcgcggtgcctgtagattgggttcccaccagccggacaacgtggtctatccacgcccaccaccaatggatgaccacggaggacatgctgtccgtgtggaaccgcgtgtggatcgaagaaaatccctggatggaggataagacccatgtgagctcctggggcgacgttccttacctgggcaagcgggaggaccagtggtgcggcagcctcatcgggctcactgcccgcgccacatgggcctccaacatccaagtggctataaaccaggtacgacggttgatcggcaacgagaattatttagactacatgacatccatgaagcgcttcaagaacgaaggggacccggagggcgccctctggtga

SEQ ID NO: 24285 - RNA, 9879 nt, synthetic construct
  misc_feature 1..9879: note = derived and/or modified CDS sequence (opt11) from DENV-1__GQ868608__SS-prME
  source 1..9879: mol_type = other RNA
tcggtgacgatgctgctgatgttgatgcccaccgcattggccttccacctcaccacccggggcggggagccccatatgatcgtctcaaaacaagaacggggcaaaagcctgctgttcaaaacctccgcgggagtgaacatgtgcacgctcatcgcgatggacctgggcgagttctgcgaggacacaatgacctacaagtgcccccgcatcaccgaggccgagcccgacgatgtcgactgctggtgcaacgccaccgacacttgggtcacctacggtacctgtagccaaactggtgagcaccgtcgggacaagcggtccgtggccctcgcgcctcacgttgggctcgggctagagacgcgaaccgagacctggatgagctccgagggggcctggaaacagatccagcgcgtcgagacctgggccctgcgccaccccgggtttacggtgatcgccctcttccttgcgcacgccatcggcactagtatcacccagaaagggatcatcttcattctcctcatgctggttacaccctccatggccatgcgatgcgtaggcatcggcagccgcgatttcgtggaagggctgtccggcgccacttgggtggacgtagtgctcgagcacgggagctgcgtgaccaccatggccaaggacaagcccaccctagacatcgagctgctcaagacagaggtcaccaatcctgcggtgctgcggaagctgtgcatagaagccaagatctccaatactaccacggacagcaggtgccccacccagggcgaagccacccttgtggaggagcaggacgccaacttcgtctgcagacgaaccttcgtggatcggggctggggcaacggctgcgggctgttcggcaaggggtcgttgatcacgtgcgccaagttcaagtgcgtgaccaagctcgagggcaagaccgtccagtacgagaacctgaagtacagcgttatagttaccgtccacactggcgaccagcaccaggtaggtaacgagtcgaccgagcacggcaccactgcgactatcacgccccaggcccccagcacagaaatccagctcaccgactacggggccctcactctagattgtagccccagaacgggcctggacttcaatgagatggtcctcctcacgatgaaggagaaggcctggctggtgcacaagcaatggtttttagacctgccgctgccctggaccagcggggcgagcaccagccaggagacgtggaaccgtaaggatctcctggtgaccttcaagaccgcgcacgccaaaaagcaggaagtcgtggtgctgggtagccaggaaggcgccatgcacaccgcgctcaccggggctactgagatccagacctccggcacaaccactatcttcgctgggcacctgaaatgccgcctcaagatggacaagctcaccctgaagggcatgtcttatgtcatgtgcaccgggtcctttaagctggagaaggaggtggccgagacgcaacatggcaccgtactcgtccagatcaagtacgagggtaccgatgccccctgtaaaatacccttcagcacgcaggatgagaagggggtgacacagaacggtcggctcatcactgccaaccccattgtgaccgacaaggagaaacccgtcaacatcgaggccgagcccccgttcggggagtcttacatcgtgatcggcgccggcgagaaggccctgaagctgagctggtttaaaaaggggtcctccattggcaaaatgttcgaggccactgctaggggtgcgcggcgcatggccatcctcggcgacacagcctgggacttcggatccatcggaggagtcttcaccagcgtcgggaaacttgtgcaccagatcttcggtacggcctacggggtactgttctccggcgtctcctggaccatgaaaatcggaattggcgtcctcctgacgtggttaggcctcaactcccgatcaacctccctgtcgatgacgtgcatcgccgtggggctagtcaccctgtaccttggcgtcatggtgcaagctgactcagggtgcgtcataaactggaagggccgggagctgaagtgcgggtcgggcatcttcgtgacgaatgaggtgcacacctggaccgaacagtataagtttcaggcggacagccctaagcgcctctcggcagccatcggcaaggcctggaaggagggggtctgcggcatcaggagcgccacgaggctcgagaatataatgtggaagcagatttccaacgagctgaaccacatactcctggagaacgacatgaagttcaccgtcgttgttggggacgtggcaggcatcctggctcaggggaagaagatgatccggccccagccgatggagtacaagtatagctggaagtcctggggtaaagccaagatcatcggtgccgacgtgcaaaacgctaccttcatcatcgacgggcccaacaccccggaatgcccggacgatcagcgagcctggaatatctgggaggtcgaagattacggctttgggatcttcaccaccaacatatggctcaaactgcgggattcttatactcaggtgtgcgaccatcgcctgatgtccgcagcgatcaaggattctaaagcggttcacgcagatatgggctactggatcgaatccgagaaaaacgagacgtggaagcttgctcgcgccagctttatcgaggtcaagacctgcatttggccgaagtcccacaccctgtggagcaacggcgtgctagaatccgagatgatcatacccaagatctatgggggcccgatcagccaacacaactatcgccccgggtacttcacgcagaccgccggtccctggcacctcgggaagctggagttagactttgacctctgcgaaggcaccacggtggtcgtggatgagcattgcggcaatcgggggccaagtctgcgcaccaccaccgtgaccggcaaaatcatccacgagtggtgttgccggagttgcacgctgccgcccctacgcttcaagggggaggacggctgctggtacgggatggagatccggccagtcaaagagaaagaggagaacctcgtgaaatccatggttagcgcgggcagcggcgaagtcgactccttcagcctggggctcctatgcatctccatcatgatcgaggaggtgatgcgcagccgttggtcacgcaaaatgctgatgaccggcaccctggccgtgttcttcctgctgatcatggggcagctcacttggaacgatctgataagactgtgcattatggtaggcgcaaacgcatcagaccgcatggggatgggaacgacgtacctcgccctgatggcaaccttcaagatgaggccgatgtttgccgtgggactactgttccgccgcctgaccagtcgggaggtcctgctactgacgatcgggttgagcctcgtcgccagcgtggagctacccaacagcctggaagagctcggcgacgggctggccatgggcatcatgatcctgaagctcttgaccgacttccaatcccaccagctttgggcgaccctcttaagcctaacgtttatcaagacaaccttttcgctacactacgcttggaaaacgatggccatggtgttgagtattgtgtccctctttcccttgtgcttatccactacgtcccaaaaaaccacatggctgcccgtcctcctgggcagtctaggttgtaagccgctcacgatgttcctgatcgccgagaacaaaatctggggacgtaagtcctggcccctgaacgaggggattatggcggtcggcatcgtgtctatcttgctgagttccctgctgaaaaacgatgtgccccttgccgggcccctgatcgccggcggcatgctgatcgcctgctatgtcataagcgggagtagcgccgatctgtccctggagaaggccgcggaggtaagttgggaggaggaggccgaacactcaggcgccagccacaacattctcgtggaggtccaagacgacgggacgatgaagatcaaggacgaggagcgggacgacatgctgaccatcctgctcaaggccaccttgctggccgtgtctggcgtttaccctctcagcatccccgcgacccttttcgtgtggtacttctggcagaagaaaaagcagcgctccggtgtgctgtgggacacaccctcgcctcccgaggtggaacgggcagtcctggatgacggtatataccgcatcatgcagcgggggcttctggggagatcgcaggttggcgtgggggtcttccaggagaatgtgttccacacgatgtggcacgtgaccaggggcgctgtcctgatgtaccaagggaagagactcgaacccagctgggcttccgtgaagaaggacctcatctcatacggcggcgggtggagactgcagggctcctggaacaccggggaagaggttcaggtcattgccgtggagcccggcaagaaccccaagaacgtgcagaccgcgcctgggaccttcaagacgagcgagggagaggttggcgccatcgcgctcgactttaagcccgggacctccggctctccgatcgttaatcgcgaggggaagattgtgggattatacggcaatggggtggtgaccactagcggcacttacgtgtccgccatcgcacaagctaaggctagtcaggaggggcccctgccggagatcgaggacgaagtcttcagaaagcgcaatttaaccatcatggacctgcaccccggctccgggaagacccggcgctacctccctgccatcgtgcgggaagccatcaagcggaagctccgaaccctgatactggcgccaacaagggtggtcgccagcgagatggccgaggccctcaagggcatgcccatcagatatcagacaactgctgtgaagtccgagcacacgggcaaggagatcgtggaccttatgtgccatgctactttcacgatgcggttactcagccccgtccgggtgcccaactataacatgataatcatggacgaggcccacttcacagacccgtccagcatcgccgcccgggggtacatctccacgcgcgtggggatgggggaggccgctgcgatattcatgacggccacaccaccgggctcagtcgaagccttcccacagtccaacgcggtgatccaggacgaggagcgggacatccctgagcgctcttggaactccgggtacgagtggataaccgacttccccggcaaaacggtctggttcgtcccatcgattaagtccggcaacgatatcgccaactgtctgcggaaaaatgggaaaagagttattcaactgagcagaaagacgttcgacactgagtaccagaagacaaagaacaatgactgggactatgtggttacgactgacatatccgagatgggcgccaactttcgagccgatcgggtaatcgatcctcgccggtgcctcaagcctgtgatccttaaggacgggcctgaacgcgtcatcctggccggccccatgcccgtcaccgtcgcgagcgcagcccaacgtcgcggtcggatcggccggaaccacaacaaggagggcgaccagtacatctacatggggcaacctctcaacaacgacgaagatcacgcccactggaccgaggctaaaatgctcctggataacataaacacccccgaaggcattatccccgccctcttcgagcctgagcgagagaagtcggcagctatcgacggtgagtaccgtctgagaggcgaggcccggaagacattcgtcgagctgatgcgccgcggggacctcccggtatggctgagctataaagttgcctctgagggcttccagtatagtgaccgccggtggtgtttcgatggcgagcgtaacaaccaggtgctggaggaaaacatggacgtggaaatctggacaaaggagggggaacggaaaaagttgcgaccccggtggttagacgcgcgcacctattcagaccccctggccctccgagagttcaaggagttcgccgcaggccggcggtccgtcagcggggacctcatcctggagattggaaagctcccccagcacttaacgcagcgcgcgcagaacgccctggataacctagttatgctgcataattccgaacagggcgggcgggcctaccgccacgcgatggaggagctgccggataccatcgagacattaatgttactggccctcattgcggtgctgaccggcggggtcacattgttcttcctcagcggccgagggctgggcaaaacctcaataggcctgctctgcgtgatggcttcttccgtgttattatggatggccagcgtggagccacactggatcgccgcttccatcatccttgagtttttcctgatggtgctgctaatacccgagcccgaccgccagcggactccacaggacaaccagctggcctacgtggtaattggtctcttattcatgattctgaccgtggctgcgaacgagatgggcctgctagagaccacgaaaaaggatctggggatcggtcacgttgccgtcgagaaccaccaccacgccgcgatgctggatgtagaccttcaccccgccagcgcatggacgctgtacgccgtcgccacgaccataattactcccatgatgcgccacaccatcgagaataccaccgcgaatatttccctgacggcgatcgccaaccaggccgcgatcctgatgggcttagacaagggctggccaatttcaaagatggacataggtgtccccctgctcgctctggggtgttattcccaggtgaatcctctcaccctcactgctgccgtgctgatgctggttgcccactacgcaatcattggccccgggctccaggccaaggccacccgggaagctcagaagcgcacggcggcaggcatcatgaagaacccgacagtggacgggattgtggcgatagacttggaccccgtcgtgtatgacaccaaattcgagaagcaactgggccaaatcatgctgctgatcctgtgcaccagccagattctcctgatgcgcacgacctgggcactgtgcgagtccatcaccctggccacagggccgctgacgactctatgggaggggagccctggcaagttctggaacaccaccatcgccgtctccatggccaatatattcagagggtcatacctcgccggcgctggtctggccttcagcttaatgaagtcgctcgggggcggtcgacgaggtacgggggctcagggcgagaccctgggcgagaagtggaaacgccagctgaaccagctgtctaagtccgagttcaacacatataagcggagcgggataatggaggtcgataggtccgaggccaaggaaggcctgaaacgcggcgagaccacgaagcacgcagtgagccgaggtaccgccaaactgcggtggtttgtggagcgcaacctcgtcaagccggaggggaaagtcattgacctgggctgcggcaggggtgggtggtcgtactactgcgccgggctgaagaaagttacagaggtcaaagggtacacaaagggcgggcccgggcatgaggaacccattccgatggcaacgtacgggtggaacctggtgaagctacactctggcaaggacgtgtttttcatcccgcccgagaagtgcgacaccctgctatgcgacatcggagaaagcagccccaaccccacaatcgaagaaggccgcaccttgcgggtcttaaagatggtggagccgtggctgcgcggaaaccaattttgcatcaagatcctcaacccctacatgccctccgtggttgaaactcttgagcagatgcagcggaagcacgggggcatgctggtgagaaaccctctcagccggaactccacacacgaaatgtactgggtgagttgcgggaccggcaatatcgtctccgccgtgaacatgaccagccgcatgctgctgaaccggttcaccatggctcatcgcaagccgacgtacgagcgagacgtggatctcggggccggcacgcggcacgtagctgtggagccagaggttgcgaacctcgatattatcggccagcgcatcgagaacatcaagcacgagcacaagtcaacctggcactacgatgaggacaacccctacaagacctgggcctaccatgggtcctatgaggttaagccctccggcagcgccagctccatggttaacggggtcgtgaagctgctcactaagccgtgggatgttatccccatggtcacccagatcgccatgaccgacacgacgcccttcggccagcaacgagtgttcaaggaaaaggtggacacccgcaccccaaaagccaaaagggggaccgcgcagataatggaagtcacggcaaaatggctgtggggctttctgagcaggaataagaagccgaggatctgcacccgcgaggagttcaccagaaaggtacgctcaaacgcggccatcggcgcagtcttcgtcgacgagaaccagtggaacagcgctaaggaagcagtggaggacgagcggttttgggacctcgtgcacagggagcgagagttacacaagcagggaaagtgcgcgacctgcgtctataacatgatggggaagcgcgaaaagaagcttggggaatttgggaaggccaagggctcccgggcgatttggtatatgtggctcggcgcacgctttctggaattcgaggccctgggctttatgaacgaggaccattggtttagccgcgagaactcattaagcggggtcgagggcgagggactgcacaaactgggctacatcctacgagacatctcgaagataccggggggcaacatgtatgccgacgacacggccgggtgggacacaagaatcaccgaggacgacctgcagaacgaagctaagatcacagacatcatggagccagagcacgccctgctcgccaagagcatcttcaagttaacctaccagaataaggtggtccgggtgcagcggccggcgaagaacggcaccgtcatggacgtcatctcaagacgtgaccaacgcggaagcggccaggtgggcacgtacggcttgaacacgttcaccaacatggaagctcagctcatccgccagatggagtccgaggggatcttcagcccctccgagctggagaccccaaacttggcgggccgcgtactcgattggctggagaagcacggggttgaacgcctgaaacggatggccatcagtggcgatgactgcgtggtcaagccgatcgacgaccgcttcgccaccgctctcactgccctgaacgacatgggaaaggtgcggaaggatatcccgcagtgggagccctcgaagggctggaacgactggcaacaggtcccattctgtagccaccacttccaccaactgatcatgaaagacggccgcgagatcgtagtcccctgccggaaccaagacgagctcgttgggcgggcgcgagttagccagggcgccggctggtcccttcgcgagaccgcctgccttggcaagtcatacgctcagatgtggcagctcatgtacttccatcggcgcgacctgagactggccgccaatgctatctgttccgccgtgccggtggactgggttcccacgtcgcgcaccacttggtctatacacgcacatcaccaatggatgactactgaggacatgctgtcggtatggaaccgggtgtggattgaggagaacccctggatggaggacaagacccacatatcttcgtggggcgacgtgccctatctgggaaagcgggaagaccaatggtgtggatccctcatcggccttaccgcgcgggctacctgggccaccaacatccaggtggccattaaccaggtgcgccgcctgatcgggaacgagaactacctggactatatgaccagcatgaagagattcaaaaacgagatcgacccggagggggcattatggtaa

SEQ ID NO: 24286 - RNA, 9879 nt, synthetic construct
  misc_feature 1..9879: note = derived and/or modified CDS sequence (opt11) from DENV-1__GQ199774__SS-prME
  source 1..9879: mol_type = other RNA
agcgttaccatgctgcttatgctgatgcccaccgcccttgcctttcacctcaccacccgtggcggggaaccccatatgatcgtttccaagcaagaacggggcaagagcctgctgttcaagacgtccgccggtgtcaacatgtgcaccctgatcgccatggacctgggcgaactgtgcgaggacaccatgacctacaagtgccccaggatcaccgaagtggagcccgatgatgtcgactgttggtgcaacaccactgacacctgggtgacctacgggacgtgcagccaaacgggcgagcaccggagggacaaacggtccgtggccctcgcgccccacgtcggtctggggctggagacccgggccgagacttggatgtcatccgagggcgcgtggaagcagatccagaaggtggaaacctgggccctccggcaccccgggttcacggtgatcgcccttttcttggcgcacgcgatcgggaccagcataacccagaaggggattattttcatccttctgatgctggtcaccccctccatggccatgcgctgcgtgggtataggtagtagggattttgttgaggggctctccggtgccacgtgggtcgacgtggtgctcgagcacgggagctgcgtcacaaccatggccaaggacaagccaaccctggacatagagctcctgaagacggaggtgaccaatcccgccgtgctgcgcaagctctgcatcgaggcgaagattagtaacaccaccacggatagccggtgcccgacccagggggaggccaccctggtagaggagcaggacgctaatttcgtgtgccgccggaccttcgtggaccgcggctgggggaacggttgcggcctgttcggcaaggggtctctcatcacatgcgcaaaattcaagtgcgtcaccaagctggagggcaagattgttcagtacgagaacctgaagtatagcgtgattgtcactgtgcacaccggcgaccagcaccaggtcgggaacgagtccacggagcacggtacgatcgcaacaattacgccacaggcgcccaccagcgagatccaactgacggactacggtgccctgaccttggactgcagcccccggaccggcctcgacttcaacgagatggtgctgctgacgatgaaggagaagtcctggctcgttcacaagcaatggttccttgacctgcctctcccctggacgagcggggcgagtaccagccaagaaacttggaacaggcaggatctgttagttaccttcaagacggcccacgccaaaaagcaggaagtcgtagtcctaggctcacaggagggcgcaatgcataccgccctcacgggggctaccgagatccaaacaacaggcacgaccacgatcttcgcagggcatctgaagtgccggctcaagatggacaagctgaccttaaagggcatgagctacgtgatgtgcaccgggtcattcaagctcgagaaggaggtagccgaaactcagcacggtacggtcctggtgcagatcaaatatgagggaactgatgcgccctgcaagatcccgttcagcacacaggatgagaagggggtgacccaaaatggccgcttgatcactgccaacccgatcgtcaccgacaaggagaagccggtaaatatagaagccgagccgcccttcggggagagctacatcgtgattggcgccggcgagaaggcgctcaagctgagctggttcaagaagggttcgagcatcggtaagatgtttgaagcaaccgcccgcggtgcacgccggatggctatcctaggcgacaccgcgtgggacttcggatccatcggcggagtattcacgagcgtaggtaagctggtgcatcagatcttcggcactgcctacggtgtcctattctccggcgtttcgtggaccatgaagatcgggatcggcgtgcttctgacctggctcggactgaactcccgcagtacgtccctgagtatgacttgcatagccgtcgggctcatcaccctgtacctgggggtgatggtgcaggccgacagtgggtgcgtaatcaactggaaaggccgcgagctcaaatgcggctccggcatcttcgtgaccaacgaggtgcacacgtggaccgagcagtacaagtttcaggccgacagcccgaagcgtctgtccgcggccatcggcaaggcgtgggaggagggcgtctgtggcatccgcagtgctactaggctggaaaacatcatgtggcgccagatttccaacgagctgaaccacatactgctggagaacgacatgaagttcaccgtggtggtcggggacgtggtcgggatcctcgcccaggggaagaagatggtcaggccccagcccatggagcacaaatacagctggaaatcctgggggaaggcgaaaatcatcggtgccgacgtccagaacaccacgttcatcatcgacggacctaacaccccggaatgccccgacgatcagcgcgcctggaacatctgggaggtggaggactacggcttcgggatctttacaactaacatctggctcaagttacgagatagctacacgcaggtctgcgaccatcggctgatgagcgctgcgatcaaggacagcaaggccgtgcacgcggacatgggctactggatagagagcgagaagaacgagacctggaaactggcccgggcgagctttatcgaggtcaagacttgcatctggcccaagtcccacaccctgtggtcaaacggagtgcttgagtccgagatgatcatccccaaaatctacgggggcccgatttcacagcataactaccggcccgggtacttcacgcagactgcaggcccgtggcaccttgggaagctggagctcgacttcgacttgtgcgagggcactaccgtcgtcgtcgacgagcactgcggcaaccggggaccgtccttacgcacaaccaccgtgaccggcaagatcatccacgagtggtgctgtcggtcgtgcacgttgccgccacttcgcttcaagggggaggacggctgctggtacgggatggaaatccggcccgttagagaaaaggaggagaatctggtcaagtccatggtgtcagccggcagcggcgaggtagactcctttagcctcgggctgctttgcatatccatcatgatcgaggaggtcatgcggagccgctggagtcggaagatgctcatgaccggcaccctggccgtgttctttctgctcatcatgggacagttgacctggaacgacttgatccgcagttgcatcatggtgggcgccaacgcctccgaccgcatgggcatgggcacgacctacctcgcgctgatggccactttcaagatgcggccgatgtttgcagtcgggttactgttccgcagactgacaagtcgggaggttctgctcctgacaattggtctgtccctcgtggccagtgtggaattacccaactccctggaggagctcggcgatgggttggccatgggcatcatgatcctgaagctcctgaccgacttccagagctaccagttatgggcgacgctcctgtccctgaccttcatcaaaacaaccttcagcctccactacgcttggaagaccatggccatggtgttatccatagtaagcctgctacccctgtgcttatcgacaactagccagaaaaccacatggttacctgtgctgctaggcagtctcggctgcaagccgctgaccatgttcctgatcgcagagaacaagatctggggccggaagtcctggcccctcaatgagggtataatggcggtgggcattgtctcaatcctgctgtcctcgctcttgaagaacgacgtgcccctggcaggtcccctcatagccggcggaatgctcatcgcatgctatgtcatctcaggcagctccgccgacctctctctcgagaaggcggccgaggtctcctgggaggaggaggccgaacacagcggcgcctcacacaacatccttgtggaggtgcaggacgacggaacaatgaagattaaggacgaggagcgcgacgacaccctcaccattctcctgaaggccaccttgctcgcagtctcgggcgtgtatccgctgtccattcccgcaaccctgttcgtgtggtatttctggcagaagaagaagcaacggagtggggtcctctgggacacgccaagcccgcccgaggtggagcgcgccgtgttggacgacggcatctaccggatcatgcagcggggtctgctggggcggtcgcaagtcggcgtgggggtgttccaggagaatgtcttccacaccatgtggcacgtgactcgtggggccgttctcatgtaccaggggaaacggctggagccttcctgggccagcgtcaagaaggacctgatctcctacggtggagggtggcgcctccaaggtagctggaacaccggagaagaggttcaagtgatagctgtcgaacccgggaagaaccccaagaacgtccagactgcccccgggaccttcaagacccccgagggtgaagtcggcgcgatcgccctggactttaagcccgggacctcaggctcgcccatcgtcaatcgggaggggaagattgtgggcctgtacggcaatggggtagtcacgacctccggcacctacgtgtccgccatcgcgcaggccaaagccagccaggagggaccgctccccgagatagaagatgaggtgttcaggaagcggaacctgaccatcatggacctgcacccgggatccgggaagacgcgtcggtacctcccggccatcgtccgcgaggcaatcaagcggaaactccgcaccctaatcctcgccccaacccgcgttgtagccagcgagatggccgaggcgctgaagggcatgcccataaggtaccagaccacggccgtcaaatcagagcacaccggccgcgagattgtggacctgatgtgtcacgccacgttcacgatgcgtctcctgagccctgtgcgcgtcccgaactacaatatgatcattatggacgaggctcacttcactgacccctcgagcatagccgcccgggggtacatcagtacacgcgtgggcatgggggaagcggcagccatcttcatgacagccacgccgccaggctctgtggaggccttcccgcagtccaacgcggtaatccaggacgaggagcgggacatccccgagcgcagctggaacagtgggtacgagtggattacggactttcccggcaagaccgtgtggtttgtgcccagcatcaagtccggcaatgacatcgcaaactgcttacggaagaacgggaagcgcgtcatccagttaagccgaaagactttcgataccgaataccagaagacgaaaaacaacgactgggactacgtggtgaccactgacatctccgaaatgggcgcgaacttccgcgccgaccgggtgatcgatccacgccggtgcctgaagccagtaatcctgaaggacgggccggagcgcgtcatcctcgcggggcccatgccggtaaccgttgccagtgccgcacagcggcgcgggcgaataggccgcaaccacaacaaggagggcgatcagtacatctacatgggccaaccactgaacaacgacgaggaccacgcccactggacggaagctaaaatgcttcttgacaacattaatacccccgaaggcatcattcccgccctgttcgagccggaacgcgagaagtcagccgctatcgacggggagtaccgactgcgtggcgaagcccggaagacctttgtggagctcatgcgccgcggagacctccccgtgtggcttagctacaaggtggcgagcgagggcttccaatacagtgacagaaggtggtgcttcgacggcgaacgcaataatcaggtcctcgaggagaacatggatgtggagatctggaccaaggaaggggagcggaagaagctgcgcccccggtggttagatgccaggacgtatagcgaccccttagctctgcgggagttcaaggagttcgccgccggccgccggtccgtgagtggggacctgatcttggagatcggtaaactgccgcagcacctgacgcagcgggcgcaaaacgccctagataacctggtcatgctgcacaactccgagcagggcgggcgggcctaccgtcacgcgatggaggagttacccgacaccatcgaaaccctgatgctgctcgccttaatagccgtgttaacgggcggggttaccctcttcttcttgagcggccgcgggctgggcaagacctccatcggcctcctgtgcgtcatggccagctccgcactgctctggatggccagtgtggaaccacactggatcgcggcctccatcatcttggagttctttctgatggtgttgctgatccctgagccggaccgccagcggacgccccaagacaaccagctggcgtacgtcgtgatcgggttgctgttcatgatcctgaccgtggccgccaacgaaatgggcctcttagagaccaccaaaaaggacctgggcatcggccacgtcgcggtggagaaccaccaccacgccacgatgctcgacgtggacctgcaccctgccagcgcctggacactgtacgccgtcgctacgaccatcataaccccgatgatgcgtcacacgattgagaacacgaccgcgaacatatccctcacggccatagcgaaccaggccgcaatcctgatggggctggacaaggggtggccgatcagcaaaatggacatcggcgtgccgctcctggctctgggatgctattcgcaagtgaatcccctcaccctgacagccgctgtcttaatgttagtagcgcactacgccatcatcggaccgggtctgcaggccaaggccacccgcgaagcccagaagcgtactgcggcgggcataatgaagaaccccacagtcgacgggatagtcgccatcgaccttgaccccgtggtttacgacgccaaattcgagaagcagctcggtcagatcatgttattaatcctctgcacatctcaaatcctgctcatgcgcactacctgggccctatgcgagtccatcaccctggcgacgggacccttgacgaccttgtgggaagggagcccaggtaagttctggaatacaactatagccgtgtccatggcaaacatttttcgggggtcatacctggccggcgccgggctagcgttcagcctaatgaagtccctagggggcggtcgccgggggaccggggcccagggcgagaccctgggtgagaagtggaagcgtcagctcaaccaactgagcaagtccgagttcaatacttataagcgcagcgggataatggaggtggatcgctccgaagcgaaagagggtctgcgtcgcggggagacgaccaagcacgccgtgagccggggcacagcgaagctccgctggttcgtcgaacggaacctggttaaacccgaggggaaggtgattgacctgggctgcggccgcgggggttggtcatactactgcgccgggctgaagaaggtgacagaggtgaagggctacacaaagggcggccccggccacgaggagcccataccaatggccacgtacgggtggaacctcgttaagctgcacagcggcaaggacgtattctttatcccgcccgagaagtgcgacaccctgctctgcgacattggagagtcaagccccaacccgaccatcgaggaggggcggaccctacgcgtactgaagatggtggaaccctggctccgggggaaccaattctgcatcaagatcctgaacccatacatgccctccgtcgtggaaaccctggagcacatgcaacgcaaacacggcggcatgctcgtacggaatcctctgagcagaaattccacccacgaaatgtactgggtcagctgcgggaccggcaacatcgttagcgccgtgaacatgacctcacgcatgctgctaaacagatttacgatggcccaccgcaagcccacttacgagcgtgacgtcgatctgggggcgggcacccgccacgtggcggtggagccggaagtcgccaacctggacatcatcggccagcgtatagagaacatcaagcacgagcacaagtctacctggcattacgatgaagataacccctataagacgtgggcctaccatgggagctacgaggtgaaaccctccggcagcgcctcttccatggttaacggtgtagttaagctcctgaccaagccctgggacgtcatccccatggtgacccagatcgcgatgaccgacacgacccccttcggccagcagcgggtgttcaaggagaaggtcgatacccgtacccctaaagccaagagggggacggcccagatcatggaggtgaccgcccggtggctgtggggctttctcagcaggaacaagaaaccacggatctgcacccgcgaagagttcacccggaaggtgcgctccaacgcagcgatcggcgccgtcttcgtggacgagaaccagtggaacagcgcgaaggaggccgtggaggacgaacggttctgggacctagtccaccgagagcgggagctacacaagcaagggaagtgtgctacttgcgtgtataacatgatgggcaagcgcgagaagaaactgggggagttcggcaaggccaaggggtcccgggccatctggtacatgtggttgggggcgcgcttccttgagttcgaggccctcggctttatgaacgaggaccattggttttcaagagaaaattccctgagcggggttgagggcgaggggctgcacaagctgggctacattctgcgggacatcagcaagatccccgggggcaacatgtacgcagacgacaccgccggttgggacactcgcattacggaagacgacctgcagaacgaggctaagatcacggacatcatggagcccgaacatgccctactggcaaccagcatctttaagctgacctatcagaataaggtagtccgggtgcagcgccccgcgaagaacggcaccgtcatggacgtcatctcgaggagagaccagcgaggcagcggccaggttggcacttatggcctcaacaccttcactaacatggaggcccaattaatacgccagatggagtccgaggggatcttcagcccttccgagctggagactcccaacctcgcagagcgggtcctggattggcttgagaagtacggagttgaacgcctcaagcggatggccatcagcggcgacgattgcgtggtcaagccgatcgacgaccgcttcgccacggcgctcacggccctgaacgacatggggaaggtgcggaaggacattccccagtgggagccctccaaaggatggaacgattggcaacaagtccccttttgcagccaccactttcaccagctcatcatgaaggacgggcgcgagatcgtcgtgccgtgccggaaccaggatgagctggtgggccgcgcccgggtgagccaaggagctggttggtccctgcgcgagaccgcctgcctcggcaaaagttacgcgcagatgtggcagctgatgtactttcaccggcgggatttacggctagcagccaacgccatctgctctgcagtgccggtggactgggtccccaccagccggacgacctggtcgatccacgcccaccaccagtggatgacgaccgaggatatgctgagcgtgtggaaccgcgtctggatcgaggagaacccctggatggaggacaagacgcacatctcttcttggggcgacgtgccttacttgggaaagcgggaagaccagtggtgcggctccctgatcggcttgaccgcccgcgcgacctgggccacaaacatccaagtggcaatcaatcaggtccgccgtctgatcgggaacgagaactacctcgactacatgacgtctatgaagcgctttaagaacgagagcgatcccgagggcgccctgtggtag

SEQ ID NO: 24287 - RNA, 9879 nt, synthetic construct
  misc_feature 1..9879: note = derived and/or modified CDS sequence (opt11) from DENV-1__GQ199775__SS-prME
  source 1..9879: mol_type = other RNA
agcgtgacgatgctgttgatgttgatgcccaccgccctggcattccacctcacgacgcggggcggggagccccacatgatcgtgtccaagcaggaacggggcaagtctctgctattcaagacatccgccggggtgaacatgtgcaccctcatagcaatggacctgggcgagttatgcgaagacaccatgacctacaagtgccccaggatcaccgaggtggagcccgatgacgtcgattgctggtgcaacaccaccgacacgtgggtgacctacgggacctgcagccagactggcgagcatcggcgcgacaaaagatccgtcgcattagcaccccacgtcggcctagggttagagacacgtgccgagacatggatgtcttccgagggggcctggaagcagatacagaaggtggagacgtgggccctcagacaccctgggtttacggtcatagccttattcctggcccacgcgatcgggacgtccattacgcagaagggaattatcttcatcctcctaatgctggtcactccctcgatggctatgaggtgtgtgggtatcggctcgagagacttcgtcgagggtttatcaggcgccacgtgggttgacgttgtgctagagcatggcagctgcgtaaccactatggccaaggacaaaccaaccctggacatagaactcctcaagacggaggtgaccaaccccgcagtgctgcgcaaactctgtatcgaggcgaagatctccaacaccaccactgattcccgatgcccaacccagggagaggccacactggtcgaagagcaggatgcgaacttcgtgtgccgacgaaccttcgtagaccgtggctgggggaacgggtgcgggctgttcggcaaggggagtctcattacttgcgctaagttcaagtgtgtcaccaagcttgagggcaagatcgtgcagtatgaaaacctgaagtactcagtcattgtcaccgtgcacaccggcgaccagcaccaggtcgggaacgaatccacagaacacggcactatcgccaccatcacaccccaggcgcccaccagcgagatccagctcacggactacggggctctgaccctcgactgctccccccgaaccggactggacttcaacgagatggtgctgttgaccatgaaggagaagtcctggctggtgcataaacagtggttcctggatttgccgctcccctggacgtctggggcctccaccagtcaggagacctggaaccgacaggacctcctggtgaccttcaagacggcccacgcaaagaagcaggaggtggtggtcctcggatcccaggagggcgccatgcacacagccctgaccggggccaccgaaatccagacgacggggaccaccacaatcttcgccgggcatttaaagtgccgcttgaagatggacaagctgacccttaaaggcatgagctatgtgatgtgcaccggctccttcaagctggaaaaggaggtggccgagactcagcatggcacggtcctggtgcagatcaagtacgagggcacggacgcgccctgcaagatcccctttagcacccaggacgaaaagggggtgacacaaaacggacgcctaataacggccaatccgattgtcaccgacaaggagaaacccgtgaacatcgaagccgagccgccctttggtgagtcctacatcgtgattggcgccggcgagaaggctcttaagctcagctggttcaagaagggttccagtatcggcaagatgttcgaggccacagcccgaggggcccgaagaatggccattctaggagacaccgcgtgggacttcgggagtattggcggcgtcttcactagcgtggggaagctcgtacaccaaatctttggcacggcctacggggtcctcttcagcggagtgagctggactatgaagatcggaattggcgtgctgttgacctggctcgggctgaattcccgctcaacgtccctgagcatgacctgcatagccgtcggtttgatcactctctacctgggagtcatggtccaggcagattccgggtgtgtcatcaattggaaggggcgcgagctcaagtgcgggagcggaatcttcgtaacaaatgaagtccatacgtggacagagcagtataaattccaggccgacagcccgaagcgactgtcagctgccatcggcaaagcatgggaggagggggtctgcggcatccgcagcgcaacccggctggagaatatcatgtggcggcagatctccaacgaactcaaccatatcctattagaaaacgacatgaagttcaccgtggtggtgggggacgttgtgggcatcctcgcccaggggaagaaaatggtgcggcctcagcctatggagcacaagtacagctggaaaagctgggggaaggcgaagataatcggtgctgacgtgcagaacaccacattcatcatcgatgggcccaacacccctgagtgccccgacgatcagcgcgcctggaacatatgggaggttgaagactacggcttcgggatctttacaacgaacatatggctgaagctgagagatagctacacgcaggtatgcgatcacagactcatgtccgccgccataaaggacagcaaagccgtgcacgcggacatgggctactggatcgaatccgaaaagaacgagacgtggaaactggcccgggccagctttatcgaggtgaagacctgtatctggccgaagtcccacaccttgtggtccaacggcgtcttggagtccgagatgatcatccccaaaatctacggcggcccgatcagccagcacaattacaggccggggtacttcacgcagaccgcgggaccctggcacctaggaaaactggagctcgactttgacctgtgcgagggcacaaccgtagtggtagatgagcattgcggcaatcgagggccatccctgcgcacgaccaccgtgaccggcaagattatccacgagtggtgctgccggagctgtacgctgccgcccctccgattcaagggggaagacggctgctggtatgggatggagatccggcccgtgcgcgaaaaggaggaaaaccttgtcaagtccatggtgtcggcgggctccggggaggtggattccttcagcctggggctgctgtgcatcagcatcatgatcgaggaggtcatgcggtcacgctggtcccgcaagatgcttatgacgggaaccctcgcggtgttcttcctattaatcatgggtcaactgacatggaacgacctgatccgcagctgcatcatggtgggggcaaacgcctcggatcgtatgggcatgggcacgacctatctcgcgctgatggccaccttcaaaatgcggcccatgttcgccgttggcctgctattccggcggctaaccagccgcgaggtgctgctcctgactatcgggttgtccctcgtcgcctcagttgagctgcccaactcccttgaggaactcggcgacggcctggccatgggcatcatgatcttaaagcttctgacagattttcagtcgtatcagctctgggccaccctcctgtccctgacgttcataaaaactacctttagcctccactacgcctggaagaccatggcaatggtgctgagtattgtcagcctgctgccgctttgcctgtccaccacgagccagaaaaccacctggctccccgtgttgctgggctccctcggatgtaagccgctgaccatgttcttaatagcagaaaacaagatctggggccggaaatcctggccgctcaacgaggggatcatggcggtgggcattgtcagcatactgctctccagcctcctgaagaacgatgtgcctctggccggccccctcatcgccggcggcatgctgatagcctgctacgtgatctccgggagctccgccgacctgagtctcgagaaggccgccgaggtgtcctgggaagaggaggccgagcacagtggcgcctcccacaacatcctggtggaagttcaagacgacgggaccatgaagatcaaggatgaagagcgggacgacacgctgacaatcctcctgaaggccactctgctggcggtcagcggtgtgtacccactttccatcccagccaccctcttcgtttggtacttctggcagaagaagaagcagcggagcggggttctctgggacacgcccagcccgcccgaggtggagcgggccgtgctggacgatgggatctatcggatcatgcagcgcggcctgctggggcggagccaggtcggcgtgggggtgttccaagagaacgttttccacactatgtggcacgtgacacgcggcgccgtgctcatgtaccagggaaagcgcctggagcccagttgggcctcagtcaagaaggacttgatctcctatggcggcgggtggcgactccagggcagctggaataccggtgaagaggtccaggtgatcgcggtcgagcccggcaagaaccctaagaatgttcagacggcccccggaacattcaaaacgcccgaaggcgaggtgggcgccatcgccctggacttcaagcccggaacgtctggcagccccatcgtcaaccgggaagggaaaattgtgggcctctacggcaacggggtggtcacgactagcggaacctatgtgtccgccatcgcgcaggccaaggccagccaagaggggcctctaccggagattgaagacgaagtgttccgcaagcggaatctgaccataatggacctgcatccaggctccgggaagacccgtcggtatttgccggccatcgttcgcgaagcgatcaaacggaagctgcgcacactgatccttgctcccacccgcgtggtggccagcgaaatggctgaggctctgaaaggaatgcccatcagataccagactacggcggttaagtcagaacacaccggccgcgagatcgtcgacctcatgtgccacgccacctttaccatgcggctcctgtcccccgtgcgcgtcccgaactacaacatgatcatcatggatgaggctcacttcacggacccatcctcgatcgccgcgcgggggtacatcagcacccgcgtgggcatgggtgaggcagccgccatcttcatgacggcaacgccgcccgggtcggtagaagctttcccgcagtccaatgcggtcatccaagacgaagaacgggacattcccgagcgctcgtggaactccgggtacgagtggataacggactttccaggcaaaaccgtgtggttcgtgcccagcatcaagtccggcaatgacatcgccaactgcctgcggaagaatgggaagcgcgttatccaactcagccggaagaccttcgacacagagtaccagaagacgaagaacaacgactgggactacgtggtgacgaccgacatatctgagatgggagcaaactttcgagccgaccgtgtcatcgatccacgcagatgcctgaagccggtaatactgaaggacgggccagagcgcgtcatcctcgcgggcccaatgccggtgaccgtagcgagcgccgcccagcggcgcggtcggatcggccgcaatcataacaaggagggcgaccagtacatctacatggggcagcctctgaataacgatgaggaccacgcccactggactgaggcgaagatgttactcgacaatatcaacaccccggagggaatcatccccgccctgttcgaacccgaaagggagaagagtgccgccatcgatggcgaataccggctaaggggcgaggcgcgtaagacattcgtcgagttaatgcggcgcggggatctgccggtatggctgagctacaaggtggcgtccgagggcttccagtactccgacagacgctggtgcttcgacggcgagcgcaacaatcaagtcctcgaggagaacatggatgtggagatttggaccaaggagggggagcggaagaagctgagaccacggtggctggatgcccgaacttacagcgaccccttagcgctgcgggagttcaaggagttcgccgcgggccgccggtccgtgagcggtgacctgatcttggagatcggcaagctcccgcagcatctcacacaacgcgcgcagaatgccctcgataacctggtcatgctgcacaattccgagcagggcgggcgagcataccgccacgccatggaggagctcccagacaccattgagaccctgatgctccttgcgctcatagccgtgctgacgggtggggtaacactcttcttcctgtcaggccgggggctagggaaaacctccatcggcctcctgtgcgtgatggccagctctgccctgctctggatggccagcgtggaaccccactggatcgcggcttccatcatcctggagttcttcctgatggttctcttaatccccgaaccggaccgccagcggacgccccaggacaatcagctggcctacgtcgttatcgggttactgttcatgatcctgactgtcgcggccaatgagatgggactcttagaaacaactaagaaggatctggggataggccatgtcgcggtggagaaccaccaccacgccaccatgctcgacgtcgacttgcaccccgccagtgcctggacattgtacgcggtcgccacgaccatcatcactccgatgatgcgccacaccatagagaatacgaccgccaacatatccctcacggccatcgccaatcaggcggctatcctcatggggctggataaagggtggcccattagcaagatggacatcggcgtgcccttactggccctagggtgctattcgcaggtaaaccccctcaccctgactgccgccgtgctgatgctcgtggcgcattacgcaatcatcggccctgggctgcaggccaaggccacaagagaggcccagaaacggaccgctgccggtatcatgaagaacccgacggtagacggtatcgtcgccatcgacctggaccccgtagtgtatgatgccaagtttgaaaagcaactcggccagattatgctgctgatactctgcactagccaaatactgctcatgcggacaacctgggccctatgcgagtccataaccctggcgactggacctctgaccaccctctgggaggggtcgccgggcaagttttggaataccactattgccgtctccatggccaacatcttccgtggttcctatttggccggcgccgggttagcgttctcactcatgaaatccctcgggggcgggaggcggggaaccggggcccaaggcgagaccctgggcgagaaatggaagcgccaattaaatcaactctcaaagtcagagttcaacacctacaagcggagcgggatcatggaggtggaccgctccgaggccaaggagggcctcagacgcggcgaaacgaccaaacacgcggttagtagagggaccgccaagctcaggtggttcgtcgagcggaacctggttaagcccgaggggaaagtgattgacctgggctgtggtcgggggggctggtcctactactgcgcaggcttaaagaaagtcaccgaggtcaaagggtacaccaagggtggacccggccacgaggagcccatcccaatggccacctacggctggaacttggtcaaactgcatagcggcaaggacgttttcttcatacctccggaaaagtgcgatacattactctgcgatataggggagtccagccccaacccgaccatagaggagggccggacccttcgcgtactgaagatggtggagccctggcttcgggggaaccagttttgcataaagatcctgaacccctacatgccgtccgtcgtggagactctggagcacatgcagcgcaagcacggcggcatgctcgtgcggaacccgttatcgcgcaattccacccacgagatgtactgggtcagctgtggaactggtaacatcgtctccgccgtaaatatgacgagccgcatgctgctgaacaggtttacgatggcccacagaaagcccacttatgagcgggatgtcgacctgggggccggcactcgccacgtggccgtggagcccgaggtcgcgaaccttgacatcatcggccagcggatcgagaacataaagcatgaacacaagtccacctggcattacgacgaggataacccctataagacttgggcctatcacggctcttacgaggtaaagccctctggcagcgcctcttccatggtcaacggggtggtgaagcttttaaccaagccctgggacgtcatccccatggtgacgcagatcgcgatgaccgatacgacaccgtttggacaacagcgcgtgttcaaggagaaggtcgatacccggaccccgaaagccaaacgcgggaccgcccagataatggaggtgaccgcccggtggctgtggggcttcctcagccgcaacaagaaaccccggatctggacccgagaagaggtcacccggaaggtacgctccaatgccggcatcggggcaggcgtgggagacgagaaccagtggaacagcgcaaaaaagggcgtggaggacgagcggttctgggacctagtccacagagagcgggagttacacaaacaagggaaatgcgcgacctgcgtgtataatatgatgggaaagcgcgagaaaaagctgggagagtttggtaaggccaaggggtcccgggcgatctggtacatgtggcttggagccagattcctggagttcgaggccctcggcttcatgaacgaggaccactggtttagccgggagaatagtctgagcggcgtggagggcgaaggattgcacaagttggggtacatcctgcgcgacatttcaaagatcccgggaggtaatatgtatgcagacgacaccgcaggatgggacacgcgcatcacagaggacgacctgcagaacgaggcgaaaatcacggacataatggagcctgagcacgcccttctagccactagcatattcaagctgacgtaccagaataaagtcgtcagagtgcaacgccccgcaaagaacggaaccgtcatggacgtgatatcccggcgagaccagcgtgggtctggccaggtcggcacgtacggcctcaacaccttcaccaatatggaggcccagttaatacgccaaatggagtccgaaggaatcttctcaccctccgagctcgagacccccaacttagcggaacgggtgttagactggctggagaagtacggtgtcgagcgattgaagcgcatggctatcagtggagacgactgcgtggtaaagccgatcgacgatcgctttgccacggccctaaccgccctcaacgacatggggaaggtgcggaaggacatcccacaatgggagccctccaagggctggaacgactggcaacaagtcccattttgcagccatcatttccaccaacttatcatgaaggacggtagagagatcgtcgtaccgtgtcggaaccaggacgagttagtgggcagagcgcgggtctcacaaggggccggatggtccctgcgcgagaccgcctgcctcggcaagagctacgctcagatgtggcaactgatgtacttccatcggagagacctgcggctagccgcgaacgcaatctgtagtgcggtaccagtggactgggtccccacctcaaggacgacttggtccatccacgcccaccaccagtggatgacaaccgaggacatgttaagcgtgtggaaccgcgtttggatcgaggagaacccttggatggaggataagacgcacatcagtagctggggcgacgtaccctacctgggtaagcgggaagatcagtggtgcgggtccctgataggcctgacggcgcgagccacttgggcaaccaacatccaggtggccataaaccaggtgcggcgactgatagggaacgagaactacctcgactacatgacgagcatgaagcgattcaaaaacgagtcggacccggaaggggccctgtggtga

SEQ ID NO: 24288 - RNA, 9876 nt, synthetic construct
  misc_feature 1..9876: note = derived and/or modified CDS sequence (opt11) from DENV-1__FJ882546__SS-prME
  source 1..9876: mol_type = other RNA
agcgtgaccatgctcctcatgctgatgcccaccgcccttgccttccacctcacaactagaggcggggagccccacatgatcgtgagcaagcaggaacgggggaagagcctgctgttcaagaccagcgccggggtgaacatgtgcaccctcatcgccatggacttgggcgagctgtgcgaggacaccatgacctataagtgcccgcgaatcaccgaggccgagcccgacgacgtggactgttggtgcaatgccaccgacacatgggtgacctacgggacatgcagccagaccggcgagcaccggcgtgacaagcgctccgtggccctcgcgccgcacgtgggtctggggctcgagacacgcacagaaacttggatgagctccgaaggcgcctggaaacagatccagagggtggagacctgggccctccgccaccccgggttcacggtgatcgccctgttcctggcgcacgccataggcacatcaataacgcagaagggcataatctttatcctcctgatgctggtgaccccctccatggccatgcggtgcgtcggcatcggcagtcgcgatttcgtggaggggttatccggcgccacgtgggtggacgtcgtgctggagcacggatcctgcgtgaccaccatggccaaggacaagcccaccctcgacatagagctgctgaagacggaggtcacaaatcccgcggtgctgcggaagttgtgcatcgaggccaagatctcgaacacaaccacggacagccgttgccctacccagggcgaggctaccctggtggaggagcaggacgcgaatttcgtctgccggaggaccttcgtggaccggggttggggcaatggctgtgggctgttcggcaaggggtctctcatcacgtgcgccaaatttaagtgcgtgaccaaactcgagggcaagatcgtccagtacgagaacttaaagtacagcgtgatagtgaccgtacatacaggcgaccagcaccaggtgggaaacgagagcacggagcacggcaccaccgcgaccatcacgccacaggccccaacgaccgagatccagctaacagactacggggccttgaccctggattgcagcccgcgcactggcctcgacttcaacgagatggtcctgctgacgatgaaggagaagtcctggctagtccacaagcagtggttcctggacctgcccctcccgtggaccagcggggccagcacctcccaggagacgtggaaccggcaagacctgctggtgaccttcaagaccgcgcacgcgaagaaacaggaggtcgtggtgctcggcagccaggagggtgcgatgcacaccgccctgacgggggccaccgaaatccagacatccggcaccacgaccatcttcgcagggcacctgaagtgccgcctcaagatggacaagctgaccctgaagggcatgagttatgttatgtgcaccgggagtttcaagctcgagaaggaggttgctgagacgcaacacggcaccgtacttgtccagatcaagtacgaaggcaccgacgccccctgcaagatccccttcagcacccaggatgagaaaggggtgacgcagaacggaagactgatcaccgctaaccctatcgtaaccgacaaggagaaacccgtcaacatcgaggcggagccgccattcggggagtcctacatcgtcatcggcgccggcgagaaggccctgaagctatcgtggtttaagaaggggtcctcgatcggcaagatgttcgaagccaccgcccgcggggcccggcgaatggcaatactgggggacacggcctgggatttcgggtccatcggcggtgtgttcaccagcgtcggtaaactggtacaccagatcttcggcactgcctacggggtcctcttctccggcgtcagctggacaatgaagatcgggatcggggtgctgttaacgtggctcggcctgaattcccgcagcaccagtctgagcatgacctgcatcgccgtggggctcgtcacactctacctgggcgtgatggtacaggccgactcaggttgcgtcattaactggaagggtagagaactgaagtgcggttcaggtatattcgtgaccaacgaggtgcacacctggaccgagcagtacaagttccaggcggacagcccgaaaaggctgtccgccgctatcggcaaggcgtgggaggagggggtttgcggcatacggagcgccaccaggctggagaacattatgtggaagcagatatccaacgaactcaaccacatcctgctggagaacgatatgaagctcaccgtggtggtcggggacgtggccggcatactggggcagggtaagaagatgatccggccccagcccatggagtataaatactcttggaagtcctggggcaaagccaaaatcatcggggcggatgcacagaacacgaccttcattatcgacggccccaacaccccggagtgtcccgacgatcagcgcgcgtggaacatctgggaggtggaggactacgggtttggcatcttcaccacgaatatttggctgaagctacgggatagctacacccaggtctgtgaccaccgcctgatgtccgccgcgatcaaggacagtaaagcagtgcacgccgacatgggctactggatcgagtccgagaagaacgaaacctggaagctggcgcgggccagtttcatcgaggtgaagacctgcatctggcccaagtcccacacgctctggagcaacggagtcctggagtccgagatgatcatcccgaagatctacggcggcccgatctcgcagcacaactaccgccccggttacttcacccagaccgctgggccctggcacctgggcaagctcgagctggacttcgacctgtgtgaggggaccacggtggtcgtcgacgagcactgtggtaaccggggcccgtccctccgcaccaccaccgtgacaggtaagatcatccacgagtggtgttgtcggagctgcaccctgccacccctgcgcttccggggcgaggacgggtgctggtatggcatggagatccgccccgtgaaggagaaggaggagaacctcgtcaaatccatggttagcgcaggtagcggtgaggtcgactccttcagcctgggcctgctctgcatctctatcatgatcgaagaggtcatgcggagccgctggtcccggaagatgctgatgaccgggactctagccgtattcttcctcctgatcatgggacagctaacgtggaacgacctcatccgactgtgtatcatggtgggggcaaacgcttcagatcgcatgggcatgggcaccacctacctggccctcatggccaccttcaagatgcggccgatgttcgccgtagggctgttattccgacggctaacgtcgcgggaggtgctactgctcactatcgggctgagcctggtggcgtccgtcgagctccccaacagcttagaggaactgggggatggtctcgcaatgggcatcatgatcctgaagctgctcactgacttccagtcccaccagctctgggcaaccttgctcagcctgacgttcatcaagaccaccttctccctacactacgcctggaagaccatggcgatggtgctcagcatcgtctccttatttcccctgtgcctcagcacgacctcccagaagaccacatggcttcccgtgctgctcgggagcctcggctgcaagccgctgacgatgttcctcatcgccgagaacaagatttgggggcggaaatcctggcccttaaacgaaggcatcatggccgtggggatcgtcagtatcctgctcagctccctgctgaagaacgacgtgcccctcgccggccccctaatcgccggcggaatgctgatcgcatgctacgtgatcagcggctctagcgccgatctctccttggagaaggccgccgaagtctcatgggaggaggaggccgagcattccggggcgagccacaacatcctggtggaggtgcaggacgacggcacgatgaaaatcaaggacgaagagcgcgacgataccctcaccatcttgctgaaggctaccctcctggccgtctccggggtgtacccgctgagcatcccagccactctcttcgtgtggtacttctggcagaaaaaaaagcagcgatccggtgtcctatgggacactccgagcccgcccgaggtggagcgcgccgtgttagacgacggcatataccggatcatgcagcggggtttgctcggccgtagccaggtcggcgttggcgtgtttcaagaaaatgttttccacaccatgtggcacgtgacccgtggggcggtgctgatgtatcagggcaagcggctggaacccagctgggcctccgtcaagaaggaccttatctcctacggggggggctggcgcctgaggggatcttggaacacgggagaggaggtacaggtgatcgcagtggagcccgggaagaaccccaagaatgtacagaccgcccccggaaccttcaagacccctgagggtgaggtcggggccatcgcgctcgacttcaagccgggcacgagcgggtcgcccatcgtcaatcgcgaaggcaagatagtgggtctctatgggaacggcgtggtaaccaccagcgggacctacgtgagcgccatcgctcaggccaaggcgtcccaggagggcccgttaccggagatcgaggacgaagtgttccggaagcgcaacctgacgatcatggatctccaccccggtagcggcaagacccggagatacctgccggctatcgttcgggaggccatcaagcgcaagctgcgcaccctcatcctggcccccacgcgggtggttgcctccgagatggcggaagcactgaagggtatgcccattcggtaccagacaaccgccgtaaagagcgagcacaccgggaaggagatagtggacctcatgtgccacgccaccttcacgatgcggctgctgtcccccgtgcgcgtcccgaactacaacatgataatcatggacgaggcccactttaccgaccccagctccatcgcggcccgtggctacatcagcacccgtgtggggatgggcgaggccgctgctatcttcatgacagcgacgcctccagggtccgtggaggccttcccgcaatccaacgccgtgattcaggacgaggagcgggatatccccgagcgctcctggaacagcgggtacgagtggatcaccgattttcccggcaaaactgtatggttcgtgccgtctatcaaaagtgggaacgacattgccaactgcctccggaagaacggaaagcgcgtgatccagctgtcaagaaagaccttcgacacggagtaccagaagaccaagaacaatgattgggattatgtagtgaccaccgacatcagcgaaatgggggcgaacttccgcgccgaccgggtcatcgacccgcgccggtgcctgaagcccgtgatcctcaaggacggccctgagagagtaatcctggctgggcccatgccggtcacggtggcctccgccgcgcaacggcgcggcaggattggaagaaaccacaacaaggagggggaccagtacatctatatgggacagcccctgaacaacgacgaggaccatgctcactggactgaggccaagatgctcctggacaacatcaacaccccagagggaatcatccccgccttgtttgagccggagcgcgagaaatccgccgcggtcgacggcgaatacagacttcgcggggaggcccggaagaccttcgtggagctgatgcggcggggcgacctgcccgtgtggctttcctacaaagtcgccagcgagggcttccagtactcggacagacggtggtgcttcgacggggagcgcaacaaccaggtgcttgaggaaaatatggatgtggagatctggacgaaagagggcgagcggaagaagctgcgcccccggtggctcgacgcccgcacctattccgatcccctggcactccgagagttcaaggagttcgcggccgggcgtaaaagcgtctccggcgaccttatcctggaaatcggtaaactgccgcagcacctcacccagcgggcgcagaatgccctggacaacctggtgatgctccacaactccgagcaaggcgggcgcgcgtacaggcacgctatggaggagctgcccgacaccatcgagacgctgatgctcctggccctaatcgccgtgctcaccggtggcgtcaccctgttcttcctgtctgggcgcggcctcggcaagacctctatcgggctgctgtgcgtgatggcctccagcgtgctcctgtggatggcatcagtcgagccgcattggatcgccgcgagcatcatcttggagttcttcctcatggtgttactgatccccgagccggaccggcaacgcacgccccaggacaaccagctcgcctacgtggtcattggcttgctgttcatgatcctcacggtggctgccaacgagatggggttgctggagaccaccaagaaggatctcggcatcgggcacgtggcagtcgagaatcaccaccacgccgccatgctagacgtagacctgcaccccgcctccgcgtggacactctacgccgtcgctacgaccatcatcacaccgatgatgcggcacaccattgaaaacacgaccgccaacatcagcctaaccgccatagctaaccaggccgccatcctgatgggactcgacaaggggtggcccatctcaaagatggatatcggggtccccctgttggctctcggctgttacagccaggtgaacccactgaccctgacggcggcagtgctcatgcttgtcgcccactacgccatcatcgggcccggtctgcaagccaaagcgacccgcgaagcccagaagcgcaccgccgccgggatcatgaaaaacccgaccgtggacggaatcgtggccatcgacctcgaccccgtcgtgtatgacgcgaagttcgagaagcagctcggccagataatgctgctcatcctgtgcacgtcccagattctgctcatgcggacaacctgggcgctgtgcgagagcattaccctggccacggggcccctgaccaccctgtgggagggctccccggggaagttctggaacaccacgatcgcggtgagcatggccaacatcttccggggatcctacctggccggagccgggctcgccttcagcctgatgaagtctctaggcggaggtcggcgcgggaccggcgcccagggcgagaccctaggcgaaaagtggaagcggcaattgaaccaattatccaagtccgagttcaacacctacaagcgctccggcatcatggaggtcgaccggagcgaggcgaaggaggggctcaagcgcggtgagactaccaagcatgccgtgtcccgggggaccgcgaagttacgctggttcgtggagcggaatctggtcaaacccgagggcaaggtgattgacctgggctgcggacgcggcgggtggagctactactgtgccgggctcaagaaggttaccgaggtcaaagggtacacgaaggggggtcccgggcacgaggaacctatcccgatggccacctatgggtggaacctggtgaagctgcactcggggaaggacgtgtttttcatcccgcccgagaagtgcgacacactcctgtgcgacatcggcgagagctcccccaacccgactattgaagaggggcggacgctgcgcgttttgaagatggtggagccctggctgcggggcaaccagttctgcatcaagatactgaatccctacatgccctccgtggtcgagaccctagagcagatgcaacgcaagcacggggggatgctggttcggaaccccttaagtcgtaatagcacccacgagatgtactgggtgtcctgcgggaccgggaacatcgtgagcgcggtcaatatgacttcccggatgctcctgaaccgctttacgatggcacaccgcaagcccacatacgagcgagatgtggatctgggcaccggcacccgccacgtcgctgtggaacccgaagtagcgaacctcgacatcatcgggcagcggattgagaacatcaagcacgagcacaagagcacgtggcactatgacgaggacaacccctacaagacctgggcctaccacggctcatacgaggtcaagccgagcggatccgccagcagcatggtgaacggagtcgtcaaacttcttaccaagccctgggacgtgatccccatggtcacccagattgcaatgaccgagctccacctgggacagcagcgcgtgttcaaggagaaggtggacacccggacgccccgcgccaagcggggaaccgctcagatcatggagatgacggcccgctggctctggggcttcctctcccgaaacaagatcccccgcatctgcacgcgggaagagttcacccgtaaagtgcgcagcaacgcggccataggagccgtgttcgtcgatgagaaccaatggaactccgcaaaggaggcggtcgaggacgagaggttctgggacttagtccaccgggagcgagagctgcacaagcagggcaagtgcgccacctgtgtatacaacatgatggggaagcgggagaagaagctcggtgagttcgggaaggccaagggcagtcgcgccatctggtatatgtggctgggtgccagattcctagagtttgaggcgttggggttcatgaatgaggaccactggttttcgcgcgaaaacagcctgagtggcgtcgagggggagggcctgcacaagctcgggtacattctgcgcgatatcagcaagattcccggcggcaacatgtacgccgacgacacggcggggtgggacacccgcattacagaggacgacctgcaaaatgaggccaagattaccgacatcatggagcccgagcacgcactcctggcgaaggccatttttaaactgacgtaccagaacaaggtggtgcgtgtccaaaggcctgccaaaaacggcaccgtgatggacgtgatctcccgccgtgatcagcgcgggagcggccaggtcggtacctacgggctcaacacctttactaacatggaggctcagctgatccggcagatggagtccgaggagattttcagcccgtccgagttggagaccccaaacctcgccgagcgcgcgctggactggctagaaaagtacggcgtggagcggcttaagcgcatggccatcagcggggacgactgcgtggtcaagcccatcgacgaccggttcgccaccgcactcaccgccctgaacgacatggggaaggtgcgcaaggacatcccgcagtgggagccctccaaggggtggaacgactggcaacaggttcccttctgcagccaccacttccaccagttaatcatgaaagacggcagagagatcgtcgtgccctgccgaaaccaagacgagctggtgggccgtgcgcgcgtaagtcagggggccggctggagcctgcgggagacggcctgccttggcaagtcctatgcgcaaatgtggcagctgatgtacttccaccgccgggacctgcgcctcgcggccaacgccatttgctccgccgtgccggtggactgggtccccaccagccggacaacttggtccatacacgcccaccaccagtggatgacgaccgaggatatgctgagcgtatggaaccgcgtgtggatcgaggagaacccctggatggaggacaagacacacatctccagctgggaggacgttccatacttgggcaaacgggaggaccagtggtgcgggtccttgatcgggctgaccgcgcgggccacgtgggccaccaacatccaggtggccatcaaccaggtgcgccggctgatcggcaacgaaaattacttagactacatgacgagcatgaagcgctttaaaaatgagtctgatccggagggcgccctgtggtga

SEQ ID NO: 24289 - RNA, 9879 nt, synthetic construct
  misc_feature 1..9879: note = derived and/or modified CDS sequence (opt11) from DENV-1__KF921935__SS-prME
  source 1..9879: mol_type = other RNA
tcggtgacaatgctgctgatgctgatgcccaccgcgctggccttccacctcaccacacggggcggggaaccgcacatgatcgtctccaaacaggaacgtgggaagagtctactgttcaaaacctcagccggggtgaatatgtgcaccctcatagccatggacctgggggaattgtgcgaggatactatgacatacaagtgccctcggatcaccgagaccgagcccgacgacgtggattgttggtgtaacgccaccgacacatgggtgacctacgggacgtgtagccagacgggggagcacaggcgggacaaaagatccgtggccctcgccccacacgtgggactagggctggaaactcgcacggagacctggatgagctccgagggcgcctggaaacagatccagcgggtcgagacgtgggccctccggcacccaggcttcactgtgatcgctctgttcctagcccacgcgatcggcacttctattacccaaaagggaatcatctttatcctcctgatgctggtgacaccctccatggccatgcggtgcgtcggcatcggctccagagacttcgtggaagggctgtccggggccacctgggtggatgttgtattagaacatgggagctgtgttaccaccatggccaaggataaacccaccctggatatcgagctactgaaaaccgaagtcacgaaccccgccgtgctgcggaaactctgcatcgaggcaaagatctccaataccacgaccgacagccgctgtccgacgcagggcgaggcaaccctagtggaggagcaggacgccaatttcgtttgccggcgcacgttcgtggaccgggggtgggggaacggttgcgggctattcggcaaggggtccctcattacgtgtgccaagttcaaatgcgtcaccaagctggaagggaagatcgtccagtatgagaacctgaagtactcagtgatcgtgacagtccacacgggcgaccagcaccaggtcggaaatgagtctaccgagcacggcaccaccgccaccatcacgccccaggcgccaaccaccgaaatccagctcaccgactatggagcactgacgttggactgcagcccccgcaccggcctcgacttcaacgagatggtcctgctgaccatgaaagagaagtcctggctagtgcacaagcagtggtttttagacctccctctaccgtggacctctggagctagcacatctcaggagacgtggaatcggcaggacctgctggtaacctttaaaaccgcccatgcgaaaaagcaagaagtcgtggtactcggttcccaggagggcgccatgcacacggccctgaccggggccactgagatccagacctccggcacgaccacaatcttcgccggacacctgaagtgccgcctcaaaatggacaagctaaccctgaagggcatgagctacgttatgtgtacggggtcattcaagctcgaaaaagaggtggctgagactcagcatggcacagtgttagtgcagatcaaatacgaaggaaccgacgcgccctgcaagataccctttctgacgcaggatgagaagggggttacccaaaacggcaggctgataaccgccaacccgatcgttaccgacaaggaaaagcctgtgaatatcgaagccgagccgccctttggggagtcttacatcatcatcggcgccggcgagaaggcgctcaagctgagttggtttaagaaggggtcaagtataggaaaaatgttcgaggccacggcccgaggggcccggcgcatggcgatccttggcgacaccgcctgggacttcggtagtatcgggggcgtgttcaccagcgtggggaagctcgtccaccagatattcggcaccgcctacggggttttattctcgggcgtatcctggacgatgaagatagggatcggcgtcctgctcacctggttgggcctgaatagccgctccaccagcctttccatgacttgtatcgccgttgggctggtgaccctttacctcggcgtgatggtccaggcagacagcgggtgcgtcatcaactggaagggccgggagctgaagtgcggttccgggatcttcgtcaccaatgaagtccacacctggaccgagcagtacaagttccaggccgactccccgaagcgactcagcgcggctatcggcaaggcctgggaagaaggggtgtgcggcatccggtccgcgaccagattggagaacatcatgtggaagcagatcagcaacgagctgaaccacatcctgctcgagaatgacatgaaattcaccgtcgtggtgggagacgtcgcaggaatactggctcaggggaaggagatgatccggcctcagcccatggagtacaagtactcctggaagtcgtggggcaaggccaaaatcatcggggctgatgtgcagaacactacgttcatcatcgacggacccaacaccccagagtgcccagacgaccaacgcgcctggaacatatgggaggtggaagactacggcttcggcatcttcacgaccaacatctggctgaagctgcgggactcccacacacaggtatgcgaccaccgcctgatgagcgccgccattaaagattccaaggctgtgcacgctgacatgggctactggattgagtcggagaagaacgagacctggaagctggcacgggcgtccttcatcgaggtcaagacgtgcatctggcccaaaagccacaccctctggtccaacggcgtcctggaaagcgagatgataatcccaaagatttacgggggtccgatatctcagcacaattaccgccccggatattttacccagacggcaggcccctggcacttggggaaactcgagctggacttcgacctgtgcgagggtacaaccgtggtggtcgatgagcactgcggcaaccgggggccgtcactccgcactaccaccgtgaccggcaagatcatacatgagtggtgctgccggtcgtgcacgctgccacccctccgcttcagaggggaagatggctgctggtacggtatggagatccgcccagtgaaggagaaagaagagaatctcgtgaagagtatggtgtcggctggcagcggagaggtggacagcttctctctcgggttactatgcatcagcatcatgatcgaggaggtcatgcgttcccgatggagccggaagatgctgatgacaggcacgcttgccgtgttcttcctcctaataatggggcagctcacctggaatgatctcatacgcttatgcatcatggtgggcgccaatgcgtccgaccggatggggatgggaaccacctatctagccctcatggcgacttttaagatgagacccatgttcgccgtcgggttactgtttcgcaggctcacaagccgcgaggtcctgctactaaccatcgggctctccctggtggccagcgtcgagctccccaattcccttgaggagctgggcgacgggctcgctatgggcattatgatcctgaagctgctcaccgacttccaatcccaccagctgtgggccactctgctctccctgacctttataaaaaccacattctcgctgcactacgcttggaagacgatggctatggtgctctcaatcgtctcactgttccccctgtgcctctccacgaccagccagaagactacgtggttacccgtgctgctcggatccctggggtgcaagccactgaccatgttcctcatcgctgagaacaagatctggggccggcgcagctggcccctgaacgagggaatcatggctgtgggaatcgtcagcattttgctatcgtcactgctgaaaaacgacgtgccccttgccgggccgctgatcgcaggcgggatgctcattgcctgctacgtgatctccggcagctccgcggatctgagcctagagaaggccgccgaggtctcctgggaggaggaggccgagcacagcggcgcctcccataatatcctggtggaggtacaagacgacgggaccatgaagatcaaggacgaagaacgggacgacactcttaccatactgctgaaggcaaccctattggccgtcagcggagtttaccctctgagtatccccgcaaccctgttcgtgtggtacttctggcagaagaagaagcagcgcagcggtgtcttgtgggacaccccctctccacccgaggtggaacgggccgtcctggatgacggcatataccgtatcatgcagcgaggcctgcttgggcgcagccaggtcggcgtgggggtcttccaggagaacgtcttccacacgatgtggcatgtgacgagaggggccgtgctgatgtatcaagggaagcgccttgagccctcctgggcgtctgtcaagaaggacctcatctcgtatggcggcggttggaggctgcaggggagctggaatactggagaggaggtccaagtgatagccgtcgagccggggaagaacccaaagaacgtgcagactgcccccgggacgttcaaaacgcccgagggagaagtgggcgccatcgccctggacttcaagcctgggacctcgggctctccgatcgtcaaccgcgagggaaagatcgtaggcttgtacggaaacggggttgtaaccacctcgggcacgtacgtctcagcgattgcccaggccaaagcctcgcaggaggggcccttgcccgagatcgaggacgaagttttccggaagaggaacctgaccattatggacctccaccctggctcagggaagactcggcgctacctgcccgcgattgtacgtgaagccatcaagcgcaaacttcgaaccctcatcctggcccccacacgggtggtggcctcagaaatggccgaggcgctgaaaggcatgcccatcagataccaaaccaccgccgtcaagtccgaacacaccggcaaagagatcgtggacttaatgtgccatgccacgttcaccatgcggctgctgagtcccgttcgcgtccccaactacaatatgattattatggacgaggctcacttcaccgacccctccagcattgccgcgcggggctacatctcgactcgcgtgggaatgggggaggccgcggccatctttatgacggcgactccgcccgggtcagtggaggctttcccgcagtccaacgccgtcatacaggatgaggagcgggacatccccgaaagatcctggaactccgggtacgaatggatcacagacttccctggcaagaccgtgtggttcgtgcccagtatcaagagcggcaatgacatcgccaactgcctccgaaagaacgggaaacgcgtcatccaactgagccggaagacgttcgacacggagtaccagaagaccaagaacaacgactgggactatgtggtgaccacggacatcagcgagatgggtgccaactttcgcgcggatcgggtcatcgacccacgccggtgtctaaagcccgtaatcctcaaggacggaccggagcgcgtgatcctggctggccccatgcctgtcaccgtggcaagcgccgctcaacggcgcgggcggatcggcaggaaccacaacaaggaaggcgaccagtacatttacatggggcagcccctgaacaatgacgaagaccacgcccactggaccgaggccaagatgttactcgacaatatcaacacccccgaaggcatcatccccgccctgttcgagcccgagagggagaagtccgccgcaatcgacggtgagtatagactccgcggggaggcgcggaagacattcgtcgagctgatgcgccgcggggaccttcccgtgtggctcagctacaaggtggcttccgagggcttccaatattccgaccgccggtggtgcttcgacggcgagcgcaataaccaggtgctggaggagaatatggacgtggagatctggactaaggagggagagcggaagaagctgcggcccaggtggctggacgcccgcacctatagcgatcccttggccctgagggagttcaaggagtttgccgcgggcaggcggtccgtgtcgggggatctcatcctggagattggcaagctgccgcagcacctcactcaacgagcccaaaacgccctggacaacctggtcatgttacacaactccgagcagggcgggcgggcctatcgtcacgcgatggaggagcttcccgataccatcgagaccctcatgctcctagccctcattgcggtgctcaccggcggtgtgaccctgttcttcctgtccggccggggcctcgggaagaccagtatcgggctcctttgcgtcatggccagcagtgtgctgctatggatggccagcgtagagccacactggatcgccgcttccatcatcctggagttcttcctcatggtcttactgatccccgaacccgatcggcagaggacgccccaggataaccagctggcatatgtggtgattgggcttctgtttatgatcctcacagtcgctgcaaacgagatgggactgcttgaaaccacgaagaaggaccttggtattggccacgtggctgtggagaatcatcaccatgccgccatgttggacgtcgatctgcaccccgccagcgcctggacgctctacgcagtggccactaccatcataaccccgatgatgaggcatacgatagagaacactaccgccaacatctccctgaccgctatcgctaatcaggcggcgatcctgatggggctcgacaagggctggcccatcagcaagatggacatcggcgtgccccttttagccctcggctgctactcccaggtaaatcccctcacgctgaccgctgcggtactcatgctagtggcccactacgccatcataggcccggggctgcaggcgaaggctacccgagaagcacagaagcgtacagccgccggcatcatgaagaatcccacggtcgacgggatagttgcgatagacctcgacccggtggtgtacgacgctaagttcgagaaacagctgggacaaattatgctgttgatcttgtgcaccagccagatcctcctaatgaggaccacgtgggcgctgtgcgagtccatcacgctggccaccgggccactcacaaccctgtgggaggggagcccgggcaaattctggaacacgaccatagcagtgtccatggctaacatcttccgggggagttatttagccggcgcgggcctcgccttctccctgatgaaatccctcggaggagggcgcagaggaactggtgcccaaggtgaaaccctaggtgagaagtggaaacgtcagttgaaccagttaagcaagtccgagttcaacacgtacaagcggagcggtatcatggaggttgatcggtccgaggcgaaggagggtctcaagcgcggcgagactactaagcacgcggtttctagaggcaccgccaagctgcggtggttcgtggagaggaacttggtgaagcccgaggggaaggttatcgacttgggttgcggacgaggtgggtggtcgtactactgtgccgggctaaagaaagttacggaggtgaaagggtacaccaagggtggtcccggccacgaggaacccattccgatggccacgtacggctggaacctggtgaagctgcattctggcaaggacgtgtttttcatcccgcccgaaaagtgcgacactctattgtgcgacataggcgagtccagcccgaacccaacaatcgaggaagggcgtaccctccgtgtgctcaagatggtcgagccctggttgcgcgggaatcagttctgcatcaagatcctaaacccgtacatgcccagcgtggtcgaaaccctcgagcaaatgcagcgaaagcatggcggcatgctggtccgaaacccgctaagccgaaactcgacccacgagatgtactgggtgagctgcgggaccggcaacattgtgtcagccgtcaatatgaccagccgtatgttactgaatcgcttcaccatggcccaccgcaagcccacctacgaaagggatgtagacctgggggccggcactaggcacgtggctgtcgagcccgaaatcgccaacctcgacataatcggccagcgcattgagaacattaagcacgagcacaagtccacctggcactatgacgaggacaacccctacaaaacctgggcctaccacgggagctatgaggtgaagccgtccggaagcgcgtcttccatggtaaacggggtcgtaaagctgctgaccaagccatgggatgtcatccctatggttacacagattgccatgacagacacgacgcccttcggtcagcagcgggtgttcaaggagaaggtggacacccgtacgccgaaggctaaacggggcaccgcccaaatcatggaggtgaccgccaagtggctctggggcttcctgagccgcaacaagaagcccagaatctgcacccgcgaggagttcacccggaaggtgcgctccaacgcggccatcggcgccgtcttcgtggacgagaaccagtggaatagcgcgaaagaagcggtggaggacgaacggttctgggacctggtccatcgcgagcgggagctgcataagcaggggaagtgcgctacctgtgtttacaacatgatgggcaaacgcgagaagaaattaggggagttcggcaaggccaaggggtcccgggccatttggtacatgtggctgggcgcccgcttcctagagttcgaggctctcggtttcatgaacgaggaccattggtttagccgggagaacagtctgagcggggtcgaaggagagggccttcataagctaggctacatcctgcgcgatatctccaagatccccgggggcaacatgtacgcggacgacacagccggctgggacacccgtatcacggaggacgacctccagaacgaggcccgaatcaccgacattatggagcccgagcacgccctgctggccaagagtatcttcaagctaacctaccaaaacaaggtcgtgcgcgtgcaacggcctgctaagaacgggacggtcatggacgtaatatcaagacgggaccagcgcggtagcggccaggtggggacgtatggcctcaatacctttaccaacatggaggcccagctaatccgacagatggagtccgaggggatcttcagcccgtccgagcttgagactcccaacttggccgaacgggtcctggactggctggagaagtatggcgtggaaaggctaaagcgcatggccatatcaggggacgactgcgtggtcaaaccgatcgacgaccggtttgctacggccctgaccgcactcaacgacatgggcaaagtgcgcaaggacatcccccagtgggagcccagcaaggggtggaacgactggcagcaggtccccttctgtagtcaccattttcaccaactgataatgaaggacggacgggagatcgtcgtgccgtgccgtaaccaagacgagctggtgggccgggctcgcgttagccagggtgccggctggtcgctccgggagaccgcatgtctaggcaaatcgtacgcccaaatgtggcagctgatgtacttccaccgccgggatctccgcctggccgccaacgcgatctgctccgccgtgcccgtggattggatacccacaagcaggacgacatggtccatccatgcccaccaccaatggatgaccaccgaagacatgctgtctgtttggaatagggtgtggatcgaggagaacccctggatggaggataagacgcatatctccagctggggtgacgtcccgtacctcgggaagcgagaggaccagtggtgcggctcattgatcggcttgaccgcccgggcaacctgggctaccaacatacaggtcgctataaaccaggtccgtcgcttgattgggaacgagaactatttggactacatgaccagtatgaagcgctttaagaacgaaggcgatcccgagggtgctctgtggtga

SEQ ID NO: 24290 - RNA, 9879 nt, synthetic construct
  misc_feature 1..9879: note = derived and/or modified CDS sequence (opt11) from DENV-1__GQ199776__SS-prME
  source 1..9879: mol_type = other RNA
agcgtgaccatgctgctcatgctcatgccaaccgccttggcctttcacctcaccaccagaggtggtgagccccacatgattgtgtcaaagcaggaacgcggcaagagcctactgttcaagaccagcgccggggtgaacatgtgtaccttgatcgccatggacctgggcgagctgtgcgaggatacgatgacttacaagtgtccccgcatcaccgaaaccgagcccgacgacgtggactgctggtgcaacgccacggacacctgggtaacgtacggaacctgcagccagacgggcgagcaccggcgtgacaagcgatcagtagccctcgcgccccatgtgggcctggggctggagaccagaaccgagacttggatgagctccgaaggcgcgtggaagcaaatccagcgggtagagacgtgggctctccgccaccccgggttcacagtgattgcgctgttcctggcccacgcgatcggcaccagcatcacccagaaggggatcatctttatcttactgatgctggtgacgccttccatggccatgcggtgcgtcggtataggcagcagagacttcgtggaggggctctccggagccacctgggttgatgtcgtgctggagcacgggagctgcgttaccacgatggccaaggacaagcccacgctggatatcgagctcctgaagaccgaggtaaccaacccagccgtgctgcggaagctctgtatcgaggccaagatttccaacaccacgaccgactcaagatgtccaacccagggcgaggccaccctggtcgaagaacaggacgccaacttcgtctgccggcgcacgtttgtggataggggctgggggaacggatgcggcctgtttggtaaggggtctctcatcacgtgcgccaaattcaagtgtgtgaccaaactcgagggcaagatcgtccagtacgagaacctgaagtactcggtgatcgtgaccgtccacacgggcgatcagcatcaggtggggaatgaaagtaccgagcatggcaccacagctaccatcacgcctcaggcccccaccacggagatccagctcaccgactatggggccctgacgcttgactgtagcccccgtaccgggctcgacttcaacgagatggtgctgttaaccatgaaggagaagtcctggctcgtgcacaagcagtggttcctggacctgcccctcccctggacaagcggggcttctacatcccaggagacctggaatcgtcaggacctgctggtgactttcaagaccgcccacgctaagaagcaagaggtcgtggtcctcggatcccaggagggcgcgatgcacacagccctgaccggggcgaccgagatccagacctccggcacaaccaccatcttcgcgggtcacctgaagtgccgccttaaaatggacaagctgacacttaagggtatgagctacgtcatgtgtacggggtccttcaagctcgagaaggaggtcgccgagacccagcacggcactgtactggtacaaatcaagtacgaagggaccgacgcgccctgcaagatccccttcagcacgcaggacgagaagggggtcacccagaacggccggctgattactgccaacccaatcgtgactgacaaagagaagcccgtcaacatcgaggcagaaccacccttcggagagtcctacatcgtcatcggcgccggcgagaaggcgctgaaactcagctggtttaagaaggggtcctcgatcggcaagatgtttgaggcgacagcacgcggtgcccggcgcatggccatcctgggcgacaccgcgtgggacttcggctccattggcggcgtcttcaccagcgtcggcaagctggtgcaccagatcttcgggacggcatacggtgtactgttctccggcgtgagctggacaatgaagattgggatcggcgtgctgctgacctggctcggtctgaattcccgcagcacgtccctgagcatgacctgcatagccgtgggacttgtcacgctgtacttaggcgtgatggtgcaggcagactccggctgcgtcatcaattggaagggccgggagctcaaatgcgggtcgggcatcttcgtcaccaacgaggtacacacctggaccgagcagtacaagttccaggccgacagcccgaaacgcctgtccgcggccatcggcaaggcctgggaggaaggggtctgcggcatccggagcgccacgcgcctggagaacattatgtggaagcagatctcaaacgagttgaaccacatcctgctcgagaacgacatgaagttcacggtggtggtcggggacgtcgccggcatcctcgcgcaggggaagaagatgatacggccccagcctatggagtataaatacagctggaagagttggggcaaggctaaaataataggagctgacgtgcagaacaccaccttcattatcgatggtcctaacaccccagagtgtcccgacgatcagcgcgcctggaacatatgggaggtcgaggactacggcttcgggatattcaccactaacatctggctgaaactgcgggattcttacactcaggtatgtgatcaccgcctcatgtccgcggcgatcaaggactccaaggccgtgcacgccgacatgggctactggattgagtccgagaagaacgagacctggaagctagccagagctagctttatcgaagtcaagacttgtatctggccaaaaagccacaccttgtggagcaatggcgtgctggagtctgagatgatcatccctaaaatctacggtggccctataagccaacacaactatagacccgggtactttacgcaggccgcaggcccctggcacctggggaagctggagctcgactttgatctgtgtgagggcacaacggttgtcgtagacgagcactgcggcaaccgggggccgtccctgcgcactaccaccgttacgggcaagatcatccatgagtggtgctgcagaagctgcaccctcccgcctctccgcttccgcggcgaagacggctgctggtacgggatggagattcgccccgtgaaggaaaaagaggagaatctggtgaagagtatggtgagcgcgggtagtggcgaggtcgacagtttcagcctcgggttactgtgcatttcgataatgatcgaggaggtgatgcggagccgctggtcccggcggatgctcatgactgggaccctcgccgtattctttcttcttatcatggggcagctgacatggaacgacttgattcgcctctgcattatggtcggagcaaacgccagcgacagaatggggatgggcaccacatacctggcccttatggccactttcaagatgcgcccgatgttcgccgtaggcttactgttccggcgcttaacatcccgtgaggtgctcctgttaaccatcgggctcagcctggttgcatccgttgagttacccaacagccttgaggagctgggcgacgggctggccatgggtataatgattctcaagctgctaacagacttccagtcacaccagctctgggccaccctgttgtcacttaccttcatcaaaaccacgctgtccctgcattacgcctggaagaccatggctatggtcctcagcattgtgtccctgttccccttatgcctcagcacgacctcccagaagaccacgtggctgccagtgctgctcggcagtctgggatgcaagccgctgaccatgtttctcatagccgagaacaaaatctggggccgccgctcctggccactgaacgagggaatcatggccgttgggattgtatccatcctgctaagctccctgctgaagaacgacgtgcccctcgcagggcccctgatcgccggcggcatgctgatagcatgctatgtcatcagcgggtcgagcgccgacctctccctggagaaggcagcagaggtgagctgggaggaagaggcggagcattccggcgcgagccacaacatcttagtggaggtccaggacgacggtaccatgaagattaaagacgaggagagagacgacaccctcaccatccttctgaaggctacgctcctggccgtgtcaggcgtgtaccctctaagcatccctgcgactctctttgtctggtacttctggcagaaaaagaagcagagatccggggttttgtgggacacacccagtccacccgaggtggagcgtgccgtgctggacgacggcatataccggatcatgcagaggggccttttgggtcggtcccaagtgggcgttggggtcttccaggagaacgtgttccacacaatgtggcacgtgacccgcggcgcggttctgatgtatcaagggaagcgtctggagccctcctgggcctcggtgaaaaaggacctaatcagctacggaggcgggtggcggctgcagggctcctggaacactggggaggaagtgcaggtcatcgccgtcgagcccggtaagaaccccaagaacgtgcagaccgctcctggtaccttcaagacccccgaaggcgaggtaggtgccattgcgttggacttcaagcctggcacttccggctcccccatcgtgaaccgggaggggaagatcgttggcctctacggcaacggggtcgtaaccacctctggcacttacgtaagcgccatcgcccaagccaaggcatcccaggaggggcctctgcccgagatcgaggacgaagtctttagaaaacggaacctgacgatcatggacctccaccccggcagcgggaagacccgacggtacctgcccgccatcgtgcgcgaggccatcaaacgcaagcttcggaccctcattctggccccaaccagggtggtcgcctccgaaatggcagaggccctgaaagggatgcccatacggtaccagactactgccgtcaagagcgagcacacgggtaaggagatagtggacctcatgtgccacgccactttcaccatgagactgctgagtcccgtacgggtgccgaactacaacatgataatcatggatgaggctcacttcaccgaccccagttccatcgcggcacgcggctacatctcaacccgggtgggcatgggggaagccgcggccattttcatgacggcaactccgccaggttccgtcgaggccttcccacagagcaacgctgtgatacaggacgaggagagagacatccccgagcgctcgtggaacagcggctatgagtggatcaccgacttccctggaaagaccgtgtggttcgtaccgagtatcaagagcggcaacgacatagccaactgcttacgtaaaaatgggaagagggttatccagctgtccaggaagacgttcgacacggaatatcaaaaaaccaaaaacaacgactgggactacgtggtcactacggacataagcgagatgggcgctaatttccgggccgaccgcgtaatcgacccgcgccgctgcctcaagccggtgatactcaaggacggccccgagagggtcatactggccggccccatgccggtgacggtcgcctccgccgcccagcgccggggtcgcatcggccggaaccacaacaaggagggcgaccagtacatttacatggggcagccgttgaacaacgacgaggaccacgcccactggaccgaggccaagatgctcttggacaacatcaacacccccgagggaattattcccgccctgtttgagccggagcgggagaaatccgccgcgatcgacggggaataccgtctgcggggcgaggccagaaagacctttgtggagctgatgaggcgcggggaccttcccgtgtggctcagctacaaggtcgcctcagagggcttccagtactctgaccggcgatggtgcttcgacggcgagcgtaacaaccaggtgttagaggagaacatggatgtagagatttggaccaaagagggggagcgcaagaagttgcggccccgctggctagacgcacggacctactccgaccccctggcccttcgggagttcaaggagttcgcggcgggccggcggagcgtctccggggacctcatactggagatcggcaagctgccgcagcacttaacccagcgggcccagaatgcattggacaacctggtcatgctccacaacagcgagcagggcggacgagcctaccggcacgccatggaagagcttccagacaccatcgagaccctgatgcttttggccctgatcgccgttctcaccggcggagtcactttatttttcctgtccggcagagggctcggaaagaccagcatcggcctgctgtgcgtgatggcctcgagtgtactcctgtggatggcctccgtcgagccccactggattgctgcttcaattatcctggagttctttctcatggtgctgctgatcccggagccggaccggcagcgcacgccccaggacaaccagctcgcctatgttgtaatcgggctgttattcatgatactcacggtggccgcgaacgagatgggactgctggagaccaccaagaaggacctcggtataggccacgttgctgtcgagaaccaccaccacgccgccatgctggacgtggacctgcaccccgcctcagcgtggaccctctacgccgtggccacaaccattatcacccctatgatgcgccacaccatcgaaaacacgaccgccaacataagcctgacggcgatcgcgaaccaagccgccatccttatggggctcgacaagggctggcccatctccaagatggacattggcgtccccctgctggccctggggtgctatagtcaggttaatcccttgacattgacggccgccgtcttaatgctggtcgcacactacgccatcattggcccggggctgcaagcgaaagcgacccgggaggctcaaaagcgcaccgccgccgggatcatgaagaaccctaccgttgacgggatcgtagcgatcgacctcgatcccgtcgtttacgatgcgaagttcgagaaacagttaggccaaatcatgctgctcatcctctgcacgtcacagatactgttgatgagaaccacctgggccctgtgcgaatctatcacgcttgccacgggacccttaaccaccctgtgggaggggtccccgggtaagttttggaacaccacgatagccgtctccatggccaacatcttccgcgggtcatacttagcgggtgccggcctcgccttttccctgatgaaaagcctcgggggagggcggcgtgggaccggcgctcagggcgagaccctgggtgagaaatggaagcggcagttaaatcagctgtccaagagcgagttcaacacgtacaagcgctcagggatcatggaggtcgaccggtccgaggcaaaggagggcctaaagcgcggggagacgaccaagcacgccgtgtcacggggcaccgccaagctgcgctggttcgtggagaggaatctggtcaagcccgaggggaaggtgatagacctgggctgcggacgcggggggtggtcgtactactgcgccgggctcaagaaggtgaccgaagtcaagggatacacgaagggcggccccggccacgaggagccaattcccatggccacctacgggtggaacctggttaagttacactccggcaaggacgtgttcttcatcccacccgaaaagtgcgacacgctcctgtgcgacatcggggagtcctccccgaacccaacaatcgaggagggacggaccctgcgcgtcctcaagatggtggaaccctggctgcggggtaaccaattctgcatcaagatcctgaacccctacatgcctagcgtggtcgagaccctcgaacaaatgcagcggaagcacgggggcatgctagtgcggaacccgctatcccgcaattctactcatgagatgtactgggtgtcttgcggtacaggtaacatcgtctccgcggttaatatgacttcccggatgctgctaaatcggttcaccatggcccatcgtaagcccacctacgaacgggacgtggacctgggggccggcaccagacacgtcgtggtggagcccgaggtcgccaaccttgacatcatcggccagcgcatcgagaacatcaaacacgagcacaagagcacctggcactacgatgaggacaacccctacaagacgtgggcctaccatgggtcctatgaggtgaagccgtctggatccgcgtccagtatggtcaacggggttgtgaagctgttgactaagccttgggacgtgattcccatggtcacccagatcgccatgaccgacacgaccccattcggccagcaaagagtgttcaaagagaaggtagacacccgcacaccgaaggctaaacgcgggacggctcagatcatggaggtgaccgcaaagtggctctggggcttcctgtcaaggaacaagaagcccaggatctgcacccgtgaggaattcacccgaaaggtgcggagcaacgcggccatcggcgccgtctttgttgacgagaatcagtggaactccgcaaaggaggcggttgaggacgagcgtttctgggacctggtccaccgggagcgcgagctccacaagcaggggaagtgcgccacgtgcgtgtataacatgatgggcaagcgagaaaagaagctgggggagttcggcaaggccaaggggagccgcgccatttggtacatgtggctgggcgcccggtttctcgagtttgaggcgctgggcttcatgaacgaagatcactggttctcccgcgagaactcgctatccggggtggagggcgaggggctccataagctcgggtacatcctgcgggacatcagtaagatccctgggggcaacatgtacgccgatgacaccgccggttgggacacccgaatcaccgaggacgacctccagaacgaagcgcgcatcaccgatatcatggagccggagcacgcactgctggcgaagtctatattcaagttgacctaccagaacaaggtcgtgcgggtgcagcgacccgcaaagaacggcaccgtgatggacgtgattagccggcgcgaccagcggggctctggccaggtaggtacttatggcctgaatacgttcaccaacatggaggctcagttgatccgccaaatggagtctgaagggatcttttccccttctgagctcgagacccccaacctggccgagcgggtcctcgactggctggaaaagtacggcgtcgagcgcctgaagaggatggcgatctccggggacgattgcgtagtcaagccgatagacgaccgcttcgcgaccgccctgacggccctaaacgatatgggcaaggtacggaaggacattccgcagtgggagcccagcaaggggtggaatgactggcagcaggttccattctgttcccaccacttccaccaactgatcatgaaggacggcagggaaatcgtcgtgccatgccggaaccaggacgaattagtgggcagggcccgcgtttcccagggggctggctggagcttgagggagaccgcgtgtctcgggaagtcctacgcccagatgtggcagttgatgtacttccatcggcgcgatctgagattggccgctaacgcgatctgcagcgccgtgccggttgactggatccccacctctcgcaccacgtggagcatacacgcccatcaccagtggatgaccactgaggacatgctgtccgtctggaaccgcgtgtggatcgaggagaatccctggatggaggacaaaacccacatcagctcctggggtgacgtgccgtacttagggaagcgggaggaccagtggtgcggcagcctaatagggctgacggcccgcgccacctgggcgaccaatatccaagtcgctatcaaccaggtacggcgcctaatcgggaacgagaactatctggactacatgacctccatgaagcggtttaaaaacgagagcgaccccgagggcgcgctgtggtga

SEQ ID NO: 24291 - RNA, 9879 nt, synthetic construct
  misc_feature 1..9879: note = derived and/or modified CDS sequence (opt11) from DENV-1__GQ199777__SS-prME
  source 1..9879: mol_type = other RNA
agcgtgaccatgttactgatgctgatgcccaccgccttggccttccacctcaccacacggggcggtgagcctcacatgatcgttagcaagcaggagcggggcaagagccttctgttcaagacctccgcgggggtgaacatgtgcaccctcatagccatggacttgggggagctgtgcgaagacacgatgacctacaagtgcccacgcatcacagagaccgagcccgacgatgtggactgctggtgcaacgccacggacacctgggtgacttatgggacctgcagccagacgggcgaacaccggcgagacaagcggtccgtggccctagcgccccacgtgggcctgggactggaaacgcgcaccgagacctggatgagctccgagggcgcgtggaagcagatccagcgcgtcgagacgtgggccctccgacaccccgggttcaccgtgatcgccctgttcctggcacacgtgataggcacatcaataacccagaaggggatcatcttcattttactgatgctggtcacgcccagtatggcgatgcggtgcgtgggcatcggcagccgcgacttcgtggaggggctctctggcgccacctgggtcgacgttgtactggaacatggaagctgtgtcaccaccatggccaaggacaaacccacgctggacatcgaactcctgaagaccgaggtgaccaaccccgcagtgcttcggaaactctgcatcgaggccaagatctccaacaccacgaccgacagccgctgcccgactcagggcgaggcgaccctggtcgaggagcaggacgccaacttcgtgtgccgaaggacgttcgtggacaggggctgggggaacggatgcgggctgttcggcaaggggtccctcatcacgtgcgccaagttcaagtgcgtcaccaagctggaggggaagatcgtgcagtacgagaacctgaagtacagcgtgatcgtaaccgtgcacaccggcgaccagcaccaggtcgggaatgagtccaccgaacacggcaccaccgccaccattacgccccaggcccccaccaccgagatccagctcaccgattacggcgcgctgaccctggactgctccccccgcaccggcctcgacttcaacgagatggtgctgctgaccatgaaggagaagagctggcttgtgcataagcagtggttcctggatctgcccctcccctggaccagcggagcgagcacgtcccaggagacctggaaccggcaggatctgctggtcaccttcaagaccgcccacgccaagaagcaggaggttgtggtcttaggctcgcaggagggcgcgatgcacacggcgctcaccggggccaccgagatccagacctccggcacgaccaccatcttcgccgggcacctgaagtgccgtctcaagatggacaagctgaccctgaagggcatgagctatgtgatgtgcacggggctgttcaaactggagaaggaggtggccgagacccagcacggcactgtcctggttcagataaagtacgagggcaccgacgccccctgtaagattcccttctccacgcaggacgagaagggggtgacacagaacgggcggctgatcaccgcgaacccgatcgtcactgacaaggagaagcccgtgaacatcgaggccgagccgcccttcggggagagctacatcatcatcggcgccggcgagaaggccctcaagctgagttggttcaagaaagggagctccataggaaagatgttcgaggcgacggcccgcggggcgcggcgcatggcaatcctcggcgacactgcctgggacttcgggagtatcggcggcgtgttcaccagtgtcggcaagctcgtgcaccagatcttcggcactgcgtacggtgtgctgttctctggcgtctcctggacgatgaagatcgggatcggcgtgttactcacctggctgggcctgaacagcagatccaccagcctctcgatgacctgcatcgccgtggggctggtaacgctgtacctcggagtgatggtgcaggccgacagcggctgcgtcatcaactggaagggccgggagctgaagtgcgggtccggcatcttcgtcacgaacgaggttcacacctggaccgagcagtacaagttccaggccgacagcccgaagcgcctgagtgccgcgatcggcaaggcctgggaggaaggggtatgcggaatccggtccgccacccgcctcgaaaacattatgtggaagcagatcagcaacgagctaaaccacatcctgctcgagaacgacatgaagttcacggttgtggtcggggacgtggccggcatcctcgcgcaggggaaaaagatgatacggccccagcccatggagtacaagtactcctggaagtcctgggggaaggcgaagataatcggcgccgacgtgcagaacaccaccttcatcatcgacgggcccaacaccccagagtgccccgatgaccaacgcgcctggaacatctgggaggtcgaggactacggcttcgggatcttcacgactaacatctggctgaagctccgggacagttacacccaggtgtgcgaccacagactgatgagcgccgcgatcaaggactccaaggccgtgcacgccgacatgggctactggatcgagagcgagaagaacgagacctggaagctggcccgggcatcattcatcgaggtcaagacgtgtatctggccgaaaagccacaccctctggtccaatggtgtcctggagagcgagatgatcatccccaagatctacgggggcccgatctcccagcacaactaccgccccgggtatttcacccaaaccgcgggcccctggcatctggggaagctcgagctggacttcgacttgtgcgagggtacgaccgtggtcgttgacgagcactgcggcaaccgggggccgtcccttcgcactacgacggtgactggaaagatcatccacgagtggtgttgccgatcctgcaccctgccgcccctgcgcttccgcggggaggacggctgttggtacgggatggagatccgccccgtcaaggagaaggaggagaacctcgtcaagtcaatggtgtccgccggtagcggcgaggtggacagcttctccttagggctgctctgcatcagcatcatgatcgaggaggtcatgcggtcccgctggagccgaaagatgctgatgaccgggacgctggccgtcttcttcctcttaattatggggcagctgacctggaacgacttgatccgcctgtgcatcatggtcggcgccaacgcctccgaccgcatggggatgggcactacctatctggcgctcatggccacgttcaagatgcggccgatgttcgccgtgggactgctgtttagacggctcaccagccgcgaggtgttactcctcaccatcgggctgtctctggtcgccagcgtggagctacccaactccctggaggaactgggggatggcctcgctatgggcatcatgatcctgaagctcttagcggactttcagagccaccagttgtgggccaccctgctcagtctgacgttcatcaagaccaccttcagtctgcactacgcctggaagaccatggccatggtactctccatcgtgagcctgttccccctgtgtctctctacgaccagccaaaagaccacctggctgcccgtgctgctgggctccctggggtgcaagccgctgacaatgttcctcatcgcggagaacaagatctggggccgtcgcagctggcccctgaatgaggggatcatggccgtcggcatcgtgtccatcctgttaagcagcctgctgaagaacgacgtgcccttagccggacccctcatcgccggcggcatgctgatcgcctgctacgtcatttccgggtcatccgcggacctcagcctggagaaggccgccgaggtttcctgggaggaggaggccgagcacagcggcgccagccacaacatcctggtggaagtccaggatgacgggaccatgaagatcaaggacgaggagcgggacgataccctcaccatcctgctgaaggcgaccttactggctgtgagcggcgtgtacccgctgagtatccccgccaccctcttcgtctggtacttttggcagaagaagaagcagcgcagcggggtgttatgggacaccccctctccgcccgaggtggagcgggcagtcctggacgatgggatctaccgcatcatgcagcggggcctgctcgggagaagccaagtaggcgtgggggtctttcaggagaacgtgttccacaccatgtggcatgtgaccaggggcgccgtcctcatgtaccaggggaagcgcctggagccttcctgggcgagcgtaaagaaggatctcatctcctacggtggtggctggcggctacagggctcctggaacacgggggaggaggtgcaggtcatcgccgtggagcccgggaagaaccccaagaacgtgcagaccgcccccgggaccttcaagacccccgagggcgaggtgggggctattgcgctggatttcaagcccggcacgtccggtagccccatcgtgaaccgcgaggggaaaatcgtgggcctctacggcaacggggtcgtaaccacctccggcacctatgtgagcgccatcgcccaggccaaggccagccaagaggggcctctgccagagatcgaagacgaggtcttccggaagcgcaacctgacgatcatggacctccaccccggttccgggaagacccgacgctacttgccggcaatcgtgcgggaggccatcaagcggcgcctgcggaccctcatcctggcccccacccgcgttgtcgccagcgagatggccgaggcgctgaagggcatgccaatcaggtaccagacgacggccgtgaagagcgagcacaccggcaaggagatcgtggatctcatgtgccacgccacattcacgatgcgactgttaagccctgtccgggtccccaactacaacatgatcatcatggatgaggcccacttcaccgacccctccagcatcgccgcgcgcgggtatatctccacgcgggtgggcatgggtgaggccgcagccatcttcatgaccgcgacgccgcccggcagcgtcgaggctttcccgcagtccaacgccgtaatacaagacgaggagcgcgacattcccgagcggagctggaactcagggtacgagtggatcaccgacttcccaggcaaaaccgtgtggtttgttcccagcatcaagtccggcaacgacattgccaactgcctccgcaagaatgggaagcgggtgattcagctcagcagaaagaccttcgacacggagtaccagaagaccaagaacaacgactgggactacgtggttactaccgacatctccgagatgggcgccaacttccgggcggacagggtgatcgacccgcggcgctgtctaaagccagtaatactcaaggacgggcccgagcgagtcatcctggcaggccccatgccggtgacggtcgccagcgccgcccagcgaagagggcgcatcggccgcaaccacaacaaggagggcgaccagtacatctacatggggcagccactgaacaacgacgaggatcacgcgcattggaccgaggccaagatgctcctggataatatcaacacccccgagggtatcatccccgccctgttcgaaccggagcgggagaagtccgccgccatcgacggggagtaccgcctccgaggcgaggcgcgcaagacctttgtagagctgatgcggcgcggtgacctgcccgtgtggctcagctacaaggtcgcctccgagggcttccagtatagcgaccggcgttggtgcttcgacggcgaacggaacaaccaggtgttagaggagaacatggacgtcgagatttggacgaaggagggggaaagaaagaagttgcggcctcgctggctcgacgcccggacctacagcgatcccctggccctgcgtgagttcaaagagttcgccgcggggcggagaagcgtctcgggggacctcatcctggaaatcggcaagctgccgcagcacctcacccaacgggctcagaacgccctggataatttagtaatgctccacaactcggagcagggcgggcgcgcctatagacacgcgatggaggagctgcccgataccatcgagacgctgatgctgctggccctgattgcggtcctcaccggcggggtcaccctgttcttcctgagcggcagagggctcggcaagacctccatcggcctgctgtgcgtgatggccagctccgtgctcctatggatggccagcgtcgagccgcattggatcgcggcctccatcatcctggagttcttcctcatggtgctgctgatcccagagcccgaccggcagaggaccccccaggacaaccagctcgcgtacgtagtcatcgggctgctgtttatgatcctcacggtggccgccaacgagatgggcctgctggagaccaccaagaaggacctaggtatcggacacgtcgcggtcgagaaccaccaccacgccgccatgttagacgtagacctgcatcccgcgtcagcctggaccctctacgcagtggccacgaccataatcacgccgatgatgcgccataccatcgagaacacgaccgccaacatttccctgaccgccatcgccaatcaggctgcgatactgatggggctcgataagggctggcccatatccaagatggacatcggcgtccccctgctggccctagggtgctactcccaggtcaaccccctgaccctgacggccgcggtgctcatgctggtcgcccactatgcgatcatcggcccggggttacaggccaaggctacgagggaggcacagaagcgcaccgccgctggcatcatgaagaatccgaccgtggacgggattgtggccatcgacttggaccccgtcgtgtacgacgccaagttcgagaaacagctgggccagatcatgttgctcatcctctgcacgtcccagattcttctcatgcggaccacctgggcgctgtgtgagtctatcaccctggccacgggccccctcaccaccctgtgggaagggagcccgggcaagttctggaataccacaattgccgtctctatggccaacatcttccgcgggagctacttggccggcgcgggcctcgccttctccctgatgaagtccctcggtggcgggcggcgcgggaccggggcccagggcgagacgctcggagaaaagtggaaaaggcagctgaaccagctgagcaagagcgagttcaacacctacaagcgcagcgggataatggaggttgatcggtccgaggccaaggaaggcctcaagcgcggagaaacgaccaagcacgcggtgagccgtggcaccgcgaagctgcgctggttcgtggagcggaacctggtcaagcccgaagggaaggtgatcgacctgggatgcggtcgcgggggttggagctactactgcgcggggctcaagaaggtgaccgaggtcaagggctacacgaagggcggccccggccacgaggagcctatcccgatggccacctacggttggaatctggtgaagctgcacagcggcaaggacgtgttcttcataccgcccgagaagtgtgacaccctcctgtgcgatatcggggagtcctcacccaaccctaccatcgaggagggacggacgctgcgcgtcctcaagatggtggagccctggcttcggggaaatcaattctgcatcaagatcctgaacccctacatgccgtccgtggtagaaactctcgagcagatgcagcgcaagcacggcggcatgctggtgcggaacccgttgtcgcgcaactccacccacgagatgtactgggtgagctgcgggaccggcaatatcgtttctgccgtgaacatgaccagcaggatgctcctgaaccggttcacgatggcacaccgcaagcccacttacgagcgggacgtggacctgggggcgggtacccgacacgtcgccgtggagcccgaggtggccaacctcgacatcatcggccagcggatcgaaaatatcaagcacgagcacaagtccacctggcactacgacgaggacaacccctataagacgtgggcctatcacgggagctacgaggtcaagccatccggcagcgcgtcctcaatggtaaacggggtcgtgaagctgctgaccaaaccatgggacgtcatccccatggtcacccaaatcgctatgacggacacgacccccttcggccagcaacgcgtgttcaaggagaaagtggacacccggacccctaaggccaagcgcgggacggcccagatcatggaggttaccgcaaagtggctctggggcttcctgtctcgaaacaagaagccccgcatctgcacccgggaggaattcacccgcaaggtacggtccaacgctgccattggcgccgtgttcgtcgacgagaaccagtggaacagcgccaaggaagcggtggaggacgagcgcttctgggacctggtgcatcgggagcgcgagctccataaacaggggaagtgtgcgacgtgcgtctacaacatgatgggcaagcgggagaagaagctgggggagtttgggaaggcaaaggggtcccgcgccatctggtacatgtggctaggcgcccggttcctcgaattcgaagcgctgggctttatgaacgaggaccactggttctctcgcgagaactccctgtcaggggttgagggcgaggggctccacaagctgggctacattctgcgggacatcagtaagatcccagggggcaacatgtacgccgacgacaccgccggttgggacacccgcatcaccgaagacgacctccagaacgaagcccgcatcaccgacatcatggagccggaacacgccctactggcgaagtcgatcttcaaactcacctaccagaacaaggtggtccgggtccagcgccccgccaagaacgggaccgtgatggatgtcatctctagacgcgaccaacggggcagcgggcaggtggggacctacgggttgaacacgttcactaacatggaagcccagctgatccgccagatggagagtgaggggatctttagcccctccgagctcgagacccctaacctggccgagagggtgctggactggctcgagaagtacggcgttgaacgtctgaagcggatggccatctcaggcgacgactgcgtggtgaagccgatcgacgaccgcttcgcgaccgccttaacggccttgaatgacatgggaaaggtccggaaggacatcccccagtgggagccatccaaggggtggaacgactggcagcaggtcccgttctgcagccaccacttccaccagctgatcatgaaggacggccgcgagatcgtggtcccgtgccgtaatcaggacgagctggtcggccgcgcccgggtgtcccagggggccggttggagcctacgcgagaccgcgtgcctgggcaagagctacgctcagatgtggcaactgatgtacttccaccggcgcgatctgcggctggccgccaacgcgatatgctccgccgtccccgtggactggatccccacgagccgcaccacgtggtccatacacgcccaccaccagtggatgaccaccgaggacatgctgagtgtgtggaaccgcgtctggatagaggagaacccttggatggaggacaagacccacatatccagctggggcgatgtgccgtacctcgggaagcgggaggaccaatggtgcggctcactgataggcctgacggcccgcgccacgtgggcgaccaacatccaggtggccatcaaccaggtccgccgcctcatcggcaacgaaaactacctggactacatgaccagcatgaagcggttcaagaacgagtccgatcccgagggcgccctatggtga

SEQ ID NO: 24292 - RNA, 9879 nt, synthetic construct
  misc_feature 1..9879: note = derived and/or modified CDS sequence (opt11) from DENV-1__GQ199778__SS-prME
  source 1..9879: mol_type = other RNA
agcgtgaccatgctgctcatgctgatgcccaccgccctggccttccacttaaccacgcggggcggcgagccccacatgatcgtgagcaagcaagaacgaggtaagagcctgctgtttaagaccagcgcaggggtgaatatgtgcaccctcatcgccatggacctgggcgagctgtgcgaagacaccatgacctacaaatgcccccgaattactgagaccgaaccagacgacgtagactgctggtgcaacgccaccgacacctgggtcacctacggtacctgttctcagacgggggagcaccgcagagacaaacggtccgtggccttagcgcctcacgtgggcctggggctggagacccgcactgagacctggatgagctccgagggcgcctggaagcagatccagcgggtagagacgtgggctttaagacaccctgggttcaccgtgatagccctgttcctggcccatgccattggcactagcattacccagaagggcatcatcttcatcctcctgatgcttgtgacgcccagtatggcaatgcggtgcgttggcatcggaagccgtgacttcgtggagggactatctggagcgacctgggtggacgtcgtcctggagcacgggagctgcgtcaccaccatggcaaaggacaagcccacgttggacattgaactcctgaagaccgaggtcacgaatcccgcggtgctgcggaagctctgtatcgaggctaagatctccaacaccacgaccgacagccgatgcccgacgcagggggaggccacattagtagaggagcaagacgccaactttgtatgccggcgcactttcgtggaccggggctgggggaacggttgcgggcttttcgggaaagggtccctcatcacgtgtgccaagtttaagtgtgtgaccaagctggaagggaagatcgtccaatatgagaacctgaaatacagcgtgattgtcacagtacatacgggtgaccaacatcaagtggggaatgagtccaccgaacacggcacgaccgccaccatcacgccccaagccccgaccacggagatccagttaactgactatggggcactgacgctagactgcagcccccgaaccggtcttgatttcaacgagatggtcctgctgaccatgaaagaaaagtcctggctcgtgcataagcagtggttcctggatttgccgctcccatggacctcaggagcctctacgagccaggaggcttggaaccggcaagatctgctggtgaccttcaagacagcccacgccaagaagcaagaagtcgtggtcctcggatcacaggagggtgcaatgcataccgccctgacaggggcgacagagatccagaccagtggcaccacgaccattttcgcagggcacctcaagtgccgcctcaagatggacaagctgaccctaaaaggcatgagctatgtaatgtgcactgggtccttcaagctcgagaaggaagtcgcggagacgcagcacggcacagtcttagtccagatcaagtacgagggcaccgacgcgccatgtaaaatccccttcagcacccaagacgagaaaggggtcacgcagaacggccgactgatcacagcaaacccaatagtcacggacaaggagaagcccgttaacatcgaggccgagccgcccttcggggagtcctacatcgtgatcggagccggcgagaaggccctgaaactctcttggtttaagaagggatccagcatcggtaagatgttcgaggccaccgcccgcggggcaagacgcatggctatccttggcgacacggcctgggactttgggtccatcgggggcgtcttcacctccgtgggcaagctggtccaccagatctttggcacagcctacggagtgctattctccggcgtctcgtggactatgaagataggtatcggcgtgctgctaacgtggctcgggctgaactcccgcagcacgtccctgtccatgacctgcatcgccgtggggctcgtgaccctttatttaggcgtcatggtgcaagccgactctggatgcgtcataaattggaagggccgggaactcaagtgcggcagcggcatcttcgtgacgaatgaagtgcacacttggaccgagcaatataagttccaggcggacagcccgaagcgcctgagtgccgctatcggtaaagcctgggaggagggggtatgtggtatccggagcgccacccgcttggagaatatcatgtggaagcagatctccaacgagctcaaccacatactcctggagaacgacatgaagttcacagtggtggtaggagacgtggcaggaatactcgcgcaagggaagaagatgatccggccccagccaatggagtacaagtacagctggaagtcctggggcaaagccaagatcatcggggccgacgtgcagaacacgacattcattatagacgggccgaacacccctgaatgccccgacgaccagcgcgcctggaatatctgggaggttgaggactacggcttcggtatatttactacgaacatttggctcaagctgcgggacagctacacccaagtctgtgaccaccggctcatgtccgccgccattaaggatagcaaggccgtgcacgccgacatgggctactggatcgagtccgagaagaacgagacctggaagctggcgcgggccagcttcatagaggtcaaaacctgtatctggcccaagtcccacacgctttggtcgaacggcgtgctcgagtccgagatgattatccccaagatctacggaggcccgatcagccagcacaactatcgccccggatacttcacccaggctgccggtccctggcacctgggcaagctggaattagacttcgacttgtgcgaaggtaccaccgtggtggtggatgagcactgcggcaaccggggtccgtccctgcgcacgaccacggtgaccgggaagataatccacgagtggtgctgccggtcttgcacgctgccgcccctccgctttcggggggaagatgggtgttggtacgggatggagattcgtcccataaaggagaaggaggaaaatctggtcaagtccatggtgtcggccggtagcggggaggttgactctttctcactcgggttactgtgcatctcaataatgatcgaagaggtaatgaggagccgctggtccaggagaatgctcatgactggcaccctggcggtgttcttcctactcatcatggggcagcttacctggaatgacctgatccgcctatgcatcatggtgggcgctaatgcaagcgatcggatggggatgggtactacttacctggccctgatggccacattcaagatgcgccccatgttcgcggtaggcttgcttttccggcggctgacgtccagagaggtgctcctgctgacaatcggtctatctctggtcgcctccgtcgagctgcccaacagcctagaggagttgggcgatggactggccatgggcataatgatactcaagctcctgacggacttccaatcccaccaactctgggcaacccttctgagcctcacctttataaagacaaccttcagcttgcattacgcctggaagaccatggcgatggtgctgagcatcgtctcactatttccgctgtgcctgagcaccacgtcccaaaaaaccacctggctccctgtgctgctgggcagcttgggttgcaagccgctgactatgtttctgatcgccgaaaacaagatctggggccgccggagttggcccctcaacgaggggatcatggccgtgggcattgtcagcatcctgctctccagcttactgaaaaacgatgtgcccttggccgggcctctaatcgcgggcggcatgctgatcgcctgctatgtaatcagcgggtcctctgccgacttatcgctcgaaaaagccgccgaggtctcatgggaggaagaggcggagcactccggcgcctcacacaatatcctggtggaggtgcaagatgacgggaccatgaagattaaggacgaagaacgtgacgacaccctaaccatactcttaaaagccaccctgctcgccgtctccggtgtttaccctctgagcatccccgccactctgttcgtgtggtacttctggcaaaagaagaagcagcgatcaggggtcctctgggacacgcccagcccgccagaagtggagcgggcggttttggacgacggcatctaccgcattatgcagagaggcctgctggggaggtcccaggtcggcgttggggtgttccaagagaacgtcttccacaccatgtggcacgttacccgcggggccgtgctaatgtaccagggaaagcgcttagagccgagctgggcctccgtcaagaaagatctgatcagctacgggggcgggtggcgcctacagggctcctggaacaccggcgaggaggtccaagtgatcgccgtcgagcccgggaagaatcccaagaacgtacagacggcccccgggacctttaagacgccagagggtgaggttggagcgatcgccctggacttcaagccaggcaccagcggatcccccatcgtcaaccgggaggggaagatagttggcctgtacggcaacggtgtggtcacgacttccgggacctatgtgtcggccatcgcccaagcgaaggcctcccaagaggggccgctccctgagattgaggacgaggtgttccgtaagcggaacctgaccatcatggaccttcaccccggcagcgggaagactcgccggtacctcccggccatcgtccgcgaggccataaagcgcaagctgcggacactgatcctcgccccaacacgcgtggtggcatccgagatggccgaagctctgaaggggatgcccatccggtatcagacaacggccgtcaagtccgagcacaccggtaaggagattgtggatttgatgtgccacgccacgttcaccatgcgactgttgtcccccgtgcgcgttccgaactacaacatgattataatggacgaggcgcacttcacggaccccagctcaatcgccgcgcgcgggtacataagcacccgtgtgggcatgggagaggccgccgcgatattcatgaccgcgacgccacccggctccgtcgaggccttcccgcagagcaacgccgtgattcaggacgaggagagggacatccccgagcgatcgtggaatagcgggtacgagtggatcactgatttccccggcaaaaccgtgtggttcgtgccctccataaagtccggtaacgacatcgcgaactgcctgcgcaagaacgggaagcgtgtcatccagctctcccgcaaaaccttcgacacggagtaccagaaaacgaagaacaacgactgggattacgtggtgaccaccgacatcagcgagatgggcgctaacttccgggccgaccgcgtcatcgatccgcggcgctgcctgaagcccgtgatcctgaaggacgggcccgagcgggtgatcctcgccggacccatgccggttaccgtagcctccgctgcccagcgccgaggccgcatcggacgcaaccacaacaaagagggcgaccagtatatttacatgggccagcccctgaacaatgacgaagaccatgcacactggacggaggccaaaatgctgctcgacaacattaacacccccgaaggcatcatccccgccctgttcgagccggagcgggagaagtccgcggccatcgacggtgagtaccgcctgaggggcgaggcgcgcaaaacattcgtcgagctaatgcggcggggagaccttcccgtatggctgtcctacaaagtggcaagcgaggggtttcaatacagtgatcgacgttggtgcttcgacggggaacggaacaaccaagttctggaggaaaacatggacgttgagatctggaccaaggaaggggagcgcaagaaactgcgtccgaggtggctggatgcccggacgtacagcgacccgttggccttgcgcgagttcaaggagttcgccgccggcagacgcagtgtgtccggagacctgatcctcgagatcggcaaactaccgcaacacctgactcaacgtgcacagaacgcactggacaacttagtcatgttacacaacagcgagcagggcgggcgcgcgtaccggcatgcaatggaggagcttcccgacaccatcgagaccctgatgttgctcgcactgatcgccgtactaacggggggggtcaccctcttctttttgagtggccgcggtctgggcaagacaagcatcggcctcctctgcgtcatggccagcagcgtgctgctctggatggccagtgtcgagccacactggatagcagcatccatcatcctggagttcttcctgatggtgctcctgatccccgagccggaccgtcagcgcactccccaggacaaccagctggcctacgtagtgatcggtctgttattcatgatcctgaccgtagcggcaaacgagatggggcttctggagacgacgaagaaggatctggggattggccacgtggccgtggagaaccaccaccacgccgccatgctcgacgtagatctccaccccgcgtccgcctggaccctttacgccgtggccaccacgatcatcacccccatgatgcgccacaccattgagaacactacggcaaacatctcactcactgcgatcgctaaccaagccgcgatactgatgggtctggacaaaggctggcccatctccaagatggatatcggcgtgcccttactggcgctggggtgttacagccaggtcaaccccctgaccctgacggccgccgtacttatgttggtcgcccattacgccatcatcggcccggggctgcaggccaaggccactcgggaggcacagaaacgtaccgccgccggtatcatgaagaaccccacagtcgacgggatcgtggcgatcgatttagacccagtggtctacgacgccaaattcgagaagcagctcggacagatcatgcttctgatcctttgtacctcccagatactgctgatgcggaccacctgggccctctgcgagagcataaccctcgccacaggtcctctgacgactctctgggaggggtcccccggcaaattctggaacaccaccatcgcggtgagcatggcaaatattttccgcggctcctacctcgccggtgccggcctggccttctcgctgatgaagtcactcggtggtggtcggcgcgggacgggggcgcagggagagaccctgggcgagaaatggaagcggcagctaaaccagttgtccaaaagcgaattcaacacgtacaagcgctccgggatcatggaggtggatcggagcgaagcaaaggagggcctaaagcgcggcgaaaccacgaagcatgccgtctccagaggcacagccaagcttcgatggttcgtggagagaaatctggtcaagcctgaaggcaaggtgattgatctaggctgcggccgcgggggctggagctactactgcgctgggctgaaaaaagtgaccgaggtgaaggggtacacgaagggtggccccggccatgaggaacccatcccgatggcgacgtacgggtggaaccttgtgaagctgcattccggcaaggacgtgttctttattccgccggaaaagtgcgacacactactctgtgacatcggggaatctagtcctaatccgaccatcgaggagggccggaccctgcgcgtgctgaagatggtcgagccatggctccggggtaaccagttttgtatcaagatactgaatccttacatgccgtcggtagtcgagacgctcgagcagatgcagcgcaagcatggtggtatgctcgtacggaatccgctgtccagaaacagcacccacgaaatgtactgggtgtcctgcgggaccgggaatatcgtgtcagccgtgaacatgacctcccgcatgctgctcaaccggtttaccatggctcaccgtaaacccacctacgagcgagacgtggacctaggggcgggcacccgccacgtcgccgtcgaacccgaagttgcgaacttagacataatcggccaacgtatcgagaacattaagcacgagcacaaatcgacttggcactacgacgaggacaatccctataaaacctgggcctaccacggctcctacgaggtgaaaccgtctgggtccgccagcagcatggtgaatggggtggtcaagttgctgacgaagccctgggacgttatccccatggtgacccaaatcgccatgaccgacacaacgccattcgggcagcaacgcgtattcaaagagaaggttgatacgcgaactccgaaggccaagcgcgggaccgcgcagatcatggaggtgactgccaagtggctgtggggcttcctctcccggaacaagaagccccgcatctgcacccgggaggagttcacccgcaaggtccgctccaacgccgccatcggcgcggtgttcgttgacgagaaccagtggaacagtgccaaggaggccgtcgaagacgagcgcttctgggatctggtgcacagagagcgcgagctgcacaagcagggcaagtgcgcgacctgcgtgtacaacatgatgggcaagcgggaaaagaaactcggggaatttggcaaagccaaggggagcagagctatatggtacatgtggttaggcgcgcgattcttagagttcgaggccctcggcttcatgaacgaggatcattggttctctcgcgagaacagcctgtccggggtcgagggtgaggggctgcacaagctcggttatatcctgcgagacattagcaagatccccgggggaaacatgtacgccgacgacacagccggctgggacacaagaatcactgaagacgacctccagaacgaggcgcgaatcaccgacatcatggagccggagcacgccttattagcgaaatccatcttcaaactgacctatcagaataaggtggtgcgggtccagcgccccgccaagaatggaaccgttatggacgtgatctcccggagagaccagcggggttccgggcaggtcggcacgtatggcttgaacaccttcacgaacatggaggcccagctgatccgtcaaatggagagcgaagggatcttctcgccaagcgagctggaaacccccaacttggcggagcgggtgctggactggctggagaagtacggagtggagcgcctcaagcggatggctatatccggagacgactgcgttgtgaagccgatcgacgaccggttcgccaccgctttgaccgcactgaacgacatggggaaggtgcggaaggacattccacagtgggagccaagcaagggatggaatgactggcagcaggtccccttctgctcccatcactttcatcagctgatcatgaaggatggccgggagatcgttgtgccgtgtcggaaccaggacgagctggtcggccgggcgcgcgtgagccagggggccggctggagccttagggagacggcctgcctcgggaagtcctacgcccagatgtggcagctgatgtactttcaccggcgcgacttgcggctcgctgccaacgccatctgcagcgccgttccagtcgactggatccccacctcccgcacaacctggtctatccatgctcaccatcaatggatgacgacagaggatatgctttcggtgtggaaccgcgtgtggattgaggagaacccctggatggaagacaagacccacatcagctcctggggcgatgtcccatacttagggaaacgggaggaccagtggtgcggcagcctcataggcctgaccgcgcgcgctacgtgggccaccaacatccaggtggcaatcaatcaggtgcggcgtttgatcggcaatgaaaattacctcgactacatgacatccatgaagcggttcaagaacgagagcgaccccgagggcgcactatggtga

SEQ ID NO: 24293 - RNA, 9879 nt, synthetic construct
  misc_feature 1..9879: note = derived and/or modified CDS sequence (opt11) from DENV-1__GQ199780__SS-prME
  source 1..9879: mol_type = other RNA
agcgttaccatgctgctcatgctgatgcccaccgcactcgcattccacctcacgaccagaggaggggaaccccatatgatcgtgtcaaaacaggaacgggggaaaagcctgctgttcaagacaagtgccggggtcaacatgtgcaccctcatcgccatggacctgggcgagttctgcgaagacacaatgacctataagtgcccccgaatcacggaagcagagcccgatgacgtagactgctggtgcaacgccaccgacacgtgggtgacctacgggacctgtagccagactggggagcaccgccgggacaagcggtccgtggcgttagcgccccacgtgggtttggggctggagacgcgcacggagacgtggatgagctccgagggcgcttggaagcagattcagcgcgtcgaaacttgggccctgcgtcaccccgggtttactgtgatcgccctcttcctggcccacgccatcggcactagcattactcagaaaggtatcattttcatcctgcttatgctggtgaccccctccatggccatgcggtgcgtcggtatcggtagccgcgacttcgtggaggggctgtctggcgccacgtgggtggacgttgtgcttgaacacgggtcatgcgttactaccatggccaaggacaagcccactttagacatcgagctgttaaagacggaagtaacgaaccccgctgtgctgcgaaaattgtgcatcgaggccaagatttccaacacgacgacggacagccgctgcccgacgcagggggaggccaccctcgtggaggagcaggacgcaaatttcgtctgccggcgcaccttcgttgaccggggctggggtaacggctgcgggttgttcggcaaggggtcactgattacgtgcgccaagttcaagtgcgtgaccaagttggagggcaagattgtccagtacgagaacctgaaatacagcgtgatcgttaccgtccacaccggagaccagcaccaggtgggtaacgagtccacggagcacggcaccactgcgactatcacgccccaggcccccagcacggagatccagctgacagattacggcgccctgaccctggactgcagcccccggaccgggctggattttaatgaaatggtcttgctgacgatgaaggagaagtcctggctagtccacaaacaatggttcttagacctgcctctcccctggaccagcggggcctccaccagccaggagacctggaaccggaaggacctcctggtgacattcaaaaccgcccacgcgaagaagcaggaggtcgtggtgctgggctcacaggaaggcgcaatgcataccgctctcaccggggccacggagatccagaccagcggcaccaccacgatcttcgccggtcacctgaagtgtcgtctgaagatggacaagctcacccttaagggcatgtcctacgtcatgtgcacagggtccttcaaactggagaaggaggtggcggaaacacagcacggcacggtgcttgtccaaatcaagtacgagggcaccgacgccccctgtaaaatccccttctcaacacaagacgagaagggggtgacccagaacggccggctgatcacagccaacccaatcgtgacagacaaggagaaaccagttaatatcgaggccgagcctccctttggggagtcttacatcgtgatcggcgcgggcgagaaggccttaaagctatcctggttcaagaaggggagctccatcggcaagatgttcgaagcaaccgcccgcggggccagacggatggcgatcctcggcgacaccgcatgggacttcgggagcatcggcggcgtgttcacctcagtgggtaagctggtgcatcaaatctttggcaccgcctacggggtgctgttcagcggcgtatcctggaccatgaaaattgggatcggcgtgctcctgacctggctgggtctcaattcacgctcgacttccctgtccatgacgtgcatcgcagtcgggctggtcactttgtacctgggcgtgatggtacaagccgacagcgggtgcgtcatcaactggaagggccgcgagctgaagtgtggaagcgggatctttgttaccaacgaggtgcacacgtggactgagcaatacaagttccaggcggattccccgaagcgcctctctgccgccatcggcaaggcctgggaggaaggggtatgcggcatccggtccgcgacccgcctggagaacatcatgtggaagcagatcagcaacgagctgaaccacattttactggaaaacgacatgaagtttaccgtcgtggtcggtgacgtggcgggcatcctggcccagggcaagaagatgatcagaccgcagcccatggagtacaagtactcttggaaatcgtggggcaaggcgaaaatcatcggtgcagatgtccagaacaccaccttcatcatcgacgggcccaacaccccggaatgccccgacgaccagcgcgcgtggaacatctgggaggtcgaggactacggcttcgggatctttaccaccaacatctggctcaagctgcgtgactcctatacccaagtgtgcgaccaccgcctgatgagcgccgccattaaggactccaaagccgtgcacgccgacatgggctactggatcgagagcgaaaagaacgagacctggaagctcgctcgagcgtcctttatagaagtgaagacctgtatctggcccaagagccacactctgtggtccaacggtgttctggagagcgagatgataatccccaaaatatacggcggccccatatcccagcacaactaccgccctggctacttcacgcaaaccgccggcccctggcatctcgggaagttggagctggatttcgatctctgtgagggcaccaccgtggtcgtggacgaacactgcggcaaccgggggccgagcctgcgcacaaccaccgtaaccggcaagatcatccatgagtggtgctgcagaagttgcaccctgccgccccttcggttcaagggagaggacggctgctggtacggtatggagatacggcccgtcaaagagaaggaggagaacctggtcaagagcatggtgagcgccggctccggcgaggtcgactctttctccctgggcctcctgtgcatcagcatcatgatcgaggaggtcatgcgctcccggtggagccgtaagatgttaatgaccggcacgctcgcagtgttctttcttctgatcatgggtcagctcacctggaatgatctgatcaggctgtgcatcatggtgggcgcgaacgcctccgatcgcatggggatgggcacgacctacctcgccttgatggctacctttaagatgcgcccgatgtttgctgtggggctcctatttcggcgactgaccagtcgggaggtgctcttgttgactatcgggctgtccctcgtcgcgagcgtggagctgcccaattctctagaggaacttggcgacgggctggctatgggcatcatgatactgaagctcctgaccgacttccagagccaccagctgtgggcgaccctcctgtcgcttaccttcatcaagacgaccttctcgctccactacgcatggaagaccatggcgatggtcctgtcgatcgtgagcctgttccctctctgtctgtccaccacgagccagaagaccacttggctgcccgttctcctgggttccctggggtgcaagccgctcaccatgttcttaatagccgagaacaagatctggggtcgcaagagctggcccctgaacgagggaataatggcagtcgggatcgtgagcatcctcctatccgccctgttgaagaacgacgtgccgctggcagggccgctaattgcgggcgggatgctcatcgcctgttacgtcatcagcgggtccagcgcagacctgtccctggaaaaggcagccgaggtgagctgggaggaggaggcagaacactccggcgccagccataacattctcgtggaagtccaagacgatgggacgatgaaaattaaagacgaggagcgggacgataccctgaccatcctgttaaaggcaaccctgctggccgtgtccggcgtatacccgctcagcatccccgccacactgttcgtctggtacttctggcaaaagaagaagcagaggtccggggtgttgtgggacacgcccagcccgccagaggtagagcgagcggtattggacgatggaatttatcggatcatgcagcggggcctgttagggcgttcgcaagttggtgtgggggtcttccaggagaacgtgtttcacacaatgtggcacgtaacccggggtgccgtcctgatgtaccagggcaagcgcctcgagccctcttgggcctccgttaaaaaggacctgatctcttatggtggagggtggcggctgcagggctcctggaacaccggggaggaggtgcaagtaatcgcagttgaaccaggtaagaaccccaagaatgtgcagacggcccccgggaccttcaagaccagcgagggcgaagtcggcgcgatcgccctcgattttaaacccgggacctccggcagccccatagttaacagggaggggaaaatcgtgggtttatacggcaacggggtagtgactaccagcggcacctacgtgtccgccatcgcgcaggcgaaggccagccaggaggggcccctgccggagatcgaggacgaggtctttcggaaaaggaacctcaccatcatggacctgcaccccggcagtgggaaaacgcggaggtacctgcccgccatcgtgcgggaggccataaagcgcaagctgcggaccctgatccttgcccccacccgggtggtcgcgagcgaaatggccgaggccttgaagggcatgcccatccgctatcagacaacagccgtgaagtctgagcacaccggcaaggagatcgtcgatctgatgtgccacgccacattcaccatgcggctgcttagccccgtccgcgtgccgaactacaacatgatcatcatggatgaggcgcacttcacggacccatcctcgatagcggcccgggggtacatatcaacccgcgtgggcatgggggaggccgcggcgattttcatgaccgccacgccgcctggcagcgtagaggccttcccccagtcaaatgccgtgatccaagacgaggaacgggacatcccggagcgctcctggaatagtgggtatgagtggattacggactttccagggaaaactgtttggttcgtacccagcataaagtccggcaacgatatcgcgaactgcctgcggaagaacgggaagcgagtaatccagctgagtagaaaaaccttcgataccgagtaccagaagacgaaaaacaacgactgggactatgtggtcaccaccgacatctcagagatgggcgcgaatttccgcgccgaccgcgtgatcgaccctaggcggtgcttgaagccggtgatcctgaaggatgggcccgagcgcgtcatcctggcaggccccatgccggtgaccgttgccagcgcggcccagcggagggggaggatcggacgcaaccacaacaaggagggcgaccagtatatttacatggggcagccgttgaacaatgacgaggatcatgcacactggacggaggccaagatgctgctcgacaacattaacacccccgaaggcattatccctgccctcttcgagcccgagagggaaaagtccgcggccatcgacggtgagtaccgccttcgcggcgaggcccgaaagaccttcgtcgagctgatgcgacgcggagacctcccggtgtggctgagctataaggtcgccagcgagggctttcagtactcagaccgccggtggtgcttcgacggcgaacgcaacaatcaggtgttagaggagaacatggacgtcgaaatctggaccaaagagggggagcggaagaaactccgcccccggtggctggacgctcgcacctatagcgacccccttgcgctccgggagttcaaagagttcgctgccggccgcagatccgtctctggggaccttatcctggagatcggcaagctcccccagcatctaacccagcgcgcacagaacgccctcgataacctcgtgatgttgcataactccgagcaaggagggcgggcctacagacacgccatggaggagctgccggacaccattgagacgctcatgctgctggctctcattgccgttttaacgggcggggtcaccctgtttttcctgagtggcaggggcctgggcaaaacgtccatcggcttactgtgcgtgatggcgagctccgtgttgctgtggatggccagcgtcgagccccactggatcgctgcctccattatactcgagttcttcctaatggtgctgctcatacccgagcccgaccgccagcggaccccacaggataaccagctggcctacgtggtcatcggcctactcttcatgatcttaaccgttgcggccaacgaaatggggctcttggaaacgaccaagaaagacctggggatcggccacgtggcggtggagaaccaccatcacgccgccatgctggacgtggacctccatcccgcgagcgcctggaccctgtacgccgtggccaccacaataatcacccccatgatgcgacataccatagagaacaccacggccaacatctccctgaccgcgattgcgaaccaggccgcaatcctcatggggctggataagggctggccgatcagcaagatggacattggcgtccctctgctcgctctggggtgctattcccaggtgaacccgctgactctgaccgcggccgtactgatgctggttgcccactacgccatcatcggacccgggctccaagctaaggccacgcgagaagcccagaagcgcaccgccgccggcattatgaagaacccgaccgtggatgggatcgtggcgatcgacctggacccggtcgtttacgatgccaagtttgagaagcagctgggtcagatcatgcttctgatcctctgcacctcccagatcctactgatgaggaccacttgggcattgtgcgaatccatcacgctcgcaaccggcccgctgacgaccctgtgggagggcagccccggcaagttttggaatacaaccatcgcagtgtccatggcgaacatctttcgggggagctacctcgccggcgccggcttagccttctcactgatgaagtcgctcgggggcgggagacggggcaccggggcccagggcgagaccctgggtgagaagtggaagcgccagctaaaccaactcagcaaatccgagttcaacacctacaagcgctctgggatcatggaggtcgatcggtcagaggccaaggagggccttaaacgcggggagacgacgaagcacgctgtgagcaggggcaccgccaagctgcggtggttcgtggagcggaacctcgtcaagccggaggggaaggtgatcgacctgggctgtggccgcggcgggtggtcctactattgcgccgggctgaagaaagtcaccgaggtcaaggggtataccaaaggcggccccggccatgaggagcccattcccatggcaacatacgggtggaacctagtgaagctccacagcggaaaggatgtgttcttcataccacccgaaaagtgtgataccctgctgtgcgacatcggggagtcgagccccaaccctactatagaggagggccgaaccctcagggtcctgaagatggtggagccgtggcttcgagggaaccagttctgcatcaaaatcctcaacccgtatatgcccagtgtggtggagacgctggagcagatgcagcggaagcacggagggatgctggttcgcaaccccctcagcagaaactccacccacgagatgtattgggtcagttgcgggaccggcaacatagtttccgccgtgaacatgaccagccgcatgctgctgaaccgtttcaccatggcccaccggaaaccaacttacgagcgcgatgtggaccttggtgccggaacccggcacgtggctgtggaacccgaagtggcgaacctggacatcatcggccagcgcatcgagaacatcaagcacgagcacaagtccacctggcactacgacgaagacaacccgtacaagacctgggcctaccacgggagctacgaggtcaaaccctcgggctccgccagctccatggtgaatggggtcgtgaagctactgacgaagccgtgggacgttatccccatggtaacccagatcgccatgacagacaccacgccctttggccagcagcgggtattcaaggagaaggtggacaccaggacccccaaggccaagcgggggacggcacagattatggaggttacggcaaaatggctgtggggctttctgtcccgcaacaagaaaccacgtatctgtacccgggaggagttcacccgtaaggtacgctccaacgcggcgataggcgcggtgttcgtcgacgagaaccagtggaactctgccaaggaggctgtggaggacgaacggttttgggacctggtgcacagggaacgggagctgcacaaacaggggaagtgcgcgacctgcgtatacaacatgatgggcaaacgtgagaagaaactgggggagttcgggaaggccaaggggtcccgggccatctggtacatgtggctcggcgcccgcttcctcgagttcgaggccctgggcttcatgaatgaggatcactggttcagccgggaaaattcattgagcggggtggagggcgaggggctgcataagctgggctacatcctccgcgacatctccaagatccctgggggcaacatgtatgccgacgacacggccggctgggacaccagaatcacagaagacgacctgcagaacgaagcgaagatcaccgacatcatggagcccgagcacgccctgctcgccaagagcatattcaagctgacgtaccagaacaaagtggttcgcgtgcagcggccggccaaaaacggcaccgtaatggatgttatctcccgccgtgatcagcgggggagcggccaggtaggcacctacggactgaacacgtttacgaacatggaggcccagctcattcgccaaatggagtccgaggggatcttttcaccatccgagctggaaacccccaacctagcgggtcgggtgctcgactggctggagaagcacggggtcgagagactgaagcggatggccatcagcggcgacgactgcgtcgtgaagcccatcgacgaccgctttgcaaccgcattgaccgcactgaacgacatggggaaggtccggaaggacgtgccccaatgggagcccagtaagggctggaacgactggcagcaggttcccttttgctcacaccacttccatcaactgatcatgaaggacggacgtgagatcgttgtgccctgcagaaaccaggatgagctcgtggggagagcaagggtcagtcagggtgctgggtggagtctgagggaaacggcctgcctgggcaagagctacgcccagatgtggcagttaatgtacttccaccgtcgcgacttgcggttagcggcaaacgccatctgctccgccgtgcctgttgactgggtgcctaccagccgtaccacgtggtccatacacgcccaccaccagtggatgacgaccgaagatatgctcagcgtctggaacagggtgtggatcgaggagaacccctggatggaggacaaaacacacatctccagctggggcgacgtcccttacctgggcaagagagaggatcagtggtgcggctccctgataggactcaccgcgcgggcaacctgggctaccaacatccaggtggccatcaaccaggtccgccggctcatcggcaacgagaactacctggattacatgaccagcatgaagcgattcaagaacgaatctgacccggagggggccctgtggtaa

SEQ ID NO: 24294 - RNA, 9879 nt, synthetic construct
  misc_feature 1..9879: note = derived and/or modified CDS sequence (opt11) from DENV-1__GQ199781__SS-prME
  source 1..9879: mol_type = other RNA
agcgtgaccatgttactcatgctgatgccgaccgccctggcctttcatttgacgacccggggcggcgagccacacatgatcgttacaaagcaggagcgaggcaagagcttactgttcaagacgtccgctggggtgaatatgtgcaccctcatcgccatggacctgggggagctgtgcgaggacaccatgacctacaagtgtccgcgcatcaccgaagccgaaccggacgacgtagattgctggtgcaacgccacggacacctgggtcacctacgggacctgcagccaaacaggggaacaccggcgcgacaaaagaagcgtggccctcgcgccgcacgtgggtctggggctggaaactcgcaccgagacctggatgtccagtgagggcgcgtggaagcagatccaacgagtcgagacgtgggccctccgccaccccgggttcaccgtgatcgccctgttcctggcacacgcgatcggcacatccatcacacagaaaggtattatcttcatcctactgatgctggtgacacccagcatggccatgcggtgcgtcggcatcggcagccgcgacttcgtggagggtctcagcggcgccacctgggtggacgtcgtgctggagcacgggtcctgcgtgaccaccatggccaaggacaagcccacgctggacatcgagctcctcaagacagaggtcacaaacccggctgtccttcggaagctctgcattgaagccaaaatcagcaacaccacaaccgactcccgctgccccacccagggcgaagcgaccctgatggaggagcaggacgccaacttcgtgtgcaggcgcactttcgtcgaccgaggctgggggaacggctgcgggctcttcggcaaaggaagcctcataacgtgtgccaaattcaagtgcgtgaccaagttagagggcaagatcgttcagtatgagaacctgaaatactccgtaatagtgacggttcacacgggtgaccaacaccaggttggcaatgaaagcaccgaacacggcaccaccgcgaccatcactccccaggcgcccacctccgaaatacagctcaccgactacggggcactgactctggactgtagcccccgcacgggactcgatttcaacgagatggtgctcctgaccatgaaagagaagtcctggctcgtccataaacagtggttcctggacctgcccctcccctggaccagcggggccagcacctcccaggagacgtggaatcgccaagacctgttagtgaccttcaagaccgcccatgcgaagaaacaggaagtggtagtcctcggcagccaagagggagccatgcacacggccctaacgggggccactgagatccaaacctccggcacaacaactatcttcgctggacacctcaaatgccgcctcaagatggacaaactgacactaaagggcatgagctacgtcatgtgcacggggtccttcaagctcgagaaggaggttgcggagacgcagcacggcaccgtgctggtacaaattaagtatgaaggaaccgatgccccctgtaagatccccttcagcacccaggacgaaaagggggtcatccagaacggccggctgatcacggctaaccccatcgtcaccgacaaggagaagccggtcaacatcgaggccgagccgcccttcggtgagtcctatatcgtcatcggcgtgggtgagaaggcgttgaagttgagctggttcaagaagggcagtagcatcggcaagatgttcgaggccaccgcccgcggcgcccggcgaatggccatcctgggtgacacggcgtgggacttcggatcaatcggcggagtgttcacaagcgtggggaagcttgtgcaccagatctttggcaccgcgtacggggtcctgttctctggcgtcagctggaccatgaagatcgggatcggcgtgctgctgacctggctcggcctgaactccaggagtacgtccctgagcatgacttgtatcgccgtcggactcgttaccttgtatctgggtgtgatggtgcaggctgactccgggtgcgtcataaactggaaaggccgggaattaaagtgtggtagcggcatcttcgtgaccaatgaggtgcacacctggacagagcagtacaagtttcaagccgactccccgaagcggctgtccgcggccatcggcaaggcctgggaggagggggtttgcggcatccggagcgccaccaggttggaaaacatcatgtggaagcaaatttccaatgaactcaaccacatcctgcttgagaacgacatgaaattcaccgtggtggtcggagacgtggtgggcatcctcgcccaagggaaaaagatgatccggccccagcctatggagcacaagtacagctggaagagctggggcaaggcgaagatcattggcgccgacgcccagaacactactttcataatcgacgggccaaacaccccggagtgccccgacgaccaacgcgcctggaatatctgggaggtcgaagactacggcttcgggatattcaccacgaacatctggctgaagctgcgggacagctacacgcaggcgtgtgatcaccgcctcatgtccgccgccatcaaggactcgaaggccgtccacgcagacatgggctactggattgagagtgaaaagaatgagacgtggaaactggcgcgggcaagctttatcgaggtaaagacgtgcatctggcccaaatcccacaccctttggagtaacggggtcctcgaatccgagatggtgatcccgaagatatacgggggcccgatcagccagcacaactaccgccccgggtactttacgcagacagcgggcccctggcacctggggaagttggagctcgacttcgacctctgcgagggcaccaccgtggtcgtggacgagcattgcgggaacagggggccgtccctgcggaccaccaccgtgaccggcaagatcatccatgagtggtgctgccgaagctgcacgctccccccactaaggttcaagggagaggacggctgctggtacgggatggagatccggcccgtcaaggagaaggaggaaaacctggtgaagtccatggtgtcggccggcagcggcgaggttgactccttcagcctcgggctgctgtgcatcagcatcatgatagaggaggtgatgcgatcccgatggtcccggaaaatgcttatgacgggcacgctggccgtgttcctgctcctcatcatgggccaacttacctggaacgatctcatccggctgtgtatcatggtcggcgcaaacgccagcgaccgtatgggcatgggcacgacctacctggccctcatggccacattcaagatgcgcccgatgttcgccgtgggcctgctgttccggcgcctcacctcccgggaggtgctgctactcacgatcgggctgagcttagtcgcttccgtggaactccccaacagtctggaggagcttggcgatggtcttgctatgggcataatgatcttgaagttattaacggacttccaatcccaccagctctgggcgaccctgctttccctgacctttatcaaaacaaccctgtccctccactacgcatggaagaccatggccatggtcctgagcatcgtgagtttattcccgctctgcttaagcaccacgtctcagaagaccacttggctgccggtgctcctaggcagcctggggtgcaagcctctcaccatgttcctgatcgccgagaacaagatttggggccgtaagtcatggcccctaaatgaggggattatggccgtcggcgtggtaagcatcctcctgagctccctgctcaagaacgacgtccccctggccgggccactgatcgccggcggaatgctcatcgcgtgctacgtgatcagcgggtcctccgctgatctgtccctggaaaaggccgccgaggtgtcatgggaagaggaggccgagcactccggcgcaagccataacatcctcgtcgaagtgcaagacgacgggacgatgaaaatcaaggacgaggagcgggacgacacgctgaccatcctgctaaaggccactctacttgccgtgtccggcgtttacccgctcagcatccccgccaccctgttcgtgtggtacttttggcagaagaagaaacagcgctcgggggtcctgtgggacacgccgtcgccacccgaggtcgagcgagccgtgctggacgacggcatctaccgcattatgcagcggggcctcctggggcgctcccaggtaggagtcggtgtattccaagagaacgtgttccacacgatgtggcatgtcacccggggcgccgtgctgatgtaccaggggaagcgcctcgagccctcatgggccagtgttaagaaagacttaatctcttacgggggcggatggcggctgcagggctcatggaacaccggggaggaggtgcaggtgatcgcagtggagcccggcaagaaccctaagaacgtccagacggcccccgggacattcaagaccccagagggagaggtcggcgccatcgcgctcgatttcaagcccgggacgagcggctcccccattgtgaaccgcgaagggaagattgtcggcctgtacggcaacggggtggtgacgaccagcggaacctacgtcagcgcgatcgcccagaccaaggcgtcgcaggagggacctctgcccgagattgaagacgaggtgttccggaagcgcaacctcacgataatggacctgcaccccggcagtgggaaaacgcggcgctacctgccagctattatccgggaggccatcaagcgcaagttacggaccctgatactggcgcccactcgcgtggtcgcctccgagatggccgaggccctcaaggggatgcccatccgctaccagacgacagcagtcaagagcgagcacactggcaaggagatcgtggacctgatgtgccacgccaccttcactatgcggttgctctcacccgtccgcgttccgaactacaacatgataatcatggatgaggcccacttcaccgaccctagcagcatcgccgcgcgggggtacattagcacccgagtgggcatgggtgaggccgccgccatcttcatgaccgccacgccgcccggctccgtcgaagccttcccgcaaagcaacgccgtcatacaggacgaagagcgggatatcccagagaggtcctggaacagtgggtacgaatggatcacggattttcctggcaaaacggtgtggttcgtccccagcatcaagagcggcaatgatattgccaactgcctgcggaagaacggaaagcgtgttatacagctttcccggaagacattcgacacagaataccaaaaaaccaagaacaacgactgggactacgtcgttaccaccgacatcagcgagatgggggccaacttcagagcggaccgggtgatcgacccgcgcagatgcttgaagcccgtgatcctgaaggacgggcccgagagagtcatcctggcaggccccatgccggtgacggttgcgtcggccgcccagcggagagggcggatcggccgcaaccacaacaaggagggcgatcagtacatctacatgggacagcccctcaacaacgacgaggatcacgcgcactggaccgaggccaaaatgctgctggacaacatcaacaccccagagggcatcatccccgccctctttgagccggagcgggagaagtcagccgccatcgacggggagtaccgcctgcggggcgaggcacggaagaccttcgtggagctgatgcgcagaggggacctccccgtgtggctttcctataaggttgccagcgagggcttccagtactctgatcgcagatggtgctttgacggcgaacgcaataaccaggtgcttgaggaaaacatggacgtggagatctggaccaaggagggggagcgtaaaaagctccgcccccggtggctggacgcccgcacttactccgacccccttgccctccgcgagttcaaggaattcgcggcgggcagacggtcagttagcggggacctgattctggagatcggcaagctcccccagcacctgactcagagagcccaaaacgccctggacaacctcgtgatgctgcacaacagtgagcagggcggccgggcctaccgacacgcgatggaggagttgccagacactatcgagacgttaatgctgctggcgctcatcgccgtgctgaccggtggggttaccctgttcttcctctccggccgggggctcggcaaaaccagcattggcttgttgtgcgttatggccagcagcgtactgctgtggatggcctccgtcgagccccattggattgcggcaagtatcatcttagagtttttcctgatggtgctgcttatcccggaaccggatcgccagagaacgccccaggataaccagctggcctacgtggtcatcgggctgttgttcatgattctgaccgtggccgcaaacgagatgggcctgctcgaaacaaccaagaaggacctggggattgggcacgtagcggtcgagaatcaccaccatgctaccatgctggatgttgacctccaccccgcctccgcctggacgctgtatgccgtagcgaccaccatcatcaccccgatgatgcgacacacgattgagaacaccaccgctaacatcagcctgaccgccatagccaatcaggccgccattctcatggggctggacaagggttggcccatttccaagatggatataggtgtccctctgctcgctttgggttgttactcacaggtgaaccccctgacgctcaccgcagccgtgctgatgctggtcgcgcattacgccatcataggcccggggctccaagccaaggccacccgggaggcccaaaagcgcaccgctgccggcatcatgaagaaccccacggtagatggtatcgtggccattgacctggaccccgtcgtgtatgacgcgaagttcgagaaacagcttggccagattatgttactgatcctgtgcacatcccagatcctcctgatgcgcactacctgggcactgtgcgagtctatcacgctcgcgaccggacccctgaccacgctgtgggaagggtcccctggcaagttctggaacactaccatcgccgtgagcatggccaatatcttccggggatcctacctcgccggcgccggcctggctttctctcttatgaagtccctcgggggtgggcgcagggggaccggggcccagggtgaaaccctcggcgaaaagtggaagaggcagctcaatcagctctccaagagcgagttcaacatctataagcgctccgggattatggaggtggatcgctccgaggccaaagagggcctgaagcgcggggagacgacgcggcacgccgtctcccggggcacggccaaactgcgctggttcgtggaacgaaacctcgttaagcccgaggggaaggtgatcgacctcggctgcgggcgtgggggttggagctactactgcgccgggctgaagaaggtgaccgaggtcaagggctataccaagggcgggccaggccatgaggagccgatcccgatggccacgtacggttggaacctggtcaagctccactccggcaaagacgtcttctttgccccgcccgagaagtgcgacaccctcttgtgcgacatcggggagagttcccccaacccgacgattgaagagggtcggacgttgcgcgtgctgaagatggttgaaccttggctgcgggggaatcagttctgcatcaaaatactcaatccctacatgcccagcgtggtcgagaccttagagcagatgcagcgcaagcacgggggcatgctggtgagaaaccccctctcccgcaacagcacccatgagatgtactgggtgtcatgcgggaccgggaacatcgtcagcgcggtcaacatgaccagccggatgctgctaaaccgcttcacgatggctcatcgcaaacccacctacgagcgggacgtggacctcggggccggcacccggcacgtcgccgtggagcccgaggtcgccaaccttgacatcatcggccagcggatagagaacattaagcacgagcacaagtcaacctggcactacgacgaggacaacccctacaagacgtgggcctaccacgggtcctacgaggtcaagccgagcggttccgcgagcagcatggtgaacggagtggtgaagctactgaccaagccctgggacgtgatccccatggtcacgcagatagccatgaccgacacaacccccttcggtcagcaacgcgtgttcaaggagaaagtggacactcgtaccccgaaggctcgcagggggactgcccagatcatggaggtcaccgcgcggtggctttggggcttcctcagccggaataagaagcctcgcatctgcacccgggaggagttcaccagaaaagtgcgtagcaacgcggcaataggagccgtgttcgtcgacgagaaccagtggaattctgcgaaggaagcggtagaggacgagcgcttctgggacctagtgcagaaggagcgggagctacacaagcaggggaagtgcgccacgtgcgtttataatatgatgggcaagagggaaaagaagctgggagagttcggcaaggccaagggatctcgggccatctggtacatgtggctcggcgcccggttcctggagttcgaggcgctgggcttcatgaacgaggaccactggttttcccgggagaacagcctctccggggtggagggggagggcctacacaagcttggctacattctccgcgacatcagcaagatccctggcggcaacatgtacgccgacgacaccgccggctgggacacccggatcaccgaggatgacttgcagaacgaggccaaaatcacggacataatggaaccggagcacgccctgctcgccacctccatcttcaagctgacctatcagaacaaggtggtgagggtgcagcgcccggctaaaaacggtaccgtgatggatgtcatcagtcgtagggaccaacggggctccggccaggtgggcacctatggcctgaacacctttaccaacatggaagcccagctcatccgccagatggagagcgaggggatcttccttccctcagagctggagacccctaacctcgccgagcgggtgttggactggctggagaagcacggcgtcgagcgcctcaagaggatggcgataagtggggacgactgcgtggtgaaaccgatcgacgaccgcttcgcgacagccctgactgccttaaacgacatgggcaaagtcaggaaggacatccctcagtgggagccctccaaggggtggaacgactggcagcaggtccccttttgttcacaccacttccaccaactgatcatgaaagatggtcgcgagatcgtggtcccgtgtcggaaccaagacgaactggtgggccgcgcacgggtgtcccagggggccggctggagcctccgggagaccgcgtgtctcggtaagagctatgctcagatgtggcaattaatgtacttccatagacgcgacctgcggttggctgccaacgcaatatgcagcgccgtccccgtggactgggtgcccacgagccgcacgacctggtccatccacgcccaccaccagtggatgacaaccgaggacatgctgagcgtgtggaaccgggtttggatcgaggagaacccatggatggaggacaagacccacgtgtcctcgtggggagatgtcccgtacttggggaagcgcgaggaccagtggtgcggctccttaatcggcttaacagccagggccacgtgggcgagcaacatccaggtggcaatcaatcaggtgcggcgcctgatcgggaatgagaattacctcgactacatgacctccatgaagcggttcaagaacgaaggcgaccccgagggggccctgtggtga

SEQ ID NO: 24295 - RNA, 9879 nt, synthetic construct
  misc_feature 1..9879: note = derived and/or modified CDS sequence (opt11) from DENV-1__GQ199782__SS-prME
  source 1..9879: mol_type = other RNA
agcgtcaccatgctactcatgctgatgcccacggcgttggctttccaccttactacacgcggcggggaaccccatatgattgtgaccaagcaagagcggggtaagagtctgctgttcaagacctcggcgggggtgaacatgtgcacacttatcgcgatggacctgggcgaactttgcgaggacaccatgacctacaagtgcccccggatcacggaggccgagcccgacgacgtcgactgctggtgtaacgctaccgacacctgggtgacctacgggacctgtagccagacgggcgagcaccggcgcgacaaacggtcagtggccctagcgccccatgtgggcctgggactggagacccggaccgagacctggatgtcctcagagggcgcttggaaacagatccagcgggttgagacgtgggccttacgccatcccgggttcacagtgatagccctgtttctggcacacgccatcggcacctccataacccaaaaggggatcatattcatcctcctgatgttggtaacgcccagcatggccatgcggtgcgtcggcatcggctcacgcgatttcgtggagggcctcagcggcgcaacctgggtggacgtcgtcttggagcacgggagctgcgtgacaaccatggccaaggataagcccacgctggacatcgagctcctcaagaccgaggtcaccaaccccgcggtgctgcggaaattgtgtatcgaagccaagatctctaacaccacgaccgactcccgctgccccacccagggcgaagcgacactgatggaggagcaggacgctaatttcgtgtgtcggcgcaccttcgtcgaccgaggttgggggaacggttgcgggctgtttggcaagggatccctcatcacgtgcgccaagtttaagtgcgtgacgaagcttgaaggcaagattgtacagtacgagaatttgaagtactccgtgatcgtgaccgtacacactggcgaccagcatcaagtcgggaacgaatctaccgaacatggaaccaccgcgaccatcacaccccaagctcccacctctgagatccagctgaccgattacggggccctgacactggattgtagcccccgaacggggttagacttcaacgagatggttctactgaccatgaaagagaagagctggctcgtccacaagcaatggttcctggacctgccgctcccgtggaccagcggagcctcgacctcacaggaaacgtggaatcggcaggacctgctggtgaccttcaagactgctcacgcgaagaaacaggaagttgttgtgctcggcagccaggagggcgctatgcacactgccctgacgggggccactgagatccagacctccggcaccacgaccatcttcgccggacacctgaaatgccgcttgaagatggataagcttaccctgaagggcatgtcgtatgtgatgtgcaccggttccttcaagctagagaaggaggtcgcggagacacagcacggcaccgttctggtgcagatcaagtacgagggcaccgatgcaccatgcaaaatccccttttccacccaggacgaaaagggggtcacacaaaacggccggcttatcaccgccaacccaatcgtgacggacaaggagaagcccgtgaacattgaagccgagccgccattcggtgaatcctatatagtcatcggagcgggcgagaaggccctgaagctcagctggtttaagaaggggtcaagcatcggcaagatgttcgaggccaccgcccggggggcccggcgcatggcaatcctcggcgacacagcttgggacttcgggtccgtgggcggtgttttcaccagcgtcgggaagctggtccatcagatcttcggcaccgcctatggggttctgttctccggcgtcagctggaccatgaaaatcgggatcggtgtgctgctgacctggctcggcctaaactccaggtccacctcactgagcatgacttgcatcgccgtgggcctcgtcaccctttacctaggcgtgatggtgcaggccgactccgggtgcgtcatcaattggaagggccgggagctcaagtgcgggagcggcatcttcgtgacgaatgaagttcacacctggaccgagcaatacaagttccaggcggacagcccgaagcgcttatccgccgccatcggcaaagcctgggaggagggggtctgtggtatccgaagcgccacccgactggagaacatcatgtggaaacagatctccaacgagctcaaccacatactgctggagaacgacatgaaattcaccgtcgtagtcggggacgttgtagggatccttgcgcaggggaagaagatgatccgaccccaacccatggaacacaagtactcatggaaaagctggggcaaggcgaagattattggtgccgatattcagaacacgacatttatcatcgatgggccgaataccccggagtgccccgacgatcagcgggcctggaacatctgggaggtcgaggactacggcttcgggatcttcaccactaatatctggcttagactgcgtgacagctacacccaggtgtgtgaccaccggctgatgagtgccgcaattaaggacagcaaggccgtccacgccgacatggggtactggatcgagtccgagaagaacgagacctggaaactggcccgcgcgtctttcattgaggtcaaaacctgcatctggcccaagagccatacgctgtggagcaacggagtgctcgagtccgagatgataatcccgaaaatctacggtggcccgatcagccagcacaactaccggcccgggtatttcacccagaccgccggcccctggcacctggggaagttagaactcgacttcgacctgtgcgaggggaccacggtggtcgtggatgagcactgcggcaatcgtgggccgtccttgcggaccacaaccgtgactggcaagatcatccacgagtggtgctgccgcagctgcaccttgccacccctccgattcaaaggggaagacggctgttggtacggaatggagatccgacccgtcaaagagaaggaggagaacctcgtcaagtctatggtgtcggctggctctggcgaagttgatagttttagcctcggcctcctttgcatctccattatggtggaggaggtgatgcggagccggtggtcccggaagatgctcatgaccggaaccctggctgtgtttctattactcataatggggcagttgacgtggaatgacctcattcgcctgtgtataatggtcggcgctaacgcgtccgatcgcatggggatgggcaccacctacctggcgctcatggccaccttcaagatccgcccgatgttcgccgtggggctgctggtccgcaggctcacgtctcgcgaggtgctgctgctcaccatcgggctaagcctggtcgcatccgtggagctgccgaacagcctggaggagcttggcgacgggctagcgatgggtatcatgatcctcaagctgttaaccgactttcagtcccaccagctatgggccaccctgctcagcctgacgtttattaagaccaccctgtcgctccactacgcctggaagaccatggccatggtgctatccatcgtctccctgtttcccttgtgcctgagtacgacctcccagaaaaccacatggctacccgtgctcctgggcagcctgggatgcaagccgctcactatgttcctgatcacggagaacaaaatctgggggcggaagtcctggccgctgaacgaggggattatggcggtgggggtggtgagcatcctcttaagctccctgctcaagaatgacgtgcccttggccggtcccttgattgccggtggcatgctcatcgcctgctatgtgatatctgggtcatcagccgacctgtccctggagaaggcggcagaggtaagctgggaggaggaagcggaacactccggagctagccacaacattctcgtcgaggtccaagacgatggtacaatgaagatcaaggacgaggagcgcgacgacactctgaccatcctgctcaaggccacgttactcgcggtgtccggcgtctacccgctcagcatccccgccaccctgtttgtgtggtacttctggcagaagaagaagcagcggtcgggggtgttgtgggacaccccctctccacccgaggtggagcgcgcggtcttagacgacggaatctaccggatcatgcaacggggcctccttgggcggtcccaggtgggggtgggggtcttccaggaaaacgtgttccataccatgtggcacgtcacgcgcggagccgtacttatgtaccagggcaaacggctcgagcccagctgggcttccgtgaagaaggacctgattagctacggcggcggttggcgcctgcagggctcctggaacacgggggaagaggtgcaggtcatcgcggtggagcccggcaagaatccgaaaaacgtgcagaccgcccccggaaccttcaagacgcccgagggcgaggtaggcgccatcgccctggactttaagccaggaaccagcggctcgcctatcgtgaaccgggaggggaagatcgtgggcctgtacggcaacggggtcgtcacgacctccggcacgtacgtgagcgcgatcgctcaggccaaggcctcccaggaggggccgctccccgagatagaggacgaagttttccggaagcggaatctcaccatcatggacctgcaccccggcagcgggaagaccaggcggtatctgccggccatcgtgagagaggcgatcaagaggaagctacgcaccctgatactggcacccacgcgtgtggtcgcatccgaaatggccgaggccctaaagggcatgcccatccggtaccagaccaccgcggtcaagagcgagcacactgggaaggagatcgtggacttaatgtgccacgccacattcactatgcgcctgctctcccccgtccgggtgccgaattacaacatgatcattatggacgaggcacacttcacagaccccagctccatcgccgccagaggttacatcagcacccgggtaggcatgggggaggcggccgctatctttatgacggccacgccgccggggtccgtagaggccttcccgcaaagtaacgctgtgatccaggacgaggagcgcgacatacccgagagatcctggaatagcggctacgaatggatcaccgatttccccggcaagaccgtgtggttcgtcccctccatcaagagcggcaacgatatcgccaattgtctccgcaagaacgggaagagggtgatccagctgtcccgaaagacgttcgacaccgagtaccagaagaccaagaacaacgactgggactacgtggtcactacggacatcagcgagatgggcgccaatttcagggcggaccgcgtgatcgacccgagaagatgcctcaagcccgtcattcttaaggatgggcccgagcgggtgatcctggccggccctatgccggtgaccgtagcctccgccgcccaacggcggggtcgaatcggtcggaaccataacaaggagggtgaccagtacatctacatggggcagcccttaaataacgacgaggaccacgcccactggaccgaggcgaagatgctgcttgacaacatcaacacgccagagggtatcatcccggccctcttcgaacccgagcgcgagaagtccgcagccatcgacggggagtaccgcttgcggggcgaagcccgcaagacgttcgtggagctgatgcggcggggtgacctccccgtgtggctttcctacaaggtcgcgagcgagggcttccagtacagcgacaggcgatggtgcttcgacggcgagcggaacaaccaggtcctagaggagaacatggatgtagagatctggactaaggagggggagcgcaagaagctgcggcccaggtggctggacgcaaggacctactccgatcccctggccttgcgagagtttaaggagttcgccgccggccgacggagcgtatccggggaccttatcctggagatcggcaagctgccccagcacctcacgcagcgagcgcagaacgccctggacaacctcgtgatgctgcacaactcagagcagggcgggcgcgcttaccggcacgccatggaggagctgcccgacacgatcgagaccctcatgctgctggcactgatcgccgtgctgaccggcggtgtaaccctattcttcctatccggccgagggctgggcaagaccagcatcgggctactctgcgtcatggcctccagcgtcctgctttggatggcctcagtagagccccactggatcgccgcgtcaatcatcctcgagttcttcctgatggtgctcctcatacccgagccggaccggcagcgcacgccacaggacaaccagttggcctacgtcgttatagggctcctctttatgatcctgaccgttgccgccaacgagatgggcctgttagagaccaccaagaaggacttagggataggccacgtggccgtggagaaccaccaccatgccacgatgcttgacgtggacctccatccagcctccgcctggaccctgtatgcggtggccaccaccattatcacgccgatgatgaggcacaccatcgagaacactaccgcaaacatcagtctgacggccatcgcaaaccaggcggccatcctcatgggattagacaagggctggcccatcagtaagatggacataggcgtccccctgctcgcgctcgggtgctacagccaagttaatcccttaacactaaccgccgccgtgctcatgttggtcgcccactacgcgatcatcggcccggggctacaggccaaggcgacacgcgaggctcagaaacgcacagcggcaggcatcatgaagaatcccaccgtggacggaatcgtggcgattgatctcgaccccgtcgtgtacgacgccaaattcgagaaacagctgggccagatcatgctcctgatcttgtgcacgtcccagattttactgatgcggaccacgtgggccctgtgcgaaagcataacgcttgccacgggccccctgaccacgctgtgggaggggtccccgggcaagttctggaacaccacgatcgcggtgtccatggccaatatcttccgcggctcctacctcgccggcgccggcttagccttcagccttatgaaatccctcgggggcgggcgacgcggcacgggggcgcagggtgagacgttaggcgaaaagtggaagcgtcagctgaaccaattatcaaagagcgaattcaatatctacaagcgctccgggatcatggaggttgaccggagtgaagccaaggagggccttaagcgcggggagactacccggcacgccgtgtcccgcgggaccgccaaacttcggtggtttgtagagcgcaatctggttaaacccgaggggaaggtgatcgacttaggttgtggtcgcggcgggtggagctactactgcgcagggctgaagaaggtgacggaggtgaagggttacacaaagggagggcccggccacgaggagcccatcccaatggccacctatgggtggaaccttgtgaaactgcactccgggaaggatgttttcttcacgccgccggagaagtgcgacacgctgctgtgcgatatcggggagagctcacccaaccctaccatcgaggagggcaggaccctccgcgtcttaaagatggtggagccatggctgcgcgggaaccaattctgtataaagatcctcaacccttatatgcccagcgtagtcgagaccctggaacagatgcaacggaagcacggtggcatgctggtccgcaacccgctctctcggaacagcactcacgagatgtattgggtgtcctgcgggacgggcaacattgtctctgcggtgaacatgacctccagaatgctgctaaaccgcttcaccatggcccatcggaagcccacctacgagcgcgatgtggacctcggggccggcactcgacacgttgcggtcgagccggaagttgccaacctggacattattggccagcggatcgaaaacatgaagcacgagcataaatcaacctggcactacgacgaggataatccgtacaagacctgggcctaccacggaagctacgaggtgaagccgagcggctccgcctcgagcatggtgaacggggtcgtgaagctgttaaccaagccctgggacgtgattcccatggtaacgcaaatcgccatgaccgacaccacccccttcggccagcagcgggtgtttaaggagaaggtggacacgcgcaccccgaaggcgaagcgggggaccgcccagatcatggaggtcaccgcccgctggctctggggcttcctgtcccggaacaaaaagccccgcatctgcacgcgggaggagttcaccaggaaggttcgaagcaacgccgccattggggcggtgtttgtggacgagaaccagtggaactccgccaaggaggccgtggaagatgaacgcttctgggatctcgtacagaaggagagggaactacacaagcaggggaagtgcgccacctgcgtttacaatatgatgggcaagcgcgagaagaagctgggtgagttcggcaaggcaaagggcagccgggccatctggtacatgtggttaggggcccgcttcctggagttcgaggccctgggcttcatgaacgaagaccactggttctcccgagaaaatagcctctccggggtcgagggcgagggtctgcacaagctgggctacatcctccgcgacattagcaagatccctggcggtaatatgtacgccgacgacaccgcggggtgggacacacgcatcaccgaggacgacctgcagaacgaggccaagatcaccgacatcatggaaccggagcatgccttgctcgccacgtccatcttcaagctgacgtaccagaacaaggtagtccgcgtgcaaaggccagcaaagaacgggacagtgatggacgtcatcagccggagagatcagcggggctccggccaggtgggtacttacggcctgaacaccttcacgaacatggaagcgcagctcatccgtcaaatggagagcgaggggatcttcctgccctccgaacttgagacccccaacctggccgagcgggtgctggattggttagagaagtacggcgtcgagcgcctgaagcggatggccatcagcggggatgactgtgtggtgaagccaatcgacgaccgcttcgccaccgcgctcaccgcgctgaacgacatgggcaaggtccggaaggacattccccagtgggagcccagtaagggctggaacgactggcagcaagtccccttttgcagtcaccacttccaccagctcatcatgaaggatgggcgcgagatcgtggttccgtgtcggaaccaagacgagttggttggccgcgcccgggtgagtcaaggggccggctggagcctgcgagaaacggcctgcctcggaaaaagctacgcgcagatgtggcagctcatgtacttccaccggcgcgatctgcggctcgcagccaacgccatctgctctgccgtacccgtcgactgggtgcccacctcgcgaaccacctggagcatacacgcccaccaccaatggatgacgaccgaagacatgctgtccgtatggaaccgggtgtggatcgaggaaaacccctggatggaggacaagacccatgtgtccagctggggcgacgttccgtacctggggaaacgcgaggaccagtggtgcgggtccttaatcggtttgaccgcccgcgcaacctgggcaagcaacatacaagtagccattaatcaggtgcggcgcctcatcgggaatgagaactaccttgactacatgacgtcaatgaagcggttcaagaacgagggcgatcccgaaggtgcgctgtggtga

SEQ ID NO: 24296 - RNA, 9879 nt, synthetic construct
  misc_feature 1..9879: note = derived and/or modified CDS sequence (opt11) from DENV-1__GQ199783__SS-prME
  source 1..9879: mol_type = other RNA
tccgtgacgatgcttctcatgctgatgcctaccgccctcgcgttccacctgaccaccagaggaggggaaccccacatgatagtcaccaagcaggagcggggtaagtccctcctgttcaagaccagcgcaggggtgaacatgtgtacactgatcgccatggacctaggcgagctgtgtgaggacaccatgacgtacaagtgcccccgcattaccgaggcggaacctgacgacgtggactgctggtgcaacgccaccgacacctgggtcacctacgggacctgttcccagaccggggagcaccgccgcgacaaacgctccgtggcactcgcgccccacgtgggcctgggtctggagaccagaaccgagacctggatgtccagcgagggcgcttggaagcagatccaacgggtcgagacgtgggccctacgccacccgggtttcaccgtgatcgccctgttccttgcccacgccattggcactagcatcacccagaagggtatcatcttcatcctgctgatgctggtgacgcccagcatggccatgaggtgcgtcggcatcggctcccgcgacttcgtggaagggacatcaggtgcgacctgggtagacgtcgtcctcgagcacgggtcctgtgtgacaacgatggccaaggacaagccgacgttagacatcgagttgttaaagaccgaggtcacgaatcccgcagtgctacggaagctgtgcatcgaggccaaaatctccaacacgaccaccgactcccgctgccccacgcagggcgaagccacgctcatggaggagcaggacgccaattttgtttgccgccgcaccttcgtcgaccggggctgggggaatggctgtgggttattcggcaaggggagcctaatcacgtgcgccaagttcaagtgcgtaaccaaattagagggcaagatagtgcagtacgaaaacctgaagtactccgtcatcgtgactgtacacaccggcgaccagcaccaagtagggaacgagagcacagagcacgggaccaccgccacgatcacgccccaggctcctacctccgagatccagctgaccgactacggggccctcaccctggattgtagcccccgcaccggcctggactttaacgaaatggtgctcctgaccatgaaggagaagtcctggctggtccacaagcagtggttcctggacctgccgctgccatggacctcaggtgcttccacgtctcaggagacctggaaccggcaagacctcctcgtaaccttcaagacagctcacgcgaagaagcaggaggtagtcgtgctaggcagccaggagggcgccatgcacacagccctcaccggggccaccgagatacagacctccggcactaccaccatcttcgccgggcacctgaagtgccgcctgaagatggacaaacttaccctgaagggcatgagctacgtgatgtgcacggggtccttcaaactggagaaggaggtagcggagacccagcacggcactgtgctggtgcagatcaagtacgagggcaccgacgccccctgcaagataccattcagcacacaggacgaaaagggggtcacccagaacggccggcttatcaccgccaacccgatcgtgaccgacaaagaaaaacccgtaaatatcgaggccgaaccacccttcggtgagagctacatcgtcatcggcgcgggcgagaaagccctgaagctgtcatggtttaagaaggggtccagcatcggcaagatgttcgaggccacggcccgcggggctcggcgcatggcgatactgggtgacactgcctgggacttcggcagcgtgggcggagtgttcaccagcgtcggaaagctagtgcaccagatcttcggcactgcctacggggtcctgttctccggggtcagttggaccatgaaaatcgggatcggcgtgctcctgacctggctggggttaaattctcgcagcacctccctgagcatgacctgtatagcggtggggctggtaacgctctacttaggcgtgatggtgcaggcggactccgggtgtgtcatcaattggaagggtcgggagttaaagtgcggaagcggtatcttcgtgaccaacgaggtacacacctggaccgagcagtacaaattccaggcggacagtccgaaacgcctgtccgccgccattggcaaggcctgggaggagggagtttgtgggattcggagctccacccggcttgagaacatcatgtggaagcagatcagcaacgaactgaatcacatcctcctggagaacgatatgaagttcacggtggtggtgggggacgttgtgggcatcctagcgcaggggaagaagatgatcagaccccagcctatggagcacaagtattcctggaagtcgtggggcaaagcgaagatcatcggcgccgatgtccagaataccaccttcataatcgacgggcccaacacacccgaatgccccgacgatcaacgcgcatggaacatctgggaggtggaggactacggcttcgggatcttcacgacaaacatctggctcaaactgcgggactcatacacccaggtgtgcgaccaccggctgatgagcgcagcgatcaaggactccaaggccgtccacgccgacatggggtactggatcgagtcggaaaagaacgaaacgtggaagctcgctcgggcctccttcatcgaggtgaaaacgtgtatttggcccaagagccacaccctttggtccaatggagtgctggaaagcgagatgatcattcccaagatctacgggggcccgatctcccagcacaactaccgccccgggtactttacccagaccgcgggcccctggcacttgggtaagctggagctggatttcgacttatgcgaggggacgaccgtcgtggtcgatgagcactgcggcaaccggggacctagcttgcgcacaaccacggtaaccggcaagataatccacgagtggtgctgccggtcttgcaccctaccgcccctacgctttaagggggaagacggctgctggtacgggatggagatccggcccgtgaaggaaaaggaagagaacctggtcaaaagcatggtcagcgctggctccggcgaggtggacagtttttccttggggctcctatgcatcagtatcatgatcgaagaggtgatgcgctctagatggagccgcaaaatgctgatgaccgggacgctcgccgtcttcctgctgctcatcatggggcagctgacatggaacgacctgattcggttatgcatcatggtgggcgccaacgcctccgacaggatggggatgggcaccacctacttggcgctgatggccacgttcaagattcgcccgatgttcgcggtgggcctcctgtttcggcgcctcaccagtcgggaagtcctcctgctgactatcgggttgtccctggtggccagcgtagagctgcccaactccctggaagaactgggcgatgggctggccatgggcatcatgatcctgaagctgctgaccgacttccaaagccaccagttatgggcgacgctgttgtctctgaccttcataaagacgaccctgagcttacaccacgcctggaagacgatggctatggtactctctatcgtgagcctgttcccgttatgcctctccaccacctcccagaagaccacgtggctgcccgtcctgctcggttcgctgggctgcaagcccctgaccatgttcctcatcaccgagaacaagatttggggccgcaagagctggcccctgaacgaggggattatggccgttggtgtggtcagcatactactctccagcctgctgaagaacgatgtgccgctcgccgggccactgattgccggtgggatgctgattgcatgctatgtgattagtgggtcatccgccgacctcagcctagaaaaagccgcggaagtttcctgggaggaggaggccgaacactccggcgcctcccacaacatactggtggaggtgcaggacgacgggacgatgaagatcaaggatgaggagcgggacgacaccctcacaatcttactgaaggccacgttacttgccgtctctggagtgtacccgctgtccatccccgcgaccctcttcgtgtggtacttctggcagaagaagaagcagcggagcggggttctgtgggacaccccttctcccccggaagtggagcgggctgtgctggacgatgggatctacaggatcatgcagcgcggcctgctcgggcgcagccaagtcggcgtaggggtgtttcaggagaacgtctttcatacgatgtggcatgtaaccaggggcgccgtgttgatgtaccaggggaagaggctggagccctcttgggccagcgtcaagaaggacctcatctcctacggcggcggttggcgtctgcagggcagctggaataccggggaggaggttcaggtgatcgccgttgaacccggcaagaaccccaagaacgtgcagactgcgcccgggactttcaagacccccgagggcgaagtgggcgccatcgccctggacttcaaaccaggaacttccgggagccccatcgtcaaccgcgagggtaagatcgtaggcctctacggcaatggggtggtcaccacgagcggaacctacgtctccgcgatagcccagaccaaagcgagccaggagggccccctccccgagatcgaggacgaggtgttccggaagaggaacctaactatcatggatttgcaccccggctccgggaaaacgcggcgctacctgccagccatagttcgggaggccatcaagagaaagctgagaaccctcattctggcccccacccgcgtggtggcgtcggagatggctgaggccctgaagggcatgccaatccgttaccagaccacggctgtcaaatccgagcataccggcaaggagattgtggacctcatgtgccacgccaccttcaccatgcggctgctgtcccccgtgcgcgtcccgaactacaacatgatcatcatggatgaggcgcacttcacggatccctcatcgattgccgctcgggggtacatctccacccgagtggggatgggggaggctgccgcgatcttcatgaccgcgactcctcccggcagcgtcgaagcgttcccgcagtctaacgccgtcatccaagacgaggagcgggatatccctgagagaagttggaactccggttacgagtggatcacggactttcccgggaaaaccgtgtggtttgtccccagcataaagtccggcaatgacatcgcaaattgcctccggaagaatggcaaacgcgtcatccagctgagccggaaaactttcgacaccgagtaccagaagacgaaaaacaacgactgggactacgtggtgactaccgacatctccgagatgggcgccaatttccgcgctgacagggtcatcgacccacgcagatgcttaaagcccgtgattttgaaggacgggcccgagcgcgtcatactagccggccccatgccggttaccgtggctagcgcggctcagcggcgcgggcgtatcggccgaaatcataacaaggagggcgatcagtacatctacatggggcaacccctgaacaacgacgaagaccacgcccattggacagaggccaagatgctcttagacaacattaacaccccagagggcattatccccgccctcttcgagccggagcgcgagaaatccgcggccatcgacggggagtaccgcttgcgcggcgaggcccggaaaaccttcgtcgaactgatgcgccgcggggacctgcccgtgtggctcagctacaaagtggccagcgaaggcttccaatactccgatcgccggtggtgttttgacggcgagcgtaataaccaggtcctcgaggaaaacatggatgtggagatatggaccaaggagggggaacggaagaagctacgcccaagatggctcgacgccagaacgtactcggaccctctggcgctgcgtgagttcaaggagttcgccgcgggccgccggtcggtgagcggggacctcatcctggagatcggcaagctaccgcagcacctcactcagcgcgcccaaaacgccctggacaacctggtcatgctccacaactccgagcaaggcgggcgggcataccgccacgccatggaggagctgccagatactatcgagactctgatgctcctggctctgatcgccgttttaactggcggggtgacgttattcttcctctccgggcgtggtctcggcaagacgtccataggcctgctgtgcgtcatggcaagctccgtcctcttatggatggcttctgtggagccccactggatcgcggccagcattatcctggagttcttcctcatggtcctgctgatccccgagccggaccgacagcggacgccccaggacaatcagctcgcatatgtggtgatcgggctgctgttcatgatactcaccgtcgcggccaacgaaatgggcttacttgagacgaccaagaaggacctaggaattggccacgtggccgtggagaaccaccatcacgcgacgatgctcgacgtcgacctgcatcccgctagcgcatggaccttgtacgctgtggccactaccatcataacccctatgatgcgccataccatcgagaacacgaccgcaaacatctccctgaccgcaatcgcaaaccaggccgccattttaatgggtctcgacaaaggctggcccatcagcaaaatggacatcggcgtgcccctgctggccttggggtgctactcccaggtcaaccccctgaccctgactgccgcagtcttaatgctggtggcccattacgcgatcatcggcccggggctgcaagccaaggcaacacgggaagcccaaaaacgcaccgccgccggcatcatgaaaaatcccacagtcgacggaatcgtggccatcgacctcgaccccgtggtctacgacgcgaagttcgagaagcagcttggccagatcatgctgctcatcctatgcacgtcgcagatcctgttaatgcgcaccacctgggccctgtgcgagtccatcaccctcgccacgggccccctcactaccctgtgggagggcagcccgggaaagttctggaacacaacgattgcagtgtcaatggccaacatcttcagagggtcgtacctggcgggcgccggactcgctttcagcctcatgaagtcgctagggggcgggcgtcgggggacgggggcccagggcgagaccctcggtgagaagtggaaacgccagctgaaccagctgagcaagtccgagtttaatatctacaagcggagcgggatcatggaggttgaccgctccgaggccaaagagggcctaaagcgcggagagacgacgcgccacgccgttagccggggaacggccaagctgcgctggttcgtcgagcggaacctggtgaagcctgaggggaaggtgatcgaccttggctgcggccgcggcggctggtcttattattgcgccgggctcaagaaggtgacagaggttaagggttacaccaagggtggcccgggccacgaggagcctatacccatggccacgtacgggtggaacctggtcaagctacacagcggcaaggacgtgttctttacgccgcctgagaagtgcgacaccctcctttgcgatatcggtgagtccagccccaatccaaccatcgaggagggccggactcttcgcgtccttaaaatggtcgagccctggttacgggggaaccagttctgcataaagatactaaacccgtacatgccctccgtggttgagacgttagagcagatgcagcgcaaacacggtggcatgctagtccggaatccgctgagcagaaattccacccacgagatgtactgggtgagctgcggtaccggtaacatcgtgagtgccgtcaatatgacgtcccggatgctcctgaatcgcttcacgatggcccatcgcaagcctacctacgagcgggacgtggatctcggggccggcacccgccacgtcgccgtcgaacccgaggtcgccaacctcgacatcatcggtcagagaatcgagaacataaagcacgagcacaagtccacctggcattacgacgaagacaacccctacaaaacatgggcataccacgggagctacgaggtcaagccgtccggcagcgccagctccatggtgaatggggtagtcaagttgctgaccaagccctgggacgtgatcccaatggtgacccagattgccatgacagatactaccccattcggccagcaacgcgttttcaaggaaaaggtggatacgcgaaccccgaaagccaagcgcggcacggcccagatcatggaggtgaccgcgcggtggctctggggcttcctgagccgcaacaaaaagccccggatatgtactcgcgaggagttcaccaggaaggtgcgcagcaacgccgcaatcggtgccgtgttcgtggacgagaaccaatggaactctgccaaggaggcggtcgaggacgagcgcttctgggacctggtgcaaaaggagcgcgagctccataagcaaggcaaatgcgccacgtgcgtttacaacatgatggggaagcgcgagaagaagctgggggagttcgggaaggctaaggggtcccgcgccatctggtacatgtggcttggcgctagattccttgagttcgaggccttaggcttcatgaacgaggaccattggttcagccgcgagaactccctgagcggcgtagagggcgaggggttacacaagctgggctacatcctgcgggacatctccaagataccagggggcaacatgtacgctgacgacacagctgggtgggacacccgcataaccgaggacgatctacagaatgaagcgaaaatcaccgacatcatggagccggagcacgcgctgctggccacgagcatatttaagctaacataccagaacaaggtagtgcgggtccaacgccccgccaaaaacgggacggtgatggacgtgatatcccgccgcgatcagcgcggaagcggacaggtgggtacgtacggcctgaacacgttcactaacatggaagcccagctgatccgtcagatggagtccgagggaatcttcttacccagcgagctggagacccccaatctggccgagcgcgtgctcgattggcttgagaagtacggcgtcgaacgactgaagcgcatggcgatctccggggacgactgtgtagtaaagccgatcgacgaccggttcgcaaccgccctcaccgccctgaacgacatgggcaaggtgagaaaagacataccccagtgggagccgtcaaaaggctggaacgattggcaacaggtccccttctgcagtcaccattttcaccagctaatcatgaaggacggccgggagatcgtggtcccgtgccggaaccaagacgagctcgttggcagggcccgcgtgagccagggggcgggctggagcctgcgagagacagcctgcctggggaagtcctacgctcagatgtggcagctcatgtacttccaccgccgggatttgcgactcgcggccaacgcgatctgtagcgccgtgcccgtcgattgggtgcccacctccagaacgacctggagcatccacgcacaccaccaatggatgaccaccgaggacatgctctccgtgtggaaccgcgtctggattgaggagaacccgtggatggaggacaagacccacgtgagctcctggggcgatgtgccgtacctggggaagagagaggaccaatggtgtggtagcctgatcggcctcacggcccgcgcgacctgggcctccaacatacaagtcgccataaaccaagtccgccgtctgatcgggaatgagaactacctggactacatgaccagcatgaagcgcttcaagaatgaaggtgacccagagggagccctctggtag

SEQ ID NO: 24297 - RNA, 9879 nt, synthetic construct
  misc_feature 1..9879: note = derived and/or modified CDS sequence (opt11) from DENV-1__GQ199784__SS-prME
  source 1..9879: mol_type = other RNA
agcgttactatgctgctcatgctgatgcccaccgccctcgccttccacctcaccactcggggcggggagccccatatgattgtgaccaagcaagagcgaggcaaaagcctgctgttcaagactagtgcgggggtgaacatgtgcacattgatagcgatggacctgggcgagttgtgtgaggacaccatgacctacaagtgtcccaggatcaccgaggctgaacccgatgacgtggattgctggtgcaacgccaccgacacctgggtaacatacgggacctgcagccagaccggtgagcaccggagagacaagcggtctgtggccctcgccccgcacgtaggcctggggctggagacccgcaccgaaacctggatgtcgagcgaaggcgcctggaagcagatacagcgcgtcgagacgtgggcgctgcgccaccccgggttcactgtgatcgccctgtttctggcgcacgttatcggcacttcgatcacccagaaggggatcatctttatcctcctaatgctggtcacgcccagcatggccatgcggtgcgtggggatcggatcccgcgatttcgtggaggggctgagcggtgccacctgggtcgacgttgttctggaacacggttcctgcgtcaccaccatggccaaggacaagcccacgctggacatcgagctcctaaaaacggaggtaaccaacccagccgtgctgcggaagttatgcatcgaggccaaaatcagcaacacgacgaccgactcccgatgccccacccagggggaggccaccctgatggaggaacaggacgcgaactttgtatgtcgaagaacgtttgtggatcggggctgggggaacggctgtggactgttcgggaaggggagccttataacgtgcgccaagtttaagtgcgtgaccaagctggagggcaagatcgtccagtacgagaacctcaagtactcggtgatcgtgaccgtccacacgggcgaccagcaccaggtggggaatgagagcactgagcacggcaccaccgccactatcactccgcaagcgcccacatcagagatccagctcaccgactatggggccctgaccctggactgcagcccccgcacgggcctcgacttcaatgagatggtcctgctgacaatgaaggagaaaagttggctcgtgcacaaacagtggttcctcgacctgccgctcccctggacgagcggggcctccacctcccaggagacctggaatcggcaagacctgctggtgaccttcaagaccgcccatgctaagaagcaggaagtcgtggttctaggaagccaggagggtgctatgcacacagccctgacgggggccaccgagattcagactagtggcactacgacgatcttcgccgggcatctgaaatgtcgcttgaagatggataagctgaccctgaaaggaatgagttacgtcatgtgcacggggtcgttcaaactcgagaaagaggtggccgagacccagcatggcacggtgttggtccagatcaagtatgaaggaaccgacgcgccgtgcaagatccccttcagcacgcaggacgaaaagggtgttactcagaacggccggctaatcaccgccaacccgatagtgacggataaggaaaagcccgtcaatatcgaggccgagccgccctttggggagtcctacatcgtgatcggggccggtgagaaagctcttaagctctcctggttcaagaaggggtctagcatcggaaagatgttcgaggccactgcccgcggggcccggcgcatggccatcctgggcgacacagcgtgggactttgggtcgatcggcggggtgttcacctccgtcggtaagctggttcaccagatcttcgggaccgcctacggggtgctgttctccggtgtaagctggaccatgaagattgggctgggcgtccttctcacctggttaggtcttaactcaaggagcacctccctctcaatgacttgcatcgcagtgggcctggtcaccctatacctcggagttatggtccaagctgactccgggtgcgtcatcaactggaaagggcgtgagctgaagtgcgggagcggaatcttcgtgacgaacgaagtacatacgtggaccgagcagtataagttccaggccgactctcccaaaaggctgtccgcggccatcggcaaggcttgggaggagggcgtttgtggcatccggtctgcgactcggctcgagaacatcatgtggaaacagatctccaacgagctgaaccacatcctgctagagaacgacatgaagttcaccgtcgtggtaggggatgtggtgggcatcctggcccaggggaagaagatgattcggccccagcccatggagcacaagtactcatggaagtcctggggtaaagcgaaaatcatcggcgccgacgtccagaacacgacctttattattgacgggccgaatacccctgaatgccccgacgaccagcgcgcctggaacatctgggaggtggaggattacggcttcgggatctttaccacgaatatctggctgaagctccgtgactcacacactcaggtatgtgatcacaggttgatgtcagccgcgatcaaggactctaaggccgtccacgccgacatgggctactggatcgagagcgagaagaacgagacgtggaaactggcccgggccagctttatcgaggttaagacctgcatctggcccaagtcccatacgctctggagcaacggcgtgctggaatccgaaatgatcatacccaagatatacgggggccccataagccagcacaattacagacctggttacttcacccagaccgcgggcccctggcacctggggaaactcgagctggacttcgacttgtgcgagggcacgacggtcgtagtggacgagcactgcgggaaccgggggccgtccctccgcacgaccaccgtcaccggcaagatcattcacgagtggtgctgccgaagctgcacgctgccgcccctgaggtttaaaggggaagacgggtgctggtacggcatggagatccgtcctgtgaaggagaaagaggagaatctcgtcaagtccatggtcagcgccggctcgggggaggtcgactccttttcgctggggctgctctgcatctcaattatgatcgaggaggtgatgcgctcgcggtggagccgcaagatgctgatgaccggaacactggccgtttttctccttcttatcatgggtcagctcacgtggaacgacctgattcgactttgcatcatggttggcgccaatgccagcgatcgcatggggatgggaaccacctatctcgcgctgatggccaccttcaagatgcgcccgatgttcgctgtgggcctccttttccggcgcctgacgtcgcgggaggtcctgctcctgaccatcggcctgtcattggtggcctccgtcgagttgccgaacagtctggaggagctcggcgacgggctggccatgggtatcatgatcctgaagctcctgacagacttccaatctcaccagctgtgggccactctcctaagccttacttttatcaagaccaccctctccctgcactacgcttggaaaacaatggccatggtcctgagcatcgtgtccctctttccactgtgcctgtctacgacctcccagaaaaccacttggctccccgtccttttaggcagcttggggtgcaagccgctggcaatgtttctgatcgcggagaacaagatctggggccgcaagtcatggcccctgaacgaaggaatcatggctgtgggcgttgtctcgatcctgctctcctccttactgaagaatgacgtgccgctggcagggcccctcatcgccggcggcatgctgatcgcctgctacgtaataagcgggtccagcgcggacctttccctcgaaaaggcggccgaggtaagctgggaagaggaggccgagcactccggcgcctctcacaacatcctggtggaggtccaggacgacgggaccatgaagattaaggacgaggaacgcgacgacaccctgacaatcctcctgaaggcgacactgctcgcagtctccggcgtttatccgctgagcattcccgccaccctgttcgtgtggtacttctggcagaaaaaaaagcagcgctccggcgtcctttgggacacgcctagcccaccggaggtggagcgtgccgtgctggacgatggcatctaccgtatcatgcagcggggcttgctgggccgctcccaggtcggcgtgggggtgttccaagagaacgtctttcacacgatgtggcacgtgacccggggcgccgtgctgatgtaccagggtaaaaggctagagcccagctgggcgtccgtgaagaaggacttaatctcctacggtggggggtggcgcttgcaggggagctggaataccggggaggaggtccaagttatcgccgtggagcccgggaaaaatccaaagaatgtgcagacggcccccggtaccttcaagacccctgagggtgaggtgggcgcgatcgccctggacttcaagcccgggaccagcggctcccccattgtcaacagggaggggaagatcgtcggtctgtacggtaacggtgttgtcacgacaagcgggacgtatgtgagcgcgatcgctcaagccaaggcctctcaggagggaccgctcccggaaatcgaggacgaggtgttccggaagcgcaacctgacgatcatggacctgcacccaggttcggggaagactcggaggtacctcccggcgatcgtacgggaggccatcaagcgcaagcttcggaccctgatcctggcccccactcgcgtggttgcctcagagatggccgaggcccttaaagggatgcccatcagatatcaaaccacggccgtcaagagcgagcacaccggcaaagagatcgtggacctgatgtgccacgccacgttcactatgcggctcctgtcacccgtgcgcgtgccgaactacaatatgatcataatggacgaggcccattttactgaccccagctccattgccgcgcggggctacatcagcaccagagtaggaatgggggaggccgccgccatcttcatgaccgccacgccgcccggctccgtggaagcgttccctcagagcaacgcagtgatccaggacgaggagcgtgacatccccgagcgctcatggaactcagggtacgagtggattacggacttccccggcaagacggtgtggttcgtgccctccattaagtcgggcaatgacatcgccaactgtctgcgcaagaacggaaagcgcgtcatccagctctcccggaagacgttcgatactgagtatcagaaaacgaagaacaacgattgggactatgtggtgacgacagatatcagtgagatgggcgccaatttccgcgctgaccgggtcattgacccccgccggtgcctgaagcccgtgatcctgaaagacgggcccgagagagtcatcctcgccggcccaatgccggtcactgtggcatccgccgcacaacggcgcgggcggatcggtcgcaatcataacaaggagggcgaccagtatatctacatggggcaacccttaaacaacgacgaagaccacgcgcactggactgaggccaagatgctgctcgacaacatcaacacccccgagggcatcatccctgcgctgttcgagccggagcgggagaagtccgccgccattgacggggagtaccgcctgcggggcgaagcgcggaagaccttcgttgaactcatgcgccgcggagacctgccagtttggctgtcctacaaggtagcaagcgagggctttcagtacagcgaccgccggtggtgctttgatggcgagcgcaacaaccaggtcctcgaggagaatatggacgttgagatctggaccaaggagggggaacggaagaagctgcgcccccggtggcttgacgcccgcacgtattccgacccactcgctctgcgagagttcaaggagttcgccgcgggccgccggtcggtgtccggggacctgatcctcgagatcggcaagctaccgcagcacctgacccaacgcgcacaaaacgccctcgataacctggtgatgctgcacaacagcgagcagggcgggcgggcataccgccacgctatggaggagctccccgacaccatcgagaccctgatgctactcgctctgattgcagtactgacaggcggcgtcaccctcttcttcctgtccgggcgggggctggggaagaccagcatcggcctcttatgtgtcatggcgtccagtgtgctgctctggatggcctccgtggagccccactggatagcggcaagcataatcctggagtttttcctgatggtcctcctgatccctgagccagaccgccagcggaccccccaggacaaccagctggcctacgtcgtgatagggctcctgtttatgatcctgaccgtcgccgccaacgagatgggcctcctcgagacaacaaagaaggatctgggaatcgggcacgtggctgtggagaaccaccaccacgctaccatgctggacgtcgacctccaccccgcatccgcttggaccctttacgccgtggcgacgaccattatcacgccaatgatgcgccacactatcgagaacacgaccgccaatatctcgctcaccgccatcgcgaaccaggccgcgatcctgatgggactggacaagggctggcccatctccaagatggacatcggtgtgcccctcctggccttggggtgttatagccaggttaaccccctcaccttgacggctgcggtactgatgctcgtggcacattacgctatcatagggccagggctgcaggcaaaggctacccgggaagcgcagaagcgtaccgccgcaggtattatgaagaaccccaccgtcgacggaatcgtagccatcgacctggatcccgtggtttatgatgctaagttcgagaagcagctcggtcaaatcatgctgctcattctatgcacttcgcaaattctgctgatgcgcaccacctgggcgctctgcgagagcatcacgctggccacgggcccactgacaactctctgggaggggagtccgggaaagttctggaacaccacgatcgccgtgtccatggctaacatctttcgcgggagttatctggccggcgccggattagcgtttagccttatgaagtcccttgggggcgggagaaggggtaccggtgcacagggcgagaccctcggcgagaagtggaagcgccagttgaaccaactgtccaagtcagaattcaatatctacaagcgctccggtataatggaggttgaccgcagcgaagccaaggagggcctgaagcgcggggagaccacgcgccacgctgtctcccggggcaccgcgaaactgcgctggtttgtggagcggaacctcgtgaagcccgaggggaaagtcatcgacctgggctgcggccgcgggggttggtcctactactgcgccggtctgaagaaggttacagaggtgaagggctacaccaagggtgggccgggacacgaagagcccatcccgatggccacatacggctggaacttggtcaaactgcactccggcaaggacgtgttctttacgccgccggaaaagtgcgacaccctgctctgcgacatcggggaatcttcgccgaacccgaccattgaggagggccggacactgagggtcctgaagatggtcgagccctggctccgagggaaccaattctgtataaagatactcaacccctatatgccctcagtggtagagaccctggagcagatgcagcgcaagcacggcggcatgttagtacggaacccgctgtcacgcaacagcacacatgaaatgtactgggtgtcctgcggcaccggcaacatcgtcagcgctgtaaacatgaccagtaggatgctactgaaccgctttacgatggcccacaggaagcccacctacgagagagacgtcgacctgggggcgggtacccgccatgtggccgtcgagcccgaggtggccaaccttgacatcataggccagcgcatcgaaaatatcaagcacgaacacaagagcacctggcactacgacgaagacaacccctataagacgtgggcctaccacgggtcctacgaagtgaaaccgagcggctccgccagcagcatggtgaacggggtggtcaagctccttactaagccctgggatgtgatccccatggtgacacagatcgccatgacagacacgaccccttttggccagcagcgcgtcttcaaggagaaggttgacacccggacaccgaaggccaagcgcgggacggcccagatcatggaggtgaccgcccggtggctgtggggcttcttatcccgaaacaagaaacctagaatctgcactcgagaagagtttacccggaaggtgcgcagcaatgcagcgatcggtgcagtctttgtggacgagaatcaatggaactccgccaaggaggccgtcgaggacgagcgcttctgggacctggtgcagaaagagcgcgagctgcacaagcaggggaagtgtgcgacgtgcgtgtacaacatgatgggcaagcgggagaagaagttaggggagttcggcaaagccaaaggaagccgtgccatctggtacatgtggctgggtgcccggttcctcgagttcgaggccctcggcttcatgaatgaggatcactggttttcccgtgagaacagcctgtccggggtcgaaggagaggggctgcacaaactcggttacatactgcgggacatcagcaagataccggggggcaacatgtacgcggacgacacagccggctgggacacccgcatcaccgaggatgacctgcagaacgaggcccggatcacggacatcatggagccggagcacgcgttactggcaacctccatcttcaaacttacctaccagaacaaggtggtgcgcgtccagcgccccgctaaaaatggcaccgtgatggacgtgatcagccggcgcgaccagcgtggctccgggcaggtcggcacgtatggcctcaacaccttcacaaacatggaggcccagctgatccgccaaatggaaagcgaggggattttccttccctccgagctagagacccagaacctggccgagagagtgctggattggctggagaagtacggcgttgagcgcctgaagcggatggccatctcgggggacgactgcgtcgtaaagcccatcgacgacagattcgctacggcgttgaccgccctcaacgacatgggaaaggtgaggaaagacatcccccaatgggagccatccaaggggtggaacgactggcagcaagtccccttctgcagccaccacttccaccagctgatcatgaaggacggtcgcgagatcgttgttccctgtcggaatcaagacgagctagtcggccgcgcacgggtgtcccagggtgccgggtggagcctccgcgagaccgcctgcctgggcaagtcctatgcccagatgtggcaactgatgtactttcacagacgcgacctacggttggctgccaacgccatatgctccgcggtgcccgtcgattgggttcccacaagcaggacgacctggagcatccacgctcaccaccaatggatgaccaccgaagacatgcttagcgtgtggaaccgggtctggatagaggaaaacccttggatggaggataagacgcacgtgtccagctggggcgacgtgccttacctagggaagcgcgaagaccagtggtgcgggtcactgattggcctgaccgccagagccacttgggccagcaacatccaggtcgcgatcaaccaggttcggcgccttattgggaacgagaactacctcgattacatgacatccatgaagcggttcaagaacgagggtgacccggagggggccctgtggtga

SEQ ID NO: 24298 - RNA, 9879 nt, synthetic construct
  misc_feature 1..9879: note = derived and/or modified CDS sequence (opt11) from DENV-1__GQ199785__SS-prME
  source 1..9879: mol_type = other RNA
tccgtgacaatgctactgatgttaatgcccacagcacttgcgttccatctgaccacgcgcggaggtgaaccccacatgattgtttccaaacaagaaagaggaaaaagtctcttattcaaaacctcagctggggtcaacatgtgcactttaattgccatggacctaggagaactttgcgaagacacgatgacctacaaatgcccacgcatcacagaagtcgaacccgacgacgtggactgctggtgcaacacgaccgacacctgggttacatatggaacatgtagccagacaggagaacaccgacgagacaaacgcagcgtagcactggccccacacgtcggcctaggcctggaaacgcgtgccgaaacgtggatgtcatcagaaggggcgtggaaacagatccagaaagtagaaacatgggcccttcgccaccccggcttcactgtaatagcgctttttcttgcacatgcgataggaacttccatcacgcagaaaggtatcatcttcatccttttaatgctcgtaaccccgagcatggcaatgcggtgcgtgggcataggatccagagattttgtggaggggctcagtggagccacatgggtggacgtcgtcctagagcacgggagctgcgtcacaaccatggcgaaagataaacctaccctcgacatagaattactcaaaactgaagtcaccaatcccgcggtactacgcaagctgtgcattgaagcgaagatatcgaacacaactacagacagccggtgtccgacccaaggagaggcaactctagtagaggaacaagacgcaaacttcgtatgccgacgcaccttcgttgacagaggatgggggaacggttgtgggctctttggaaaaggatctctcatcacatgcgccaagtttaagtgcgtaaccaaactagaagggaagatcgtccagtatgagaatctgaaatattccgtcatcgtcacagtccacaccggcgaccagcaccaagttgggaacgagtcgaccgaacacggcacaaccgccacaataacgcctcaagcccccacgagcgagatccaactaacagactacggcgccctcaccctagactgcagccctcgaactggactagacttcaatgaaatggtgttacttactatgaaagagaaatcctggctggtccacaaacagtggttcctggatctacccctcccatggaccagcggtgccagcacgagccaagaaacctggaaccgtcaagacttactcgtaaccttcaagacagcacatgcgaagaaacaggaagtagtcgttctcggatcacaagagggggcaatgcacaccgcgctaacaggcgcgacggaaatacaaacatcagggacaaccacgattttcgctggtcatctgaaatgccggctaaaaatggacaaactcactctcaaaggaatgtcatacgtaatgtgcaccggctcgttcaaactcgaaaaagaagtcgcagagacgcaacatggaactgtcctcgtacaaatcaaatacgaaggcaccgatgccccgtgcaaaatccctttcagcacccaagatgagaaaggggttacacaaaacggaaggctcatcaccgcaaacccaatcgtgacagacaaagaaaagcctgtgaacatcgaggcggaaccgcccttcggcgagtcgtacattgtcattggcgctggagaaaaagccctaaagctcagttggtttaagaaaggatcgtctatcggaaaaatgttcgaagcaaccgcacggggagcccgaagaatggccatcttaggggacaccgcgtgggacttcggctcgatcggcggcgttttcacctccgtggggaagctggtgcaccaaatattcgggactgcgtacggcgtgctattttcgggcgtaagttggaccatgaagatcgggatcggcgtattactgacctggctcggacttaactctcgcagcacatccctaagcatgacatgcattgcagtcggcctcgtgacattatacctgggggtaatggtccaagcagactccggttgcgtaataaactggaaaggccgagaacttaagtgcgggagtgggatatttgtaacgaacgaggttcatacgtggacagaacaatacaaattccaggcggactccccaaagcggctgtcagccgctataggcaaggcctgggaggagggagtatgtggcatccgcagtgcgacacgcctcgaaaacattatgtggaggcagattagcaacgaactgaaccatattctgctcgaaaacgatatgaaattcacggtagtcgtcggggatgtcgtaggcatactagcccaagggaagaaaatgataagaccccaacccatggaacacaagtacagctggaaatcgtggggcaaggctaaaataataggcgctgatgtgcaaaatacaacctttataatagatggtccaaatacgcctgagtgtccagacgaccagcgcgcatggaacatatgggaagtcgaagattatgggttcggcattttcaccaccaacatatggctaaagctacgggacagttatacccaggtatgcgatcaccgccttatgtccgctgccataaaagacagcaaagcggtacacgccgacatgggctactggatcgaaagtgagaaaaatgaaacatggaagctcgcccgcgcgtcattcatagaggtgaaaacttgcatctggccaaaatcccacaccctgtggtcaaacggcgttcttgagagcgaaatgataatcccaaagatatacgggggcccgatcagccagcacaattatcgacctggctacttcacgcagactgcgggcccctggcatctcggcaagctggaactagatttcgacttgtgcgaagggaccacggtcgtcgtggacgaacattgcggtaaccggggaccaagtctcaggacaacaaccgtaacgggaaaaatcatacatgagtggtgctgtagaagctgcacactcccacccctccgctttaaaggggaggacgggtgctggtacggcatggaaataagacccgtgaaggaaaaagaagagaaccttgtgaagtcaatggttagcgccgggtcaggcgaagtagactcgttcagcctaggactcctatgcatatccatcatgatagaggaagtcatgaggagccggtggagccggaaaatgcttatgaccggaacactcgcggtgttcttcctactgataatggggcaactgacctggaacgaccttataagatcatgcatcatggtgggggccaacgcgtccgaccgcatgggcatgggcacgacgtacctcgcactgatggccacattcaaaatgcgcccaatgttcgcagtaggactgcttttccgtcgtctcacctccagagaagtgctcctgctaacaataggcctaagcctagtggcatcggtggagctacccaactcactcgaagaactgggggacggactggcaatggggataatgattctcaaactactaaccgattttcagtcttaccaactatgggcaacactcctatcactaacgtttattaaaactacattctcactccactacgcctggaaaaccatggcaatggtcctgagcatagtgagcctcctcccactctgcctcagcacaacaagtcagaaaaccacctggctgcccgtcttgttgggctcactcggctgtaaaccgctaacaatgttcctcatagcagagaacaaaatctggggtagaaaatcgtggcccttaaatgaaggaataatggcagtaggtatcgtatctattctgctcagttctctcctcaaaaacgatgtgcccctagcaggccctctgatcgctggcggcatgctcattgcatgctacgttataagtggtagctcagctgacttgagccttgagaaggccgcagaagtatcctgggaagaagaagccgaacattcaggagcctcgcataacatactggtagaggtacaggacgacgggacaatgaagattaaagacgaagaacgcgacgacacgctcacaatacttctaaaagcaaccttgcttgcagtcagtggagtttacccgctgagcatcccggcaacactcttcgtttggtacttctggcagaagaagaaacagcgcagcggggtattatgggacacaccaagcccacccgaagtcgaaagagccgtcctagacgatggcatatacaggatcatgcagagagggctcctgggaaggtcccaagtcggcgttggcgtattccaagagaacgtatttcacaccatgtggcatgtgaccagaggtgccgtgctgatgtatcagggcaagagactcgaaccctcgtgggcatccgtaaagaaggaccttatatcctacggagggggatggaggcttcagggatcgtggaacaccggggaggaagtacaagtgatagcagtggaacccgggaaaaaccccaaaaacgtgcagacagcgccagggacgtttaagacaccagaaggggaggtcggcgctatagccttggacttcaagcccggaacctccgggagcccaatagtgaaccgcgaggggaaaatagttggcttatacggaaatggagtcgttactacctccggaacgtatgtctcagcaatagctcaagccaaggcgagccaagagggaccgctgccagagatcgaggatgaggtgttcaggaaacgtaatttgacaataatggacctgcacccaggcagtggtaagacccgtcgatacctaccagcaatcgtccgggaggcgattaagcgcaaactcagaacgctcatattagcgcccacgagggtagtcgcaagcgagatggcagaggccctcaagggcatgccaatccgctatcaaaccacagccgtaaagagcgagcacacagggcgcgaaatcgtagacctcatgtgtcacgcaacctttacaatgcgtctcctcagtccagtccgagtacccaactataacatgatcatcatggatgaggcgcacttcaccgatccatcaagcatcgcggcgcgaggctacatctccacaagagtggggatgggtgaggctgcagcaattttcatgactgcgaccccaccggggtccgttgaagcgttcccgcaatccaacgcggtcatccaagacgaagaacgcgatatcccagagcgatcctggaacagcggatacgagtggatcactgacttcccaggcaaaaccgtctggttcgtgccatccatcaagagcggaaacgacatcgcaaattgtcttcgcaagaacggaaaacgagtcatccagttatcgcgaaagaccttcgacacagaataccagaaaactaaaaacaatgattgggactatgttgtcaccacggatatttcagagatgggggccaatttcagggcggaccgggtgattgacccccgacggtgtctaaaacccgtcatcctgaaagacggcccggagcgcgtgatactggcagggccaatgcccgtaactgtagccagcgcggcacaacgccgaggccgcatagggcgcaaccacaacaaggaaggcgaccaatacatctacatgggccagcccctaaacaacgacgaagatcacgctcactggacagaggcaaaaatgctactagataatataaacaccccggaaggaataataccggcactcttcgagccagagcgcgagaagtctgcggccatagacggagaataccgacttcgaggggaagcacgaaaaacgttcgtagaactcatgcgtcgcggcgatctacctgtatggctttcctacaaggtagcatccgagggattccaatattcagacaggagatggtgtttcgatggcgaacggaacaaccaagtcctagaggaaaacatggatgtggaaatctggaccaaagagggggaaaggaagaaactgcggccgcgatggctagacgcaagaacgtactccgaccccctcgccctgagagagttcaaagagtttgcggctgggagacggagcgtaagcggcgatttaatcctcgagatcggaaaactaccgcagcacctcacacaaagagcccagaatgcgctcgacaacctagttatgctccataatagtgagcaagggggcagagcctaccgccacgcgatggaagaactccccgacaccatcgaaacgctgatgctgctagcactgattgcggtgctaaccgggggagtgacactcttcttcctctcaggtaaggggctggggaaaacatcgatagggctcttgtgcgtgatggccagcagcgctctactttggatggcgtcagtcgagccacactggattgcagcgagcataatcctagagttcttcctgatggtacttctaatcccagaacccgatcgtcaacgcaccccacaggataatcaactagcatatgtggtgatcggcctattattcatgatcttgacggtcgcggcgaacgaaatgggcctacttgagacaaccaagaaagacctagggattggacacgtcgcagtcgaaaaccaccatcacgccacaatgctcgacgtagacctccatccggctagcgcctggacactgtacgccgttgccacaacgataatcacaccgatgatgcgtcacacgatagaaaacaccacagccaacatctccctaacggctatcgccaaccaagcggctatactaatgggcctagacaaaggttggcctatctcgaaaatggacatcggcgtcccactcctcgccctcgggtgctactcccaagtcaatccactcactctgacggctgccgtgcttatgctcgtggcacactacgcaatcataggaccagggctgcaagctaaggccacccgcgaagcccagaagcgaaccgccgccggaatcatgaagaatccaacggtcgatgggatagtagcaatagacctggatccagtggtctacgacgcgaaattcgagaagcagctaggccagatcatgctactcatactatgcacatctcaaatactccttatgcgcactacatgggccctatgtgagagcatcacactggcgacaggccccttaacgacattatgggaagggtcccccggaaaattttggaacaccacgatcgcagtatctatggccaatatctttcgcggcagctacctagccggagccggacttgcattctcgctaatgaagtcactcgggggcggcaggcgcggcactggggctcaaggcgaaacccttggcgagaagtggaaacgccaactcaaccagctgtcgaaaagcgaatttaacacctataagaggagcgggataatggaggtagacagaagcgaagccaaagaaggccttcgccgcggcgaaacaacgaaacacgctgtatcgcgaggaacagccaagctacgctggttcgtagagcggaaccttgtaaaacctgaaggtaaggtaatcgatctcggatgcgggcgaggtggatggtcgtattattgcgcaggactgaaaaaggtgacagaagtcaagggatacaccaagggagggcccgggcacgaggaaccgatacccatggcaacatatggctggaatctggtcaaactccatagcggaaaggacgttttcttcatcccgccggaaaaatgtgacacattattatgcgatatcggagagtctagccccaaccccaccattgaagaagggaggaccctcagagtcctaaaaatggttgaaccatggctaagaggtaaccaattctgtataaagatattgaacccatatatgccaagcgtcgtggagacactagagcagatgcaaagaaaacatggcggaatgcttgtaaggaacccattatcgcgaaacagtactcacgagatgtactgggtatcatgtggaacagggaacatagtatcagcggtaaacatgacaagccgcatgttattaaaccgctttaccatggcgcaccgcaaacccacgtacgagagggacgtagatttaggcgccggcacccgacacgttgcagtagaacccgaagtagcgaacctcgatattattggccagagaatagaaaacataaaacacgagcacaaaagcacgtggcactacgacgaagacaacccatacaaaacctgggcataccacgggagttacgaggtgaaaccgtccgggtcagccagcagcatggtaaacggagtagtgaagctcctgacgaaaccatgggacgtaatacccatggtaacccaaatagcaatgacggacacgacgccattcggacagcagcgagtcttcaaagaaaaagtggacacacgcacgcccaaagcaaaacgcgggacagcccagattatggaagtcaccgcgaaatggctatggggctttttgagccggaacaagaagccacgtatctgcacgcgagaggagttcacccgaaaggtgcgaagcaacgcagcaatcggcgcggtcttcgtggacgaaaatcagtggaacagtgccaaagaagcggtcgaagacgaacgcttctgggacctagtacatcgggagcgtgaactacataagcaagggaaatgcgcaacctgcgtatacaatatgatgggaaaaagagagaagaaacttggcgagttcggcaaagccaaagggtcacgggcgatatggtatatgtggctaggtgccagattcctagagttcgaagccctaggcttcatgaacgaggaccactggttctcgagagaaaacagcctaagcggtgtggagggcgaagggctacataaactaggttacatcctacgggacataagtaaaatcccaggcgggaacatgtacgccgatgacacagcagggtgggataccaggattactgaagatgatctgcaaaatgaggccaaaataactgatatcatgaaacccgaacatgccctcctagcaacatcaattttcaaactgacctaccaaaacaaagtagttcgggttcaacgccccgcgcgaaatggcacggtaatggacgttatatcacgtcgtgaccaacggggatccggacaggttggcacatacggcctaaacacattcacgaatatggaggcacagctcatacgacaaatggaaagcgaaggaatcttcagcccaagcgaattagaaaccccgaatctggcagaacgggttttagactggctagagaaacatggcgtagaaagactaaagagaatggccataagtggcgacgactgcgtggttaaaccaatcgacgaccgattcgcgaccgcgctgtccgcgctgaacgatatgggcaaggtacgcaaggacatccctcaatgggagccatccaagggctggaacgattggcagcaggtaccattttgtagccaccatttccaccaactcataatgaaagacggaagggagatagtggtaccctgcagaaaccaagacgaacttgtagggcgcgcacgcgtctcacaaggtgcaggctggtcactacgcgagacagcatgtctaggtaagagctatgctcaaatgtggcaactgatgtacttccaccgcagggacctacgcttggcagcaaacgccatttgcagtgccgttccagtcgactgggtgccaacttcgcggacaacctggtccatccacgcgcaccaccaatggatgacaaccgaagatatgctaagtgtatggaatcgagtatggatagaagaaaacccatggatggaagacaagacacacatctcgtcgtggggcgacgtcccatacctcggaaaaagggaggatcaatggtgtggctcactgatcggactcacagcccgggctacctgggcaacaaacatccaagtggcaatcaaccaagtgcgtcgattaatcggcaacgaaaactacctcgactacatgacgagcatgaaacgatttaaaaatgagtccgaccctgaaggtgcgttatggtag

SEQ ID NO: 24299 - RNA, 9879 nt, synthetic construct
  misc_feature 1..9879: note = derived and/or modified CDS sequence (opt11) from DENV-1__GQ199786__SS-prME
  source 1..9879: mol_type = other RNA
agtgtgaccatgcttttaatgctgatgcccacggccttagccttccatttaaccaccagagggggagaaccgcatatgattgttagcaaacaagaacgcgggaagtcgttacttttcaaaacctcggcgggagttaacatgtgcacgttaatcgcgatggatctaggagaactatgcgaagataccatgacgtataaatgcccccggataacggaaacggaacccgacgacgtcgactgctggtgcaatgcaacggacacatgggtgacatatggaacatgcagccaaactggagaacaccgaagagataagaggtccgtggcccttgccccacacgtcggtctcggacttgaaacaaggactgaaacgtggatgtcatccgaaggagcctggaaacagatacagcgcgtcgaaacatgggcgttaagacatccaggtttcacggtcatagcgctgttcctagcacacgcaatcggaacctccatcacgcagaaaggcatcatcttcatcctactaatgctggtgacaccgagcatggcgatgagatgtgttggtattggatcacgcgactttgtagagggcctctcgggcgcaacgtgggtagacgtcgtcctagaacacggttcgtgcgttacaactatggcaaaagacaaaccgaccctcgacatcgagctgctaaagacggaggtgaccaatcccgctgtcctaagaaagctctgcatcgaagcgaagattagcaacacgaccaccgactcaagatgcccaacacaaggagaagcgaccctggtggaagaacaagacgctaacttcgtctgtcggagaaccttcgtcgatcgcgggtggggtaatgggtgcggcctcttcggaaaaggctccctgataacgtgcgccaaattcaagtgcgtcaccaagctggagggaaagattgtgcagtatgaaaacttgaaatactcagtgattgtgacagtgcacacgggcgatcaacatcaagtcggcaatgagtcgaccgaacacggcactacagcgacaattacacctcaggcccccaccaccgagatacaacttacggactatggcgcgcttacactagactgctccccgagaaccggactagacttcaacgaaatggttctgctcacgatgaaagaaaaatcatggttggtccacaagcagtggttcctagacctcccgctaccctggacaagcggcgcctcgacaagccaagagacatggaaccgccaggatctcctcgtcacattcaaaacggcacacgccaagaaacaggaagtagtggtgcttggaagccaagaaggggccatgcatactgcgctcactggagccacagaaattcaaacaagcggaacgaccacaatcttcgcaggacacctcaaatgcagactcaagatggacaaactcactctgaagggcatgtcctatgtcatgtgcacgggatcatttaaactcgagaaagaagtagccgaaacacagcatggcaccgttctggtacaaatcaagtacgaaggcaccgacgcgccctgcaaaataccatttagcacccaggatgagaaaggcgtgacgcagaacggccgattaattacggcaaacccaatagtcaccgacaaagaaaaacccgtaaatattgaagcagaacccccatttggcgaatcatacatagtcataggggctggagaaaaagccctcaaactctcttggtttaagaaagggagctcgatagggaaaatgtttgaagctaccgccagaggggcgcgacggatggctatcctgggcgatacagcatgggacttcggatcaatcgggggagtcttcacctctgtcggcaagctggtccaccagattttcggaaccgcctatggagttctcttctccggggtctcttggaccatgaaaataggaatcggcgtactactaacatggttagggctcaattctagaagcacttcactgtcaatgacatgcattgcagtagggttagtgaccctttacctcggcgtgatggtgcaagcagactcaggctgcgtaatcaactggaagggaagagaattgaaatgcggcagtggcattttcgtcaccaacgaggtccacacctggactgagcaatacaaattccaagcggatagtcctaagcgcctttctgcagcgatcggaaaagcgtgggaagagggggtctgcggaatccgcagcgcaacacggctagagaatattatgtggaaacaaatcagtaacgaactaaaccatatcctattagagaacgacatgaagttcacggtcgttgtcggcgacgtagccggaatcctcgcccaaggaaagaagatgatcaggccgcaacccatggagtacaaatatagctggaaatcatggggaaaagcaaaaattatcggggcagacgtacagaatactaccttcatcatagacggaccgaacacccccgagtgccctgacgatcaaagagcgtggaacatttgggaagtcgaagattatggcttcggaatcttcaccactaatatatggttaaaactacgagattcatacacccaggtatgtgaccaccgacttatgagcgccgccatcaaagacagcaaagcggtccacgctgacatggggtactggatagaatccgagaaaaatgagacatggaaattagcgcgagcgagcttcatagaggtgaagacttgcatatggcctaaaagccacacactctggtcgaacggtgtcttagagtcagaaatgataatcccgaaaatatacggaggaccgatctcacaacacaactaccgccccgggtacttcacgcagacggcagggccttggcacctcggcaaactcgaactagacttcgacttatgtgaaggaaccacggtcgtggtagacgaacattgcggtaacagagggccgagcctgcgtacaaccacggtgacaggcaaaataatacacgagtggtgttgcaggtcctgcacgctccctcctctacgcttccggggagaagatggctgctggtacggcatggaaatacgtccagtcaaggagaaagaagagaacctcgtcaagtcgatggtaagcgcaggcagcggggaagtagactccttctctctcgggctactctgcataagcatcatgatagaagaggtaatgcgaagccgctggagtagaaaaatgctcatgacgggtacactagctgtctttttcctgctgataatgggacaattaacatggaacgacctcatacgcctatgcattatggtaggtgccaatgctagcgaccgcatgggcatgggaactacgtatctggccctaatggcaaccttcaaaatgcgaccgatgttcgcagtcggcctcttgttccgacgtttaaccagccgggaggtcttactcctaacgattggactaagcctagttgcaagcgtggaattgccgaacagcctggaggagttgggtgacgggctcgccatgggtataatgatcttaaaacttctaaccgactttcagtcgcaccaactatgggcaacattactgtccttgacgtttatcaagacgacattctcacttcattacgcctggaaaaccatggccatggtactaagcatcgtcagcctcttcccactttgccttagcacgacttcccaaaagacgacctggctaccagtactgttgggcagtctaggttgtaaacccctgaccatgttcctaatagcagaaaacaagatctggggccgccggagctggcctctcaacgagggaattatggctgtaggcatcgtatcaattctgctttccagtctgttgaaaaacgacgtcccactcgcggggccactaatagccggcggaatgctcatagcgtgctacgttattagcggatcctcggccgacctgtcactggaaaaggcggccgaagtatcatgggaagaagaagcggagcactcaggggcatcccacaacatcctcgtcgaggtccaagacgatggcacaatgaaaataaaagacgaagaaagagacgacacattaacgatactgcttaaggcaaccctccttgctgtaagcggagtttacccgttgtccatcccggccacactattcgtctggtacttctggcaaaagaagaaacaaagaagtggcgtactctgggatacaccgagtccaccagaggtcgagcgcgcagtactagacgacggaatatacagaatcatgcaaagaggcttgctggggaggagccaagttggagtaggcgtgttccaagaaaacgtgttccacactatgtggcacgtgacaaggggcgcggtgctcatgtaccaaggcaagcgactagagccctcatgggcatcagtgaaaaaggacctgatcagttacggcgggggatggaggctccaaggatcctggaacacgggcgaggaggtacaagtaatagcggtcgaacccggcaaaaacccaaagaacgttcaaacagcccctggaacgttcaaaacgccagaaggggaggtgggagcaattgctctcgacttcaaaccgggaacttccggatcaccaatcgtaaaccgcgaaggaaaaatagtaggcctctatgggaacggagtagtcacaactagcggaacatacgtgtccgcaattgcccaagccaaagcatcccaggagggcccgctccccgaaatcgaggatgaggtatttcgcaagagaaacctaacgattatggacctccacccaggctccggcaagacacgtcgctacctaccggccatcgtgcgggaagcaataaaacggaaactgcgaacgcttatcctggcgccaacgcgggtcgtagcctccgagatggccgaagccttgaagggcatgccaataaggtaccagacgacggccgtgaagagtgagcataccggaaaggaaattgtagatttgatgtgccacgccacgttcacgatgcgactattatcaccagtgcgtgtacccaactacaacatgataatcatggacgaggcccacttcactgaccccagttctattgcggcacgcggttacatatcgacacgagtcggaatgggagaggccgcagcaattttcatgaccgccacaccccctggctcggtagaggcctttccccaatccaatgccgtaatacaggacgaggaaagggatatcccggagcgatcgtggaacagcgggtacgaatggataactgatttccccggcaaaacagtctggttcgttccgagtatcaaatcagggaacgatatcgccaactgtctacgcaagaacggaaaacgggtaatacagctctcacgcaagaccttcgacaccgaataccagaaaacgaaaaacaacgactgggactatgtcgtgactacagacattagcgaaatgggggctaattttagggctgacagggttatcgacccacgccgttgcctcaagccagtaatcctcaaggatggccccgagcgagtgatcctagccgggccaatgccagtcacggtggccagtgccgcacagagaaggggccgaataggacgcaaccacaacaaggaaggggatcaatatatatatatggggcagccgctcaacaacgacgaagaccatgctcactggacagaggcaaaaatgcttttagataacataaatacacctgaaggcatcattcccgccctattcgagcccgagagagagaaatccgctgccatcgacggggaataccgcctgcgtggtgaggcaaggaaaacgttcgttgaactcatgaggcggggcgatctccctgtatggcttagctataaggttgccagcgaaggatttcaatactcagaccgcagatggtgtttcgatggagagagaaataaccaagttttagaagaaaacatggacgtggagatttggacaaaagaaggcgaaagaaagaaactcagaccacgatggctcgacgccaggacctactcggacccgctcgccctccgagaatttaaagagttcgccgccggcagacgtagcgtcagtggagacctaatattagaaattggaaaactgccccaacatctaacacaacgagctcagaacgccctagataaccttgtaatgctccataacagcgagcaaggaggccgcgcttaccgtcacgctatggaagaacttccggacaccattgaaaccctgatgttgctagccttgatcgcggtcctcaccggcggggtaatactattcttcctaagcggacgcggactaggcaaaaccagcatcgggctcctctgcgttatggcgagcagtgtgctactttggatggcgtccgtcgagccacactggatagccgcgtctatcatactcgagttcttcctgatggtgctcctaataccagaaccagaccgccagagaacaccccaggataaccagctcgcctacgtagtcataggactactcttcatgatcttaacagtagcggcgaatgaaatgggtttactcgagaccaccaagaaagacctcggcataggacatgtcgcagtcgagaatcaccatcacgcagccatgttggacgtggatctgcaccccgcctctgcgtggacactctacgctgtagcaaccacaatcatcacgccaatgatgcgccacacgatcgaaaacacaacagctaacatcagcctcactgcgatcgcaaatcaggcggcaatactgatgggactggacaaaggctggcccatctctaagatggacatcggggtccccctcctagccctcgggtgctactcgcaagttaacccgctgacattgaccgctgctgtcctaatgctagtagcgcattacgccatcataggaccgggcctccaggcaaaggcgacgagagaggcgcaaaaacggacagcggctgggatcatgaaaaaccccactgtcgacggaatcgtagcgatagatcttgatcccgtcgtttatgacgcgaaattcgagaaacaactcgggcagatcatgctcctcatcctctgcacaagtcaaatcctcctcatgagaacgacttgggccttatgcgagagtatcaccctggcgactggaccccttaccaccctctgggaaggcagccctgggaaattctggaacaccaccatcgccgtatccatggcgaacatattccggggctcgtacttagccggtgcaggactagcattctcactaatgaaaagcctcggcggtggacgacgggggaccggagcccagggtgaaaccttgggggagaaatggaaacgccaactcaaccagcttagtaagtccgagttcaacacatataaacgtagcgggatcatggaagttgaccgctccgaggcaaaagaaggtctaaagcgcggggagacaaccaaacacgctgtgtctcgtggtaccgcgaaactccgatggttcgtcgaacgtaatctagtaaaaccagaaggtaaagtcatcgacttggggtgtggaagaggcggatggagttactactgtgctggtctcaagaaagtaaccgaagtaaaagggtacacaaaagggggaccggggcacgaagaaccgataccaatggccacatacgggtggaatctagtgaagttacactctggcaaggacgtcttctttattccccctgaaaagtgcgacactctgctctgcgacataggtgaatcctcccctaatcccacgatagaagaaggaaggacattgagagttctaaaaatggtggaaccgtggctacgcggaaatcaattctgcatcaaaatcctaaacccctatatgccgtccgtcgtcgaaactctggaacagatgcaacgaaagcacggcggaatgctggttcgaaaccctttgtcgcgcaatagcacacacgagatgtactgggtatcctgtggcactgggaacatagtgagcgccgttaatatgacgtcccgaatgctactaaaccgattcacgatggcccaccgaaagcccacatacgaaagagacgtagacttgggagcaggaacaagacacgttgccgttgagcccgaagtggccaacctcgatataatcggccagcgcattgaaaacatcaagcatgaacacaaatctacctggcactacgatgaagacaatccgtataagacgtgggcttatcacgggtcatacgaagtaaaaccctcgggaagcgcatcaagcatggtgaacggggtcgtgaaactactcactaaaccgtgggatgtgatccccatggttacgcagatcgccatgacagacaccacccccttcggccaacaaagagtttttaaagagaaagtggatacgcgaaccccaaaggccaagcgagggacagcccaaatcatggaagtaacggcgaagtggctgtggggcttccttagcaggaacaagaagcctcgaatctgcacgcgggaggagtttacgcgaaaggtccgctccaacgctgccataggtgcagttttcgtggacgaaaaccagtggaactcagccaaggaggccgtcgaagatgaaagattctgggacttagtccaccgggaaagggaattgcacaaacagggcaagtgcgccacctgtgtctacaatatgatgggaaagcgcgagaagaagctgggagagttcggcaaggccaaagggagccgggccatatggtacatgtggctaggagcccgattcctagagttcgaagccctcggctttatgaacgaagaccactggttctcccgcgaaaacagcctcagtggcgtagagggcgagggtcttcacaagctgggatacatcttgcgcgacatatcgaaaatccccgggggaaatatgtatgctgatgacaccgccggatgggatacgcggataaccgaagacgacctccagaacgaagcacgtattacggacatcatggagccagagcacgccctcctggccaggtccatcttcaaactgacctatcaaaacaaagtggtccgtgtacaacgaccagcgaaaaacggaacagtaatggacgtgataagtcgacgagaccagcgtggctcaggacaggtggggacctatgggttaaacaccttcacgaacatggaggcgcaactcattcgtcaaatggaatcggagggaatcttcagcccttcggagctcgaaactcctaatttagcggaacgagtcctagactggcttgaaaaatacggcgttgaacgacttaaacgcatggcgatctcgggagatgattgcgtagtaaaaccgatagacgatagattcgcaaccgccctaacagcccttaacgatatggggaaggttaggaaagacataccacagtgggagccgagtaagggctggaacgactggcaacaagtacctttctgtagccaccacttccaccaactaataatgaaagacggccgcgaaatcgtagttccatgcagaaaccaggacgaacttgttggcagagcaagggtctcacaaggcgccgggtggtctcttcgggaaaccgcatgtcttgggaaatcctacgcccaaatgtggcagttaatgtacttccacagacgcgacctccgcctagcagcaaacgcgatttgctcggccgtacccgtggactggatcccaacatcaagaaccacatggtccatacacgcgcaccaccaatggatgaccaccgaggacatgctatctgtgtggaaccgagtctggatcgaagaaaacccctggatggaggacaagacccacatcagctcatggggagatgtaccctacctaggcaaacgggaagaccagtggtgcggatcactaatcggcctaaccgcgagggccacatgggctaccaacatccaggtcgccataaaccaagtacgccgcttaataggaaatgaaaactacctagactacatgacctcaatgaaacgcttcaagaacgaaagcgacccggaaggggcactgtggtga

SEQ ID NO: 24300 - RNA, 9879 nt, synthetic construct
  misc_feature 1..9879: note = derived and/or modified CDS sequence (opt11) from DENV-1__GQ199787__SS-prME
  source 1..9879: mol_type = other RNA
agcgtgaccatgctgctgatgctggtccccacagccctggctttccacttaaccacccgtggcggggaaccccacatgatcgtcaccaagcaggagcggggaaagagtctgttattcaagaccagcgcgggggtaaacatgtgcaccctaatcgccatggacctgggtgagctgtgcgaggacactatgacatacaaatgccctcggatcacagaggccgagccggacgatgtcgactgctggtgtaacgccaccgacacctgggtcacctacgggacttgtagccaaaccggggagcacaggcgggacaagcgtagcgtggcactcgcgcctcacgtagggctggggctagaaacccggactgaaacctggatgtccagcgaaggcgcttggaagcaaatccaacgggtggagacttgggccctccgacaccccgggttcaccgtaatcgccctgtttctggcgcatgcgatcgggaccagtattacccagaaggggatcatcttcatccttttgatgctggtgacgccctcgatggccatgcggtgtgtgggcataggatcccgcgacttcgtggaagggctctccggcgccacctgggtcgacgtggtcctggagcacggctcctgcgttaccaccatggcaaaagacaagcccacgctggacatcgagctactgaagaccgaggtgaccaaccctgcggtgctacggaagttatgcattgaggcgaagatcagcaacacaacgaccgattcccgctgccccacccaaggcgaggctaccctgatggaggagcaggacgccaactttgtttgccgacgcacattcgtggacaggggctgggggaacggctgcgggttgtttggcaaaggaagcctaatcacgtgcgccaagtttaagtgcgtgaccaaactggaaggcaagatcgtgcagtacgaaaacctgaagtactccgtgatagtcacggtccatacgggcgaccagcaccaggttggaaacgaaagtaccgagcatggcacaacagccacgatcacgccccaagctccaacctcggagatccagctcacagattacggggctctgaccctggactgcagccccagaacgggcctcgacttcaacgagatggtcctgctcaccatgaaagagaagtcctggctcgtgcacaagcagtggttcttagacctgccgctgccctggacctctggcgcctcgacctctcaggagacgtggaatagacaggacctgttggtgaccttcaaaaccgcccacgcgaagaagcaggaagtagtggtgctcggatcacaggagggcgccatgcacaccgcccttactggggcaacggagatccaaaccagtggcaccacgacaatattcgctgggcacctgaagtgccgcctcaagatggacaagctgacgctgaaggggatgagctacgtcatgtgcactggctccttcaagctcgagaaagaggtggcggaaactcagcatggtaccgtgttggtccagatcaagtacgagggtaccgacgccccctgcaagataccattctccacccaagatgagaagggggtgattcagaatggtcggttgatcacggccaaccctatcgtgaccgacaaagaaaagcccgtaaacattgaagccgagccgcctttcggggagtcctatatcgtgatcggcgtgggcgagaaggcgctgaagctcagttggttcaagaagggttcttcaatcggcaagatgttcgaagccacagcacgcggggcgcggcgtatggccattctaggggacaccgcgtgggatttcgggtccatcggcggcgtcttcacgtcagtaggtaagttagtgcaccagatattcggcaccgcctacggggtccttttctccggcgtgagttggacaatgaagattgggatcggcgtgcttctgacctggctcggtctgaactccaggagcacgtccctgagcatgacctgcatagctgtcggtctcgtgaccttatacctcggcgtgatggtccaggcagattccgggtgcgtgattaactggaagggacgggagctgaaatgcggaagcggcatcttcgtgaccaacgaagtccacacgtggactgagcagtacaagttccaggccgacagcccgaagcgcctgtccgcggccattgggaaggcatgggaagagggggtgtgcggcatccggtctgccacccgcctggagaacatcatgtggaagcagatcagtaacgagctcaatcacatcctgctggaaaatgacatgaagttcacggtggtcgtgggtgacgtcgtcggcatcctcgcccaggggaagaagatgatccggccccaacccatggaacataagtacagctggaagtcgtggggtaaggcaaagataatcggagccgacgtccagaacaccacgttcattatcgacgggcctaacaccccagagtgccccgacgaccagcgcgcctggaacatatgggaggtggaggactacgggttcgggatcttcaccaccaacatctggctcaagctgcgggattcgtacacccaggcctgcgaccaccgcctgatgtcggcggcgattaaggacagcaaggccgtccacgccgacatgggttactggatagagtccgaaaagaacgagacctggaagctagcacgggcgagcttcatagaggtgaagacgtgcatctggccgaagtcgcacaccctgtggagtaacggtgtgctcgagtccgagatggtcatccccaagatttacggtggcccaatctcacagcacaactaccgccccgggtatttcacgcagacggccggtccttggcacctgggaaagctcgaactcgatttcgacctgtgcgagggaaccactgtggttgtcgacgagcactgcggtaacagggggccctcccttagaactaccactgtgaccggcaagatcatacacgagtggtgctgccggagctgcacgttgccgcccctacgttttaaaggagaggacggttgctggtacggaatggagatcagaccagtgaaagaaaaagaggaaaacctggtcaagtccatggtgagcgccggcagtggcgaagtggacagtttctccctcggactgctctgtatctccatcatgattgaagaggtcatgcgatcccggtggtccaggaaaatgctaatgaccggcaccctggccgtgttcctgctcctgatcatgggccagctcacctggaatgatctcatccggctgtgcatcatggtgggggccaacgcgagcgaccgcatggggatgggcaccacctacttggcgctcatggctacgttcaaaatgcgcccgatgttcgccgtcgggctgctgttccggcgcctcacctcacgggaggttctgctgctcacgatcgggctgagcctggtcgccagcgtggagctccccaacagcctggaggagctgggcgatgggctcgcgatgggaatcatgattcttaagttactcacggactttcagtcccatcagctgtgggccacactgctcagtcttacattcatcaagacgaccctaagtctccattatgcgtggaagaccatggccatggtgctgtcgatcgtctccctgttccccctctgcctgagcaccacctctcagaagaccacctggctgcccgtgctcctgggcagcttgggatgcaagccgttgaccatgttcctcatcgcggagaacaagatttggggccgcaaatcctggccccttaacgagggtatcatggccgtgggggttgtgtcgatcctcctgagctccttgctcaagaacgatgtgccgttagccgggccactgatagccggcggcatgctcatcgcttgctatgtaattagcgggagtagcgcggacctgagcctggagaaggcggccgaagtttcttgggaagaggaagcagagcactccggcgctagccataacatactcgtggaggttcaagatgacgggacgatgaaaattaaggatgaggagcgggacgatactctgaccattctgctcaaggcaaccctgctggctgtatccggcgtgtacccgctctcgatccccgcaacgctgttcctgtggtacttttggcagaaaaagaagcagcgcagtggtgtcctgtgggacactccctcaccgcctgaggtcgagcgggcggtgctcgacgacggaatctatcgtatcatgcaacgggggctgctcgggcgctcccaagtaggcgtgggggtgtttcaggagaacgtcttccacaccatgtggcacgtaacccggggcgccgtgctgatgtaccaggggaaacgactggaaccctcgtgggcttccgtcaagaaagatttgatcagctacggcggggggtggcgtttgcagggcagctggaacaccggggaagaggttcaagtgatcgcagtcgaacctggcaagaaccccaagaacgtacagacggcccccgggaccttcaaaacccccgaaggcgaggtaggcgccatcgcgctggacttcaagcccggaacttccggtagtccaatcgtcaaccgggaggggaagatagtcggcctgtacggcaacggggtggtcaccacaagcggcacatacgtgagcgcgatcgcccaggccaaagcgtcccaagagggaccgcttcccgagatcgaggatgaggtgttccggaagcggaatttgaccatcatggacctgcaccccggcagcgggaaaacgcggcgctacctccccgcgatcgttcgagaggccatcaaacgcaagctgcgaaccctcatactcgcacctacccgcgtggtagcatcagagatggccgaggcgctgaagggcatgcccatccgctaccagactacggccgtcaagtctgagcataccggtaaggagatcgtggacctaatgtgccacgccacattcaccatgagactacttagtccagtgcgtgttccgaactacaacatgatcatcatggacgaagcccatttcacggatccctcgtctatcgccgctaggggatacatcagcaccagagtaggcatgggcgaagctgccgcgatcttcatgaccgccacaccgcccggctccgtggaggcgttcccgcaaagcaacgccgtcatccaagacgaggagcgggacatacctgaacgttcttggaactctgggtacgagtggataacggactttcccggcaaaaccgtctggttcgttccctctatcaagagtggaaatgatatcgccaactgcctacggaagaacgggaagcgcgtaatccagctctcccgcaagaccttcgacacagagtatcagaagacgaagaacaacgactgggattacgttgttaccacggatatcagcgagatgggcgctaacttccgcgcggacagggtgatagacccgcgccggtgtctgaaacccgttatcctaaaagacgggcccgagcgggtgatcctcgccggcccaatgcctgtcaccgtggcctccgccgcccagcggcgcgggcgaatcggcagaaaccacaataaggagggtgaccaatacatctacatgggtcagcccctgaacaacgacgaggaccatgcccactggacggaagcaaaaatgctgctagacaacatcaatacccccgaaggcatcatccccgctctgtttgagccggagcgagagaagtccgctgcgatcgacggtgagtaccggctgcgcggcgaggcaagaaagactttcgtcgagttaatgagaaggggagatctgccggtgtggctgtcttacaaggtggccagtgagggctttcagtacagcgaccgtcggtggtgcttcgacggcgagcgcaataatcaggtcctcgaggagaatatggacgtggagatttggacaaaggaaggggagcgtaaaaagctgcgcccacgctggctcgatgccagaacgtattcggaccccctcgcactgcgggaattcaaggaatttgccgcgggacgccggagtgtgtccggggacctgatccttgagatcggcaagctccctcagcacctaacccagcgcgcccagaatgccctcgacaacctggtcatgctacacaacagcgagcagggaggtcgggcctaccgccacgctatggaagaactacccgacaccattgagaccctgatgctgctcgccctgatcgccgtgctgacggggggggtaacacttttcttcctgtccggccggggcctggggaaaaccagcatcggcttactgtgtgtaatggcgtccagcgtgctgctctggatggcatccgtggaaccccactggatcgcggcctcaatcattttagagttcttcctgatggtcttgctcatacccgagccggaccgccagcggacgccccaggataaccagctggcctacgtagttatcgggctcctttttatgatcctgaccgtcgccgccaacgagatgggcctccttgagacgaccaaaaaggatctgggaatcggccacgtggcggtggagaaccaccaccacgctaccatgttggatgtcgaccttcaccccgcctccgcatggaccctctacgcggtggcgacgaccatcattaccccaatgatgcgacacaccatcgagaacacgactgccaatatctcactcacggctatcgccaaccaggccgcgatcctgatggggctggacaaggggtggcccatatccaagatggacatcggcgttcccctcctggcactggggtgctatagccaggtcaaccccctcactttaactgcggccgtgttaatgcttgtggcgcactacgccatcatcggccccggtttacaagccaaggcaacgcgggaagcccagaagagaaccgcggctggcatcatgaagaacccgacggtagacgggatcgtggccatcgaccttgaccctgtcgtctacgacgccaagtttgaaaagcagctaggccaaatcatgttgctgattctctgcacgtctcagatcctgcttatgcggaccacttgggcgctatgtgagagcattaccctggcgacaggcccactgaccacattatgggagggctcccccggcaagttctggaacaccacgatcgccgtgagtatggccaatatcttccgagggagttacctggccggagctggcctggcgtttagcctcatgaagtccctcgggggcgggcgccggggtaccggcgcccagggcgagacgctgggcgaaaaatggaagaggcagctcaaccagctgtccaagagcgaattcaacatctacaaacggtccggtatcatggaggtggaccgcagcgaggccaaggaaggcttgaagcgcggggagaccacgcgccacgccgtctcccgaggcactgcgaagttacgctggtttgtcgaaagaaacttggtcaagcccgaggggaaagtcatagacctcggctgtggacgcgggggctggagctactactgcgccgggctgaagaaagttaccgaggtgaagggctacaccaagggagggccgggccacgaagagcccatccctatggccacgtacgggtggaatctggtcaagctgcattcgggaaaggacgttttcttcacccccccagagaagtgcgacaccttactctgcgacatcggggagtcatctcccaacccgaccattgaagagggccggacgttgcgcgtgttaaagatggtcgagccgtggttacgggggaaccagttctgcatcaagatcctaaacccctacatgcccagcgtggtggagactctggagcagatgcagcgcaagcatggcggcatgctcgtgcggaaccctctgtcccggaactctacacacgaaatgtactgggtatcctgcgggaccgggaacatcgtgtcagcagtcaacatgacatcgcggatgctgttgaaccgcttcacgatggcccaccgtaagcctacttacgagcgggatgtggatctgggggcgggcacacgccacgtggcggtcgaacccgaagtggccaacttagacataatcgggcaacggatagagaacatcaagcacgagcacaaaagcacctggcattacgacgaggacaatccctacaagacatgggcctaccacgggtcctatgaggtaaagccgagcggctctgcctccagcatggtgaacggggtggtcaagctcctcactaagccctgggacgtgatccccatggtcacccaaatagcgatgaccgatacgaccccattcggccagcagcgtgtcttcaaggagaaggtggatacccggaccccgaaggccaagcgcggtacagctcagataatggaagtgacagcccggtggttatggggcttcttatctcgtaacaaaaaaccccggatctgcacccgcgaagaattcacccgaaaagtccgctcgaacgccgcaatcggcgccgttttcgtggacgaaaaccagtggaactcagccaaggaggccgtcgaagacgagcggttctgggatttagtccaaaaagagcgcgagctgcacaagcagggtaagtgcgctacgtgcgtgtacaacatgatggggaagcgcgaaaagaagctgggggagttcggcaaggctaaagggtcacgcgctatttggtacatgtggctgggagcccggttcctggaattcgaggctctcggatttatgaacgaggatcattggttttctagagaaaatagcttgagcggggtcgagggcgaggggctgcacaaactcgggtatatcctgcgggacataagcaaaattcccgggggcaacatgtacgccgacgatacagccggctgggacacccgcatcaccgaggacgatctgcaaaacgaagccaagatcacggacatcatggagccggagcatgcgttactggccacctccattttcaagctaacctatcagaacaaggtggtccgggtccagcgccccgctaagaacgggacggtaatggatgtgatcagccgccgagaccagagggggtccgggcaggttggcacgtacggcctcaacacattcactaatatggaggcccagctgatcagacaaatggagtctgaggggatctttctgccctccgagcttgagactcctaatctggccgagcgcgtacttgactggctcgagaagcacggcgtggaacggctgaagcgcatggcgatatcaggggatgactgtgttgtgaagccgatcgatgatcggttcgcaactgcgctaaccgcactcaatgatatgggcaaggtgaggaaggacataccccaatgggagccctccaaggggtggaacgactggcagcaggtccccttctgcagccaccatttccaccaactgatcatgaaggacggccgggaaatcgtggttccctgccgcaacgaagacgagctggtcggacgcgctcgcgtgagtcagggggctgggtggtcgctacgggaaaccgcctgtttgggaaagagctatgcacagatgtggcaactgatgtacttccaccggcgggacctccgcctggccgctaatgctatctgttccgcggtaccggtcgattgggttcccactagccggacgacctggtccatccacgcccaccatcagtggatgacgaccgaggatatgctgagcgtgtggaaccgcgtctggatcgaagagaacccctggatggaggacaagacacatgtgtccagctggggcgacgtgccgtacctcgggaagagagaggaccagtggtgcggatccctgatcggattaaccgcccgtgccacctgggcctccaacatacaggtcgcgatcaaccaagtacgccggctcatcgggaatgagaactacctagattacatgacctccatgaaacggttcaagaacgagggcgaccccgagggtgccctgtggtaa

SEQ ID NO: 24301 - RNA, 9879 nt, synthetic construct
  misc_feature 1..9879: note = derived and/or modified CDS sequence (opt11) from DENV-1__GQ199788__SS-prME
  source 1..9879: mol_type = other RNA
agcgtgactatgctgctcatgctgatgcccaccgccctggcattccatctcacgacccggggcggggaaccgcacatgatcgtgtccaagcaggaacggggtaagagcctgctgttcaagaccagcgcgggggtgaacatgtgcactctcatagcaatggacctgggggagttctgcgaggacacgatgacctacaagtgcccccggatcaccgaagccgagcccgacgacgtggattgctggtgcaacgccactgacacgtgggtgacctacgggacctgtagccagaccggcgagcaccggcgggacaagcggtccgtggccctggcgccccacgtgggcctcgggctggagacgcgcaccgaaacttggatgagcagtgagggggcctggaagcaaatccagcgggtggagacctgggcgctgcgccatcccgggttcacggtgatcgccctcttcctggcacacgcgatcgggaccagcattacccagaagggaattatctttatcctcctcatgctggtgacgccctccatggcaatgcggtgcgtgggcatcggcagccgcgacttcgtggagggtttgtccggcgccacgtgggtggacgtcgtgctagagcacgggtcttgcgtgaccaccatggccaaggacaagcccaccctggacatcgagctgctcaagacggaagtcacaaaccccgcggtgctgcggaaactgtgcatcgaagccaagatctccaacaccaccacggacagcagatgcccgacccagggcgaggccaccctcgtggaggagcaagacgctaactttgtctgtcggcgcacattcgtggaccggggctgggggaacgggtgcgggctgttcggcaaggggtccttaatcacgtgcgcgaagttcaaatgcgttactaagctcgagggcaagactgttcagtacgaaaacctgaagtacagcgtcatcgtgaccgtccacacgggcgaccagcaccaagtggggaacgagtccacagagcacggcactaccgccaccatcactccccaggcccccagcaccgagatccagctgaccgactacggggccctcaccctggattgttcaccccggacgggcttagacttcaacgagatggttctcctgaccatgaaggagaagtcctggctagtgcacaagcagtggtttctcgaccttcctctcccctggacaagcggcgcgtccacctcccaagagacttggaaccggaaggacttgttagtgacctttaagaccgcccacgcgaagaagcaggaggtcgtggtgctgggctctcaggaaggggccatgcacaccgccctcacgggagcaaccgagatacaaaccagcggcaccacgaccatcttcgccgggcacctgaaatgccgcctaaagatggacaagctcaccctgaaggggatgtcctatgtcatgtgcaccgggagcttcaagctggaaaaggaggtggcggagacgcagcacggcaccgtgctcgtccagatcaagtacgagggtactgatgccccctgcaagatcccgttttccacccaggatgagaagggggtgacgcagaatgggcggctgattacagccaacccgattgtgaccgataaggagaaacccgtcaacatcgaggcggagccgccgttcggggagtcctacatcgtgatcggcgcgggcgagaaggccctaaagctgtcctggtttaagaaggggagctcgatcggcaagatgttcgaggccaccgcccggggtgcccggcgcatggctatcctcggtgacacggcctgggacttcgggagcatcggcggcgtgtttacctccgtcggtaagctggtccaccagatcttcgggaccgcctacggggtcctgttcagtggcgtctcctggaccatgaaaatcgggatcggcgtgttgctgacgtggctgggcctcaactctcgctccaccagcctgtccatgacctgcatcgccgtagggctggtcaccctctacctgggcgtgatggtgcaggccgacagcgggtgcgtcatcaactggaagggccgggagctcaaatgcgggagcggtatcttcgtgacgaacgaggtgcatacctggaccgaacagtataagttccaagcagactccccgaagaggctctcggccgccatcggcaaggcgtgggaggaaggggtctgcggcatccggtccgccacccgccttgagaatataatgtggaagcaaatcagcaatgagctgaaccatatcctcctggaaaatgacatgaagtttaccgtggtggtcggggacgtggcgggcatcttagcccaggggaagaagatgatccgtcctcagcccatggagtacaagtactcctggaaaagctggggtaaggccaagatcataggcgccgacgtgcagaacacaacctttataatagacgggcccaataccccagaatgccccgacgaccagcgcgcgtggaatatctgggaggtagaggactacgggttcgggatcttcaccacgaacatctggctcaagctgcgagactcctacacccaggtgtgcgaccatcgcctgatgagcgccgccatcaaggactccaaagccgtgcatgccgacatgggctattggatcgagtccgaaaagaacgagacatggaagctcgcccgagcctccttcatagaggtcaagacatgcatctggcccaagtcacacaccttgtggtccaacggggtactggagagcgagatgatcatccccaaaatctacgggggcccgatctcccagcacaactaccgccctgggtacttcacccagaccgccggcccatggcacctcgggaagctggagctggacttcgacctctgcgagggcaccacggtggtggtggatgagcattgcggcaaccggggtccgagcttgcgcaccaccacagtaacgggtaagatcatccatgagtggtgctgccggtcatgcactctgcctccgctgcgcttcaagggcgaggacggctgctggtacggaatggagatccggcccgtcaaggagaaggaggagaatctggtcaagagcatggtgagcgccggctccggcgaggtcgacagcttctccctggggctcttatgcatcagcatcatgatcgaggaggtgatgcgctccagatggagccgcaagatgctgatgaccggtaccttggccgtcttcttcctgctgatcatggggcagctcacatggaatgacctcatccgtctgtgcatcatggtcggcgcgaacgcctccgaccgaatggggatgggcacaacctacctcgcgctcatggcaacattcaagatgcgcccgatgttcgccgtgggcctcctgttccggcgtctcacgagccgggaggtgctgctcctgacgattggtctgtccctggtcgcgagcgtggagctgcctaattccctggaggagctcggggacgggctggccatgggcataatgatcctgaagctactgacagatttccagagccaccagctgtgggccaccctcctttccctgacgttcatcaagaccaccttcagcctccactatgcatggaagaccatggcgatggtcctgtccattgtgagcctgttccccctctgtctgagtacgaccagccagaagaccacctggctgcccgttctcttaggctctctcggttgcaagcccctcacgatgttcctgatcgccgagaacaaaatatggggccgcaaaagttggcctctgaacgaggggatcatggccgtcggcatcgttagcatcctcctgtcctccctgctcaagaacgacgttccgctggccgggcccctgatagccggtggcatgttaatcgcgtgctacgtcatctccggcagcagtgccgacctgtctctggagaaggccgctgaggtgtcctgggaggaggaggccgagcacagcggcgcgagccacaacattctcgtggaggtccaggacgacggtacgatgaagatcaaagacgaagaacgcgacgacactctgaccatcctgctcaaggccaccctgctggccgtgtccggcgtctacccgctctccatacccgccacgctgtttgtctggtacttctggcagaagaagaagcagcgcagcggggtgctgtgggacacaccctctcctcccgaggtggaacgagcagtgctcgacgacggcatataccgaatcatgcagcggggtctcctggggaggtcacaggtgggcgtaggggtgttccaggaaaacgtgttccacaccatgtggcacgttaccagaggggcggtcttaatgtaccaggggaagcgcctcgagccatcctgggctagcgtgaagaaggacctgatctcctacggtggcgggtggcggctgcagggctcatggaacaccggagaggaggtgcaggtcatcgccgtggagcccggtaagaatccgaagaacgtgcagaccgcacctggtacattcaagacctccgaaggcgaggtcggcgccatagctttagacttcaagcccgggacgagcggcagtcctatcgtgaatcgagaagggaagattgtaggcctttatggcaatggggtcgtgacgacctccggaacctacgtgagcgccatagctcaggccaaagcgtcccaggagggtcccctgccggagatcgaggacgaggtcttccggaagcgcaacctcacgatcatggacctgcaccctggcagtgggaagactcggagatacttgcccgccattgtgagagaggccatcaagcgcaaacttcggaccctgatcctggccccgaccagggtggtcgcctccgagatggccgaggccctcaagggcatgcccatccgctaccagacgaccgccgttaagtccgagcacacaggcaaggagatcgtggacctgatgtgccacgccacgttcacaatgaggctgttgtcccccgtccgcgtgcccaactacaacatgatcataatggacgaggcccacttcaccgacccaagctcgatcgctgcccgggggtacatcagcacgcgcgtgggcatgggggaggctgccgccatcttcatgacggcgaccccgcccggctccgtcgaggccttcccccagagcaatgctgtaatccaggatgaggagcgggatatcccagagcgctcctggaacagcgggtacgagtggatcacagacttccccggcaaaaccgtgtggttcgtaccctccatcaagagcggcaacgacattgccaactgcttgcggaagaacgggaagagagtgatccagttatcccggaagaccttcgacacggagtaccagaagaccaaaaacaacgactgggactacgttgttacaaccgacatcagcgagatgggcgcgaacttccgcgccgaccgggtgatcgaccctagacggtgcctcaaaccggtgatcctgaaggacgggcccgagcgcgtcatcctggccggccccatgcccgtaacggtcgccagcgcggcacagcgccgcgggcggatcggccgcaaccacaacaaggagggcgaccagtatatctacatggggcagccgctcaacaacgacgaggaccacgcgcactggaccgaggcgaagatgctgttagacaacataaacacccccgagggcatcatcccggccctctttgagcccgaacgggagaagtccgccgcgatcgacggggagtaccgcctgaggggcgaggcccggaagaccttcgtagagctgatgcgccgcggggacctcccggtgtggctgagttacaaagtcgcctcggagggcttccagtacagcgaccgccggtggtgcttcgacggcgagaggaacaatcaggttctggaagagaacatggacgttgaaatctggaccaaggagggggagagaaagaagctccggccccggtggctagatgcccgcacatacagcgaccccctggccctccgcgagttcaaggagttcgcggcaggccgtcggagcgtcagcggggacctgatcctggagattggcaagctcccccagcacctgacgcaacgcgctcaaaacgctctggacaacctcgtgatgttgcacaacagcgagcagggcgggcgtgcgtaccgacacgccatggaggagctgccggacaccattgagacgctcatgctgcttgccttaatcgcggtcttaaccggcggggtcaccctattcttcctctccggccgggggctcggaaagaccagcatcggcctgctctgcgtgatggcctccagcgtcctgctgtggatggcgtccgttgagccccactggatcgccgcctcaatcatcttagagttctttctgatggtgctgctgatcccagagcccgaccgccaacgaacaccccaggacaatcagctcgcctacgtggtcatcgggctcctgttcatgatcctgacggtggccgctaacgagatgggcttgcttgagaccaccaagaaagatctggggatcggacacgtggccgtcgagaaccatcatcacgccgccatgttggacgtggacttgcaccccgcctccgcttggacactgtacgccgtggccacgaccatcatcacgcccatgatgcgccatactatcgagaacacgaccgccaacatttccctgaccgccatcgcaaaccaggccgccatcctcatggggctggacaagggatggccgatctccaaaatggatatcggtgtacccctgctagccctggggtgttactcacaggtgaaccccttaacgctgaccgcggccgtactgatgctggtcgcacactacgccatcatcgggcccggtctccaggccaaggcgacccgggaggcccagaaaagaacagctgccggcattatgaagaacccgacggtggacgggatcgtggccatcgacctggaccccgtcgtgtacgacgcgaagttcgagaagcagctgggccagataatgctcctgatcctctgcacgtcccagatcctcctgatgcgcaccacctgggctctctgtgagagcatcaccctcgccacgggccctctgaccaccctatgggaggggtcccctggcaagttttggaacaccacgatcgccgtgagcatggccaacatcttccgtgggtcgtacctcgcgggcgccggcctggccttttccttaatgaagtccctcgggggagggcgccgaggcacgggggcccaaggcgagaccctgggcgagaagtggaagagacaactgaaccagctcagtaagagcgagttcaacacctataaacggtccgggatcatggaggtggaccgaagcgaggcgaaggaaggcctgaagcgcggggagacgaccaagcacgccgtgtcccgcggcaccgcaaagctccggtggttcgtggagagaaacctcgtcaagccggaggggaaagtgatcgacctcggttgtggccgcggcgggtggagctactactgcgcggggctgaagaaggtgaccgaggtgaagggttacacaaagggtggccccggccacgaggagcccattcccatggccacctacggttggaacctggtgaagctccactccggcaaagacgtgttctttatcccgcctgagaagtgcgacaccctgttgtgcgacattggggagagctcccccaaccccaccatcgaggaggggcggactctccgggtcttaaaaatggtggagccttggctgcgcgggaaccagttctgcatcaaaatcctcaatccgtatatgcccagcgtggtggagaccctggagcagatgcagcggaagcacggcggcatgctggtgcgcaaccccctctcccggaacagcacacacgaaatgtactgggtgagctgtgggacgggcaacatagtcagcgctgtgaacatgacctcccgcatgctgctgaaccgcttcacgatggcccatcgtaagcctacctacgaaagggacgtggacctgggggccggcacccggcacgttgccgtggagcccgaggtggcgaatttggatatcataggccaacgaatagagaacatcaagcacgagcacaagagcacttggcactacgacgaagacaacccctacaagacatgggcgtaccacggttcatatgaggtcaagccctcaggcagtgccagctctatggtgaacggggtggtgaagctgctcaccaagccgtgggacgtgattcctatggtcacccagatcgccatgaccgacacgacacccttcggccaacagcgagtgttcaaggagaaggtggacacccgcacccccaaggccaagcggggcacggcccagatcatggaggtcaccgctaagtggctgtggggcttcctgtccaggaacaagaagccccggatctgcacacgagaggagttcacccggaaggtgcggagcaacgccgccatcggcgccgtgttcgtcgacgagaaccagtggaactcagcgaaggaggcagtggaggacgagcggttctgggacctcgtgcaccgcgagcgggagcttcacaagcaagggaaatgcgccacatgtgtctacaacatgatgggcaagcgggagaagaagttgggggagttcgggaaggccaaggggagcagggccatatggtacatgtggcttggcgcgcgtttcctggagttcgaagccttaggcttcatgaacgaagaccactggttctcccgggagaactcactctccggggtggagggcgaggggttacacaaactgggctacattctgcgcgacatcagcaagatcccaggagggaacatgtatgccgacgacacagccggctgggacacccggatcaccgaagacgacttacagaacgaggccaagatcacggacattatggagcccgagcacgcgctgctagccaagtctatcttcaagttgacctatcaaaacaaggtggtccgtgtgcagcggccggccaagaacgggaccgtcatggacgtcatcagccgccgcgatcagcggggatccggccaggtgggcacttatggcctgaacacattcaccaacatggaggcccagctaatccgacagatggagagcgaggggatcttctccccctctgagctggagacaccaaacctagcccggcgagtactcgactggctagagaaacacggcgtcgagcgtttgaagcgcatggcgatctccggggacgactgcgtggtgaaaccgatcgacgaccggttcgccaccgcactcactgccctgaacgatatggggaaggtccgcaaggacatcccgcaatgggagcctagcaaggggtggaacgattggcagcaggtccccttctgcagtcaccacttccaccagctgataatgaaagacggccgggagattgtggttccctgccggaaccaggacgagctcgtgggccgggcccgggtgtcccagggagcgggttggtccttacgagaaaccgcctgcctggggaaatcctacgcccagatgtggcagctaatgtatttccaccgtcgggacctgcgcttagccgcgaacgccatctgctcggccgtcccggtggactgggtgcccacctcccggaccacgtggagcatccacgcccaccaccagtggatgaccaccgaggacatgctctccgtctggaaccgcgtgtggatcgaggagaacccctggatggaggataagacccatatcagctcctggggcgatgtaccctacctggggaaacgggaggaccagtggtgtggtagcctgatcggcctcactgccagagcgacctgggccaccaacatccaggtcgccatcaaccaagtgcgccggctgatcgggaacgagaactacctggactacatgacctccatgaagcggttcaagaacgagtcagacccggagggcgccctctggtag

SEQ ID NO: 24302 - RNA, 9879 nt, synthetic construct
  misc_feature 1..9879: note = derived and/or modified CDS sequence (opt11) from DENV-1__GQ199789__SS-prME
  source 1..9879: mol_type = other RNA
agcgtgactatgcttctaatgttaatgcctaccgccctggccttccacctaacgacgcgcggcggagaaccccacatgatcgtcagcaagcaggaacgcggcaagagcctcctgttcaagacaagtgccggggttaatatgtgtaccctcatagctatggatctaggggagttctgcgaggacaccatgacctacaagtgccctcggatcaccgaggccgagcccgacgacgtggactgttggtgtaacgccactgacacctgggttacatacgggacctgcagccaaaccggcgagcaccggcgcgataagagaagtgtggccctggctccccacgtgggactcggactggagacccgcaccgagacctggatgagctctgaaggggcttggaagcaaatccagaaggtcgagacctgggccctgcggcacccgggtttcacggtgatagcactcttcctggcgcacgcgatcggcacatcgattacccagaaggggataatcttcatactactaatgcttgttacccctagcatggctatgcgttgcgtcggcatcggtagccgagacttcgtggagggcctgagcggcgcgacttgggtggacgtcgtgctcgaacacggatcctgcgtcacaactatggcgaaagacaagcccaccctggacatcgagttgttaaagacagaagtcaccaaccccgcggtgcttagaaaactatgtatcgaagccaaaatctccaataccactacggattctcgctgcccgacgcagggcgaggcaactctagtcgaggagcaggacgccaacttcgtctgccgacgtaccttcgtggatcgcggatgggggaacggctgcggattattcggcaaagggtccctgatcacgtgtgcgaagttcaaatgcgtaacaaagctggagggcaagactgtacagcatgaaaacctcaagtactccgtgatcgtcacggtccacacgggagaccaacatcaagtggggaatgaatccaccgagcatggaaccacagcgacgatcacgccacaggcccccagcacagagatccagcttaccgactatggcgccctcacacttgactgcagcccccggacgggcctcgacttcaacgaaatggtcctcttgaccatgaaggaaaagtcctggctggtacacaagcagtggttcctcgacctgcccctcccctggacctctggagccagtaccagccaggaaacgtggaatcgcaaggacctcttggtgaccttcaaaacggctcatgcgaaaaagcaggaggtcgtcgtgctggggtcccaggaaggcgccatgcatacagccctcacaggtgcaaccgaaatccagactagcggaaccacaacaatctttgccggacacctgaagtgccggctgaagatggacaagctcaccctgaagggcacaagctatgtcatgtgtacgggcagtttcaagctggagaaagaggtcgcagagacccagcacggcaccgtgctcgtgcagataaaatacgaaggcacggacgccccctgcaagataccgttctcgacgcaggacgagaagggtgtgacccaaaatggacgcttgataacagccaacccaatagtcacggataaagagaagcccgttaacattgaagccgagccacccttcggggagagctatatcgtcatcggcgcgggcgagaaagctctgaagttgtcctggttcaagaaagggtcctcaatcggcaaaatgtttgaggccactgcccgaggggccagacgcatggcaatcttaggcgacactgcctgggacttcggcagcatcggcggtgtgttcacgtccgtcggaaagctggtgcaccagatttttggcaccgcgtacggggtcttattcagcggagtctcatggacgatgaagattggaatcggcgtgctccttacctggctgggcctcaactctcgctcaaccagcctttcaatgacgtgtatcgccgtgggtctggtcacgctttacctgggcgtgatggtgcaggccgacagcggatgtgtcattaattggaaagggcgcgagctgaagtgcgggagtggcatcttcgtaaccaacgaagtccacacctggactgagcaatataagttccaggcggactcaccgaagcggctcagcgcagctatcggcaaggcgtgggaggaaggggtctgcggcatccgctccgcgaccaggctcgagaacattatgtggaagcaaatctctaacgagctgaatcacatacttctggagaacgatatgaagttcaccgtggttgtaggagacgtcgcgggcatcctggcacaggggaagaagatgatccgcccccagcccatggagtataaatactcctggaaatcctggggaaaggccaagattatcggcgcggacgtgcagaacaccaccttcatcatcgacggccccaacacccccgaatgccccgacgatcagcgcgcctggaacatctgggaggtggaggattacggctttggcatcttcacgaccaacatttggctcaagctgcgcgactcttatacgcaagtgtgtgaccaccggctgatgtctgccgccattaaggactctaaagctgtgcatgccgatatgggctattggatcgagagcgagaagaacgagacctggaaactagctagagccagcttcattgaggtcaagacgtgcatctggcccaaatcgcataccctgtggagtaatggcgtattggagagcgagatgataattccgaagatctatggcggcccgacctcgcagcataactaccggcctgggtattttacccagactgccggcccctggcacctcggaaaactggaactggactttgacctctgcgaggggaccaccgtcgttgtggacgaacactgcggcaatagaggtccatcactgcgcaccacgaccgtaacaggcaaaatcatccacgaatggtgctgccgatcttgtaccctgccgcccctgagatttaagggtgaagacggttgctggtacggcatggagattcgccccgtcaaagagaaagaggaaaacctggtaaagagtatggtgtctgcaggctccggcgaggtcgactctttctcactggggttactgtgcatctcaatcatgatagaagaggtgatgcgctcccgctggagccggaagatgctgatgacgggcaccctcgcagtatttttcctgctgatcatgggccagctcacctggaacgacttgattcgcttgtgcatcatggttggcgcgaacgcctccgaccggatggggatgggcaccacgtacttggccttaatggccacgttcaagatgcgcccgatgttcgcagtggggttactgttccgcagattaaccagtcgagaggtcctgctcctcactatcgggctgagcctcgtcgcgtccgtagaactgcccaactcgctggaagaattgggcgatgggctcgccatgggcatcatgatccttaaattactgacagatttccagtcccaccaattatgggccacattgctctccctcaccttcatcaaaacaactttcagcctccactatgcctggaaaaccatggcgatggtgctatctatcgtgagcctatttcccttgtgtctgagcacaactagccagaagacgacctggctgccagtgctactgggttccctggggtgcaagccgctcacaatgttcctaatcgctgaaaacaagatctggggacgcaagagctggcccctgaatgaggggatcatggccgtcggtatcgtgtctattctccttagtagcttactcaagaacgacgtccccctggccggacccctgatcgccggcggtatgctcatagcgtgctacgtcattagtgggagctccgcagacttgagcctcgagaaagctgcagaggtgtcctgggaggaggaggctgagcacagcggcgcgtcacacaatatcctggttgaagtccaggacgacgggaccatgaagataaaagatgaggagcgtgacgacaccctgacgatcctgctcaaggccacactgttagccgtgagcggcgtgtacccgctcagcatccctgctacactcttcgtgtggtacttctggcagaagaaaaagcagcgtagcggggtgctttgggacaccccaagcccacccgaggtggagcgcgccgtccttgacgacggcatctaccgcatcatgcagcggggcctgttagggaggagccaggtgggcgtcggggttttccaggagaacgtgtttcatacgatgtggcatgtgacacgcggcgccgtcctgatgtaccaaggtaagcggcttgaaccttcctgggcctccgtgaaaaaggatctgatttcatacggcggcgggtggcgactgcagggatcctggaacaccggggaggaggttcaagtcatcgccgtagagcctggtaaaaatcccaagaatgttcaaacagcgcctgggacgttcaagaccagtgagggcgaagtcggcgctatcgctcttgactttaaacccggtaccagcgggagccctatcgtaaatcgggagggcaagatagtcggcttatacggcaacggtgttgtaacaacctcgggcacctacgtgagcgccatagcccaggccaaggcgtcccaagaagggcccctgccggagatcgaggatgaggtcttccgcaagcgcaacctcaccatcatggatctgcacccgggctccggcaagacccgcaggtatttaccggcgatcgttcgcgaggccatcaagcggaaacttcgcactttgatcctggccccaactcgagtggtcgcatccgagatggcggaggctctaaaggggatgcctatccgctaccaaacgaccgccgtgaagggtgagcacaccgggaaggagattgtggacttgatgtgtcacgccaccttcactatgcgcctgctcagtccggtgcgggtgcctaactataacatgatcatcatggacgaggcccatttcaccgacccatcaagcatagcggccagaggctacatcagcacgcgcgtagggatgggcgaggccgccgccatattcatgacagctacccctccggggtctgtagaggcgttcccccagtccaatgctgttatccaggacgaggaacgcgacatcccggagcggagctggaactccggctacgagtggatcactgactttcccggaaagacggtgtggttcgttcccagcatcaaatccggcaacgatatcgccaactgcctgcgtaagaacgggaagcgggtgatccaactaagccgcaagacattcgacaccgagtatcagaagaccaagaacaacgattgggactacgtggtaacgaccgatatttcggagatgggtgcgaacttccgggccgaccgcgtgatcgatccacggaggtgcttgaaaccagtgatcctaaaggatggtccagagcgcgtcatactagctgggccaatgcccgtgaccgtagcgagcgccgcgcagaggcggggccgcataggccggaaccacaacaaagagggggaccagtacatctacatgggacagcctttgaacaatgacgaggaccatgcacactggaccgaggccaagatgctgttagacaacattaacacccccgaggggatcatccccgccctttttgagcccgagcgggagaagtctgccgcaatcgacggcgagtatcggctgcgcggggaggcgcgcaagacctttgtggagctgatgcggcgaggcgacctcccagtgtggctgtcgtataaggtcgcttccgagggatttcagtactccgaccggcgctggtgcttcgatggcgaacgaaataaccaggtattagaagaaaacatggacgtggagatctggaccaaggaaggcgagcgcaagaagctccggccccgctggctggacgcccggacctactctgatccactagccctccgcgagtttaaagagttcgcggcaggtcgtcgctctgtctcaggcgacttaatcctggagattggtaagttaccgcagcacttgacacagcgggcacagaatgccctagataacctcgtgatgcttcacaactccgagcaaggcgggagagcttaccggcacgcgatggaggaactaccggacaccatcgaaactctcatgttacttgccctcatagccgtgttgactgggggcgtcaccctatttttcctatcgggcagaggcttgggaaagacgagtataggactgctatgcgtgatggccagctccgccctgctgtggatggcctcggtggagccacactggatcgctgccagcatcatcctcgagttctttcttatggtcctactgatcccagagcctgacaggcaacgcaccccacaggataatcagctggcctacgtggttatcggccttttgtttatgatcctaaccgtcgcagccaacgaaatggggctgctggagacgacgaagaaagatctgggcataggacacgtagccgtggagaaccaccatcacgccgcaatgctggacgtcgacttgcacccggcgtccgcatggaccctctatgccgtggccaccaccattataacgcccatgatgcggcatacaatcgagaatactaccgccaacatctcccttactgcaatcgcgaaccaagcagccatcctgatgggcctggacaagggatggcccattagcaagatggacattggagtgcccctgctcgcgctgggctgctattcccaagttaatccgctcaccctcacggcagcagtcctgatgctggtggcgcactacgcaattatcgggcccggcttgcaggcgaaagctaccagggaggcgcaaaaacgaacggccgcagggatcatgaaaaatccgacagtcgacggaatcgtagcgatcgacctggaccccgtcgtctacgacgcaaagttcgagaagcagctgggccagatcatgctcttagtgctgtgtacgtcgcagatcctgctaatgaggacgacgtgggccctgtgtgagtccatcactcttgccacaggtcccctgaccaccctgtgggaaggttcacctggtaagttctggaacacaaccatcgccgtctcaatggcaaacatcttccgcgggagctacctagccggtgctgggctggcctttagcctgatgaagtccctaggtggagggcggcgcgggaccggagcccagggcgagacgctgggcgagaagtggaaaaggcaactgaaccagcttagcaagtccgagttcaacacttataagcgcagcggaatcatggaagtggatcgatccgaggccaaagagggcttaaagcgcggagagacgacaaaacatgctgtgtcacggggtacggctaagctgcggtggttcgtggagcggaatctggtgaagccggaaggtaaggtgatcgacctgggctgcggtcgcggcgggtggtcctactattgcgccggtctgaagaaggtgaccgaggtcaagggctacaccaaaggcggcccggggcacgaggaaccgatccccatggcgacttacggatggaacctcgtgaagctccactccgggaaggacgtgttcttcatcccacccgagaaatgcgacacactgctgtgcgatataggcgagtcctccccgaaccccacgatcgaagagggtcgtaccctcagggtcctgaagatggtggaaccttggttgcggggcaatcagttctgcatcaagatcctaaatccctacatgccttccgtggttgagacgctggagcaaatgcaacgcaagcacggcggcatgttagtgcggaatcccctcagccgaaactccacccacgaaatgtactgggtgagctgcggcaccgggaacatagtctctgctgttaacatgaccagcagaatgcttttgaaccgcttcaccatggcacaccggaaacccacctacgagcgcgacgtagacctcggggcagggacgcgccacgtcgcggtggagcccgaagttgcaaatctggacattatcggccagcggatcgagaacatcaaacacgaacacaagagtacctggcactacgacgaggacaatccatataagacctgggcctatcacggcagctatgaggttaaaccctccggcagcgcatcctccatggttaacggtgtggtgaagctgctcacgaagccgtgggacgtgatccccatggtgacgcagatcgccatgacggacaccactccgttcgggcagcagcgcgtgttcaaggaaaaggttgacacgcgtacccccaaggcgaaacgcggcaccgcgcagatcatggaggtcactgccaagtggctgtggggcttccttagccggaataagaaaccgcgcatctgtacacgggaggagttcacccgcaaagtgcggtctaatgcggccatcggagcagtctttgtagacgaaaatcagtggaacagcgcgaaagaagccgtggaggacgagcgcttctgggacctcgtgcaccgtgaaagagaattgcacaagcaggggaaatgcgcgacatgcgtgtataatatgatgggtaagcgggagaagaagctgggtgagttcggcaaagccaagggctccagggctatctggtatatgtggttgggcgcccggttcctggagttcgaagcgctggggttcatgaacgaggatcactggttcagccgcgaaaattccctcagtggtgtggaaggcgaagggttacataagctgggttacatactccgggacatctcaaagatacccggcgggaacatgtatgccgacgataccgccgggtgggacacgcgcatcacggaggacgacctgcaaaacgaagcgaagatcacggacatcatggagccggagcatgccctgttagccaagagcatctttaagctgacctaccagaataaggtggtaagggtgcagcgcccagcgaagaacggtacggtcatggacgttatcagtcggcgagatcagcgaggcagcggccaggtgggcacctacggtctgaacaccttcaccaacatagaagcgcagctcatacggcagatggagtcggaagagattttcagcccttccgaactggagacgcccaacttggcgggacgcgtccttgactggctcgagaagcatggagtcgagcgactgaagcgcatggcaatctcaggggacgactgcgtcgtaaagcctattgacgataggttcgctaccgccctcactgccctgaacgacatggggaaagtccgcaaagacatcccgcagtgggagccctccaaaggctggaatgactggcagcaagtgcccttttgctcacatcactttcaccagcttatcatgaaagacggccgtgagatcgtggttccttgcagaaaccaagatgaactcgtggggcgggcgcgcgtgagccaaggcgcggggtggtccctgcgggagactgcctgcttaggcaagtcctatgcccagatgtggcagctcatgtacttccacaggcgggacttacgcttagcggctaacgcgatctgttccgctgtcccggtggactgggtgcccactagccggacgacctggagcatccatgcccatcatcaatggatgactacggaagacatgctcagtgtctggaaccgagtttggatcgaggagaacccgtggatggaggacaagacccacatctcgagctggggcgacgtgccctacttaggcaaacgagaggatcagtggtgcggttcattaatcgggctcaccgcccgcgctacgtgggctaccaacatacaagtagccatcaatcaggttcggcgcctgatcggcaacgagaactacctggactatatgacgagcatgaagcgcttcaaaaacgagtccgacccggagggggccctctggtga

SEQ ID NO: 24303 - RNA, 9879 nt, synthetic construct
  misc_feature 1..9879: note = derived and/or modified CDS sequence (opt11) from DENV-1__GQ199790__SS-prME
  source 1..9879: mol_type = other RNA
tccgtaacaatgttgctcatgctgatgccaactgcactcgcattccacttaaccactcggggaggagaaccgcacatgatcgtgactaagcaagagcgcggaaagtccctactgttcaagaccagcgcaggagtgaatatgtgcacactcatcgcgatggacctgggtgaactctgcgaggacacgatgacatataaatgccccaggataactgaagcagaacccgacgatgtcgattgttggtgcaacgcaacagatacgtgggtaacatatggaacttgctctcaaactggtgagcaccgccgagacaaacgcagcgtagccttagcaccccacgtcggactcgggctcgagacacggacagagacgtggatgtctagcgaaggcgcgtggaagcaaatacagcgtgtagagacctgggccttacgtcaccccggttttacggttatagcactcttcctcgcacatgtgattggaacaagcatcacccaaaaaggtatcatcttcatactactcatgctcgtcacaccatccatggcaatgagatgtgtcggaatcggttcaagggatttcgtcgagggattgagcggagcaacttgggtagacgtagtactcgaacacggctcttgcgtaaccacaatggcgaaggacaagccaaccctcgacatagagctactaaaaactgaggtaacaaatcccgcagtgctccgcaagctttgcatagaagcaaaaatatcaaatacgacgacagacagccgctgtcccacgcaaggggaagcgactctcatggaggagcaagacgcgaacttcgtctgccgacgaacctttgtagaccggggctggggaaacggctgtggactgtttggaaagggaagcttaataacttgtgctaagtttaaatgcgtcacgaaacttgaaggaaaaatagtacaatacgaaaacctgaagtatagcgtcatagtaaccgtccatactggagaccaacaccaggtcggcaacgaatcaacggaacacgggaccacagcgacaatcacgccgcaagcgcccactagtgaaatacaactaacggactacggagccctcacactagactgcagcccccgcaccggacttgactttaatgaaatggttctgctgaccatgaaagaaaaatcatggctcgtacataagcaatggttcctcgacctccccttaccatggacatctggcgcatcgacgtcacaagagacgtggaatcgccaagacctactagtaaccttcaagacagcccatgccaaaaaacaggaagtagtagtactaggatcgcaagaaggcgccatgcacacagccctgacaggagcgaccgagatccaaacctcaggcaccacaactattttcgcaggccacctaaaatgcagactaaaaatggacaagctaacactcaaaggcatgtcatacgtcatgtgcacagggagtttcaagctcgagaaagaggtcgccgagacacagcatggaaccgttctggtccagataaaatatgaaggaacggacgcgccatgcaaaataccgttttctacccaagacgagaaaggcgtaacacaaaacgggcgcctaatcaccgcaaatccaatagtcactgacaaagaaaagcctgtgaacatcgaagctgaaccgccattcggtgagtcttatatcgtgatcggcgcgggagagaaggctctcaagctaagttggtttaaaaagggatcctcgataggcaagatgttcgaggcgaccgctcgcggcgcaagacgcatggccatcctcggagacactgcctgggacttcggtagcatagggggagtattcactagcgtgggtaagttggtgcaccagatcttcggcaccgcgtacggggtattgttctcgggagtaagctggacaatgaagatcggcattggcgttctcttgacctggctcggcttgaatagcagatccacaagcctcagcatgacgtgcatcgcagtggggctagtcaccctatatctgggtgtgatggtccaagcggacagcggatgcgtgatcaattggaagggacgcgaacttaaatgcgggagcggcatatttgtcaccaacgaggtccacacctggaccgagcagtacaaattccaagcagacagccctaaaagactctcagcagcaatcggaaaggcatgggaagaaggggtatgcggaatccggtcagccacccgcttagagaacattatgtggaagcagattagcaatgagctcaaccacatcctactagaaaacgacatgaaatttactgtggtagttggagatgtagtcggtatactcgctcaaggtaagaaaatgattagacctcagccaatggagcataagtacagctggaagagctggggaaaggcaaagataattggcgcagacgtccaaaacacaactttcatcatcgacggtccgaacacccccgagtgcccggacgaccaaagagcctggaatatctgggaagtcgaggactacgggtttgggatattcacgacaaacatttggctaaagctgcgtgatagccatacacaggtatgcgatcacagactaatgagcgccgccatcaaagactcaaaggcagtacacgcagatatgggatactggattgaaagtgagaaaaacgaaacgtggaagctcgctcgcgcctcgtttatcgaggttaaaacatgcatatggcccaaatcacatacactatggtcaaatggggtactggaaagcgaaatgataatcccaaaaatatacggtggcccaataagccagcacaactaccgaccagggtactttacgcagacggcgggcccatggcatttgggcaaactggaactcgacttcgacctgtgcgaggggacaaccgtagtcgtggatgaacattgtggaaaccgaggtccaagccttcgtacaactaccgtgacaggaaaaatcatccatgaatggtgctgtcggtcatgtacgctcccacccctcagattcaagggggaagacggctgctggtacggcatggagatcagaccagtgaaggagaaagaagagaacctagtaaaaagcatggtcagcgctgggagcggcgaagtcgactccttctcactcgggttgctgtgtatctcaatcatgatagaagaagtgatgagaagtcgctggtcccgcaagatgctcatgaccggaaccttagcagtgttcctactattaatcatgggccaactcacatggaacgacctaatccgcctgtgcataatggttggggccaacgcgagtgacaggatgggaatgggaacaacgtacctcgcgctgatggctacattcaaaatgcgacccatgtttgcggtcggcctcctattccgccgcctcacctccagagaggtcctattgttaaccatcggtctcagcctggtcgccagtgtggaactacctaactctttagaagaactgggcgacggcctagccatgggcataatgatactcaaactccttacggacttccaaagccatcaactctgggccacactactcagccttaccttcattaagacgacgctgtcccttcactatgcgtggaagactatggcaatggttctatctatagtctcacttttcccgctctgcttatcaaccacctcacagaaaacgacgtggctgccggtgctcctcggcagtttgggctgcaaacccttagcaatgtttctgatagcagagaataagatttggggccgcaaaagttggcccctgaacgaagggattatggcagtgggcgtcgtgtcgatcttactgagcagcctcctcaagaacgacgtgcccctagcgggccccctaatagccggcggaatgctaatcgcttgctacgtcataagtggaagcagcgccgacctctccctcgagaaggctgcggaagtatcatgggaagaggaggctgagcattcaggcgcgagtcacaatatattagtagaggtccaagatgacgggaccatgaaaatcaaagacgaagagagggacgacacacttaccatactgctgaaagcaaccctgttagcagtgtcaggcgtatacccactaagcatcccagcaaccttgtttgtctggtatttctggcagaagaaaaagcaaagatcgggggtactatgggacacgccgtctcctcctgaagtagaacgggcggttcttgacgacggcatctaccggatcatgcagcggggtctgctgggaaggagtcaagtcggcgtaggcgtatttcaggagaatgtttttcacacgatgtggcatgtaacgaggggagcagttttaatgtatcaagggaaacggctagagccctcatgggcttccgttaagaaagatctgatcagctacggagggggctggagactgcaaggcagttggaacacaggtgaagaagtgcaggtaatcgcagttgaaccaggaaagaacccgaaaaacgtacaaacagcccctggcaccttcaaaacacctgaaggggaagtaggagcgattgcgcttgacttcaagccaggtacgagtggatcaccaatcgtcaaccgcgaaggaaagattgtcggactctacggcaacggagttgtaacaaccagcggaacgtacgtgtccgctattgcccaggctaaagccagtcaggaaggcccattaccggaaatcgaggacgaagtgttcaggaagcgaaacttaacaataatggacctccatcccggtagcgggaagacgcgaaggtatctgccagccatcgtgcgagaggcgatcaaacgaaagctaaggacgttgatactagcccccacaagggtagttgcctcggaaatggccgaagcacttaaaggtatgcctatacgataccaaaccacagcagttaaaagcgagcataccggaaaggaaatagtggaccttatgtgccacgcaacattcacgatgagactcttaagcccggtaagagttcccaactacaacatgatcataatggacgaagcccactttacggacccaagctccatcgccgcacgcgggtacataagtaccagagtaggaatgggcgaggccgcagccatcttcatgacggcaacacccccaggcagtgtcgaggcctttccccagagcaacgcggtcatacaggacgaagaaagagacatcccggaaaggtcatggaacagcgggtatgagtggataacagactttcctggaaaaacggtctggttcgtgccgtctataaagtctggaaatgacatagctaactgcctaaggaaaaatggcaagcgcgtaatacaactgagcagaaaaaccttcgataccgaataccagaaaactaaaaacaatgactgggactacgtagtaaccacggacatttcagaaatgggggccaacttcagggctgaccgcgtcatcgacccaagacggtgcctgaaaccagtgatactcaaggacgggcccgaaagagtcatcttagctggtccaatgccagtcaccgtggcgagcgccgcccagagacgcggccgaatcgggcgtaaccacaacaaggaaggagaccaatacatctacatgggacaaccactcaacaacgacgaggaccacgcacactggacagaggcaaaaatgctgctagacaacataaacacgccagaaggaattataccggcattattcgagcccgaacgagaaaaaagcgctgcaatagacggagaataccgcctaaggggcgaggccagaaaaacattcgtagaactcatgcgccgaggggaccttccggtctggctctcctacaaagtagcaagcgaagggtttcagtactccgaccgaagatggtgcttcgacggtgaaagaaacaatcaagtactcgaagaaaacatggacgtagaaatctggacaaaggagggggagcgcaagaaacttcgaccccggtggctcgacgctcggacttacagcgaccccctggcgctacgggaatttaaagagttcgcagcaggccggaggtcggtatcaggagatttaatattggaaatcgggaaactcccgcagcacttaacccagagagcacagaacgcactagataacttagtgatgctgcacaactctgagcaggggggacgtgcctatcgacatgccatggaggagctaccagatactatcgaaacattaatgctgctcgccctcatcgcggtactaaccggaggagtaacattgtttttcctatcgggaagaggcctgggtaaaacttctattgggctactttgtgtcatggcgtcgtccgtccttctatggatggcgagtgtagaaccacattggatagcagccagcattatcctggaattcttcttaatggtcctactgatcccggagcctgaccgccaacgcacaccacaagataatcaattggcatatgtagtgataggccttttattcatgattctaacagtcgcggcgaacgagatgggactcctagaaacgacaaaaaaggacttaggcataggacatgtcgcagtagagaatcaccaccacgccaccatgttggacgtcgatctccaccccgcgagcgcttggaccctctatgccgtagcaacaaccattatcacccccatgatgcgacacacgatcgaaaatacgactgccaacatctcactcaccgcaattgccaatcaagcagcgatcctgatgggacttgacaaagggtggccgatctccaaaatggacattggtgtcccccttctcgcactaggctgctacagccaagtgaacccactgacactaacggcggcggtcctgatgctcgtagcacactatgcgataatcgggcccggattgcaggcgaaagccacgagggaagcacagaaacgtacagcagccgggatcatgaaaaacccaacggtcgatggaattgtcgccatagacttggatcccgtcgtatacgatgcgaaattcgaaaaacaactcgggcagatcatgctactaatactatgtacatcgcaaattctgctaatgcgaacaacgtgggctttgtgtgaatccatcacacttgcgaccggaccgctcacaacactgtgggaaggaagccccggtaagttctggaacaccaccatagcagtgtccatggcaaacatattccgcggatcctacctcgccggagccgggctcgccttctcactcatgaaatccctgggcggaggaagaagaggcaccggagcccagggagagactctaggggaaaaatggaagcgtcaactaaaccagctaagtaagtccgaatttaatatttacaaaagaagtggtatcatggaagtcgacaggagcgaagccaaagaagggcttaaacggggagaaaccacaaggcatgccgtcagccgaggaaccgcgaaacttcgatggttcgttgaaaggaacctagtcaaaccagagggaaaggtaatcgacttaggatgcggacgaggcggctggagttactattgcgcggggctcaagaaagtgaccgaagtcaaaggctacaccaaggggggtcccggccacgaagagcctataccgatggccacgtacggctggaacctggtgaaactccacagcggcaaagacgtctttttcacaccaccggaaaaatgcgacacgctactatgcgacataggagaatcctcgcccaacccgacaatcgaagagggcagaacccttagagtcctcaaaatggtagaaccgtggttacgcggaaaccaattctgcatcaaaatcctcaacccatatatgcccagtgtggtcgagacgctagaacaaatgcaacgtaagcacggcgggatgctcgtcagaaatccgctcagtcgaaattccacccatgaaatgtattgggtctcgtgcgggacaggaaatatagtatccgcagtgaacatgacaagcaggatgctactgaaccggttcacaatggcccacagaaagccgacctatgaacgcgacgtcgatctaggagcggggacccgccatgtcgcagtcgagccagaagtggcaaatctagacatcatcggccaacgaatcgagaatatcaaacacgaacataagagcacctggcactatgacgaagacaacccctataagacctgggcctaccatggctcgtacgaggtgaaacccagcggtagcgctagctccatggtcaatggagttgtcaaattgttgacaaaaccgtgggacgtaataccgatggtaacccaaatcgccatgacagacacaacgcccttcgggcagcaacgggtcttcaaagaaaaagtagacacgagaacaccaaaggccaagagaggcacggcacaaataatggaggtcacagcaaggtggctctggggcttccttagcagaaataaaaagccccgcatatgtacgagagaggaattcacgagaaaagtgcgcagcaacgcagctatcggggccgtctttgtcgacgagaaccagtggaactcagcaaaagaggcagtcgaggatgagcggttctgggacctagtgcaaaaggagcgtgagttacacaaacagggtaagtgcgcgacttgcgtatacaacatgatgggcaaacgcgagaaaaaactcggggagttcggtaaggccaaaggctcacgggccatatggtacatgtggttgggcgcgaggttcctagaattcgaagcgctgggcttcatgaacgaagatcactggttctcccgggaaaatagcctaagcggagtagagggtgagggactccacaagctaggatacatcctcagagacatttcgaagatcccggggggaaacatgtatgcagacgatacagcgggatgggatacgcgaatcacagaggacgacctgcaaaacgaagcacgaatcacagacataatggaaccagaacacgcacttctagcaactagtatattcaaactgacctaccagaacaaggtagtgagagtacagcggccagcgaagaacggaaccgtcatggacgtcatttcgaggcgggatcaacggggtagcggacaggtaggaacatatggtctgaacacgtttaccaacatggaggcgcaactaatacgccagatggagtccgaaggaatattcctaccctcggaacttgaaactcaaaacttggccgaacgtgtcttagactggctagagaaatacggagtagaacgcctcaaacgaatggcgatcagcggagacgattgtgtcgtcaaacctatcgatgaccgattcgcaaccgcacttaccgcgctcaatgacatgggaaaagtaaggaaagacatacctcagtgggaacccagcaaggggtggaacgactggcagcaggtcccgttctgctcgcatcatttccaccagctaatcatgaaggacggccgagaaattgtagtgccgtgcagaaaccaagacgagctcgttggtagagcaagagtctctcagggcgcaggctggagtctccgagaaaccgcttgcctaggtaaatcctacgcccagatgtggcagctcatgtacttccaccggcgcgacctgcgactcgcagcgaacgcaatttgttccgcggtccccgtagactgggtccccaccagcagaacgacctggagtatacatgctcaccaccaatggatgacgacagaagatatgttgtcggtatggaaccgagtctggatagaagagaacccatggatggaggacaaaactcacgtatcttcatggggggacgtgccgtacctaggcaagagggaagatcagtggtgcggctccctaatcggcctcacggcacgcgcgacctgggcctcaaacatccaggtcgcgataaaccaagtgcgacgactaataggaaacgagaactacctcgattacatgaccagcatgaagcgattcaagaatgaaggggatcccgaaggagccctgtggtga

SEQ ID NO: 24304 - RNA, 9879 nt, synthetic construct
  misc_feature 1..9879: note = derived and/or modified CDS sequence (opt11) from DENV-1__GQ199791__SS-prME
  source 1..9879: mol_type = other RNA
agcgtgacgatgctcttaatgctgatgcccacggcgctggccttccacctaacaacccgggggggggagccccacatgatcgtgaccaagcaagagcggggcaagagcctgctttttaaaacgagcgcgggggtgaacatgtgcaccctcatagcaatggatctgggcgagctgtgtgaagacaccatgacctacaagtgtccccgtataacggaggccgagcccgacgacgtggactgttggtgtaacgccaccgacacctgggtcacctacgggacttgcagccagactggcgagcatcggcgtgacaagcggtcggtcgcccttgcgccccatgtgggactcgggttggagaccaggaccgagacatggatgtccagcgaaggcgcctggaagcagatccaacgcgtcgagacgtgggccctccggcaccccgggttcaccgtgatcgccctgttcctggcgcacgctataggcacctccatcacacagaaggggataatcttcatcttgctaatgctcgtgacgcccagcatggctatgagatgcgtcggcattggctcacgcgactttgtcgaggggttatcaggcgccacttgggtagacgtagtgctggagcacggatcctgcgtcaccactatggcaaaggacaagcccacgctggacatcgagctcctgaaaaccgaggtcacaaaccccgcggtgctgcggaaactctgcatagaagccaagatcagcaacaccacgaccgatagcaggtgtcccacccagggcgaggctaccctgatggaagagcaggacgccaactttgtgtgccgacgcacgttcgtagatcgggggtgggggaacggctgcgggttattcggaaagggcagcctgatcacgtgtgccaagttcaagtgcgtgaccaagctggaaggcaagatagtgcagtacgaaaaccttaaatactccgtcatcgtcacggtgcacactggagaccagcaccaagtgggcaacgaatcaaccgagcacggcaccaccgcgacgatcacccctcaggccccaacctccgaaatccagcttacggactatggggcccttaccttggactgcagcccaagaacgggcctggacttcaacgagatggtgctactgactatgaaggagaagtcttggttggtacacaagcagtggttccttgatcttccgctcccgtggaccagcggggcctcaacctcccaggagacgtggaatcggcaagacctgctggtgactttcaagaccgcccacgcgaagaaacaggaggtggtcgtgcttggaagccaagagggtgcaatgcacaccgccctgacgggggccactgagatccaaacctccggcaccactacaatctttgcgggtcatctgaagtgccgcctcaagatggacaaactgaccctgaagggaatgagctacgtgatgtgcaccgggtccttcaagctcgagaaggaggtcgcggaaacgcagcatggtaccgtgctggtccagattaagtacgaaggcaccgacgccccctgcaagatcccctttctgacccaggacgagaagggggtgacgcagaacggacggctgatcaccgctaaccccatcgtaaccgataaggagaaacccgtgaacatcgaagccgagccgcccttcggggaaagctacattgtcataggcgcaggcgagaaggccttgaagctgtcctggtttaagaaggggagctccatcggaaagatgttcgaggccacggccaggggggcacggcgcatggccatcttaggggacacggcttgggatttcggcagcatcgggggcgttttcacatcggtggggaagctcgtccatcagattttcggtaccgcctacggcgtgctgttcagcggcgtgagttggaccatgaagatcgggatcggtgtcctgctcacgtggctgggtctgaacagccggtccaccagcctctcgatgacatgtatcgccgtcgggctggtgaccctgtatctcggtgttatggtgcaagccgatagcgggtgcgtgatcaactggaagggacgggagctgaaatgcgggtccggcatctttgttacgaacgaggtacacacttggaccgagcagtacaagttccaagccgactcaccgaagcgactgagcgccgccatcggcaaggcctgggaggagggtgtttgcggcatccggtctgccacccgcctcgagaacataatgtggaaacagatttccaacgaactgaaccacatcctgctcgagaacgacatgaagttcacagtcgttgtgggcgacgtcgtgggcatcctggctcagggtaagaagatgattcgtccccaacctatggagcataagtactcctggaagtcctggggcaaagcaaagattatcggtgcggacgtacagaatacgacctttatcatcgacgggcccaataccccggagtgtccagacgatcagcgcgcttggaacatctgggaggtcgaggactacggcttcgggatatttaccacaaacatttggctgaagctccgggactcctacacccaggtgtgcgatcacagattgatgtcggcggccatcaaggactctaaggccgttcacgcagatatgggctactggatcgagagcgagaaaaacgaaacatggaagctggcccgggcttccttcattgaggtgaagacgtgtatctggcctaaaagccacacgctctggtccaatggcgtgctggagagcgagatgatcattcctaagatatacggtggccccatttcccagcataactacaggcccgggtacttcacccaaaccgccggcccctggcacctggggaaactcgagcttgactttgacctgtgcgaaggcactacggtggtcgtcgacgagcattgcggcaatcgggggccctctctccgcactacaacggttacggggaagatcatccatgagtggtgctgtcggagctgcaccctgccgccccttcgctttaaaggggaggacggctgctggtacggtatggagatacggcccgtcaaagagaaggaggagaatttggtcaagtcgatggtgtccgccggcagtggcgaggtggactccttctccctggggcttctctgcattagcatcatgatcgaggaggtgatgcgaagccggtggtctcgcaaaatgctgatgaccgggacccttgcagtattcttgctgctgattatggggcagctcacgtggaacgacttgataaggttatgcattatggtcggcgccaatgcttcggaccgcatgggaatgggcaccacttacctcgcgttgatggccacctttaagatgaggccgatgttcgccgtgggactgctcttcagaaggctgaccagcagagaggtgctgttactcaccattgggttatctttagtcgccagcgtcgaactacccaactccctggaggagctcggcgacgggctggctatgggcataatgattctgaaactccttaccgactttcagagccaccaactgtgggccaccctcctgagcctgacgtttatcaagaccacccttagcctgcactacgcttggaaaacaatggccatggtactgtcgatcgtgagcctattcccactctgcctgtccacgactagccagaagactacatggcttccagtgctgctgggttcgctggggtgtaagccgctgacgatgttcctgatcgccgagaacaagatctggggccgcaagagctggccgctgaacgaggggattatggcggtcggcgtggtgtcaatccttctgagtagtctgttgaagaacgacgtccccctggccgggcccctcatcgcaggcggcatgctgatcgcctgttacgtgatctccgggtctagtgcagatctgagcctcgagaaagccgctgaggtgagttgggaggaggaggcggagcatagcggtgcctctcataatatcctggtcgaggtgcaggacgacgggactatgaagatcaaggatgaggagcgggacgacacactgacaatcctccttaaggcaaccctcttggcagttagtggcgtctaccctctgagcatccccgccactttgttcgtgtggtatttctggcagaagaaaaagcagagatcaggagtgctatgggacactccatcgccgcccgaggttgagagggccgtgctcgacgatggaatttaccgcatcatgcagcggggcctgctggggcgctcccaagtgggcgtgggagtgttccaggagaatgtttttcacacgatgtggcatgtaacaaggggcgccgtgctgatgtatcagggaaagagactggagccctcatgggcgagcgtgaagaaggacctaatatcctacggcggcggatggcggcttcaggggagctggaatacgggggaggaggttcaggtgattgccgtggagcccggcaagaaccccaaaaacgtccagacggcgcccgggaccttcaagaccccggagggcgaggtcggcgccattgcactcgactttaagcccgggacctcaggctctcccatcgtaaaccgcgaggggaaaatcgtcggcttgtacggcaacggtgttgtgaccacttccggtacctacgttagcgctattgcccaggctaaggctagccaggagggaccgctgcccgaaatcgaggacgaggtgttcagaaagcgcaatctgacgatcatggacctgcaccctggctccggcaaaactagacgatatctacccgcgatcgtgcgtgaagccatcaaacgcaagctgcggaccctgatccttgcccccacccgcgttgtcgcaagcgagatggccgaggcgctgaaaggcatgcctatccgataccagacgaccgctgtcaagtctgaacacaccggcaaagaaatcgtcgacctgatgtgccatgccacttttacgatgcggctattaagccccgtgcgcgtgcctaattacaacatgattataatggacgaggcccacttcacggacccctccagcatcgccgcgcgggggtacatttccactcgcgtcggtatgggggaggccgccgccatcttcatgactgccaccccgcccgggagcgtggaggcgttcccccagtccaacgccgtgatccaggatgaggaacgggatattcccgagcgctcgtggaactcgggttacgagtggatcaccgacttccccggtaagaccgtatggttcgtgcccagcatcaagtcaggcaacgatatcgccaactgcttgcggaagaacgggaagagggtgatacagctcagccggaagaccttcgacacagagtaccagaagaccaagaacaatgactgggactacgtcgtgaccaccgacatatccgaaatgggcgccaactttagagccgaccgggtcatcgacccccgcagatgcctgaagcccgtcatcctgaaggacggccccgagcgtgtcattctcgccggccccatgcctgtcacggtcgccagcgcggcccagcgacggggtcggattggccgcaaccacaacaaggaaggtgaccagtacatctacatgggtcagcctctgaacaacgatgaggaccacgcgcactggacagaggccaagatgcttctcgacaacatcaacacccccgagggtatcatccccgccctcttcgagccggagcgggaaaaatctgccgccatcgacggtgagtaccgcttacgcggcgaggctcggaaaaccttcgtggagctcatgcgccggggggacctgcccgtctggctgtcgtataaggttgcctctgagggcttccagtacagcgacaggcgttggtgcttcgatggcgagcgtaacaaccaggtcctcgaggagaacatggacgtcgaaatctggacaaaggagggcgagagaaagaagctacgcccccgttggctggacgcgaggacttacagcgatcctctagccttacgtgagtttaaagagttcgccgcaggcaggagatccgttagcggcgacctgatcctcgaaataggcaagctgccgcagcatctgacccagcgcgctcagaatgcccttgacaatctggtgatgctgcacaactctgagcagggcgggcgcgcctaccgccacgcgatggaggagctcccggacaccatcgagacgctaatgttgctcgcccttattgcagtcctgacaggaggggtgacccttttcttccttagcggccggggactgggcaagacctccatcggcgtgctctgcgtcatggcaagttccgttctgctgtggatggccagcgtagagccccactggatcgcggcatcgatcatcctcgagttcttcctgatggtgctgctcatccccgaaccagataggcaaagaactccccaggataatcagctggcatacgtggtgataggactcctgttcatgatcctgacggtcgccgccaatgagatgggcctgctcgagactaccaagaaggacttagggatcggccatgtggcggtggaaaatcatcaccacgccaccatgctggacgtcgacctccaccccgccagcgcctggacgttatacgccgtggcgaccacgataatcacccccatgatgcgccacacgatcgagaacaccaccgccaacatctccctaaccgccattgccaatcaagccgcaatcttaatggggctggacaagggctggccaatcagcaagatggacatcggcgtgcccctgctcgccctcgggtgctattcccaggttaacccactgaccctcaccgccgccgtactcatgttagtcgcgcactacgccatcataggacccgggctccaggccaaggctactagagaggctcagaagcgcaccgcggccggcatcatgaaaaaccccacagtggacgggatcgtggctatcgacctggaccccgtggtatacgatgcaaagttcgagaagcagctgggccagattatgctcctgattttatgtacatcacagatcctcttaatgagaaccacctgggccctgtgcgagtccataacgctcgcgacaggccccctgacaaccctgtgggagggtagcccgggcaaattttggaacacgaccatcgccgtaagtatggccaacatctttagaggtagctatttagctggtgctggcctggcgttttcgctgatgaagagcctcggcggcgggcgccggggcaccggggcccagggagagactctgggcgagaagtggaagcgccaactgaaccagctcagcaagagcgagttcaacatctacaagcggagcgggatcatggaagtggataggtccgaggcaaaggagggcctaaagcggggggaaactacccgccacgcggtctcccggggaactgcgaagctgcgctggttcgtggagagaaacctggtgaagcccgaggggaaggttatcgaccttggctgcggacgcggaggctggtcttattactgcgctgggctgaagaaggttactgaggtgaagggctacaccaagggcgggcctggtcatgaggaacccatcccgatggccacctatgggtggaacctggtcaagctccactcaggtaaggacgtgttctttactccgcccgagaaatgtgacaccttgctctgcgacatcggcgagtccagcccaaatcctacgatcgaggagggcagaaccctccgcgtgctcaagatggtcgagccctggctgcgggggaaccagttttgcatcaagattcttaacccatacatgccctccgtggtcgagaccttagagcagatgcagagaaaacacggcggaatgttagtccgcaacccgctcagccgcaactccacccacgaaatgtattgggtgagctgcgggaccgggaacatcgtttcagccgtgaacatgaccagccgaatgctgttaaatcgcttcactatggcgcatcgcaaaccaacctatgagcgggacgtggacctcggggctggcacgcgccacgtggccgtcgagcccgaggtcgccaatctggacatcatcggacaacgaattgagaacatcaagcacgaacacaaatccacatggcattacgacgaggacaacccctacaagacttgggcttaccacgggagctacgaggtcaaaccgtccgggtcggcctctagcatggtgaacggggtagtcaagctgttgaccaagccctgggacgtgattcccatggtaacccagatagctatgacagacaccaccccctttggacagcagcgcgtgtttaaggagaaggtggatacgcggacaccgaaggccaagcgcggcaccgcccagatcatggaggtcaccgcccgctggctgtgggggttcctttctcgcaacaagaagcctcggatctgcacccgcgaggagttcactcggaaggtgcgctccaacgctgctatcggggccgtgttcgtggacgagaaccagtggaacagcgccaaggaggcagtggaggacgagcggttctgggacctcgtgcagaaggaacgggagctgcacaagcaagggaagtgcgcgacctgcgtctacaacatgatgggaaagcgtgaaaagaagctaggggagttcggaaaggccaaggggtcgcgcgcgatctggtacatgtggttaggagcccgtttcctggagttcgaggcgctcggattcatgaacgaagaccactggttcagccgtgagaattccctctcgggggtcgaaggcgagggtctccacaagctgggatacatcctccgggacatatccaaaatacctggtggcaatatgtacgcggacgacaccgcaggctgggacacccgcatcacggaggatgatctccagaacgaggccaagatcactgacatcatggaaccggaacatgctctgctcgccaccagcatctttaagctgacctaccagaacaaggtggtacgggttcagcgccccgcgaagaacggtactgtgatggacgtgataagccgccgggatcagcgcggcagcgggcaggttgggacctacggactgaacacctttaccaatatggaggcacagctaatccggcaaatggagagcgagggtatattcctgcccagcgagctggagacgcccaacctcgcggagcgcgtgctggactggctggagaaatacggggtggagcggctcaagcgcatggccatatccggtgacgactgcgtggtgaagccgatcgacgaccggttcgccactgccctgaccgccctgaatgacatgggcaaggtgcgcaaggatataccccagtgggagcccagcaagggctggaacgactggcagcaggtacccttctgctcccaccatttccatcagttgatcatgaaggacggccgggagatcgtcgtgccatgccgcaatcaggatgagctggtcgggcgggctagagtgagtcagggagctggctggtccctgcgggagaccgcgtgtctcggcaagagttacgcccagatgtggcagctgatgtacttccacagacgggacctgcgcctcgccgcgaacgccatctgcagcgcggtgcccgtcgactgggtgcccacgagcagaactacctggtcgatacacgcccaccaccagtggatgacgacggaagatatgttgtccgtgtggaatagggtgtggatcgaagagaatccctggatggaggacaagacacacgtcagtagttggggtgacgtgccatacctcggcaagcgggaggaccagtggtgcggcagcctcatcggcttgactgccagggccacgtgggccagcaatattcaggtcgcgataaaccaagtgcgccggctgatagggaacgagaattatctcgactacatgaccagcatgaagcgcttcaagaacgagggtgaccccgagggggctttctggtga

SEQ ID NO: 24305 - RNA, 9879 nt, synthetic construct
  misc_feature 1..9879: note = derived and/or modified CDS sequence (opt11) from DENV-1__GQ199792__SS-prME
  source 1..9879: mol_type = other RNA
agcgtgaccatgctgctcatgctgatgcccacagccctggccttccacctcaccaccaggggaggggagccccacatgatcgtgtcgaagcaggagcgggggaagtcgctgctgttcaagacctccgccggggttaatatgtgcaccctcatagcaatggacttaggcgagctgtgcgaagataccatgacctacaagtgcccccgcatcaccgaggccgaacccgacgacgtggactgttggtgcaacgccaccgacgcatgggttacctacggtacgtgcagccagactggagagcaccggcgggataagcgttcggtggccctcgcgccccacgtggggctggggctggagaccagaaccgagacgtggatgtcctccgagggcgcctggaagcaaatccaacgggtcgaaacgtgggccctgcgccacccagggttcaccgtgatcgcgcttttcctggcccacgcgatcggtacgagcatcacccagaaggggatcatctttatactcctgatgcttgtgacaccgtccatggccatgcggtgcgtcggcatcggatcacgcgacttcgtggaggggctctccggcgcaacctgggtagacgtcgtgctggagcacgggagctgcgtgacgactatggcgaaggacaagcccaccctggacatcgaactacttaagaccgaagtcacgaaccccgcagtgctgcggaagctctgcatcgaggccaagatttccaacaccaccacggattcacggtgcccgacgcagggcgaggccacactggtggaggaacaggacgctaacttcgtctgccggcgcacctttgtggatcgcggctgggggaacggctgtggcctgttcggcaaggggagtctcataacgtgcgcgaagttcaagtgcgttacgaaacttgagggcaagatcgtccagtatgagaaccttaagtacagcgtgatcgtgaccgtccacacgggcgaccagcaccaggtggggaacgaatccaccgagcacggtacgactgctaccatcacgccccaggcccccaccacggagatccagctcacggactatggcgccttaaccttagactgctcgccccggaccggcctcgacttcaacgaaatggtcctgctcacgatgaaggagaagtcctggctcgttcataagcagtggttcctggacctgccactcccgtggaccagcggggcatcgacctcccaggaaacctggaaccgacaggacctgctggtgactttcaaaactgcgcacgccaaaaagcaggaggtcgtggttctgggcagtcaggagggcgccatgcacaccgccctgaccggggcgacggagattcagacctccggaaccactaccatcttcgcggggcacctcaagtgtcgcctcaagatggacaaattaaccctgaaggggatgagctatgtcatgtgcacggggtccttcaaactcgagaaggaggtggccgagacccagcacggaacggttcttgtacaaatcaagtacgagggcaccgacgccccctgcaagatccccttcagcacccaggacgaaaagggggtgacccagaacgggcggctaatcacggcgaaccccatcgtgaccgacaaggaaaagccagtcaatatagaggcggaaccgccgtttggcgagtcttacattgtgatcggggcaggggagaaagccctgaaattaagctggttcaagaaggggtccagcattggcaaaatgttcgaggccaccgctagaggggcgcggcgcatggccatcctgggagataccgcctgggatttcgggtccatcggcggcgtgttcacgagcgtcggcaaactcgtgcaccagatcttcggcaccgcctacggggtcctcttctccggcgtcagctggacgatgaaaattggtatcggcgtgctactgacatggcttggtctgaactccagaagtacgtccctgtctatgacctgcatagccgtggggctcgtgaccttgtatctgggcgtcatggtgcaggcagactccggctgcgtaatcaactggaagggccgggagctgaagtgcgggagcggcatcttcgtgaccaacgaagtgcacacgtggaccgagcagtacaagttccaggccgacagcccgaaacgactctccgccgctatcggcaaggcctgggaagagggggtctgcggcatccggagcgcgacccgcctggagaacatcatgtggaagcagatcagtaacgaacttaaccacatcttactggaaaacgacatgaagctcaccgtagtggtcggggacgtggccggcatcctggggcagggcaagaagatgatccggcctcagcccatggagtacaagtactcctggaagtcatggggcaaggccaagatcattggggccgacgcgcaaaacaccacgttcatcatcgacggccccaacaccccggagtgccccgacgatcagcgcgcctggaacatctgggaggtggaagactacgggttcggcatcttcaccaccaacatctggctcaagctccgggacagctacacgcaggtctgcgaccaccgcctgatgtccgccgcaatcaaggacagcaaggcggtgcacgccgacatgggctactggatcgagtcagagaagaacgagacctggaagctggcgcgggcctccttcatcgaggtgaagacctgcatctggcccaagtcccacaccctctggtcgaacggggtcctggagtccgagatgatcattccgaagatctacggagggcccataagtcagcataactaccgtcccggctactttacgcagaccgcggggccctggcacctgggcaagctcgagctggacttcgatctgtgtgagggtaccaccgtggtggtcgacgagcactgtgggaaccggggcccgtcactgcgcacaaccacggtgaccgggaagatcatccacgagtggtgctgccggagctgcactctgccgcccctgcgcttccggggcgaagatgggtgttggtacggaatggagatccggcccgtgaaagagaaagaagagaacctcgtcaagtccatggtgagcgccggcagtggcgaggttgacagcttctctttgggcctgctttgcatctccatcatgatcgaggaggtaatgcgtagtcgctggtccagaaagatgctgatgacggggaccctcgcggtatttttcctcctcatcatgggccagctgacctggaatgacctcatacgcctgtgcatcatggtaggggcaaacgccagcgaccgcatgggtatgggcacgacgtaccttgccctcatggccacatttaagatgcggccgatgttcgcggttgggttattattccgccggctcacctcccgggaagtcttactgttgacgatcggcctgtctttagtggcctccgtcgaactcccaaacagcctggaggagctgggggacggccttgcgatgggcatcatgattcttaaactgctgaccgacttccagtcccaccaactttgggcaaccctgctcagcctcaccttcatcaagacgacctttagtctgcactacgcgtggaagaccatggccatggtgttatcaattgtctccctgttccccctgtgcctcagcacgacgtcccagaagaccacctggctgcctgttctgctcgggtccctgggctgtaagccgcttaccatgtttcttatcgccgagaacaagatatggggacggaaatcctggccactgaacgagggcattatggccgtggggatcgtcagtattctgctcagctccttattgaagaatgatgtgcccctagccggccccctgatcgcgggcgggatgttaatcgcctgctatgttataagcggctccagtgctgacctaagcctggagaaggccgcggaggtcagctgggaggaggaagctgagcactccggggccagccataacatattagtggaggtgcaggacgacggcacgatgaagatcaaggatgaggaacgcgacgacaccctcaccatactactgaaagcaaccctgctggccgtatctggtgtatatccgctgagtatccccgctaccctctttgtatggtacttttggcagaagaagaagcagcggagcggcgtactgtgggatacgccgagcccgcccgaggtggagcgcgcggtgctggacgacggtatttatcggatcatgcaacgcggccttttaggcaggtcccaagtaggggtgggcgtgttccaggagaacgtcttccacaccatgtggcacgtgactcgcggggccgtactgatgtaccagggcaagcggctagagccctcgtgggcatccgtcaagaaagatttaatcagctacggtggagggtggcgcctgcgtggatcttggaacatgggcgaggaagtccaagtaatcgccgtcgagcccgggaagaaccccaagaacgtgcagaccgctcccggtacgtttaagaccccagaaggagaggttggcgcgatcgccctagacttcaagcccgggacgagtgggtcgcccatcgtcaaccgcgaaggcaagatagtgggcctctacgggaacggcgtggtcacgactagcgggacctacgtgagcgccattgcccaggctaaggcctcccaggaaggcccgctgcccgagatcgaagacgaggtgttccgaaagagaaacctcactatcatggatctccatcccgggtcgggcaagacccgacgctacctaccggcgatcgtgagagaggcgatcaaacgcaagttacggactctcatcctggcccccacccgggtggtggcgagtgagatggcggaagcacttaagggtatgccgatcagataccagaccaccgccgtcaagtccgaacatacggggaaggagattgtcgaccttatgtgccacgctaccttcacaatgcggctgttaagtcccgtgcgcgtcccgaactacaacatgatcattatggacgaggcgcacttcaccgaccccagctccattgccgccagagggtacattagcactcgcgtggggatgggcgaggccgctgcgatcttcatgaccgccacaccgcccggctccgtggaggccttcccgcagagcaatgctgttattcaggatgaggagcgggacatccccgagcgctcttggaacagcggctacgagtggatcaccgacttccccgggaaaacggtgtggttcgtgccctccatcaagagcgggaatgacatcgcgaattgtctccgcaagaacggcaagcgggttatccagctgtccaggaagaccttcgacacggagtaccaaaagaccaagaataacgactgggactacgtggtgactacagatatcagcgaaatgggggctaacttccgcgcggatagggtcatcgacccccgccggtgcctgaagcccgtgatcctcaaggacggccccgagcgtgtgatcttggccggacccatgccggtcaccgtggcctccgcagcacagcggcgtggccgcattggccgcaaccacaacaaagaaggggaccaatatatctacatgggccagcccctgaacaacgacgaggatcacgcccactggaccgaggccaagatgctccttgacaacatcaatacgccagagggcataatccccgccctgttcgagccggaaagggaaaagtccgcggccgtcgacggcgagtatcggctcagaggggaagcccgtaagaccttcgtggagctgatgagacggggcgacctgcccgtgtggttatcctacaaggtcgccagcgagggcttccagtatagcgaccgccggtggtgcttcgatggcgagcgcaacaaccaagtgctggaggaaaacatggacgtagagatttggactaaagagggtgagcggaagaagctgcgcccccgttggctcgacgcccgcacctactccgaccccctggcgctgcgggagttcaaagagttcgccgccgggcgacggagtgtctccggcgacttgatccttgagatcgggaagctgccgcagcatctcacgcagcgggcccaaaacgctctggataacctggtgatgctccacaacagtgagcagggcgggcgggcgtaccgacatgcaatggaggagttgcccgacaccatcgagaccctgatgcttctggccctgatagcggtgctcaccgggggcgttactcttttcttcctgtccgggcggggcctaggcaagacttcgattggcctgctgtgcgtaatggcgtccagcgttctcctatggatggcgtctgtcgagccccactggatcgccgcctcgatcatcctggagttctttctcatggtactgctgatcccggagcccgaccgccagaggactccccaggacaaccaacttgcgtacgtggtcatcggcctgctgttcatgatcctaactgtggcggcgaacgagatggggctgctggaaaccactaaaaaggacctcggcatcgggcacgtggccgtagaaaaccaccaccacgcagcaatgctagatgtggacctgcaccccgccagtgcctggactctctatgccgtggccaccacgattatcacgccgatgatgcgccacaccatcgagaacaccacagccaacatctctctgactgcgatcgccaaccaggccgccatcctgatgggccttgacaagggctggccgatctccaaaatggacataggggtcccccttctggcgctaggctgctatagccaggtcaaccccctcaccctgaccgctgccgtgctaatgctcgtagcccattacgctatcatcggtccgggccttcaagccaaagccacgagagaagcgcagaagcggaccgccgcagggatcatgaagaaccccactgtggacggcatagtggccatcgacttggacccagtagtgtatgatgccaagttcgagaagcagctagggcagatcatgttactcattctgtgcacgtcccagatcctgctaatgcgcaccacgtgggccctatgcgagagcatcacactggccaccgggcccctcaccacgctgtgggaaggctccccggggaagttctggaacactaccatagccgtgagcatggcgaacatcttcagaggctcctacctggccggcgccgggctggccttcagcctaatgaagtccctgggagggggccgccgggggaccggtgcgcaaggcgagacgttaggggagaagtggaagagacagctgaaccaactgagcaagagcgagttcaacacctataaaagatccggtatcatggaggtcgaccgcagcgaggccaaggaggggctcaagcggggcgagaccacaaagcacgccgtgtcccgtgggacggcaaagctgcggtggttcgtggaacgcaacctcgtcaaacccgaggggaaggtgattgatctcggttgcggacggggcgggtggagctactactgcgcgggcctcaagaaggtgaccgaggtcaaaggctacactaagggcggccccggtcacgaggagcccatcccgatggcgacctacggctggaacctggtaaagttgcactcaggaaaggacgtattctttatcccgcccgagaagtgcgacacgttgctgtgcgacatcggcgagagctccccaaacccgacaatagaggaggggcgcacgctgcgggttctcaagatggtggagccctggctgcgcggcaatcagttctgcataaagatcctgaatccgtacatgccctcagttgtcgagaccctcgagcagatgcagcggaaacacggcgggatgctggtgcgcaacccactgtccagaaacagcacgcacgagatgtattgggtgtcgtgcggcaccgggaacatcgtaagcgccgtcaatatgacttccagaatgctcctgaaccgcttcaccatggcccaccgtaagccgacctacgagcgcgacgtagacctggggacgggcacccggcatgtcgccgtggagcccgaggtagcgaatctagatatcatcgggcagaggatagagaacatcaagcatgagcacaagagcacctggcactacgacgaggataacccttataaaacgtgggcgtaccatggctcctatgaggtcaaaccgagcgggtcagccagcagcatggtcaacggcgtcgtgaagctgctcaccaagccatgggacgtgataccgatggtcacccagatcgccatgaccgacaccacccccttcgggcaacaacgagtatttaaggagaaggtggacacacgcaccccgaaggccaagcggggcactgcccagatcatggaggtaactgcgcgctggctctggggcttcctttcccgcaacaagaagccccgcatatgcacccgggaggagttcacaagaaaggtgcggagcaacgcagcaatcggcgccgtcttcgtcgatgagaaccagtggaatagtgctaaggaagccgtggaggacgagaggttctgggacctcgtgcaccgggagcgcgagctccataagcaaggtaagtgcgcgacctgcgtctataacatgatggggaagcgggagaagaaactgggggagttcgggaaggccaagggcagccgcgccatctggtacatgtggctgggcgcgagattcctcgagttcgaagccctgggttttatgaacgaggaccactggttctccagggagaacagcctgtccggcgtggaaggggagggcctgcacaagctgggatatatactgcgggacattagcaaaatccccggcggcaatatgtacgccgacgatacggctgggtgggacaccagaatcaccgaagacgacctccagaacgaagcaaagatcaccgacatcatggagccggagcacgcactgctggcaaaggccatcttcaagctcacgtaccagaataaggtcgtccgcgtccagcggcccgccaagaacggcacagtgatggacgtgatctcccggcgggaccaacgcgggagcggacaagtgggcacctacgggcttaacaccttcaccaacatggaggcccagctgatccgccagatggagtccgaaggtatcttctctccctccgagctagagacccccaacctggcagagcgcgcgttagactggctcgaaaagtatggcgttgagcgtctgaagcgcatggcaatttcaggcgacgactgtgtcgtcaaaccgatcgacgaccggttcgctactgccctgaccgcgctcaacgacatggggaaggtgcgcaaggacatcccccagtgggagccatctaaaggctggaacgactggcagcaggtacctttctgcagccaccacttccaccagctgattatgaaggacggtcgcgagatcgtcgtgccttgtcgcaaccaagacgagctggtcggccgggcccgcgtgtcccaaggcgccgggtggagcctccgggagaccgcctgcttgggaaaaagctacgcacaaatgtggcagctgatgtatttccaccgacgggacctacgcctggccgcaaacgccatttgcagtgctgtgccaggggactgggtccccacctctcggacgacctggagtatccacgcgcaccaccagtggatgacaacggaagacatgctgagcgtgtggaaccgcgtgtggatcgaggagaacccctggatggaggacaagacgcacatctccagctgggaagacgttccatacttaggcaagcgcgaggaccagtggtgcggctccctgatagggctgactgctcgggcaacgtgggccaccaacatccaggtggccattaaccaggtgcgcaggctaatcggcaatgagaactaccttgactacatgactagcatgaaacgtttcaagaacgagtcggaccccgagggggcgctgtggtga

SEQ ID NO: 24306 - RNA, 9879 nt, synthetic construct
  misc_feature 1..9879: note = derived and/or modified CDS sequence (opt11) from DENV-1__GQ199793__SS-prME
  source 1..9879: mol_type = other RNA
agcgtcacgatgctgctcatgctgatgcctaccgctctggccttccacctcaccacccggggcggggagccccacatgattgtgaccaagcaggaacgtggtaagagcctccttttcaagaccagcgcgggggttaatatgtgtaccctgatcgcaatggacttgggggagctgtgcgaggataccatgacctacaagtgcccccggatcacggaggctgagcccgatgacgttgattgctggtgcaacgccactgacacctgggtgacctacgggacgtgctcccagacaggggaacaccggcgcgacaagcggagcgtggctttagcgccccacgtgggcctggggctggagacccgcaccgagacctggatgtccagcgagggcgcctggaagcagatccagcgggttgagacgtgggcactccgccaccccgggttcaccgtaatagccttattcctggcgcacgccatcggcacctccatcacccagaaggggatcatattcatcctcctcatgctggtcacaccaagcatggcaatgcggtgcgtcggcataggatccagggacttcgtggaggggctgagcggcgcgacctgggtggacgtggtgctggagcatggctcttgcgtcacaaccatggctaaggacaagccgacgctggacatcgagctcctgaagaccgaggtcacgaaccctgcggtgctccggaaactctgtatcgaggccaagatcagcaataccacgaccgactcacgctgccctacacaaggcgaggccaccctgatggaggagcaggatgccaactttgtttgccggcgcaccttcgtcgaccggggctgggggaacggttgcgggctgttcggcaaggggagcctcatcacttgcgccaagtttaagtgcgtgaccaaactggagggcaagatcgtgcagtacgagaacctgaagtactccgtcatcgttaccgtgcacacgggcgaccagcaccaagtcgggaacgaatctactgagcacggtacaaccgcgacaatcacgccccaggctcccacctccgaaatccagctcaccgactacggggctctgaccctggactgcagcccgcgcacgggcttagacttcaacgagatggtgctgctcaccatgaaagaaaagtcctggcttgtccataagcagtggttcctggacctcccactcccctggaccagcggggccaccacaagccaggaaacctggaaccggcaggacctgctcgtcaccttcaagacagcccacgcgaagaagcaggaggtggtcgtgctcggctcccaagagggggccatgcacacggcactgacgggggccaccgagatccagaccagcgggacgaccaccatattcgccgggcacctgaagtgtcgcctcaagatggacaagctgaccctgaaggggatgtcttacgttatgtgcacgggatctttcaagctcgagaaagaggtcgcggagacccagcacggcactgtgctggttcagatcaagtacgagggtaccgacgccccctgtaagatccccttttccacccaggacgagaagggggtaacccagaacggccggcttatcaccgccaacccgattgtcaccgacaaagaaaagcccgtgaacatcgaggcagaaccccccttcggggagagctacatcgtaatcggcgccggcgagaaggccctgaagctctcatggttcaagaaggggagctccattggcaaaatgtttgaggccacggcccgcggggcccggcgcatggcgatcctgggagacaccgcatgggacttcgggtccatcggcggcgtatttacatccgtggggaagttggtccatcagatcttcggcacggcatatggtgtcctgttcagcggggtttcctggacgatgaagatcgggatcggcgtcctcttgacctggttaggcctgaactcgcgctccacctcgttgtccatgacctgcatcgctgtgggactcgtgacgctatacctgggcgtcatggtacaggccgacagcggatgcgtgatcaattggaaaggccgggagctcaaatgtgggtccggcatatttgtcacgaacgaagtgcacacctggactgaacagtataagttccaggcggactccccgaagcgcctgtctgcagccatcggcaaagcatgggaagagggagtgtgcggaatcagatctgctaccagactggagaacatcatgtggaagcagataagcaacgagctcaaccacatcttactggaaaatgacatgaagtttacggtcgtcgtgggggacgtcgtgggcatcctcgctcaagggaagaagatgattcggcctcagcccatggagcacaagtactcctggaaatcctggggaaaagcgaagattatcggcgccgacgtgcagaacaccaccttcatcatcgacgggcccaatacgccggagtgccccgacgaccagcgcgcctggaacatctgggaggtcgaagactacggcttcgggatcttcactaccaacatctggctgaagctgcgggacagctacacccaaatgtgcgaccatcgcttgatgagcgcagccatcaaggactcgaaggccgtacatgccgacatgggatactggatcgagagcgagaaaaacgagacctggaagctggcccgggcgagcttcatcgaggtgaagacgtgtatctggcccaagtcccataccctgtggtccaacggcgtcctagagagcgagatgataattcctaagatctacgggggccctatctcccagcacaactaccgcccgggctatttcacccagaccgccggcccgtggcacctgggcaagctcgagctcgatttcgacttgtgcgagggcacgaccgtggtcgtcgacgagcactgcggcaaccgggggccgtctcttcgcaccaccacagtcaccggcaaaatcatccacgagtggtgctgcaggtcgtgcaccttaccaccgcttcgcttcaagggcgaagacggatgctggtacgggatggagatccggcccgtgaaggaaaaggaggaaaacctggtcaagagcatggtctccgccggaagcggcgaggtggattccttctccctcgggttgctatgcatctcaatcatgatcgaagaggtcatgcgctctcgctggagccgcaagatgttgatgaccggcacgctggccgtcttcctgctccttatcatggggcagctgacctggaacgacctcatccggctgtgtattatggtgggggctaacgccagcgaccgcatgggcatgggcaccacgtacctggcgctcatggccacgttcaagatgcgccccatgttcgccgtaggtctcctgttccgacgtctcacctcgcgggaagtgctgctgctaaccattggcctgtccttggtcgcgagcgtggagcttccgaactccctggaggaactgggcgacgggctcgcgatgggcatcatgatcctgaagctgctcacggacttccaaagccatcagctatgggctaccctgctctccttgaccttcataaagaccaccctaagtctgcactacgcctggaaaacgatggccatggttctgagtatcgttagcctcttcccactctgtctctccaccaccagccagaagacgacgtggctgcccgtgctcctggggtcgctggggtgcaagccgctcaccatgttcttgatcaccgagaacaaaatctggggcagaaagagctggcccctaaacgaggggatcatggcggttggcgtcgtctccattctcttgagcagcctcctcaagaacgacgtgcccctggccgggcccctgatagctggcggaatgctcatcgcgtgctatgtcatctctggtagcagcgcagacctgagcctggagaaggcagccgaggtatcctgggaggaggaggccgagcactcaggcgcctcccacaacatcttagtggaggtccaggacgacgggaccatgaagatcaaggatgaggagcgggacgacaccctgacgatcctgttgaaggccacgctgctggcggttagtggcgtgtatccgctctccatccctgcaaccctgttcgtctggtacttctggcagaagaagaagcaacgcagcggggtgttgtgggacacccccagcccccccgaggtggagcgggcggtcctcgatgacggcatctaccgcatcatgcagcggggcctcctcgggcgcagccaggttggggtgggagttttccaggagaacgtgttccatacgatgtggcacgtgaccagaggcgccgtcctgatgtaccaggggaagagactcgagccctcttgggcctcggtaaagaaggacctaatctcctacggaggcggatggcggctccagggcagctggaacgcgggcgaggaggttcaggtcatcgcagtggaaccgggcaagaacccaaaaaacgtgcagaccgctcccgggaccttcaaaacccccgaaggtgaggtcggcgccatcgctctcgacttcaagcccgggacctccggctcccccatagtgaaccgcgaaggtaaaatcgttggcctgtacggcaacggggtcgtgaccacctccggcacgtacgtgagcgcgattgcccaagccaaagccagccaggagggcccgctgcccgagatcgaggacgaggtgtttcggaagcgcaacttgaccatcatggacctgcaccccggaagcggtaagacccgcaggtacctaccagcgatcgtgagggaggccatcaagcggaagctccggaccctgatcctggcccccacgcgcgtcgtcgccagtgagatggcagaggctctcaaagggatgcccatccgatatcaaacgacagccgtgaagtccgagcataccggcaaggagattgtggaccttatgtgccatgccacgttcacaatgcggctgctctctccagtccgcgtgccaaactacaacatgatcatcatggatgaggcgcacttcaccgacccctccagcatcgccgcgcgggggtatatctccacacgcgttggcatgggcgaggcggccgccatttttatgacggccacgccgcccggtagtgtcgaggcttttccccagtcaaacgccgtgattcaagacgaggaacgggacatccccgagcgctcttggaatagcgggcacgagtggatcaccgactttcccggcaaaaccgtgtggttcgtacccagcatcaagtcaggcaacgacatcgccaactgcctgcggaagaacgggaagcgggtgatccaactgagccggaagacgttcgacaccgagtatcagaaaacgaagaacaacgactgggattatgttgtcaccacggacatctccgagatgggggctaactttcgtgcggaccgggtcatagatccgcgccggtgcctcaaacccgttattctgaaggacgggccggagcgcgtcatattggccggccctatgccggtaaccgttgccagcgccgcccaacggcgcgggcggattggccgcaaccacaacaaggagggcgaccaatatatctacatggggcagcccctcaacaacgatgaggatcacgcgcactggaccgaggccaagatgctattggacaacatcaacaccccagagggcatcatccccgccctttttgagccggagcgggagaagtccgccgccatagatggagagtaccgtcttcgcggcgaggctcggaagacgttcgtcgagctgatgcgccgcggggaccttccggtatggcttagttacaaggtggcgtccgaggggttccagtacagcgatcgtcggtggtgcttcgacggagaacgcaacaaccaggtgctcgaagagaatatggacgtcgaaatttggacaaaggagggggaacggaagaagctccgcccaagatggctggacgcccgtacctacagcgaccccttagctctccgggagttcaaagagttcgcggcgggccgccgaagcgtctctggggacctaattttggagatcggtaagctaccccagcacctgacgcagcgtgctcagaatgcgctagacaacctcgtgatgttacacaactccgagcaaggcgggcgggcttatagacacgcgatggaagagcttcccgacacaattgagaccctcatgttgctggcgctcatcgcagtcctgaccggaggggttaccctgttctttctaagcggccgggggctggggaagacctcaatcggcttactctgcgtgatggcttcctccgtgctgttatggatggcgagtgtcgagccccactggatcgctgcatccatcatcctcgagttcttccttatggtgctgctcatccccgagccggaccgccagagaaccccccaggacaatcaactggcctacgtcgtcatcggtctactctttatgatcctaacagtggccgccaacgagatgggcctgcttgagacaaccaagaaggacctaggaatcggacacgtggcggtagagaaccaccaccatgccacgatgctggacgtggacctccaccctgccagcgcctggaccctatacgccgtggcgaccaccatcatcacgccgatgatgcgccacaccatcgagaacaccacagccaacattagtctgacagccatcgccaaccaggctgcgatcctcatggggcttgacaaaggctggcccatcagcaagatggacatcggagtccccctgctcgccctggggtgctactcccaggtaaaccccctgaccctcaccgccgccgttctgatgctggtagcccattacgcaatcatcgggccagggctccaggccaaagccaccagggaggcccaaaaacgtaccgcggccggtatcatgaagaaccccaccgtggatgggatcgtggccatcgacctggatcccgtcgtctacgatgcaaagttcgaaaagcaactgggccaaatcatgctcctcattctgtgcaccagccagattcttttaatgcgcaccacgtgggccctgtgcgagtccataaccctcgcgactggtcccttgacaacgctttgggaagggagcccgggcaagttctggaacactaccatcgccgtgagtatggccaacatcttccgggggagctatctggccggggccggccttgcgttctccctgatgaagtcccttgggggcggcaggagaggcacaggggcccaaggcgagacgctgggagaaaagtggaaacgccaactaaaccagctcagcaagtccgaatttaacatctacaaacggtctgggatcatggaggtcgaccgatccgaggccaaggagggcctgaagcgcggggaaaccacccgccacgccgtgagccggggcaccgcgaagctgcgctggttcgttgagcggaatttggtcaaacccgaggggaaggtaatcgatctcggctgcggccgcgggggttggtcatactactgcgccgggttgaagaaggtgacggaggtaaagggctacaccaagggcgggcccggccatgaggagcccattcctatggccacctatgggtggaacctggtgaaattgcacagcgggaaagacgtctttttcacgcctcccgagaagtgcgacacgttactgtgcgacatcggggagtccagccctaacccgacgatcgaggaaggccggaccctccgcgttctgaagatggtggagccttggctccgggggaaccagttctgcattaaaatccttaacccttacatgccctccgtggtcgagaccttggagcaaatgcagcgcaagtacggcggcatgctggttcggaatccgctcagccgcaacagcactcacgaaatgtattgggtaagctgcgggacggggaacatcgtctcagccgtgaacatgacgagccggatgttgctgaaccgtttcaccatggcccatcgcaaacccacttacgagcgggacgtggaccttggggcaggcacgcgacacgtcgccgtggagccggaggtggccaacctggacatcatcggacagaggatcgagaacatcaagcatgaacacaagtccacttggcactacgacgaggacaacccctacaagacgtgggcgtaccacgggagctacgaggtcaagccgtccggcagcgcctcctcgatggtaaacggcgtcgtcaagttactcacgaagccctgggacgtgatccctatggtcacgcagatcgcgatgaccgacaccacacccttcggccagcagcgcgtgttcaaggagaaggtagacacgcggacgccgaaggccaagcgcgggacggcccagattatggaggtcaccgcacggtggctctggggcttcttgtcacgcaacaagaagccccggatctgtacgcgcgaagaattcacccggaaagtccgttccaacgccgcgattggcgccgtgttcgtcgacgagaaccagtggaatagcgccaaagaggccgtggaggacgagagattctgggatctcgttcagaaggagcgcgagctgcacaaacagggtaagtgtgccacttgcgtgtacaacatgatgggaaagagagagaagaagctgggggagttcggcaaggccaaggggtcacgcgccatctggtacatgtggctcggcgcccgcttcctggagtttgaggccctgggctttatgaacgaggaccactggtttagccgggagaactccttaagcggggtggagggcgaagggctacacaagctgggctacatcctccgcgacatctcgaaaatcccaggaggcaacatgtatgcagacgacacagccggctgggatacgcgcattaccgaggatgatctgcagaacgaggccaaaatcaccgacatcatggagccggagcatgctttgctcgccaccagcatctttaagttgacgtaccagaacaaggttgtcagggtgcagcgccccgcgaagaacggcacagtgatggacgtcatctcccgccgggaccagcgaggcagcggccaagttgggacctatggactaaacaccttcacgaacatggaagctcagctgatcaggcagatggaatccgaggggatcttcttgcccagcgagctggaaacccccaacctggccgagcgcgtgctggactggctggagaagtacggcgtagagcggctcaagcgcatggccatatccggggatgactgcgtggtgaagccgatcgacgaccggttcgctacagcgcttaccgccttaaacgacatgggaaaggttcgaaaagatatcccgcagtgggaaccatccaaagggtggaacgattggcagcaggtgcccttctgctcccatcacttccaccaattaatcatgaaggacggcagggagattgtggttccgtgcaggaaccaggacgagctggtcggcagggcccgagtgagccagggggccggctggtctctgcgggaaacggcctgcctcggtaagagctacgcacagatgtggcagctgatgtacttccaccgccgggacctccgcctagccgcgaacgccatctgcagcgcggtccccgtggattgggtgcccacctcccggaccacctggagcatccacgcccaccatcaatggatgaccactgaggacatgctatccgtctggaaccgcgtatggatcgaggagaacccttggatggaggacaaaacccatgttagctcctggggcgacgtcccgtacctcgggaagcgggaggaccaatggtgcggcagcttaatcggcctgacggcccgcgccacctgggcgtccaatatccaggtggcgataaaccaggtgaggcggttgatcgggaacgagaactacttagactacatgacatctatgaagcgcttcaagaacgagggcgaccccgaaggtgccctgtggtga

SEQ ID NO: 24307 - RNA, 9879 nt, synthetic construct
  misc_feature 1..9879: note = derived and/or modified CDS sequence (opt11) from DENV-1__GQ199795__SS-prME
  source 1..9879: mol_type = other RNA
agcgtgaccatgctgctcatgctgatgcctaccgcgctggccttccacctcaccacccggggtggggagccccatatgatcgtcagcaagcaggagcggggcaagagcctgctgtttaagaccagcgccggcgtgaacatgtgcaccctcattgccatggacctgggcgaattatgcgaggacaccatgacctacaagtgtccccgcataacagagaccgagcccgacgacgtggactgctggtgcaacgcaacggacacctgggtgacctacgggacctgtagccagacgggtgagcaccggcgcgataagcggagtgtggccctcgcgccccacgtgggtctggggctggagacccgcaccgagacctggatgagctccgagggcgcgtggaagcagatccagcgggtcgagacgtgggccctccgccaccccgggttcaccgtgatcgcactgttcctggcccacgcaatcggcaccagtatcacccagaaggggatcattttcatcctactgatgctggtgacgccgtccatggccatgcggtgcgtaggcatcggcagccgcgacttcgtggaggggctctccggcgccacttgggtggacgtcgtgctggaacacgggagctgcgtgaccaccatggccaaagacaagcccactctggacattgagctcttgaagaccgaggtcactaaccccgccgtgctccgtaagctctgcatcgaagcgaagatcagcaacaccacgaccgacagccgctgtccgactcagggcgaggccaccctggtggaggagcaggatgccaacttcgtctgccggcgcacgttcgtggaccggggatgggggaacggctgcgggcttttcggcaaggggtccctcatcacgtgcgccaagttcaagtgcgtgaccaagctggagggcaaaatcgtccagtatgagaacctgaaatactccgtgatcgtgaccgtccacactggcgaccagcaccaggtggggaacgagtccaccgagcacggtaccaccgccaccataacgcctcaggcgcccaccaccgagatccagctcaccgactacggggccttaactctggattgcagcccacgtaccggtctagacttcaacgagatggtcctgctgaccatgaaggagaagtcctggctcgtgcacaagcagtggttcctggacctgcccctaccctggacgtctggggccagcacctcccaggaaacctggaaccgtcaggatctgctcgtgaccttcaagaccgcccacgcgaagaaacaggaggtcgtggttctcggcagccaggagggcgcgatgcacacggccctgaccggcgccaccgagatacaaacctccggcacgaccaccatcttcgccgggcacctgaagtgccgcctcaagatggataaacttaccctgaagggcatgagctacgtcatgtgcacagggtcattcaagctcgagaaggaggtggccgagacccaacacggcaccgtgctggttcagatcaagtacgagggcaccgacgccccctgcaagatccccttcagtacgcaagacgagaagggtgtgacccagaatggccggctgatcaccgccaacccgattgtgaccgacaaggaaaagcccgtcaacattgaggccgagccgcccttcggtgagtcctacattgtgatcggagccggcgagaaagcgctgaaactgagctggtttaagaaagggtcctcgatcggcaaaatgttcgaggccacggcacgcggggcccgacgcatggccatcttaggcgacacggcgtgggacttcgggtccataggcggcgtgttcaccagcgtcggtaagctggtgcaccagatattcggaaccgcctacggggtgctgttctccggcgtcagctggacgatgaagatcgggatcggcgtgctgctgacctggctcggccttaactcccgtagcactagcctgagcatgacttgtatcgccgtcgggctcgttacgctgtaccttggcgtgatggtccaagccgactcgggatgtgtaataaactggaagggccgggagctcaagtgcggaagcggcatctttgtgaccaacgaggtgcacacctggaccgagcagtacaagttccaggccgactcaccgaagcgcctgtccgctgctatcggcaaggcctgggaggagggggtctgcggcatccggagcgccacccgcctggagaacatcatgtggaagcagatctccaacgagctcaaccacatactgctggagaacgacatgaagttcacggtggtggtgggggatgtggcgggtatcctcgcgcaggggaagaagatgatccggccgcagccaatggagtacaaatacagctggaagtcctggggcaaggccaagatcatcggcgccgacgtacagaacaccaccttcatcattgacgggcccaacaccccggagtgcccggacgaccagagagcctggaacatctgggaggtcgaggactacggcttcgggatcttcacgaccaacatctggctgaagcttcgagacagttacacccaagtgtgcgaccaccgcctcatgtccgcggccatcaaggacagcaaggccgtgcacgccgacatgggctactggatcgagtccgagaagaacgaaacctggaagctggcccgggcgagcttcatcgaggtcaagacctgcatctggcccaaatcccacaccctttggagcaacggtgtgctcgagtccgagatgatcatacccaagatctatgggggaccgatcagccagcacaactaccgcccggggtacttcacccaggccgcaggcccctggcacctggggaagctggagctcgacttcgacctgtgcgagggcacaacggttgttgtggacgagcactgcggcaaccgggggccgtccctgcgcaccaccaccgtgacgggcaagatcatccacgaatggtgttgccggagctgcaccctgccgccgctccgcttccggggggaggacggctgttggtacgggatggagatccggccagtcaaggagaaggaggagaacctagtgaagtccatggtgagcgccggatctggcgaggtcgactccttcagcctcgggctgttatgtatctccatcatgatcgaagaggtgatgcggagccgctggtccaggcgcatgctcatgaccggaacactggccgttttcttcctactcatcatggggcagctgacctggaacgacctgatccgcttgtgcatcatggtcggcgcgaatgccagcgatcggatggggatgggcactacctacctggccctgatggccacctttaagatgcgccccatgttcgccgtagggctcctctttcggcgcctaacgtccagagaagtgctcctgctgaccatcgggctctctcttgtcgcgtccgtggagctgcccaacagcctcgaagagctgggcgacgggctggccatgggcatcatgatcctcaagttgctgaccgactttcagtcccaccagctctgggccaccctgctgagcctgacgttcatcaagaccacgttctccctgcactacgcctggaagaccatggcgatggtcctgagcatcgtgtccctcttccccctgtgtctgagcacgacgtcccagaagaccacctggctccccgtgttactgggtagcctcgggtgcaagccgctgacgatgttcctgatcgcagagaacaagatctggggccgccggtcctggcccctcaacgaggggatcatggccgtcggcatcgtaagcatcctgctaagctccctcctgaagaacgatgtgcctttagctgggcccctaattgcaggaggcatgctaatcgcgtgttacgtcatcagcgggtcctccgccgacctgtccctcgagaaggctgccgaggtctcttgggaggaggaggccgagcattccggcgcatctcacaacatcctggtagaggtccaggacgatgggaccatgaaaatcaaggacgaggagcgcgacgacaccttaaccatacttctgaaggccacgctgctcgccgtctccggcgtgtacccactgtctatccctgccacgctgttcgtgtggtacttctggcaaaagaagaagcagcggtccggggtgctctgggacaccccttcgccacccgaggtggagcgcgcagtcctcgacgacggcatctaccgcatcatgcagcgtggcctgctagggcggtcccaggtgggcgtcggtgtcttccaggagaacgtgttccacaccatgtggcacgtgacgcgtggcgcggtcctcatgtaccaggggaagcgtctggagcccagctgggcctctgtgaagaaagatctgatcagctacggcggagggtggcgactccagggctcctggaacacgggagaggaggtgcaggtcatcgccgttgagcccggcaaaaaccccaagaacgtacagaccgcccccgggactttcaagacccccgagggcgaggtaggtgccattgcgctggacttcaagcccgggacgagcggctccccaatcgtcaacagggaggggaagatcgtgggcctgtacggcaacggggtcgtaaccaccagcggcacctacgtgtctgccatcgcccaggctaaggcgtcccaggaagggccgctccctgagattgaggatgaggtgttccgcaagcggaacctaacgatcatggacctgcacccaggcagcgggaagacccgccggtacctcccggccatcgtacgcgaggccatcaagcgcaagctacggacgctgatcctcgcacccacccgcgttgtcgcctccgaaatggccgaagcgctgaagggcatgcccatcagatatcagacgaccgccgtcaagagcgagcacaccggcaaggagatcgttgacctgatgtgccatgccaccttcactatgcggctcctgtcccccgtccgggtgccgaactacaacatgatcatcatggacgaggcccacttcaccgaccccagctccatcgcggcccgcgggtacatcagcacccgggtgggcatgggggaagcggccgccatcttcatgaccgcgacgccccccggctccgtcgaggcatttccgcagtctaacgccgtaatccaggacgaggaacgcgacatcccagagcggtcctggaactctgggtacgagtggatcaccgacttccccggtaagaccgtgtggttcgtaccttctattaagtcgggcaacgacattgccaactgcctgcgcaagaacgggaagcgggtgatccagctgtcccgcaagacctttgacacggagtaccagaaaaccaagaacaacgactgggactacgtggtgacaaccgacatcagcgagatgggcgcgaacttccgagcagaccgcgtgatagacccgcgtcgctgcctgaagcccgtgatcctgaaagacgggcccgagcgggtcatacttgccgggcccatgccggtgacggtcgcgtccgccgctcagcgccgggggagaatcggccgcaaccacaacaaggaaggcgaccagtacatttacatggggcagcccctgaacaacgacgaggaccacgcccactggaccgaggccaagatgcttctcgacaacatcaacaccccggagggcatcatcccggccctgttcgaaccggagcgggagaagtccgccgcgatcgacggggagtaccgcctgcggggggaagccaggaagaccttcgtagagctcatgcggcgcggggacctgcccgtgtggctgtcctacaaggtcgcaagcgaaggcttccagtactcagatcggcgctggtgctttgacggcgagcggaacaaccaggtgctcgaggagaacatggacgtggagatctggaccaaggagggggagcgcaagaagctgaggccccgatggctagacgcccggacctactccgatccgctagcgctgagggagttcaaagaattcgccgccggccggcgcagcgtatccggggatctgatcctcgagatcggcaagttgccgcagcacctgacgcagcgggcgcagaacgcgctcgataacctggtaatgctgcacaacagtgagcaaggcggccgcgcgtaccggcacgccatggaggagctccccgacaccatcgagacgctgatgctgctcgccctgatcgcggtgctgacgggcggtgtcaccctttttttcctgtccggcagggggctgggcaaaaccagcatcggcctcctgtgcgtgatggcctccagcgtgctcctctggatggcgtccgtcgagccgcactggatcgccgccagcatcattctggagttcttcctgatggtgctccttatccccgagccggaccgacagcgcacaccccaagacaaccagctggcctatgtggtcatcgggctgctgttcatgatactgacggtggccgcgaacgagatgggcctcctggagactacgaagaaagatctggggatcggccacgtggccgtcgagaaccaccaccacgccgccatgctagacgtggatctgcaccctgcctccgcctggacgctgtacgccgtggccacgaccatcattaccccgatgatgcgtcacaccatcgaaaacacgaccgcgaacatcagcttaaccgccatcgcgaaccaggccgccatcctgatgggcctggacaagggctggcccatttccaaaatggatatcggcgtccccctcctggcccttggatgctacagccaggtgaaccccctcaccctgacggcggcggtgctgatgctcgtagctcactacgccatcatcggaccggggctgcaggcgaaggcgacccgggaggcccagaaacgcaccgcagctggtatcatgaagaaccccaccgtggacgggatcgtggccattgacctggaccccgtcgtctacgacgcgaagtttgagaagcaactcggccagatcatgctattaatcctctgcacgtcacagatcctgctgatgcggaccacctgggctctctgcgagagcatcaccctggccacaggccctctgaccacgctctgggaggggtccccaggcaagttctggaacaccacaatcgccgtgagcatggccaatatcttcagaggctcctacctggcgggcgccggcctggccttcagcctcatgaagtccctcgggggcgggcgtcgcgggaccggggcgcagggcgagaccctgggcgaaaagtggaaacgccagctcaatcagctgtccaagtcagagtttaacacctacaagcgctccgggataatggaggtcgaccggagcgaggcgaaagagggcctgaagcgcggggagacgaccaagcacgccgtttcccggggcaccgccaagctccgctggttcgtggagcggaacctggtcaagcccgagggaaaagtgatcgatctgggctgcgggcgcgggggttggagctactattgcgccgggcttaagaaggtgaccgaggtcaagggctacacgaagggcggccccggccatgaggaccccataccgatggccacctacgggtggaacctcgtgaagctgcattccggcaaggacgtattcttcatcccgccagagaagtgcgacaccctgctctgtgatatcggggagagctccccaaacccgaccatcgaggagggccgtacgctgcgcgtcctgaagatggtggagccctggctcaggggtaaccagttctgcatcaagatcctgaacccctacatgccctcggtggtcgagacactggaacagatgcagcgcaagcacggcggtatgctcgtccggaacccgttaagtcgcaacagcactcacgagatgtactgggtgtcctgcgggaccggcaacatcgtgagcgcggtgaacatgacctcaagaatgctgctcaaccggttcacgatggcccaccgcaagcccacctacgagcgggacgtggacctgggggccggcacccgccacgtcgccgtggagcccgaggtggccaacttggacattattggccagcgaatcgagaatatcaagcacgagcataagagcacctggcactacgacgaggacaacccatacaagacgtgggcgtaccacgggtcgtacgaggtcaagccgagcggctccgcaagctcgatggtgaacggggtcgtgaagctcctcaccaaaccctgggacgtgatcccaatggtcacccagatcgccatgaccgacacgacccccttcgggcagcagcgcgtgttcaaggagaaggtcgacacccggaccccgaaggccaagcgcgggacggcacagatcatggaggtcaccgcgaagtggctgtggggctttctctccagaaacaagaagccgcgcatttgtacccgggaggagttcacccgcaaggtgcggagcaacgccgccatcggcgcagtgttcgtcgacgagaaccagtggaactccgcgaaggaggctgtggaggacgagaggttctgggacctggtgcaccgggagcgcgagctgcataagcaaggcaagtgtgccacgtgtgtctacaacatgatgggcaagcgggagaagaagctcggggagttcggcaaggccaaggggtcacgcgccatctggtacatgtggctgggggcgcggttcctggagttcgaagccctcggcttcatgaatgaggaccactggttttcccgcgagaacagcctgagtggggtggagggtgagggacttcacaagctcggctatatactgcgggacataagcaagatccccgggggcaacatgtacgccgacgacaccgccggctgggacacccgcatcaccgaggacgatctgcagaatgaagcccgcatcacggacatcatggagccggagcacgcgctcctggccaagtcgatcttcaagctgacctaccagaacaaagtggtacgcgtgcagcgccccgccaagaacgggaccgtgatggacgtaatcagccggcgcgaccagcggggcagcggccaggtggggacgtacggcctgaatacattcaccaacatggaggcccagctgatacgccagatggagagcgaggggatcttctccccctcggagctggagacccccaacctcgccgagagggttctcgactggctggagaagtatggtgtcgagcgcctcaagaggatggcgatatccggtgatgattgcgtggtgaagccgatcgacgaccgctttgccacagccctgacggccctgaacgacatgggcaaggtcagaaaggacataccccagtgggagcccagcaagggatggaacgattggcagcaggtccccttctgctcccaccacttccaccagctcatcatgaaggacggccgcgagatcgtggtcccgtgccggaaccaggacgagctggtgggccgagcccgggtgagccagggggccggctggagcctgcgcgaaaccgcgtgcttggggaaatcctacgcccagatgtggcagctgatgtactttcaccggcgcgaccttcggctcgctgcgaacgccatatgcagcgctgtccccgtggattggatccccacctcccgcaccacatggagcatccacgcccaccaccagtggatgaccaccgaggacatgctgtccgtgtggaaccgcgtgtggatcgaagagaacccctggatggaggataaaacccacatcagttcctggggcgacgtgccgtacctggggaaaagggaggaccagtggtgcggcagcctcattggcctgacggcccgcgcgacctgggccaccaacatccaagtggccataaaccaggtaagacgccttatcgggaacgagaactacttagactacatgacctccatgaagcggttcaagaacgagagcgaccctgagggcgccctgtggtga

SEQ ID NO: 24308 - RNA, 9873 nt, synthetic construct
  misc_feature 1..9873: note = derived and/or modified CDS sequence (opt11) from DENV-1__FJ882547__SS-prME
  source 1..9873: mol_type = other RNA
agcgtgacgatgttgctcatgctgatgcccaccgcgctcgcattccacctcaccactcgtggcggggaaccccacatgattgtgagcaagcaggagcggggcaagtcattgctgttcaagacaagcgcgggggtgaacatgtgcaccctcatcgctatggatttgggcgagctctgtgaggacacgatgacgtacaaatgccccaggatcacagaggccgagcccgacgacgtggactgctggtgtaacgccaccgacacgtgggtgacctacgggacctgtagccagactggcgagcaccgccgcgacaagcggtccgtggcactcgcgccgcacgtaggcctgggtctagagacgcgcacagagacttggatgtcgagcgagggcgcttggaagcagatccagcgggtcgagacctgggccttgcgccaccccgggttcacggtgatcgcattgttcctcgctcatgccatcggtaccagcatcacccagaaggggataattttcatcctcctgatgctcgtgaccccctccatggcaatgcggtgcgtcggcatcggcagtcgcgacttcgttgaggggctttccggcgccacgtgggtggatgtagtgctggagcacggtagctgcgtgaccacgatggccaaagacaagcccaccctggacatcgagctcctcaagacggaggtaaccaaccccgctgtgctccggaagctctgcatagaggccaagatctccaacaccaccacggacagccgctgcccgactcagggcgaggcgacccttgtggaggagcaggacgcaaactttgtctgtcggcgcaccttcgtggaccggggatgggggaacggctgtgggttattcggcaaggggtccctcataacctgcgccaagttcaagtgcgtgaccaaacttgagggcaagatcgtccagtacgagaacctcaagtacagcgtgatcgtgactgtccacaccggcgatcagcaccaagttggaaacgagtccaccgagcacggcacaaccgcgaccataacgccccaggcccccactaccgagatccagctcaccgattacggggccctgaccctagattgcagcccgcgcaccggcttagacttcaacgagatggtcctgctgaccatgaaggagaagtcctggctcgtgcacaaacagtggttcctggacctgcccttgccctggacgagcggggccagtacctcccaggaaacttggaacaggcaggacttactggtgacctttaagaccgcacatgctaagaagcaggaggtagtggtgctcggcagccaggagggcgcgatgcacactgctctgacgggggccaccgagattcagacctctggcaccacgaccatcttcgccgggcatctgaagtgccgcctaaagatggacaagctgaccctgaagggcatgagctatgtcatgtgcaccgggagcttcaagttagagaaggaggtggccgagactcagcacggcaccgtgttagtccagatcaagtacgagggcacagatgccccatgtaaaatccccttcagtacccaagacgagaaaggggtgacgcagaacgggcgcctgatcaccgccaacccgatcgtgactgacaaggagaagcccgtcaacatcgaggccgagccgccgttcggagagtcctacatcgtaatcggcgcgggcgagaaagccttgaaactcagctggttcaagaagggatccagcatcggcaaaatgttcgaggccaccgccagaggggcgcggaggatggcgatcctgggagacacggcctgggacttcgggtctatcggcggcgtgttcacctctgtgggcaagctcgttcaccagatcttcggcactgcctacggcgtgctgttctccggcgtcagctggaccatgaagatagggatcggcgtgctgctgacgtggctgggcctgaactcccgcagcacctcgctgagcatgacatgcatcgccgtggggctcgtcaccctgtacctgggcgtgatggttcaggccgactcagggtgcgtcatcaactggaaaggccgggaactcaagtgcgggagcggcattttcgtgacgaatgaggtgcatacatggaccgagcagtacaagttccaggcagactcgccgaagcgcctgtccgccgccatcggcaaagcctgggaggaaggggtttgcgggattcgaagcgccacccgcctggagaacatcatgtggaagcaaatttccaatgagttaaaccacatactgctcgagaacgacatgaagctcacggtagtggttggggatgtggcgggcatcctagggcagggcaagaagatgattcggccccaacctatggagtacaagtactcgtggaaatcatggggtaaggccaaaatcattggggccgacgcccaaaacaccactttcatcatagacggcccaaacactccggagtgccctgacgaccagcgcgcgtggaatatctgggaggtggaggactacggcttcggcatcttcaccacgaacatatggctcaagttgcgggacagctacacccaggtctgcgaccacagactgatgtccgcggctatcaaggactcgaaagccgtgcacgcagatatgggctactggatcgagtccgaaaagaacgagacctggaagctggcccgggccagcttcatcgaggtgaagacctgcatctggcccaagtcccacacgctgtggagcaacggggtgctggaatcggagatgatcatccccaagatatatggcgggccgatcagccagcacaactacaggcccggctacttcacgcagaccgccgggccctggcacttgggcaagctcgagctggacttcgacctctgcgagggcacgactgttgtggttgacgagcactgcggcaacagggggccgtccttacgcaccacaaccgtgacggggaagatcatccacgagtggtgctgccggagctgtacgttaccgcccctacgcttccgcggcgaagacggttgctggtacggcatggagatccgccccgttaaggagaaggaggagaacctcgtcaagtccatggtgagcgccggcagcggggaggttgattccttcagcctggggctcttatgcatctcgatcatgatcgaggaagtcatgcggtcccgctggtccagaaagatgctgatgaccgggactctggccgtgttcttccttttgatcatgggccagctcacgtggaacgacttgattcgcctgtgcatcatggtcggcgcgaacgctagcgatcgcatgggtatcggtacgacctatctggcgctaatggccaccttcaaaatgaggccgatgtttgccgtcggcctgctgttccgacggttaacatcccgcgaggtgctgctactcaccatcggcctgagcctggtggcttccgtcgagctccccaactccctggaggagctgggggacggcctcgccatgggcataatgatgctgaagctgctcaccgacttccagtcccaccagctgtgggccactctgctcagcctgacgtttatcaagacaacgttctccctgcactacgcatggaagaccatggcgatggtgctcagtatagtctccctgttccccctgtgcttgagcacgacctcccaaaagacgacctggctccccgttctgcttgggtcactgggctgcaagccgctgacgatgtttctcattgccgagaacaagatctggggtcgtaagtcatggcccctgaacgagggcataatggccgtagggatcgtctcaatcttacttagctccctgctcaagaacgatgtgcccctcgccggcccccttatcgccggagggatgctgatcgcgtgttacgtgatcagcggctcaagcgccgacctctcactggaaaaggccgccgaggtctcgtgggaggaggaggcagagcactctggggcgagccacaacatcctggttgaggtacaggacgacgggaccatgaaaattaaggacgaggagcgcgacgacaccctcacgatcctgcttaaagctactctcctggccgtcagtggggtttaccctctcagtatacccgccaccctcttcgtgtggtacttctggcagaagaagaagcagcggtccggcgtcctgtgggataccccctctcctccggaggtggagcgtgcagttctggacgacggcatctaccggatcatgcaaagggggctgctcggccggtcccaggtcggggtgggagtgttccaggaaaacgtcttccacaccatgtggcacgtcacccgcggagcggtgctgatgtaccagggaaagagactggagccgagctgggcctcggtcaagaaggatttgatctcttacggcggagggtggcgcctgcgggggtcctggaacacgggagaggaggttcaagtgatcgctgtggaacctgggaagaatcccaagaacgtgcaaacagcccccggtaccttcaaaacccccgaaggcgaggtgggggccatcgccctggatttcaaacccggcacgagcggttcaccgatcgtcaaccgtgagggcaagatcgtgggcctctacgggaacggcgtcgtcaccacctccgggacctacgtgagcgccattgcccaggccaaagcgtcccaggagggcccgctgcccgagatcgaggacgaggtgttccggaaacgcaacctgacgattatggacctccacccgggtagcggcaagacccggcgctatctgccggccatcgttagggaggccataaagcggaagctccgcaccctcatcctggcccccacccgggtggtagccagtgagatggcggaagcactgaaaggcatgcccatccgctaccagacgaccgccgttaaaagcgaacataccggtaaggagatagttgacctcatgtgccacgccactttcacgatgcgactgctctcgcccgtgcgagtaccgaattacaacatgatcattatggacgaggcccacttcactgatcccagctccatcgccgcccggggctacatctcaacccgggtggggatgggcgaagccgccgcgatcttcatgactgcgacgccgcccggatccgtggaggccttcccgcagtctaatgccgtcatccaggacgaggagcgtgacatacccgagcgctcctggaacagcggatatgaatggatcaccgactttccgggaaagaccgtgtggtttgtgccctccatcaagagcgggaatgacatcgccaactgcctccgcaagaacggcaaacgcgttatccagttatcccggaaaaccttcgacacggagtaccagaagaccaaaaacaacgactgggactacgttgtgaccacggacatctccgagatgggggcgaacttccgcgccgatcgggtgatcgatccacgccggtgtctaaagcccgtgatccttaaggacggccccgagcgcgtgatccttgccgggcccatgccggtcacggtggcgtccgccgcgcagcggcgcggccgcatcggacgcaaccacaacaaggagggggaccagtacatctatatgggccaaccgctgaataatgacgaggaccacgcccattggacggaagcaaaaatgctcttagacaatatcaacaccccggagggcattatccccgcgctgtttgagccggagcgcgagaagtctgcagcggtcgacggcgagtatcggctccgcggggaggctcggaagaccttcgtggagctgatgcgccgaggcgaccttcccgtgtggttatcatacaaggtcgcctccgagggatttcaatactcagaccggcggtggtgcttcgacggggagaggaataaccaggttctggaggagaacatggacgtggagatctggacgaaggagggcgaggggaaaaagttacggccccgctggctcgacgcgcggacctattccgaccccctggccctgcgcgagttcaaagagttcgcggcgggccggcgctccgtctcaggcgacctcatcctggagatcgggaagctgccgcagcacttgacacagcgtgctcaaaacgccctggacaacctagtaatgttacacaacagcgaacagggcgggcgcgcgtaccgccacgcgatggaggagctgccagacacaatcgagacgctcatgctcctagccttgatcgctgtcctcaccggcggggtcacgctatttttcctgagtggccgtggcctggggaagaccagcataggcctactgtgtgtgatggcttccagcgtgctcctgtggatggcgtccgtggagccccactggatcgccgccagcattatcctggagttcttcctcatggttctgctcatccccgagccggatagacagcgaacgccccaggacaaccaactcgcttacgtggtcatcgggctgctgttcatgatactcacggtggcagccaacgagatgggcctgctggagactacgaagaaggacctcgggatcggccacgtcgccgtcgagaaccaccatcatgcggccatgctagacgtggacctgcaccccgcatccgcgtggaccctatacgccgtggccacgactatcattaccccgatgatgcggcacaccattgagaatactacagccaatatctcattaaccgcgatcgcgaatcaagcggccatcctgatgggcctcgacaaggggtggccaatatccaagatggacatcggcgtacccctgctggccctcggctgctactcccaagtcaaccccttgaccctgacggcggccgtgctcatgctggtggcccactacgccatcatcggcccggggctgcaggccaaggcgaccagagaggcacagaagcgcaccgccgcaggcataatgaagaacccgaccgtagatggcatcgtggccatcgacctagaccccgtagtctacgacgcaaagttcgagaagcagctaggacagatcatgctgctcatcctgtgcacgagccaaatcttactcatgcggaccacctgggccctgtgcgagagcataaccctggccacgggacccctcactactctgtgggaggggtctccggggaagttctggaacaccacgattgctgttagcatggccaacatcttccgaggctcctacctggcgggggcgggcctagccttctctctaatgaagtccctcgggggcgggagacgcggcaccggcgcccagggcgagaccctcggcgagaagtggaagcggcagctcaaccagctgtccaagtcggagtttaacacctataagcgtagcgggatcatggaggttgaccggagcgaggccaaggaaggattaaagcgcggggagactaccaagcatgccgtgtcccggggcaccgccaagctgcgctggttcgtggagcgaaacctggtaaagccggagggtaaggtgatcgacctggggtgcggccgcgggggatggagctattactgcgccgggctcaaaaaggttaccgaggtcaagggctacactaagggcgggcccggacacgaagaacccataccgatggcgacctatgggtggaatttggttaagctccactccggcaaggatgtgttcttcatcccgcccgagaagtgcgatacactcctgtgcgacatcggagaaagctcccccaatcctaccatcgaggagggccggacactgcgcgttctcaagatggtggagccctggctgcggggcaaccagttctgcatcaaaatcctgaacccctatatgcctagcgtggtcgagaccctcgagcagatgcagcgcaagcacgggggcatgttggtgcggaaccccctgtctcgcaacagcactcacgagatgtactgggtttcctgcgggaccggaaatatagtctcggcggtgaacatgacctccaggatgctcctgaatcgctttaccatggcccatcgcaagcccacctacgagcgggacgttgacctaggcaccggcacacgccacgttgcggtggagcccgaggtggccaacctcgacatcatcggccagcggatcgagaatatcaagcacgagcataaaagcacgtggcactacgacgaggacaacccctataagacctgggcctaccacgggtcctacgaggtcaagcccagcggcagcgcgagctccatggtcaatggggttgtgaagctgctgaccaagccctgggacgtgatccccatgtcccccatcgcaatgaccgacactactccgttagcccagcgcgtcttcaaggaaaaggtcgacaccaggactcccaaggccaagcgcgggacggcgcaaatcatggaggtcaccgcgcggtggctgtggggctttctgagccgcaacaaaaagccgaggatctgcacccgtgaggagttcacccggaaggtccgctccaacgctgcaatcggggccgtgttcgtggacgagaaccagtggaacagcgcgaaagaggcagtcgaggacgagcggttctgggacctcgtgcaccgggagagagaactgcacaaacaggggaagtgcgcgacgtgcgtttacaacatgatggggaagcgcgagaagaaactgggtgagttcgggaaggccaagggctctcgagcaatatggtacatgtggctcggcgcacggtttctggagttcgaggcactggggtttatgaatgaggaccattggttctcgcgggagaacagtttatccggcgttgagggggagggcctgcacaaacttgggtacatcctccgcgatatctccaagatcccgggcggcaacatgtacgccgacgacaccgccgggtgggatacccggattaccgaggacgacctgcagaacgaggccaaaatcaccgacatcatggagccagagcacgctctccttgcgaaagccatattcaagttaacgtaccagaataaggtggtgcgggtccagcgccctgccaaaaacggcaccgtgatggacgtgatcagccggcgcgaccaacggggctccggccaagtaggcacctacgggctaaatacgttcacgaacatggaagctcagttaatacgccaaatggagagcgaggagatcttctcacccagcgagctggagacgccgaacctggcggagcgggccttagattggctcgagaaatacggcgtggaacgcctgaagcgtatggcaatctccggggacgactgcgtggtcaagcccattgatgacagatttgcgaccgccctcacagcgctcaacgacatgggcaaggtgcgcaaggacataccccagtgggagcccagcaagggttggaacgactggcagcaggtcccgttctgctcccaccactttcaccagctgatcatgaaggatggccgcgagatcgtagtaccctgccgaaatcaagacgagctggtggggcgggccagggtaagccaaggggccggctggagcctgcgcgaaaccgcctgcctggggaagtcctacgcgcagatgtggcagctcatgtacttccatcgacgcgacctgcggctggccgccaacgccatctgttcagccgttcccgtcgattgggttccaacgtcccgcaccacctggagtatccacgcgcaccaccagtggatgacgaccgaggacatgctgtccgtgtggaaccgggtgtggatagaggagaacccatggatggaggataaaacccacatcagctcgtgggaagacgttccctacctgggcaaacgcgaggaccagtggtgcggcagcctaatcggcctcacggcccgcgccacctgggccaccaatatacaggtcgctataaaccaggtgcggcgcctgattggcaacgagaactacctggattatatgacctccatgaagaggttcaagaacgagagcgaccccgagggggcactctggtaa

SEQ ID NO: 24309 - RNA, 9879 nt, synthetic construct
  misc_feature 1..9879: note = derived and/or modified CDS sequence (opt11) from DENV-1__GQ199797__SS-prME
  source 1..9879: mol_type = other RNA
tcggttacgatgctacttatgttaatgccaacggcactcgcgtttcatctaaccacgcgcggcggggaaccacacatgatagtatcgaaacaagaacgcgggaaaagcctcctatttaagaccagcgcaggagtgaacatgtgcactttaatcgcaatggacctgggagagttctgcgaagacaccatgacgtataaatgcccccgaatcacagaagctgaaccggacgatgtcgactgctggtgcaacgcaacggacacctgggtcacatatggtacctgcagccaaaccggagagcatcgcagagacaagcgctcagtggcactcgcgcctcacgtcggactgggactcgagacacgaacggaaacttggatgtcaagcgaaggcgcgtggaaacagatacaacgcgttgaaacatgggcattgagacaccccggcttcacagtaatcgccttgttcctcgcgcacgcgataggaacatctattacccagaaaggaataatattcatcctcctaatgctcgttacaccgtcgatggccatgcgctgtgttgggatcggctctcgcgatttcgtagagggcctgagtggcgcaacgtgggtggatgtggtcctcgaacatggcagctgtgtgaccaccatggccaaagataaaccaacactcgacatcgaattactaaaaacagaggtgacgaaccccgccgtactaagaaagctgtgtatagaagcaaaaatatccaataccacaacagactcccgatgtcctacccaaggagaggccaccctagtagaggaacaagacgccaactttgtctgtagaagaactttcgtggacaggggctggggaaacggatgtggattgtttggaaaaggctccctgataacatgcgctaagttcaaatgcgtcacaaagctcgaaggcaaaacagtccaatacgagaacctaaaatatagcgtgatcgtgacagtccacacgggagaccaacaccaggtaggcaacgaaagtaccgagcacggaacgaccgccaccataacaccccaagcgccatcaacggaaatccaactcactgactatggagcccttactttagactgctcaccacgcacgggcctagactttaacgagatggtactcctaaccatgaaggaaaagagctggctcgtgcacaagcaatggttcctcgatctaccacttccatggacatcgggtgcctcaacgagccaagaaacatggaacagaaaagaccttctcgtcacgttcaagactgctcacgcaaagaaacaagaggtcgtagtactaggatcccaagaaggagccatgcacacggcattaacaggcgccaccgaaatacaaacatccggaaccacgacaatctttgcgggacacttgaagtgtcgactgaagatggataaactaacactcaaaggcatgagctacgtcatgtgcacgggcagcttcaagctagagaaggaggtcgccgaaacacagcatggaacagttctagtgcaaataaagtacgaaggcacagacgccccatgcaaaattcccttcagcactcaagatgaaaaaggagtgacacaaaacggaaggctaatcaccgcgaaccccatagtaactgacaaagaaaaacccgtgaacatagaagcggagccaccgttcggcgaatcgtacatcgtgataggagcaggcgaaaaggctctcaaactaagctggtttaagaaaggttcctccataggcaagatgttcgaggcaaccgccaggggagcgcggaggatggctatcttgggagatacagcatgggacttcggctcgataggaggcgtcttcacctccgtgggcaagctagtacaccagatattcgggacggcgtacggcgttctcttctccggggtgtcttggacaatgaagataggaatcggtgtcctgctcacatggctgggattaaatagtcgctcaactagccttagtatgacttgcatagctgtgggattggtaacgctctacctgggagtcatggtacaggcagacagcggctgcgtaataaactggaaaggccgcgaactgaaatgcggaagcggaatatttgtgacaaacgaagtccacacttggaccgaacaatacaaattccaggccgacagccctaaacgcctgtcagcagcgatcggtaaggcgtgggaagaaggcgtgtgtggaatacggtcggccacgagactcgagaacataatgtggaagcaaatatcgaacgagctcaatcacatcctgctagagaacgatatgaagttcaccgttgtcgtaggcgacgtcgccggaatactggctcaggggaaaaagatgatacgcccacagccgatggagtacaagtactcctggaaatcttggggaaaggcgaagatcatcggcgctgacgtgcaaaatacaacctttatcatcgacggccccaataccccggagtgcccagatgatcagcgggcatggaatatttgggaggtagaggattatggattcggaatcttcacaacaaatatctggttaaaactacgtgacagctacacacaagtatgcgaccaccggctcatgtcggcagcaataaaggactcaaaagcagtgcacgcagacatggggtactggatcgaatccgagaaaaacgagacatggaaattagcgcgggcatcgttcatagaagttaagacgtgcatctggccaaaatcacacacactctggtctaacggagtcctagagagtgaaatgatcatacccaaaatatatggaggcccgatctcgcaacacaactatcgccctgggtattttacccaaacagccggaccatggcacctcggtaaactggaactcgacttcgacctgtgcgagggaaccaccgtagtggtagacgagcactgcgggaatagaggaccgtctctcagaacgactacggtaacaggcaaaataatccacgaatggtgctgtagatcatgcaccctgccaccactccggttcaagggagaagatggatgctggtatgggatggaaatccggcccgttaaggaaaaagaagaaaatttagttaaatcaatggtctcagccgggagcggcgaagtcgattcgttcagcctagggctactatgtatatcgataatgatcgaggaggtaatgcgatctagatggtcacggaagatgctcatgactggaaccctagcggtattcttccttctgatcatgggtcagctaacatggaacgacctaataagactgtgcatcatggtcggcgccaatgcaagcgaccgcatgggaatgggaacgacgtacctcgccttaatggccacattcaagatgcgacccatgttcgcggtcggactcctcttccgtagacttacctcgagagaggtattgcttctcaccatcggacttagcctagtcgccagcgtggagctcccaaactcactagaagaacttggggacgggctggcaatggggatcatgatactaaagctgctaacagacttccagtcccatcaattatgggccacattactctcgctaacatttatcaaaacaacgttctcactgcactatgcttggaagaccatggcaatggttttatcaatagtgagcctcttccccctatgcctaagtaccacgtcacagaaaacaacctggttaccagtgctattggggtccctgggttgcaaaccgctgaccatgttcctcatcgccgaaaacaagatctggggtcggaaaagctggcccctcaacgagggcataatggcagtgggcatcgtcagcatactcctctctagcttactgaaaaacgacgtcccactagcagggcccctcatagcgggaggaatgctaatagcatgctacgtaatatccggaagcagcgccgacctcagcctcgaaaaggcggcagaagtcagttgggaagaagaggctgaacactccggcgcctcacacaatatacttgtagaagtccaagatgatgggaccatgaagattaaagacgaggaaagagacgacacgttgacaatactgctcaaagcaaccctgctcgcagttagtggagtgtacccactaagtataccggcaaccctatttgtctggtatttttggcaaaagaaaaagcaacgatcaggggtcctgtgggatacaccctcgcctccagaagtagaacgagcggtcctcgacgacggaatctacagaataatgcagagagggctcctcggtcgcagccaggtgggcgttggcgtgttccaggagaatgttttccataccatgtggcacgtcaccagaggcgccgttctgatgtaccaaggtaagagactagagccttcttgggcgagtgtaaagaaagacctaatctcatacggaggaggatggaggcttcaaggctcgtggaacacaggggaggaagtgcaagtgatagccgtcgaaccgggtaagaatcccaaaaacgtgcaaacagcaccaggaacgttcaagaccagtgagggggaagtgggggcgattgccctagacttcaagccagggactagcggatccccaatcgtaaatagggagggaaagatagtcggactctacggcaacggtgtggtcaccacatccgggacttacgtgtctgcaatagcacaagccaaagccagccaagaaggtccgttacccgaaatcgaagacgaggtattccgaaaacgaaatctgacaataatggatttgcaccccggctcgggcaagacgagacgctatctccctgccattgttcgcgaagcaatcaaacgcaagctccgcacattgatactagcgcccacccgcgttgtagcaagcgagatggcggaagctctaaaaggcatgcccatacggtaccagacgactgccgtgaaatccgaacacacaggcaaagagatagtcgatctgatgtgtcatgccacgtttacgatgcggcttctgtccccagtgagagtcccaaactacaacatgataatcatggacgaagcccacttcaccgaccctagttcaatagcggcacgaggctacatatcaacccgagtaggaatgggagaggccgcagccatcttcatgacagcaacaccaccagggtccgttgaggcatttccccaatcaaacgctgtcatacaagacgaggagcgagacataccggaaagaagctggaacagtggctatgaatggatcacggacttccccgggaaaacggtatggttcgtcccgagtatcaaaagcgggaacgacatagcaaactgccttaggaaaaacggtaaaagagtaatccagctgagcagaaaaacattcgacacagaataccagaaaacaaagaacaatgactgggactatgtagtcacaacggatatatccgaaatgggtgccaatttccgggcggacagagttatagacccaagaagatgcctcaagccagtcatattgaaggacggccctgaaagggtcatactggccgggccaatgcccgtgacagtggccagcgcagcacaaagaaggggtcgcatcggacgcaaccacaacaaagaaggcgaccaatacatttatatggggcaaccactcaacaacgatgaagaccacgcccattggaccgaagccaaaatgctcctggacaacatcaatacaccagagggaatcataccggcgctgttcgaaccagaacgtgagaaaagcgctgccatagatggcgaatacaggctgagaggcgaagccaggaaaacattcgtcgaactcatgaggcggggagatcttccagtgtggctctcctataaagtagccagcgaaggcttccagtactcagatcgcagatggtgttttgacggggagcgtaacaaccaagtcctcgaagagaacatggacgtcgaaatctggaccaaggagggagagcgcaagaaactaagaccccgttggctggatgcaagaacgtactcggaccccctcgctctgcgtgagttcaaggagttcgcagccggcaggcgatcagttagcggagaccttatcttggaaatcggcaagctgccacagcacttaacccagagagcacagaatgccctagacaacctcgtcatgctacataactccgaacaagggggccgagcctaccgacatgcaatggaagaacttccagatacaattgagacgatgatgctactggccctaatagcggtactcacaggaggggtcaccctcttcttcctctcagggagagggttgggaaaaacaagcatcggcttactatgcgtcatggcctcgtccgtccttctctggatggccagcgtggaaccacactggatcgcagcgagcattatcctggagttcttcctcatggtcttactgatacccgaaccggataggcagcggacaccccaggacaatcagctcgcttatgtggtcatcggtttactctttatgatcctgactgtggccgcaaacgaaatgggtctactcgagacaaccaagaaagatctaggcatcggccacgtcgccgtggaaaaccaccaccacgccgctatgcttgatgtggacctccatccggctagcgcgtggacactctatgcagtcgcaacgactatcataaccccaatgatgaggcatactatcgaaaacaccactgctaatatctcgttaacagccatagccaaccaagcagcaatcttgatgggccttgacaaagggtggccaatatcaaagatggacataggtgtccccctcttagccctagggtgctacagccaagtcaaccccttaacgcttactgcagcagtcctcatgctggtagcacactatgctattatcggacccggtctgcaggccaaggcaacccgcgaagctcaaaagcgcacagcggccggtataatgaaaaacccgacggtggatggtatagtggccatagacctagatccggtagtgtacgacgccaaattcgagaaacagctaggacaaataatgctcctaatcctttgcacaagccaaatattactgatgcgaaccacatgggccttgtgcgagtccatcaccttagcaaccggcccacttacgacattatgggaagggagccccgggaaattctggaataccacaatagcagtaagtatggcaaatatcttcagagggagctacctagccggagcaggactggcgttttctctgatgaagtcacttggcggcggtcggcgtgggaccggggcgcagggagagacgctcggggaaaaatggaaacgtcaactcaatcagctatccaaaagcgagtttaacacctataagcgcagcggcatcatggaagtagacaggagtgaagcgaaggaaggactaaaaaggggagaaacgactaagcatgccgtatcgcgagggacagcgaaattacgctggttcgtggaacgaaacttagtaaagccagagggaaaggtcatcgatctgggatgcggacgagggggatggtcttactactgcgccggcctgaagaaggtcacggaagtgaaaggatacacgaagggcggcccggggcacgaagaaccgatcccaatggcaacttacggttggaacttagtaaagctccactcgggtaaggatgtatttttcattccacccgaaaagtgtgatacactcttgtgtgacatcggggaatcaagcccgaacccaacgatcgaagaggggaggacactacgagtactaaagatggtggaaccatggctaagagggaaccagttctgcataaagatactcaatccatatatgccgagtgtggtggaaaccctagagcaaatgcagcgtaaacacgggggcatgttagtcagaaaccctctaagtcggaactcaacacacgaaatgtactgggtgtcttgcggcaccggaaatatagtcagtgcagtcaacatgacaagccgaatgctattgaatcgcttcactatggctcacagaaaacctacatacgagcgagacgtggaccttggcgccggtacacggcacgtggcagtagagcccgaggtcgccaacctggacattattggacagcgaatagaaaacataaagcacgaacataagagtacgtggcattatgatgaagataacccgtataaaacttgggcgtatcacggctcctatgaagtaaaaccgagcgggtctgcaagctcgatggtcaacggagtagtgaaacttcttacgaagccttgggatgtcataccaatggtgacacagatagccatgacagatactacgccattcgggcagcagcgggttttcaaagagaaagttgacacacgcacgccaaaggcgaagcgaggcacggcccaaattatggaagtgacggccaaatggctctggggattcctcagcagaaataagaagcctcggatctgtacacgagaagagttcacaagaaaagttcgctctaacgccgcgatcggtgcagtattcgtcgacgaaaatcaatggaacagcgcaaaagaagcggtcgaagatgaaagattctgggacctcgtacacagggagcgggaactacacaaacagggaaaatgcgcgacgtgtgtgtataatatgatgggaaagcgcgagaagaagctaggagagttcggaaaagcgaaaggatcccgagcaatatggtacatgtggctgggagcacgcttccttgagtttgaggccctgggctttatgaacgaagatcactggttctcgcgggaaaactcactttcgggtgtggaaggggagggacttcacaagttaggctatatactacgagacataagtaagataccgggcggaaacatgtacgcagatgacaccgcgggatgggatacacgcatcacagaagatgacctacagaacgaagcgaaaataacagacatcatggaaccggagcacgcattactagctaaatcaattttcaaacttacgtatcagaacaaggtggtcagggtccagaggccagccaagaacggcacagtaatggacgtgataagccgtagagaccaaaggggcagcggtcaggtcggaacctacggcctcaacacatttacgaacatggaggcccaactcatccgacaaatggagtccgaggggatcttctcaccatccgaactcgagacacccaacctagcccgaagggtgctcgactggctcgagaagcacggagtggaacgcctcaaacgcatggccatcagcggcgacgactgcgtcgttaaaccaatcgatgaccggtttgccacagcattgaccgcactcaacgacatggggaaggtgagaaaggatatcccacagtgggaaccctcaaaaggatggaacgattggcaacaagtgcccttctgtagccatcacttccaccaacttatcatgaaagatgggcgggaaatcgtcgtgccgtgccgcaatcaagacgagctggtaggacgcgcaagagtgtcacaaggcgctggctggtccctgcgtgaaaccgcctgccttggtaaatcatacgctcaaatgtggcaacttatgtatttccacaggcgtgacttaagactagcagcgaacgctatttgtagtgccgtcccagtagactgggtaccaacaagcagaacaacttggtccatccacgcgcaccaccaatggatgacgacagaagacatgctaagtgtctggaatagggtctggatcgaggagaatccctggatggaagacaaaacccatatttcctcgtggggagacgttccgtacctcggcaaaagggaagaccaatggtgcggaagcctgattgggctaacggcacgggcaacctgggcaacaaacatacaggtcgcgattaaccaggttagacgactaatcggcaacgaaaattacctcgactatatgacaagcatgaaaaggttcaagaacgaaagcgaccccgaaggggcattgtggtaa

SEQ ID NO: 24310 - RNA, 9879 nt, synthetic construct
  misc_feature 1..9879: note = derived and/or modified CDS sequence (opt11) from DENV-1__GQ199799__SS-prME
  source 1..9879: mol_type = other RNA
tcggtgaccatgctgctgatgctgatgccgaccgccctggctttccacctgacaacacggggcggggaaccccacatgatcgtgtcaaaacaggaacggggcaagagcctactcttcaagacatcagccggggtgaacatgtgtaccctcatcgcaatggacctcggcgaattttgcgaggataccatgacctacaagtgcccgcggattacggaggccgaacccgatgacgtggactgctggtgcaatgcgaccgacacgtgggttacctacggaacttgtagccagacaggtgagcaccgccgggacaagcgatcagtggccctggcgccacacgtcggcctcggactagagacgcgcactgagacctggatgtctagtgagggggcctggaagcagatccagagggtcgaaacctgggctctgcggcaccctggcttcacggtgatcgccctcttcctggcgcatgccatcggaaccagtatcactcagaagggtatcattttcatattgctcatgctggtgacgccctccatggccatgagatgcgttggcattggctctcgcgacttcgtggagggtctatcaggcgccacgtgggtggacgtagtcctcgagcacgggagctgcgtgaccacgatggcaaaagacaagcccaccttagatatcgagttgctcaagacggaggtcaccaaccccgcggtgctacggaaactgtgcatcgaagccaaaatctctaacacgacaacggactcacgctgcccaacgcagggcgaggctacactcgtagaggagcaagacgccaattttgtctgccggcgtaccttcgtggacagaggctgggggaacggctgcgggctgttcggcaaggggtctctgatcacgtgcgccaagttcaagtgcgtgaccaagttagaaggaaagatcgtccagtacgagaacttgaagtactctgtgatcgtgaccgtccacaccggcgaccagcaccaagtggggaacgagtccacggaacatggcactactgcgacgatcactccccaggctccctcaacggagatccagctaactgactatggggccttaaccctagattgcagcccgcggacgggcttggacttcaacgagatggtactcttaacaatgaaggaaaagtcctggctggtgcacaaacaatggtttctcgacctgcctctgccgtggaccagcggggcgagcaccagccaagaaacctggaaccggcaggacctcctggtgacgtttaagaccgcgcacgcgaagaaacaggaggtcgtcgtgctgggcagccaggagggagccatgcacaccgccttgaccggggccacggagatccaaaccagcggcacaacgacgatcttcgccggacatttaaagtgtcgccttaagatggacaagctcactctgaagggcatgtcctatgtcatgtgtacagggagcttcaaattagagaaggaggtggcggagacccagcatggtaccgtgctcgtccagatcaagtacgagggcaccgacgccccgtgcaagatcccattctccacgcaggatgagaagggggtaacacagaacggccggctgataaccgccaaccccatcgtaactgacaaagaaaagcccgtcaacatcgaggcagagccccctttcggggagtcctatatcgtcatcggcgcgggcgagaaggccctgaaactttcgtggttcaagaaggggagctccataggcaaaatgttcgaggcgaccgcccgcggggctcggcgaatggcgatcctcggggacacggcctgggacttcggaagcatcggaggcgtgttcacgtccgtcgggaagctggtgcaccagattttcggcactgcctacggggtactcttcagcggcgttagctggaccatgaagattgggattggcgtactcctgacctggctgggcctcaacagccgctccacgagcctatccatgacctgcattgctgtagggttagtcaccctctatctgggcgtgatggtgcaggccgacagcggttgcgtcatcaattggaaggggagggagctgaaatgcggttcaggtatattcgtaaccaacgaggtgcacacgtggaccgaacaatacaagtttcaggcggactccccaaagcgcctcagcgccgcaatcggcaaggcctgggaggagggggtctgtggcatccggtccgcaacccggctggagaacatcatgtggaagcagatcagcaacgaactaaaccacatcctcctggaaaacgatatgaagttaaccgtggtcgtcggggacgtggcgggcatcctcgctcaggggaagaagatgatccggccccaacccatggagtataagtactcctggaagtcttggggcaaagcaaagataatcggcgccgacgtgcagaacaccactttcatcatcgacggaccgaataccccggagtgccctgacgatcaacgtgcctggaacatatgggaggtcgaggattacggtttcgggatctttaccaccaacatctggctgaagctgcgggacagttacacccaggtatgtgaccaccgactcatgagcgccgccatcaaggatagtaaagcagttcatgccgacatgggctattggattgagagcgaaaagaacgagacctggaagttggcgcgggcttccttcatcgaggtcaaaacctgcatctggcccaagagccacaccctgtggtccaacggcgtgttggagagcgagatgatcatccccaagatctacgggggaccgatctctcaacacaattatcgacccgggtattttacgcagaccgccggtccctggcacctggggaagctggaactcgacttcgatctttgcgaaggcacgacagtggtcgttgacgaacactgcggcaaccgtggtccgagcttacgcacgaccaccgtgaccgggaagattattcatgagtggtgttgccggtcctgcacgctgccgcctctccgattcaagggcgaggacggctgctggtacgggatggagatccgcccggtgaaggagaaagaagaaaacctggtcaaaagcatggtgagcgcagggtccggcgaggttgactctttctccctcgggctgctgtgcatcagcatcatgattgaggaggtgatgagatctcggtggagccgcaagatgcttatgaccggcaccttggctgtgttctttctgctcattatgggacaactgacctggaatgacctgatccggctatgtatcatggtcggtgcgaacgcctctgaccgcatggggatgggcacgacctacctggcgctgatggccacgttcaagatgcgaccgatgttcgctgtggggcttttgttcagacggctgaccagccgggaggtcctcctactgacgatcgggctctccctggtagcgtccgtcgagctgcccaactccctcgaagagttaggggacggcctggcaatgggcataatgatcctcaaactgttgaccgactttcagccccatcaactctgggcgaccctgctgagcctcaccttcatacgaacgactttctccctgcactacgcatggaagactatggcgatggtcttgtccatagtgtctctcttcccgctatgcttaagcaccacatctcagaagacgacctggctcccggtcctgcttggtagcctagggtgtaaacccctgaccatgttcctgatcgccgaaaacaagatttggggccgtaagtcctggcccctcaacgagggcattatggctgtcggcatcgtgagcatcctcctgtcctccctcctgaagaacgatgtccccctggccgggccgctaatcgccggcggaatgctgatagcatgctacgtgataagcggctccagcgcagatctgtcccttgaaaaggccgccgaagtgtcctgggaggaagaggccgagcactccggagcgagccacaacatcctggtcgaggtccaagacgacgggacgatgaagatcaaagacgaggagcgcgacgacaccttgaccatccttctgaaggccacgctgctcgccgtgtccggcgtgtacccgctgtccatccccgctacgctgttcgtatggtacttctggcagaaaaagaaacagcgatccggggtgctttgggatactccctcgccgcccgaggttgagcgtgccgttctggatgatggcatctaccgtatcatgcagcggggcctgctgggccggtcccaggtgggcgtgggtgtcttccaggagaacgtgttccacaccatgtggcacgtgacccggggtgcggtcttgatgtaccaggggaagaggctggagcccagttgggcctccgtgaagaaagatctaatctcgtatggcggcgggtggcgccttcaaggctcctggaacaccggagaggaggtacaggtcatcgccgtggagcctggcaaaaacccgaaaaacgtgcagacggcgcctgggacgttcaagaccagcgagggcgaagttggagccatagcactggactttaaaccggggacctcgggtagccctatcgtgaaccgggagggtaagatcgtggggctgtacggaaacggagttgtgacgacctccggcacttacgtgtccgccatcgcccaggccaaggcgagccaggaggggccgctccccgaaatcgaggacgaggtctttcgcaagcggaacctcaccatcatggacctgcaccccggctccggtaagacgaggcggtatcttccggcaatcgtgcgcgaggccataaaacggaggctccggaccctgatcctcgcccccactcgcgtcgtcgccagcgagatggcggaggccctgaagggtatgcccattaggtatcagacaacggccgtgaagtccgagcacaccggcaaggaaatcgtagacctgatgtgccatgccaccttcaccatgcggctacttagccccgtccgcgtgccgaattacaatatgatcatcatggatgaggcacacttcacggatccctcttctatcgcggcgcgggggtacatctccacccgggtaggcatgggggaggcagccgccatcttcatgaccgcgacgccgcccggcagcgtcgaggccttcccacagtccaacgcggtgatccaggacgaagaacgggatatccccgagcgcagctggaactccgggtacgagtggattaccgacttccccggaaagaccgtgtggtttgttcccagcatcaagtccggcaacgacatcgcaaactgccttcggaagaacggtaagcgcgtgattcagctcagcagaaaaaccttcgacacagagtaccagaaaaccaaaaataacgattgggactatgtggttacaactgacatatccgagatgggcgcgaacttccgagccgaccgggttattgacccgcgccggtgcctgaagccggtgatactgaaggacgggcccgagcgcgttatcctcgccggccccatgccggtgaccgtcgccagcgcggcgcagcggcgcggacggattggccggaatcacaacaaggagggcgaccagtatatctatatgggtcagcccctcaacaatgatgaggaccatgcgcactggacggaggcgaagatgcttctcgacaacattaacaccccggagggcatcatccccgctttattcgagcctgaaagagagaaaagtgcggcgatcgacggggagtaccgtttgcgcggcgaggcccggaagaccttcgtggagctcatgcgccgcggggatctgcctgtgtggctaagctacaaagtcgcatctgagggcttccagtactccgaccgccgatggtgcttcgacggcgagcgcaacaaccaagtccttgaggaaaacatggacgttgagatttggaccaaggagggcgagagaaagaagctgcgaccccggtggctggacgccaggacctactctgatcccctcgccctgcgggagttcaaggagtttgcggccggccgccgttcggtaagcggtgacctgatcctcgagatcggcaagctcccgcagcacctgacccaacgcgcccagaacgccctcgacaacctagtgatgctgcacaattccgagcagggcgggcgggcgtatcggcacgccatggaggagctccccgacaccatagagaccctgatgctgttggccttgatcgccgtattaacgggtggtgtgacccttttcttcctgagcggccgggggctgggcaagacctccatcggactcctctgcgtaatggctagctctgtcttgctctggatggctagtgttgagccccactggattgcggccagcatcatcctcgagttcttcctgatggtgctcctgatccccgagccagaccgccagagaacgccccaggacaaccagctcgcttatgtggtcataggtctgctgttcatgatcctgacggtggcggcgaacgaaatgggcttactggagacgacaaagaaggaccttgggatcggccacgtggccgtcgagaaccaccaccatgccgcaatgctcgacgtagacctgcaccctgcgagcgcgtggaccctttacgccgtggcgaccacgattatcacaccgatgatgagacataccatagagaacaccacggccaacatctccctcactgccatcgcgaaccaagccgccatcttaatgggtctggacaaggggtggcccatttctaagatggacatcggcgtacccctcctagccctggggtgctactctcaagtgaacccgctcaccctgacggcggcagtcttaatgctcgtcgcccactatgccatcataggtcccgggttgcaagcgaaagcgacgcgcgaggcccagaagcggacggcagccggaatcatgaagaaccccactgtggatgggatcgtggcgatcgacctggaccccgtcgtgtacgacgcgaaattcgagaagcagctcggccagatcatgctactgatattgtgcactagccaaatcctactgatgcgcacgacttgggccctttgcgagtccattaccctcgccaccggccccttaacgaccctctgggaggggagcccgggcaagttctggaacaccaccatcgccgtgtctatggcgaacatttttcgggggtcgtatctggcgggagccggcctggccttcagcctcatgaagtccttgggcggagggcgccgggggacgggggcgcagggcgagaccctgggcgaaaaatggaagcgccagctcaaccagttaagcaagtccgagtttaacacctataaacggtctggtatcatggaggtcgaccgctccgaggcgaaggagggattaaaacgcggcgagaccacgaagcacgcggtttcccgcggcacagccaaactccggtggtttgtggagcgcaacctggttaagccggaggggaaagttatagacctggggtgcggccgcggcgggtggagctactactgcgccgggctgaagaaagtcaccgaggtcaaagggtacacgaagggcgggcccggacatgaggagcccatcccgatggcaacgtacgggtggaacctcgtaaagctgcacagtggcaaggacgtatttttcatcccgcccgaaaaatgcgataccctcctatgcgatatcggggagtccagccccaacccgacaatcgaggagggccgtacccttcgggtcctgaagatggtggagccctggctacgcgggaaccagttctgcatcaagatcctgaatccttatatgccctccgtggtcgagaccctggagcaaatgcagcggaagcacggtggcatgctagtgcgtaatccgttgagccggaactccacccacgagatgtattgggtaagctgcggtaccggtaacatcgtctccgcggtgaacatgactagccgcatgctgctcaaccggttcaccatggcccaccggaagccaacctacgaacgcgatgtggacctgggggccgggacccggcacgtcgcagttgagccggaggtggccaacctagacatcatcggccagagaatcgaaaacatcaagcatgaacataaatccacctggcattacgacgaggacaacccctacaagacctgggcgtaccacgggtcttatgaggtgaagccgagcggcagcgccagctccatggtgaacggggtcgtgaagctcctgacgaagccatgggacgtaatccccatggtgacccagatcgcgatgaccgatacgacgccgttcggccaacagcgggtcttcaaggagaaggtggacacgcgcacaccgaaggccaagagagggaccgcccagataatggaggtcaccgcgaagtggctctggggcttcctctcacgcaacaagaaacccagaatctgcacccgcgaggagttcacacggaaagtgcgctccaacgccgcgataggcgccgtgttcgtcgacgagaaccagtggaacagcgcgaaggaggccgtggaagacgaacggttctgggacctggttcaccgcgagcgggagctgcacaagcaaggaaaatgcgcaacctgcgtctataatatgatgggcaaacgcgagaagaaactcggggagttcggcaaagccaaggggtctcgggccatctggtacatgtggttaggcgcccggtttctcgagttcgaggcgctcggcttcatgaacgaggaccactggttcagccgggaaaatagccttagcggggtcgagggggagggcctgcacaagctcggctatatcctgagggacatatcaaagatcccagggggcaacatgtacgccgacgacactgccggctgggacacacggatcaccgaggacgacctacagaatgaggcaaagattacggacatcatggaaccagagcacgctctcttggccaagagcatcttcaagctgacctaccagaacaaggtggttcgcgtgcagcgccctgccaagaacgggaccgtgatggacgtcatttcccggcgtgatcagagaggtagcggccaagtaggcacctacggcctcaacactttcacgaacatggaagcgcagctcatccgtcaaatggaaagtgagggcatcttctcaccctcggaactcgagactcccaatcttgcagggcgcgttctagactggctggagaaacatggtgtcgaacgcctcaaacggatggctataagtggtgatgactgcgtagtgaaaccgatcgacgatcgctttgcgaccgctcttactgccctgaacgacatgggcaaggtccggaaggacatcccccaatgggagccctcgaagggatggaacgattggcaacaggtccccttctgtagccaccatttccaccagctcatcatgaaggacggccgcgagatagtggttccgtgccgtaaccaggacgagctggtcgggcgcgcacgggtgagtcagggcgcggggtggtccctgcgtgaaacggcatgtctcggcaagagctatgcccagatgtggcagctgatgtattttcacagacgcgacttacggctcgccgcaaacgccatatgctccgccgtccccgtggactgggtgcctaccagccgcaccacctggtccatccacgcccaccaccagtggatgacgaccgaggacatgctgagcgtttggaaccgagtgtggattgaggagaacccctggatggaggacaagacccacgtatcttcttggggcgacgttccatacctgggtaagcgcgaggatcagtggtgtggctcgctcatcggtctgaccgcgcgcgcgacctgggctaccaacatccaggtggccatcaaccaagtgcggcgcctgctcgggaacgaaaactacttggactacatgaccagcatgaagcggttcaagaacgagtccgatccggagggggccctatggtga

SEQ ID NO: 24311 - RNA, 9879 nt, synthetic construct
  misc_feature 1..9879: note = derived and/or modified CDS sequence (opt11) from DENV-1__GQ199800__SS-prME
  source 1..9879: mol_type = other RNA
tcagtaaccatgctgttaatgctgatgcccaccgccttagccttccacttgacgaccagaggtggggagccccacatgatcgtgtccaagcaggagcggggcaagagcctgctgttcaagacctccgccggtgtgaacatgtgcacccttatcgccatggacttaggcgagttctgcgaggacaccatgacctacaagtgcccgcgcattaccgaggccgaaccagacgatgtcgactgctggtgcaacgccaccgacacatgggtcacctacgggacctgtagccagaccggtgagcacagacgggacaaacggtcggtggctctggcgccccacgtgggcctggggcttgagacacgcacggagacctggatgtcatccgagggcgcctggaaacaaatccaacgtgtcgagacgtgggcactgcgccaccccgggttcacagtgatcgcccttttcctggcccacgctatcggcacttccatcacccaaaaagggatcatcttcattcttctcatgctggtcaccccctctatggccatgcgctgcgtcggcatcggcagccgcgatttcgtcgagggtctatccggcgcgacgtgggtagacgtcgtgctcgaacacgggagctgcgttaccacgatggccaaggacaaaccgactcttgacatagagctgctaaagaccgaggtcaccaaccccgcggttctgaggaagctgtgcatcgaggccaagatctctaacaccaccacggattcccgctgcccgacacagggcgaggccacgttggtggaggagcaagacgccaacttcgtctgtcggcgaacgttcgtggaccggggctgggggaacggctgcgggctgttcgggaagggttccctcattacctgcgccaagttcaagtgcgtgaccaagctcgagggcaaaatcgttcagtacgagaacctgaagtactctgtgatcgtgaccgtccacaccggggaccagcatcaggtggggaatgagtccacggagcacggaacgaccgcaaccatcacgccccaggcccccagcacagaaatccaattaaccgactacggggccctcacactggactgcagcccccggaccggcctggacttcaacgaaatggttctcctgacgatgaaggagaagtcctggctggtccataagcagtggttcctcgatctgccgctgccatggaccagcggggcttcaaccagccaggagacctggaaccggcaggacttgcttgtgacgttcaagaccgcccacgcgaaaaagcaggaagtcgtggttctgggctcccaggagggggccatgcacaccgccctcaccggagccacggaaatccagaccagcggcaccacgacgatctttgccggacacctaaagtgccgccttaagatggacaagctcaccctgaaaggcatgagttacgtcatgtgcacagggtcgttcaagctggagaaggaggtggcagaaactcaacacggcaccgtgctcgtccagatcaagtacgagggcaccgacgcaccatgcaagataccatttctgacccaagacgagaagggggtgacccagaacggccggctgattacggcaaacccgatcgtcaccgacaaggagaagcccgttaacatcgaggctgaaccacccttcggggagagttacatcgtgatcggcgcgggcgaaaaggccctcaagctctcatggttcaagaaagggtccagcatcggcaagatgttcgaagcaaccgcgaggggggcgcggaggatggcaattctaggcgacaccgcttgggactttgggtccatcggcggggtgttcacgagcgtcggcaaactggttcaccagatttttggcaccgcgtacggggtgctgttctccggagtctcttggaccatgaaaatcgggattggcgtgctgctgacgtggttaggcctgaacagccgcagcacgtccctgagcatgacctgcatcgcggtggggctcgtcaccctgtatctgggtgtgatggtgcaggccgactccgggtgcgttatcaactggaagggccgggagcttaagtgcgggagcggtatcttcgtgaccaatgaggtccacacctggaccgagcagtacaaattccaggcggactcaccaaagaggctatccgccgctatcggcaaggcctgggaggagggggtctgtggcatacgatcagcgacccgcctggagaacatcatgtggaaacagatttccaacgagctaaatcacatcctgctagagaacgacatgaaattcaccgtggttgtcggcgacgtggcgggaatcttagcccaggggaagaaaatgatccggccccagcccatggagtataaatactcatggaagtcctggggcaaggccaagattatcggcgctgatgtgcagaacaccacgttcataatcgacgggcctaatacccctgagtgtcccgacgaccagcgggcgtggaacatctgggaggtcgaggactacggcttcgggatcttcaccacgaacatttggttgaagctgcgggacagctatacccaggtctgcgaccacaggctcatgtccgccgccatcaaggacagcaaggccgtccacgcggacatgggctactggatcgaatccgagaagaacgagacctggaagctggcgcgggcgagcttcatcgaggtcaagacctgcatttggccaaagtcccataccctgtggagcaacggcgtactcgagtccgagatgatcatccccaagatttacggcggcccgataagtcagcacaactaccgcccggggtacttcacgcagacggccggcccctggcacctgggaaagctggagttagacttcgacttatgcgagggcaccaccgtggtcgtggacgagcactgcggcaaccgcggcccgtctctgcgcacgaccaccgtgactggcaagatcatacacgagtggtgctgccgcagctgcacgctgccgcccctccgctttaagggggaggacggctgctggtacgggatggaaatccggcccgtgaaggagaaggaggagaatttggtgaagtccatggtgagtgcaggcagcggcgaagtcgactccttcagccttgggctgttatgcatcagcatcatgatcgaggaggtaatgcgctctcgatggtcccgaaaaatgctcatgaccggcaccctggctgttttcttcctactcatcatggggcagttaacctggaacgatctgattcggttatgtatcatggtcggagccaatgccagcgaccgtatgggaatgggcacgacgtacctggccctgatggccactttcaagatgcgcccaatgttcgccgtcgggctcctcttccggcgcctgacgagtcgggaggtgctcttactgacaatcgggctaagcctggtcgcgagcgtagagcttcccaacagcctcgaagagctaggcgatgggctagccatgggcatcatgatcctcaagctgctgaccgacttccaatctcaccagctctgggccaccctgctgagcttaacgtttatcaagacgacattctccctacactacgcctggaagaccatggcgatggttctgagcatagtgtccctattccctttatgcctcagcaccacgtctcaaaaaaccacctggctccccgtgctcctgggctctctcgggtgtaagccgttgaccatgttcctaatcgccgagaacaaaatctggggccggaagtcctggccactcaatgaggggatcatggccgtcggaatcgtgagtatcctgctgagctccctcctgaagaacgacgtgcctctggccggccctctcattgccggcggcatgttaatcgcgtgctatgtcatcagcgggtcaagcgccgacctgagtctagagaaggctgcggaagtgagctgggaggaggaggccgagcactccggtgcttcgcacaatatcctggtggaggtccaagacgatggtacgatgaagataaaggacgaggagcgggacgacactctgaccatcctcctgaaggccacgctgctcgccgtgtcaggcgtgtacccgctgtcgatccccgccacgctgttcgtctggtacttctggcagaaaaagaagcagcgctccggggtgctctgggatactccatctccgcctgaggtagagcgggccgtattggacgatggtatctacaggatcatgcagcggggcctgttggggcgctcccaggtgggcgtgggggtcttccaggaaaacgttttccacactatgtggcatgtgactagaggcgcagttctcatgtaccaggggaagcgcttagaaccctcctgggcgtccgtgaagaaggacctgatcagctatgggggggggtggcggctccagggctcctggaatacgggggaggaggtgcaggtcatcgctgtggagcctggcaagaatcccaagaacgtgcagacggcccccgggaccttcaagacctccgagggagaggttggcgccatcgcgctggacttcaagcctgggacctccggcagccccatcgtaaaccgcgaggggaaaatagtgggcctatacggcaatggggtcgtgacgacatctggcacatacgtgtccgccattgcgcaagccaaggcgagccaggaggggccgctcccggagatcgaggacgaggtgttccggaaacgcaacctgaccatcatggatcttcaccccggctccggaaagacacggcgatatctccccgccatcgtgagagaggcaatcaaacgcaagctgcgaaccctgatccttgccccgacccgcgtggtcgccagcgagatggctgaggctctaaagggcatgcctatccgctaccagaccacggccgtcaagtccgagcacactggcaaggagatcgtggatctgatgtgccacgccacgttcaccatgcgcctcctgagccccgtccgcgtgcccaactacaatatgatcattatggacgaggcccatttcacggacccgtccagcatcgcggcccgggggtacatctccacccgggtgggcatgggggaggctgcagcgatcttcatgaccgcgacgccacccggcagcgtcgaggcattcccccagtccaacgcggtgatccaggacgaggaaagggacatcccggagcgcagctggaactccggatacgaatggattactgatttccccggtaagaccgtgtggttcgttcccagcatcaagtccggcaacgacatcgccaactgcttacggaagaacggcaagcgcgtgatccagctctcacgcaagaccttcgacaccgagtaccagaagacgaagaacaacgactgggactacgtggtcaccacggatatatccgagatgggggcgaactttagagccgaccgggtgatcgacccccgccggtgtctgaagccggttatcctgaaggacggccccgagcgcgtaatcctcgccggcccaatgcccgtgactgtcgccagcgccgcacagcggcgcgggcggatcggtcgcaaccacaataaggagggagatcagtacatttacatggggcagccgctgaacaacgacgaggaccatgcccactggacggaggcaaagatgctgttggacaacatcaacacccccgaggggatcatcccagccctgttcgagcccgagcgcgagaagtccgccgcgattgacggtgaatatcgcctacgcggcgaggctaggaaaaccttcgtagagctgatgcgccgtggggacttaccagtgtggctcagctacaaagttgcaagcgaaggcttccagtactccgaccgccggtggtgcttcgacggcgagcgcaacaaccaggtgctcgaggaaaacatggacgtggagatttggacgaaggagggggagaggaaaaaactgcgcccgcggtggttagacgccaggacctatagcgaccccctcgccctcagggagttcaaggagttcgcggccgggcgcaggtccgtcagcggagacctcatcctcgagatcggcaagctgccccagcacctgacgcagcgcgcccagaacgccttagacaacctggtcatgcttcataactcagagcagggcgggcgagcgtaccgccacgccatggaggaactcccggacaccattgagaccttaatgctgctcgccctgattgccgtgctcacgggcggggtcacccttttctttctgagtggccgcggactgggtaagacctctatagggctactgtgcgtgatggccagctccgtcctgctctggatggcgagcgtcgagccccactggatcgcggcctccatcatcctggagttcttcctgatggtgttgctgatccccgagcccgataggcagaggaccccgcaggacaaccagctcgcctacgtggttatcgggttactgttcatgattctgaccgtggccgcgaacgagatgggcctccttgagacgaccaagaaggatctggggattggtcacgtggcggtggagaatcatcaccatgccgccatgctcgacgtagacctgcaccccgccagcgcgtggactttatacgccgtggccaccacgatcataacccccatgatgcgccacaccatcgagaacaccacggccaacatcagtctcaccgccattgcgaaccaagccgccatactgatgggtctggataaaggctggcctatcagcaagatggacatcggcgtccccctcctggccctagggtgctactcccaggtgaatcccctcaccttaaccgcggccgtgctcatgctcgtcgcccactacgccatcataggcccaggactgcaggccaaggccacgcgggaggcacagaagcgtactgccgccggcatcatgaagaaccctaccgtcgacggcatcgttgcgatcgacctggaccccgttgtgtacgacgctaaattcgagaagcagctcggtcaaatcatgctcctgattctctgcaccagccagattctcctgatgcgcacgacgtgggcgctctgcgagtccatcacgctggcgacaggccccctgacgaccctctgggaaggttccccggggaagttttggaacaccactatcgcagtgagcatggccaacatcttccgggggagttacctggcgggcgccggcctggccttcagcctcatgaagtcactaggcggcgggcgccgcgggacgggcgcccagggagaaaccctgggcgagaagtggaagcgccaactcaaccagctgtcaaagtctgagttcaacacgtacaagcgttctggaatcatggaggtcgaccgctcagaggcgaaagagggcttaaagcgcggagagaccacgaagcacgccgtgagtcgtggcaccgcaaagctccggtggtttgttgagcgtaacctggtcaagcccgagggaaaggtaatcgacctgggctgcgggcgcggggggtggtcctactattgtgcggggttgaagaaggtgactgaggtcaagggatacactaagggcggtcccggtcacgaggagcccattcccatggccacgtacggctggaacctcgtgaaacttcacagcggcaaggacgtgttttttatcccacctgaaaagtgcgacactctgctctgcgacatcggggaaagtagccccaaccccacaatcgaggagggccgcactctgcgggttctcaaaatggtggagccgtggctccgtgggaaccagttctgcatcaagattctgaatccttacatgccctccgtggtcgagacactggaacagatgcagagaaagcatggcggaatgctcgtgagaaaccccctgagcaggaactccacccacgagatgtactgggtgagctgcgggaccggtaacatcgtgtccgcagtaaatatgacaagcaggatgctgctcaaccggttcaccatggcccacaggaaacctacgtacgagcgtgatgtcgacctgggggccggcacgcggcacgtagcggtggagcccgaggtggccaacctggacatcatcgggcagcgcattgagaacatcaagcacgagcataagtccacctggcactacgacgaagacaacccctacaaaacctgggcgtatcacgggagctacgaggtcaagccctccggctcggcaagctctatggtcaacggggtcgtgaagctgctcactaagccgtgggacgtgatcccgatggtgacccagatcgccatgaccgacactactccctttggacagcagcgggtgttcaaggagaaggtcgacacccgcactcctaaggcaaagcggggcaccgcccagatcatggaggtcacggcgaagtggctgtggggattcctttcgcgcaacaagaagccgcggatctgtacacgcgaagagtttaccaggaaagtgcgctccaacgccgcaatcggcgcagtgttcgttgacgaaaaccaatggaatagcgcgaaggaggccgtggaggacgagcggttctgggacctggtgcaccgggagagagagctgcacaagcaggggaagtgcgcgacctgcgtctacaacatgatgggcaagagagagaagaagctgggggagtttggaaaagccaaggggtcccgggccatttggtacatgtggttaggcgcccgcttcctggagttcgaggccctggggttcatgaacgaggatcactggtttagccgggagaactccctgtccggtgtggagggcgagggtctgcacaaactcggctacatactgcgcgatatttccaagatccccgggggcaacatgtacgccgacgacacagccggctgggatacccgtatcaccgaggacgacctgcagaacgaggccaagataaccgatatcatggagcccgagcacgcgctcctggcgaaatcaatcttcaaactgacgtaccagaacaaggtcgtccgcgtgcagcgccctgcaaagaacgggaccgtgatggacgtcatctcccgtcgcgaccagcggggcagcggccaggtgggtacctacggcctaaataccttcacaaacatggaggcacagttaatcagacagatggaatccgaggggattttctccccctccgagctggagacccccaacctcgcgggccgggtcctggactggctggagaagcacggggtggaacgcctcaagcggatggcgatcagcggcgacgactgtgtggtaaagcccatcgacgaccgcttcgccaccgccctgacggctctgaacgacatgggaaaggtccggaaggacatcccgcagtgggagccgagcaagggctggaacgattggcaacaggtccccttctgcagccaccatttccaccagctaataatgaaggacggccgcgagatcgtggtcccctgccggaaccaggacgagctagtggggcgggctagagtaagtcagggcgcggggtggtccttaagagagacggcgtgtctcggtaaaagctacgcccagatgtggcagctaatgtacttccaccggcgcgacctgcggctcgccgccaacgccatctgttccgccgtgccggtggactgggtgcccaccagccgcaccacctggtccatccacgctcaccaccagtggatgacgaccgaggatatgttgtcggtctggaaccgcgtgtggatagaggagaacccctggatggaggacaagacccacatatccagctggggagacgtgccctacctaggtaaacgcgaagaccaatggtgcgggtctctcatcgggctgacggcccgggcgacatgggccactaacattcaggtggccatcaaccaggtacgacgcctgatcggcaacgagaactacctcgactacatgactagcatgaaacggttcaagaacgagtccgatcctgagggtgccctgtggtga

SEQ ID NO: 24312 - RNA, 9879 nt, synthetic construct
  misc_feature 1..9879: note = derived and/or modified CDS sequence (opt11) from DENV-1__FJ882548__SS-prME
  source 1..9879: mol_type = other RNA
tccgtaacaatgctcttgatgctgatgcctacggcgttagcctttcatctcacaacgagagggggagaacctcacatgatagtgtcaaaacaagaacgcggaaaatccttgctgttcaaaaccagcgcgggcgtaaacatgtgcacccttatagctatggatttaggagaactgtgcgaagatacaatgacatacaaatgtccccgaatcacggaagcggaaccggatgacgtagactgctggtgcaatgccacagacacgtgggtgacctacggaacttgttcacaaacgggcgaacatcgacgagacaaaagaagcgttgccctggcgccccatgtaggcctggggctggaaacgcgcacagaaacatggatgagcagcgaaggcgcatggaaacaaatacagcgtgttgaaacatgggcgctacgacaccctggcttcacggtaatcgcgctatttttagcacacgcaattgggacgtcgataacccaaaaaggaatcatcttcatactattaatgctagtgaccccaagcatggcgatgcgttgcgtggggatcgggagcagggacttcgtcgaaggactttccggagcgacatgggtagacgtagtcctggaacatggcagctgtgtgacaacaatggccaaagacaaaccaaccctggacatcgaattattaaagacagaagtcacgaaccccgccgtccttcggaaactatgcattgaagcgaagataagtaacaccacaacagacagtcgctgccccacacagggcgaagctacacttgtagaggaacaggacgcgaacttcgtctgccgtagaactttcgttgatcgaggatggggaaacggatgtggtctgttcggaaagggatcacttatcacatgcgcaaaatttaaatgtgtcacgaaactagagggaaaaatagtccagtacgaaaaccttaaatacagcgtgatcgtgacggttcacaccggtgaccagcaccaagtaggcaacgagtcgactgaacacggtacaacggctaccatcaccccgcaagcgccaactacggagatacaactaactgattacggagccctgacgctagactgcagcccacgaacaggactcgacttcaatgagatggtgctcctaacgatgaaagagaaatcatggctagtacacaaacaatggtttctggatctgccactaccctggacttcgggggcgtcgaccagccaagaaacctggaaccgacaggacctactcgtgacctttaagacggcccacgctaagaaacaggaggtcgtcgtgctggggtcacaggaaggagcaatgcacactgcgctgacaggcgcgacggaaatacagacgagcggcactacgaccatcttcgccggccatctcaaatgccgccttaagatggacaaacttacactgaaaggaatgtcttacgtgatgtgcacgggcagctttaaactggagaaagaagtagctgagacccaacatggtacagtcctagtccaaataaagtacgagggcacggacgcgccctgcaagattccgttctccacccaagacgaaaagggggtcacccaaaacggaagattgataacagcaaatccgattgtcacggacaaggaaaaacccgtgaatatcgaggcagagccgccatttggggagtcatacatagtgatcggagcaggcgaaaaggcactcaaactaagctggtttaaaaagggtagttccataggtaaaatgtttgaagcgacagcccgcggcgcacggaggatggccatactgggcgacacagcatgggacttcggctcgatcggcggagtgttcacctccgtcggaaaactaatacatcaaatcttcgggacagcatacggggtcttattctcaggcgtgtcctggactatgaaaatcggcattggcgtactgttaacatggctgggactgaacagtcgtagcactagcctaagcatgacgtgcatagcggtgggtctagtaaccctctacctcggcgtcatggtccaagcggacagcgggtgtgtaataaactggaaagggagggaactaaaatgcggctccggaatcttcgtcacgaatgaagtccacacctggacggaacagtacaaatttcaagcagatagcccgaaacgactatccgcggccatcggcaaggcttgggaggagggtgtctgcggcatacgatctgcaacgcggctagaaaacataatgtggaaacaaataagcaacgaacttaatcacatccttctagaaaacgacatgaagttaaccgtagtagtaggcgatgtcgcgggcatactcgggcaaggtaagaaaatgattcgaccgcagccaatggaatacaaatacagctggaaatcatggggaaaagcaaagatcatcggggcggacgctcagaacaccacattcataatcgacggaccaaatacaccggaatgtccggacgaccaacgcgcatggaacatatgggaagtagaggattatggtttcggaatcttcaccacaaatatctggctaaaacttcgggatagctacacgcaagtctgcgaccaccgcctcatgagcgccgcaattaaggacagtaaagcagtacacgcagacatgggatactggatcgagagtgaaaagaatgaaacgtggaagctggcccgagcatccttcattgaggtcaagacgtgcatttggcccaagagtcacacgctatggagcaatggcgtactggagagcgaaatgataattcccaaaatatacggcggacctataagccaacacaactatagaccgggttacttcacccaaacagctggcccctggcacctagggaaactcgagttagacttcgacctgtgtgagggcacaaccgtagtcgtagacgagcactgcgggaatcggggccccagcctacgtacaactactgtgacgggaaaaatcatacacgagtggtgctgccgaagctgtacgctacccccgctcaggttccgcggcgaggacggctgttggtatggaatggaaatccgcccagtcaaggaaaaggaagaaaacctagtaaaaagcatggtaagcgccggatccggagaagtggactccttcagcttaggactactgtgcatcagcataatgatagaggaagtgatgagatctcgatggtcacgaaaaatgctcatgacaggaacgctcgccgtattcttccttctcataatggggcagctcacttggaacgacctcatcagactatgcataatggtaggtgctaacgcgttcgaccgtatgggtatgggcacgacctacctagctctgatggcgacctttaaaatgagacccatgtttgcggtcgggctcctattcagaagactaacttcacgagaggtactgctactgaccattggactgagccttgtcgcatcggtcgaactgcctaacagccttgaagaactgggagatgggctggcaatgggaataatgatcttaaagctactaaccgacttccagtcacaccagctttgggcaaccctgcttagcctgacattcattaaaaccacgttctcgcttcactacgcctggaaaaccatggctatggtcttgagcatcgtatctctattgccactctgtttatcaacgacatcccagaaaaccacatggctgccggtgctgctggggtccctaggctgcaaacccctaacaatgtttctgatagccgagaacaagatctggggccggaaaagctggcccctgaacgaggggattatggccgttggaattgtgagcatactcctaagctcattactgaagaacgacgtacccctggcggggcctctcatcgcagggggcatgcttatagcctgttacgtcataagtgggtcgagcgccgacctttccctggagaaagctgccgaggtctcatgggaggaggaagcagaacacagcggcgcgtcacacaatatcctcgtggaggtgcaagacgacggtaccatgaagatcaaggacgaggagcgagacgataccttaacaatcctcctgaaggcaacactcttagccgtctcgggcgtctatccactctccatacccgcgacgctattcgtctggtatttttggcagaagaagaaacaaagatcaggagtcctatgggacacaccatcacctccggaagtcgaacgagcggtcttggacgacggaatataccgcattatgcagaggggcctattaggacggagccaagtgggggtaggcgtattccaagagaatgtcttccacaccatgtggcacgtaacgcgaggggcagtgttgatgtaccaagggaagagattagagcccagctgggcaagtgtcaagaaagacctcatttcctatggagggggctggagactacgaggaagctggaacactggggaggaagttcaggtaatcgcagtcgagcccggcaaaaatccgaaaaacgttcagaccgcgccggggacattcaaaaccccagagggcgaagtgggcgcaatcgcgctagacttcaaaccagggacatccgggtcccccattgtcaaccgggaaggcaagatagtcggactatacggcaacggagtggtaacaacttctggaacctacgtttcagccatagcgcaggccaaagcctcacaggaaggcccactacccgagatagaagatgaggtctttaggaagcgaaatctgactatcatggacctgcatcctggcagcggcaaaaccaggcgctacctaccagcgatcgtacgcgaggcaattaagcgaaagctgcgaaccttaatccttgcaccaacacgtgtggtagcctccgagatggccgaggcgctgaaaggaatgccaattcgctaccagacaacggcagtgaaaagcgaacacactgggaaagagatcgtagacctgatgtgccacgcgacgttcaccatgcgcctgctaagcccggtacgagtcccaaattataatatgatcattatggacgaagcgcatttcacagaccccagcagcatcgcagccagaggatacatcagcacaagagtgggcatgggggaagccgcagcaatcttcatgactgccacgcccccgggatcagtcgaagccttcccccagtccaatgcggtgatacaagacgaagaacgagatatccctgaaagatcttggaactcaggccacgaatggataacagactttccagggaaaacggtctggtttgtccccagcattaaatcgggaaacgatatagccaactgcttgcggaaaaacggcaagcgagttattcaactaagcagaaagacattcgacacggaataccaaaagacgaagaacaacgattgggactacgtggtcaccaccgacatctcggaaatgggagcaaactttcgcgcggaccgagtcatcgacccgagaaggtgcttgaaaccggtaatattgaaagatggccccgagagagtgatcctggccggtccgatgcccgtgactgtcgcatcggcagcacaacggcggggacggatcggtcgaaaccacaacaaggagggagatcaatacatctacatgggacagccactaaacaacgatgaggaccacgcccactggaccgaagcgaaaatgctcctggataacataaacacaccagagggaatcatacctgcactcttcgaaccagaacgagagaaaagcgctgccgtagatggggaatacaggcttagaggagaagcaagaaaaacgttcgtcgaattaatgcgacggggcgacctgccggtatggctcagctacaaggtagcctccgaggggttccaatattcagaccgcagatggtgcttcgacggcgaacggaacaaccaggtattggaagagaacatggacgtggaaatatggacaaaggaaggcgaaagaaagaaactgcgaccgcgatggttagacgcgagaacttattctgacccactagcgttgcgagagttcaaagagttcgccgcaggccggcgctccgtgagcggagatctaatacttgaaatagggaaactaccacaacacctgacgcaacgcgcacaaaatgccctcgacaacctggtaatgctccacaactccgagcaaggcggccgagcctaccgccacgccatggaggaattaccagacaccattgaaaccttgatgctgctagcactcatagcggtactgaccggtggggtaacgttattcttcctcagtggccgaggactcggtaaaacctctataggattgctctgcgtcatggccagcagcgtcttactctggatggcgtcagtagagccgcactggatagccgcaagtataatcctagagttcttcctgatggttttgctgatacctgagccggatagacagcgaacgccgcaagataaccagctagcgtacgtcgtcataggactcctgtttatgatactcaccgttgcggcgaatgaaatgggattgctcgaaacgacgaagaaagacctcggaataggtcacgtggccgtcgaaaaccatcaccatgcagccatgctcgatgtggacttgcatcccgcgagcgcctggaccctctacgcagtagcgactacaataatcacgccgatgatgcgccacacaatagaaaacacgacggccaacataagcctgactgccatagctaatcaggccgcgatactaatgggtttggacaaaggttggccaatctcaaagatggacataggcgtgccgctcctggcactcggctgctatagtcaagtaaatccgctgacgctgaccgcagctgtactaatgctagtagcgcactacgcaataatcgggccaggacttcaagcgaaagcaacgcgtgaggcgcagaaaagaacagccgcaggtataatgaagaacccgacagtcgacggaatagtagcaatagacctagacccagtagtctacgacgccaagttcgaaaagcaactaggacagataatgttgcttatattatgcacgtcccagatcctacttatgcgcacgacctgggccctatgtgaatcaataaccttggcaacgggaccgctcaccacgctttgggaaggctccccagggaagttctggaacaccactattgccgtcagcatggcgaatatctttcgtggctcatacctcgcgggcgccggtctcgcttttagcctaatgaaatcgttagggggagggaggcggggaacgggtgcacagggagagacactgggcgagaaatggaagaggcaactcaaccaactgagcaagtcagagttcaatacctataagcgctcagggataatggaggtggaccggtcagaagcgaaggaaggcctgaagcggggagaaaccacaaagcacgcagtcagcaggggaaccgcgaaacttagatggttcgtagagcgaaatctcgtcaaacctgaaggaaaggtcatcgacttaggatgtgggagagggggctggtcgtactactgtgcaggcctcaagaaagtcacggaagtgaaagggtatacgaaagggggccctggacacgaagaaccgataccaatggctacgtatggctggaacctcgtcaaactacactcgggtaaagacgtcttcttcataccgcccgaaaagtgcgacaccctactgtgtgatatcggcgaatcttcaccaaacccgacaatcgaggagggtaggacgcttcgtgtcctcaaaatggtagaaccttggctaaggggaaatcagttctgcattaaaatactaaacccgtacatgccatcagtagtggagacgctagaacaaatgcaaagaaaacacggaggtatgctggttcgaaatccgctaagccgaaacagtacacacgaaatgtactgggtaagttgcggaacgggtaacatagttagcgcagtaaatatgacgagccgcatgctcctcaaccgattcacgatggcccaccgcaagccgacctacgaacgagacgtggatctgggaacgggaacacggcacgttgctgtggaaccggaggtagctaatctggacataatcggccaacgaatagaaaacatcaagcacgaacataagtcaacttggcactacgacgaggacaatccatataagacgtgggcataccacggatcctatgaagtcaaaccatcaggaagcgcgagctcaatggtaaacggagtcgtaaaacttctcacgaagccatgggacgtaatccctatggtaacacaaatcgctatgacggatacaacaccttttggacagcaacgggtttttaaggaaaaagtcgacacgcgaacgccaaaggcgaaacgaggaaccgcacagattatggaagtaacggctagatggttgtggggattcctaagtcggaataagaaaccgaggatatgcacacgcgaagagttcacacgcaaagttcgcagcaatgcagccataggtgcggtgttcgtagacgaaaaccaatggaactctgccaaggaagcggtcgaagacgagagattctgggacctagtgcatagggaaagggaattgcacaagcaggggaagtgcgcaacctgcgtatacaacatgatgggtaagcgagagaagaaattaggtgaatttgggaaagcaaaaggctcgagggcgatctggtacatgtggctgggcgcgcgatttctcgagttcgaagccctaggattcatgaacgaggatcactggttttcacgcgaaaattcattatcgggcgtcgagggggaggggctacataaactcgggtacatcctacgcgatataagcaaaatacccggaggaaacatgtatgccgacgacacggctggatgggataccaggattacggaagacgacctccaaaacgaagcgaagattacagacataatggagccagaacacgcattactagccaaggcaatattcaaactaacatatcaaaacaaggtcgtaagggtgcaacgcccagccaaaaacggaaccgtgatggacgtaataagtcgacgggaccagcgtggatcaggacaggtggggacttacggactaaacacgttcacaaacatggaagcacagctcataagacaaatggaaagcgaaggcatcttcagtccctcggaactcgagacaccaaacctcgccgaacgcgctctcgactggttagagaagtacggcgtcgaaagactcaagagaatggccataagtggagatgactgcgtagtcaaaccgatcgatgacagatttgccacggcactcacagccttaaatgatatgggcaaggtacgaaaggacattccgcagtgggaaccctcgaagggttggaacgactggcaacaagtaccattctgtagccaccatttccaccagttgatcatgaaagacgggcgagagatagtagtaccctgccgcaaccaagacgaacttgtgggtcgggcgcgggtatcgcaaggagctgggtggtccctccgagagacggcatgcctcggaaagtcatatgcacagatgtggcagctcatgtacttccacagacgagacttacgattggccgccaacgctatatgcagcgcagtaccagttgattgggttccgaccagtcgcaccacatggtcgatacacgcccaccatcaatggatgaccacggaagacatgctttcagtatggaaccgtgtctggatcgaggaaaacccatggatggaagataagacacatatcagcagttgggaggacgtcccatacctggggaagcgggaggaccaatggtgcggctccctaataggactgacagcgagagcaacatgggcaaccaacatccaggtagcgatcaaccaggtcagaaggttgataggaaacgaaaattaccttgactacatgacctccatgaagcgctttaagaacgaaagcgacccagaaggagcgctgtggtaa

SEQ ID NO: 24313 - RNA, 9879 nt, synthetic construct
  misc_feature 1..9879: note = derived and/or modified CDS sequence (opt11) from DENV-1__GQ199801__SS-prME
  source 1..9879: mol_type = other RNA
tcagttacgatgttactcatgctaatgcccacagcattggcgttccacctgacgactagagggggtgaacctcacatgatcgtgtcaaaacaagaacggggcaaatcactactattcaaaacttccgccggtgtaaacatgtgcacgctcattgcaatggacctgggggagctgtgcgaagatacaatgacgtacaaatgtccccggataacggaagccgagcccgacgacgtggactgctggtgcaatgcaacggacacgtgggtaacgtatgggacatgctcccaaacaggggaacacaggcgtgataaacgatcagtagccctagcaccccacgtagggttgggcctggaaacaaggactgagacctggatgagctccgaaggcgcttggaaacaaatccaacgggtcgaaacctgggcacttcggcacccgggctttacggtcatcgctctcttcttggcacatgcaatagggacgagtataacacaaaaaggcataatattcatactactaatgctagtcactccctcgatggcaatgagatgcgtcggaataggcagccgggactttgtcgagggcctaagcggcgccacatgggtcgacgtagtattagagcacggcagctgtgtcacaaccatggcaaaagacaaaccaacactagacatagagctgctcaaaacggaggtaacgaacccagcggtgctgagaaaactgtgcattgaagccaaaatatcaaatactaccacagactcccgatgccctacccaaggcgaggccaccttagtcgaggagcaagacgcaaacttcgtttgccgacggactttcgtagacagggggtggggcaacgggtgcggtctattcgggaaaggatcgctcataacgtgcgccaaatttaaatgcgtgacacgcttagaagggaagatcgtccagtacgagaatctaaagtatagtgtcatagtgaccgtgcacacgggagaccagcaccaagtaggcaatgaatcgaccgaacacgggacaactgcgacaatcacaccgcaagcacctagtactgaaatccagcttaccgattacggagcactaacgctggattgtagcccgcgtacaggactagacttcaacgaaatggtcttactgacaatgaaagaaaaatcctggctcgttcacaaacaatggtttctagacctaccgctaccttggacaagtggcgcgtccacaagccaagagacatggaaccgccaggacctcttagtcaccttcaagacagcccacgccaagaaacaagaggtagtagtcctcggttcccaagagggcgcgatgcacaccgcacttaccggcgcaacagaaattcaaaccagcggaacaacgacaatcttcgccggtcatcttaagtgtcgacttaagatggacaaactcacactaaagggaatgagttacgttatgtgcacgggctcgttcaaacttgagaaggaggtcgccgaaacacaacacgggacggtacttgtccaaatcaagtatgaaggaacagacgccccttgtaagattcccttcagcacccaggacgaaaagggcgtaacccaaaacggtcggctaataaccgccaatccgatcgtaaccgacaaagaaaagcccgtcaacatagaagccgaaccaccctttggggagagctacattgtaatcggggccggagaaaaagccctcaaattatcctggttcaagaaaggaagctcgataggcaaaatgttcgaagcaacggcaagaggggcacggcgcatggcgatcctcggagacacagcatgggatttcggctccatcggcggcgtatttacttccgtagggaagctagtacaccagatatttggtaccgcatatggcgtcttattttcgggcgtctcgtggactatgaagataggcatcggggtcctacttacctggcttggactgaactcgcgatcaacctcgctatcgatgacatgtatcgccgtggggctggtcaccttgtacctcggagtcatggtacaggctgacagtgggtgcgtcatcaattggaaaggacgcgagttaaagtgcggctcgggaatctttgttacgaacgaggtccatacgtggactgaacagtataaatttcaggccgactcacctaaacgcttaagcgccgctattggcaaggcatgggaagaaggggtatgcggcatacggagcgcaacgagattggagaacataatgtggaaacaaataagcaacgagctcaaccacatcctgctggagaatgacatgaagttcacagtagtcgtaggtgacgttgccgggatcctagctcaaggcaagaaaatgatccgcccacaaccgatggaatataaatactcatggaaaagctggggcaaagcaaagattatcggcgcagacgtgcaaaacaccaccttcatcatagacggaccaaacacacccgaatgcccagatgaccaaagggcctggaatatctgggaagtggaagactatggcttcgggatattcactacaaacatttggctaaaattacgtgactcatatacacaagtctgcgaccacaggctaatgagcgcggccataaaggactccaaggctgttcatgctgacatgggatactggatcgaaagtgagaagaacgaaacgtggaaactggcccgagcaagttttatcgaagttaagacttgtatatggccaaaatcacacacactctggagcaacggcgtcttagaatccgaaatgatcatccccaagatctacggcggcccaataagccaacacaattaccgacccggctacttcacccagaccgcaggcccctggcatttaggcaaactcgaattagacttcaatctatgcgaagggacgacagtcgtagttgatgagcactgcggaaacaggggcccgagcctaagaaccaccactgtcacaggaaagataatacatgagtggtgttgcagaagttgcacactacccccactaaggtttaaaggcgaagatggctgctggtacgggatggaaatccgaccagtaaaagagaaggaagagaacctcgtgaaatcgatggtatcggcggggtcgggagaagtagactcgttctcactcggcctactctgcatctcaataatgattgaggaagtgatgcgctcacgctggagcaagaaaatgctgatgaccgggacgttggcagtattcttcctgctaataatgggtcaactaacttggaatgacctcataagactgtgtatcatggtaggcgccaacgccagcgaccgcatgggaatgggaaccacatatctcgccctaatggccactttcaagatgaggcctatgctggccgtcgggcttttattccggagactcacgtcccgagaagtcctattgctcactatagggctgtccctcgtggcgagcgtagaactgccgaacagcctcgaggaattaggcgacggactcgcgatgggcatcatgatactaaagctcctgacagacttccaatcacaccagctatgggcaacgctacttagcctcacattcatcaaaactacatacagccttcactatgcttggaaaactatggcgatggtcctctcgatagtcagtctgttcccgctctgcctctccaccacgtcacagaaaacgacatggctcccggtattactggggtcgctcgggtgcaaacccttaaccatgttcctgatagcggaaaataaaatatgggggcgcaagtcctggccacttaacgaagggatcatggccgtaggtatcgtcagtatcctcctctcaagcctactgaagaacgatgtacccctagcgggaccactcatcgccgggggcatgctgatcgcttgctacgtaatatcaggatcttcggcagacctgtcacttgaaaaggcagccgaagtcagttgggaggaagaggcagaacacagcggagcaagccataacattctggtagaggtgcaggacgatggaaccatgaagatcaaggacgaggagcgtgacgatacgctaacaatcttgttgaaggcgaccttgctggcagtaagcggtgtatacccactaagcatcccggccacactttttgtttggtacttctggcagaaaaagaaacaaaggtccggagtactgtgggacaccccctctccacccgaagtagaacgcgcggtcttagacgacggaatataccgcatcatgcaacgtggactcctcgggcggtcacaagtgggcgtaggagtcttccaagagaatgtctttcataccatgtggcacgttacccggggcgctgtcttgatgtatcagggaaaacgattagagccttcatgggcgagcgtgaagaaagacctcatttcatatgggggaggatggagactgcaaggaagttggaatacaggagaagaagtccaagtaattgcagtcgagccggggaagaatcctaagaacgtacagaccgcaccgggaacatttaaaacatctgaaggcgaagtaggcgccatagcgctagacttcaagcccggcacttcaggtagtcctatagtcaatagagaggggaagatagtgggactatacgggaacggtgtcgtgacaacatcaggaacctacgttagcgcaatcgcgcaagcgaaagcatcgcaagaaggacccctaccggagatagagaatgaggtctttcgaaaaaggaacctaaccataatggacctgcaccccggctcaggcaaaacgcggcgatacctccccgcaatcgtacgtgaagccataaagcggaagttacgcacccttatactcgcaccgacacgcgtagtagcttccgaaatggcagaggctctaaaaggaataccaatccgataccaaactacggccgtaaaatctgaacataccggtaaagagatagtggacctcatgtgccacgccacgttcaccatgagactattatcaccagtgagagtgccaaactacaacatgattatcatggacgaagcgcatttcacggacccgagttcgatcgccgccaggggatacatatctacccgagtcggaatgggggaagcggccgcaatattcatgactgccacgcctccagggtccgtcgaagccttccctcaatccaacgcggtcatccaagacgaggaaagagacatacccgaaaggtcctggaactccggttatgagtggatcaccgatttcccaggcaaaacagtgtggtttgtcccctccatcaagtcaggcaatgacatagccaactgtttaagaaagaacggcaagcgcgttatacaactcagtaggaagacgttcgacactgaatatcagaaaaccaagaacaatgactgggattacgtagtaactacagacatctcggagatgggagcaaacttccgagcggaccgagtaatcgacccaaggcgctgcctgaaaccggtaatactaaaagacggaccagagcgtgtaatcctagcaggaccaatgccagtcacagtcgcaagcgcagcccagcgacggggccgaatagggaggaatcacaacaaggaaggggaccaatacatctacatgggacagccgctaaacaacgacgaggaccacgctcactggaccgaagcaaaaatgctacttgataatataaacacgcccgaaggtataatacccgccctattcgagccagaaagggagaaaagtgcagcaatcgacggcgagtaccgtctaagaggagaggccaggaagaccttcgtggaactcatgagaaggggtgacctccccgtatggctctcgtacaaggtagcaagcgaaggatttcaatactccgatcgaagatggtgctttgatggcgaaagaaataaccaggtgctagaagagaacatggacgtcgagatatggaccaaagaaggtgagaggaagaaactacgcccacggtggcttgacgcacggacatatagtgatcccctggcattacgcgagttcaaagaatttgccgccggacggcgctccgtctcgggagatctcatactcgaaataggcaaattaccccaacaccttacacagcgagcgcaaaacgccctagacaacctggtgatgctccacaatagtgaacaaggagggcgcgcctatcgccacgcgatggaagaactccccgacacaatagagacgctcatgttgctcgcattgatagctgtcctgacaggcggagtcacgctattctttctgagcggcagagggcttggcaaaaccagcatcgggctgctatgcgtaatggccagttccgtgctactgtggatggcctccgtcgaaccccactggatagcggccagtattatcctcgagtttttcctcatggttctactgataccagaaccggaccggcaaagaacaccacaggacaatcaattagcctacgtggtcatcggtttgctattcatgatcctcacggttgcggcgaacgagatgggtctcctcgaaacaacgaaaaaggacttgggcataggacacgtagcagtcgagaaccatcaccacgcggccatgctggacgtagacctccaccccgcttcagcctggacactctatgccgtcgcaacaaccatcataacgccaatgatgcgccacacaatagagaacacaacagctaatatctccctcacagccatagccaaccaagcagcaatacttatgggcctcgacaaaggctggccgattagcaaaatggacatcggggtgccgttgctagcgctagggtgctattctcaagtgaacccgcttacccttactgcagctgtgctcatgctggtagcacactacgccattatcgggcccggccttcaggcgaaggccacgagagaggcacagaaaaggactgcagcagggattatgaagaaccctacggttgacggaatagtcgcaatagacctcgaccccgtagtttacgacgcaaagtttgaaaaacaactagggcaaatcatgctgcttatactctgcacaagccaaatcctgctcatgcgaacaacgtgggcactctgtgaatccattaccttggccacaggaccgctcacaaccctgtgggagggaagccccggtaaattctggaatacaacaatcgcagtaagcatggcgaacatatttcgaggcagctacttagccggtgcaggtctcgctttcagtctgatgaaatcacttgggggaggccgcagggggacgggagcccagggcgaaacgttaggcgagaagtggaagcgccaacttaaccagctaagcaaaagcgagttcaacacgtacaaaagatccggaataatggaagtcgatagatcggaggcgaaggaaggcctaaagaggggagagacgaccaagcacgccgtctcccgaggaacagctaagctaagatggtttgtagaaaggaacctagtaaaaccggagggaaaggtgatcgacctaggctgcggacgagggggttggagctactactgtgcgggactaaagaaggtgacggaagtcaaaggctatactaaagggggccccggccacgaggaacccatccctatggccacttacggctggaacttagtgaaattacactccggaaaagacgtattcttcattccaccagagaaatgcgacacattgctatgtgatataggcgaaagcagcccaaatccaacaattgaagaagggcgtacgctgcgagtgctaaagatggtggagccgtggctccgtggcaaccaattctgcataaaaatcctaaacccttacatgccttcggtcgtggagaccctagaacagatgcagcgcaagcacggaggaatgctcgtaagaaatcctctctctcgaaatagcacacacgaaatgtattgggtgagttgcggaaccggaaacatcgtgagcgccgttaatatgacgtccagaatgctattaaaccgattcaccatggctcacagaaaaccgacgtacgagcgggacgtcgacttgggggctggaacacgccatgtagccgtagagccggaggtggcgaacctcgacatcattggacagagaatagaaaacataaagcacgaacacaagagtacgtggcattacgacgaggacaacccgtacaaaacgtgggcctaccatggcagctatgaagtcaaaccgagcggatcagcatcatcgatggtgaatggggtcgtcaaactcttaacaaaaccctgggacgtaatcccaatggttacacagatcgccatgacggacactacgccattcgggcagcaacgagtattcaaagaaaaggtagatactcgaacaccaaaagcgaagcggggcacagcgcagataatggaggtcaccgcgaagtggctctgggggttcctcagcaggaacaagaaaccacgaatatgcactagagaagaatttacacgcaaggtacgctcaaacgccgcaataggagctgtattcgttgacgagaaccaatggaacagcgcgaaggaagcggtcgaggacgaacgcttttgggacctcgtacaccgagaacgggagcttcacaaacaaggcaaatgcgcgacgtgcgtatacaacatgatggggaaaagagaaaagaagctaggagagttcggcaaggctaagggaagtcgagcaatatggtacatgtggctgggagccagatttctcgagttcgaagcgctcggcttcatgaacgaagatcactggttctcacgcgaaaacagcctgtcgggtgttgaaggtgagggcctccacaaacttgggtacatcctgagagacattagcaaaattcctgggggcaacatgtacgccgacgacaccgcggggtgggacaccagaataaccgaagatgacctgcaaaatgaggccaaaataactgacataatggaacccgaacatgccctgttagccaagagcatttttaaactaacataccagaataaggttgtccgagttcaacgccccgcgaaaaatgggacagtgatggatgtcatcagtcgtcgagatcaaagaggcagcggacaagttggaacatacggactaaacacgttcacgaacatggaggcacaacttatccggcaaatggagagcgaaggaattttcagcccctcggagctggagacgccaaacctcgcaggcagagttttggactggcttgaaaaacacggcgtggagcgactcaaaaggatggctatatccggtgacgactgcgtagtgaagccaatagacgaccgcttcgccacagcactaaccgcccttaacgacatgggaaaagtcagaaaagacatcccccaatgggaaccgtcaaaagggtggaatgactggcaacaagtcccattctgcagccaccatttccaccaactcataatgaaggatggccgggaaatcgtggtaccgtgccggaaccaagacgagctggtcggcagggcacgagtttcacaaggagcaggatggtctctacgtgagacagcctgcctcggtaagagctatgcacaaatgtggcagttaatgtacttccacagacgcgacctgcggttagcagctaacgcaatctgtagtgctgtaccggtcgattgggtccccactagccgaacaacgtggagtatccacgcacaccaccaatggatgacaaccgaagacatgctatccgtctggaatcgggtatggatagaggaaaacccctggatggaggacaaaacccacatcagcagttggggagacgtcccctatctcggaaaacgggaagaccaatggtgcgggtcactcattggcctcacggccagagccacgtgggcgaccaacatccaagtggccataaaccaggtgagacgcttgatcggtaatgaaaactatctcgactatatgactagcatgaagcggtttaaaaacgaatccgacccggaaggcgcgctttggtaa

SEQ ID NO: 24314 - RNA, 9879 nt, synthetic construct
  misc_feature 1..9879: note = derived and/or modified CDS sequence (opt11) from DENV-1__GQ199802__SS-prME
  source 1..9879: mol_type = other RNA
agcgtgacaatgttactcatgctgatgcccaccgccctggccttccacctcacaacacggggcggggagccccacatgatcgtaagcaagcaggagcggggcaagagtctgctgtttaagaccagcgccggcgtgaatatgtgcaccctcatcgctatggacctaggagaactgtgcgaggacaccatgacctacaagtgccctcggatcaccgaaactgagcccgacgacgtggactgttggtgtaacgcaacggacacctgggtgacgtatgggacctgtagccagacgggcgaacatcggcgcgacaagcgctccgtggccctcgcgccccacgtgggcctcgggctggagacgcgaaccgagacctggatgtcttctgagggcgcgtggaagcagattcagagggtagagacgtgggcccttcgccaccccgggtttaccgtgatcgccctgttcctggcccacgcgataggtaccagtatcacccaaaaggggattattttcattctactgatgctcgtgacgccctccatggccatgcggtgcgtcggcattggctcacgcgactttgtggagggactctcgggggccacctgggtggacgtcgtgctggagcatgggagctgtgtgaccaccatggctaaggacaagcccacgctggacatcgagctcctgaaaaccgaggtcaccaaccccgccgtgttgcggaaactctgtatcgaggcgaagatcagtaacacgacgaccgacagccggtgcccgacccaaggcgaggccaccctggtggaggagcaggatgccaacttcgtatgccggcgcacgttcgtagaccggggctgggggaatggctgcggcctcttcggcaaagggtcccttatcacgtgtgccaagttcaagtgcgtgaccaagctggagggaaagattgtccagtacgagaacctgaagtactctgtgatcgtcaccgtgcacacgggcgaccagcaccaggtggggaacgagtccaccgagcatggcaccaccgccaccataacgccccaagcgcccaccacggagatccagctcactgactacggggccctcaccctggactgtagcccccgcacgggcctcgacttcaacgagatggtcctgcttaccatgaaagagaagtcctggctcgtgcacaaacagtggttcctcgacttacccctcccgtggactagcggggccagcacttctcaggagacctggaaccggcaggacctgctggtcacctttaagacggcccacgcaaagaagcaggaggtcgtggtgctcggcagccaggagggcgcgatgcatacggctctgaccggggctaccgagatccaaacctcggggactacgaccatcttcgccggacacctgaagtgcagactcaagatggacaagctgaccctgaagggcatgagctacgtcatgtgcacggggtctttcaagcttgaaaaggaggttgccgaaacccagcacggcacggtgctggtccagatcaagtacgaaggcaccgacgctccctgcaagatccccttcagcacgcaggatgagaagggggtgacgcagaacggccggttaatcaccgccaacccgatcgtgaccgacaaagagaagcccgtaaacatcgaggccgagccgcccttcggggagtcttacatcgtgatcggcgcaggcgagaaagcgctgaagcttagctggttcaagaaggggtccagcatcggcaagatgttcgaggccacggcgagaggggcccggcgcatggccatactgggcgataccgcgtgggacttcgggtccatcggcggcgtgttcacctcagtcgggaaactggtgcaccagatatttggcacagcctacggtgtgttgttttccggagtcagctggacaatgaaaatcgggatcggcgtgctactgacatggctcggactgaacagccgttcgaccagtctgagcatgacctgcatcgccgtgggcctcgtcacgctgtacttaggcgtgatggtccaggccgactcggggtgcgtcatcaactggaagggccgggagctcaagtgcggctcaggcatctttgtgacaaacgaagttcatacgtggaccgagcagtacaaatttcaggcagactcaccgaagcgcctgtccgcagctatcggcaaggcgtgggaggagggggtatgcgggatccggagcgccacccgcctggagaatatcatgtggaagcagatatcaaacgagctaaaccacatcctgctggagaacgacatgaagttcacggtagtggtcggcgacgtagccggcatcctcgcgcagggtaagaaaatgattcgaccccagcctatggagtacaagtacagctggaagtcctggggaaaggctaagattatcggcgcagacgtgcagaacaccacattcatcatcgacggccccaacacacccgagtgccccgacgaccagcgtgcctggaatatctgggaagtggaggactatggcttcggcatattcactacaaacatctggttaaaactgcgcgacagctacacccaggtgtgcgatcaccgcctcatgtccgccgccatcaaggactccaaggccgtacacgccgacatgggctactggattgagtccgagaagaacgaaacatggaaactggctcgggcgagtttcatcgaggtcaagacgtgcatctggcccaagtcacacaccctgtggagcaatggtgtattggagtccgagatgatcatccccaagatatacgggggccccattagtcaacacaactaccgccccgggtacttcactcaggcagccggcccttggcacctggggaagctggagctagacttcgacttatgcgaggggaccacggtggtcgtcgacgagcattgtggcaaccggggcccctcccttcgaaccaccaccgtgactggcaagatcattcatgagtggtgttgcagaagctgcaccctaccgccgttgcgcttcaagggggaggatggctgctggtacgggatggagatccggcccgtcaaggaaaaggaagagaatctggtgaaatccatggtgtcagctggaagtggcgaggttgacagcttcagcttagggctgctgtgcatctcgatcatgatcgaggaggtgatgcgcagccggtggtcccgccggatgctcatgaccggaaccctggccgtgttcttcctgttaatcatggggcaactgacgtggaacgatttgatccgtctctgtatcatggttggcgcgaacgcatctgaccgcatggggatgggcaccacttacctggcgctgatggccacctttaaaatgcggcctatgttcgcagtgggcctcctattccgccggctgacgtctagagaagtattgctgctgaccatcgggctcagcttggtcgcgagcgtggaactgcccaacagcctcgaagagctcggcgacggcctggccatgggcatcatgatcctcaagctgctgactgacttccagtcccatcagctttgggccaccctgctgagcctcacgttcatcaagacaacattctcgctgcactacgcctggaaaaccatggcgatggtactcagcatcgtaagtctcttccccctgtgcctgagtacgaccagccagaagaccacctggttaccggtgttgctgggcagcctcggttgcaagccgctgacgatgttcctgatagcagagaacaaaatctggggccggcgcagctggcccctcaacgaggggatcatggcagtcggaatcgtgtcaatcctgctgagctccctcctgaaaaacgatgtgcccctggctgggcccttgatcgccgggggcatgctgatcgcttgctacgtcatcagcgggtctagcgcggacctctccctcgagaaggccgccgaggtgagctgggaggaggaggccgagcactccggtgcgtcgcacaacatcctggtggaagtccaggacgacggcaccatgaagataaaggacgaagagcgggacgacaccctgaccatcctcctgaaggccaccctgttggctgtgagcggagtgtatccgctgagcatccccgccactctgtttgtctggtatttctggcagaagaagaagcagcgcagcggggtcctctgggacactcccagcccgcccgaggtggagcgggcggtccttgacgacggcatctacagaatcatgcaacggggactgctgggccgctctcaggtgggcgtgggggtgttccaggagaacgtgtttcacaccatgtggcatgtgacccggggcgcggttctcatgtaccagggaaagcggctggagcccagttgggccagcgtcaagaaggacctcatctcctacggaggcgggtggaggctccaaggctcctggaacacgggggaggaagtgcaggtaatcgccgtcgagcccggcaagaaccccaagaacgttcagaccgcacccgggaccttcaagacccctgagggggaagtgggcgccattgcgctcgacttcaaacccggcacgagcggttccccaatcgtgaaccgcgagggtaagattgtgggcctgtacggaaacggtgtcgttacgaccagcggcacctacgtgtcggccatcgcccaggctaaggcgtcgcaggaggggcccttacccgagatcgaggacgaggtcttccggaaacgcaacctaacgataatggacctgcaccccggctcagggaagacgcggcgctatcttccagccatcgttcgggaggccatcaagcgaaagctccgcacactgatcctcgcaccgacgcgggtggtcgcctcggagatggctgaagcactgaaggggatgcccatccggtaccagacgaccgccgtcaagagcgagcacaccggcaaggagatcgtggacctgatgtgccacgccacctttacgatgcggttattgtcccccgtccgcgtgccgaactacaatatgattatcatggatgaggctcacttcaccgatcccagctccatagctgcccgggggtacattagcacccgcgttggcatgggagaagccgccgccatcttcatgaccgcaacgccgcccggctccgtcgaggccttcccgcagtcaaacgccgttatacaggacgaggagcgagatatccccgagagatcctggaacagcgggtatgagtggatcaccgactttcccggcaaaaccgtgtggtttgtcccctccatcaagagtggcaacgacatcgccaattgcctgcggaagaacgggaagcgcgtgatccagctctcgaggaagacattcgacacggagtatcagaagaccaagaacaacgattgggattacgtggtcaccaccgacatcagcgagatgggtgcgaactttcgcgcagatcgggtgatcgacccgagacggtgcctgaagcctgtgatcttaaaggacgggcccgagcgcgtcatactcgccggacccatgccggtgacagtcgcctccgccgcgcagcgacgcgggcggataggccgcaaccataacaaggagggcgaccagtacatctacatgggtcagccattgaacaacgacgaggaccacgcccactggaccgaggccaagatgctgcttgacaacatcaacacgcccgagggcatcatcccggccctattcgagccggagcgtgaaaagtccgcggcaatagacggggaataccgtctgcgtggtgaggccaggaaaaccttcgtggagctcatgcggcgcggggacctgcccgtatggctgtcctacaaggtcgcttcggagggctttcagtacagcgaccgtcggtggtgcttcgacggcgaacgcaacaaccaggtgctcgaagagaacatggatgttgagatttggacgaaggagggggagcggaagaagctgcggccccggtggctggacgcccgcacctatagtgaccccctggccctgcgagaattcaaggagttcgcggctggccgccggagcgtctcgggggacctgatcctcgagatcggcaagttgccgcaacaccttacccaaagagctcaaaacgccctcgacaacctggtgatgcttcacaactctgagcagggcgggcgggcttatcgtcacgcgatggaagaactcccagatacgatagaaacgctgatgctgttagccttaatagccgtactgaccgggggggtcaccctgttctttctctccggtcgtgggctgggcaagaccagcatcggcctactgtgtgtaatggcctccagcgtgttattgtggatggcttccgtcgagcctcactggattgccgcatctatcatcctggagttcttcctgatggtcctcctgatccccgaaccggaccgtcaacggacgccacaggacaaccagctggcctacgtggtcatcgggctcctcttcatgatcctgacggtggccgcgaacgaaatgggactgctggagacaaccaagaaggacctggggatcggccacgtggccgtggagaatcaccaccacgccgctatgttagacgtggacctgcaccccgcctccgcgtggactctgtacgccgtggccactaccattatcacccctatgatgcgccataccatcgagaacacgaccgctaacatcagcttgaccgccatcgcgaaccaggccgccattctgatggggctggacaagggctggccaatctccaagatggacatcggagtccccctcttggcccttggctgttacagccaagtgaatcccctcaccctgacagccgctgtgctcatgcttgtcgcccactatgcaatcatcggcccggggctacaggccaaggctaccagagaggcccagaaacggaccgccgccggtatcatgaagaaccctaccgtggacgggatagtggccatcgacctggaccccgttgtgtacgatgcgaagttcgagaagcagctcggccagatcatgcttctgatcctctgtacgtcccagatcctactgatgcgcacaacctgggccctctgcgagtcgatcactctggccacaggccccctcacaaccctctgggaagggagtccgggcaaattctggaacacgacgattgccgtgagcatggccaacatttttcggggctcctacttagcgggcgccggcctcgccttcagcttaatgaagtcgttgggggggggtaggcgggggaccggggcccaaggcgagacgctaggagaaaagtggaaacgccagttgaaccaactttccaagagcgagtttaacacctacaaacggtccgggatcatggaggttgataggtctgaagcaaaggagggcctgaagaggggggaaacgaccaagcacgccgtgtcccgcgggacagcgaagttacggtggtttgtggagcgcaacttagtcaaaccagaaggtaaggtgatcgacctcggctgcggccgcggcggctggagctactactgcgccgggctgaagaaggtgaccgaggtcaaggggtacactaagggcggccccggccacgaggagcctattccgatggctacctatggttggaacctcgtgaagctgcactccggcaaggacgttttcttcatcccgcccgaaaagtgcgacacactgctctgcgacatcggggagagctcccctaacccgaccatcgaggaggggcgcacgcttcgggtgctgaagatggtagaaccgtggctgcgtgggaaccagttctgcatcaagatattgaacccctacatgccgagcgtagtcgagactctggaacagatgcagcgaaagcacgggggcatgctcgtaaggaacccgctgtcgcggaacagcacccacgagatgtactgggtgtcgtgcgggaccggcaacattgtttcagcggtgaatatgacctcccgcatgttactcaaccgcttcacgatggcgcaccgaaagcccacctacgagcgcgacgtggatctgggggccggaacccggcacgtcgcggtggagcctgaggttgccaacctcgatatcatcggccagagaatcgagaacattaagcacgagcacaaaagcacttggcactacgatgaagacaacccctacaagacgtgggcgtaccacggaagttacgaggtcaaaccgagcgggtccgcaagctctatggtgaatggggtagtaaagctcttaaccaaaccctgggacgtgatccccatggtcacccagattgccatgaccgacacgacccctttcggccagcagcgggtgttcaaggagaaggtcgatacccgcaccccgaaagccaagcgggggacggcccagatcatggaggtcacagcgaagtggctctgggtattcctctcccgcaacaaaaagccgcggatatgcacccgcgaggagttcacaaggaaggttcgctcgaatgccgccatcggtgccgttttcgtggatgagaaccagtggaacagtgcgaaggaggcggtggaggacgagcggttctgggacctggtgcaccgcgagcgggaactgcacaagcagggaaagtgcgccacatgcgtatacaacatgatgggcaagcgcgagaagaagcttggcgagtttgggaaagcaaagggcagccgggccatttggtacatgtggctgggggcgcgctttctggaattcgaggccctgggcttcatgaatgaggaccactggtttagccgggagaacagcttgtccggagtggagggggagggcttgcataagctcggatacattctgcgcgatattagcaagatcccaggagggaacatgtacgccgacgacaccgccggctgggacacccggatcaccgaggatgatcttcaaaacgaggcacgcatcaccgacatcatggagccggagcatgcgctactggcaaagtccatctttaaactgacctaccagaacaaggtcgtgcgcgtacaacggcctgccaagaacggcaccgtcatggacgtgatcagccgccgggaccaacgcggatccggccaagtggggacctacggtctcaataccttcaccaacatggaggcgcagcttatccggcaaatggagagcgagggcatattctcccccagcgagttggaaaccccaaacctcgccgaacgcgtattagactggctggagaagtacggcgtggagcggttaaagcgtatggcgatatccggcgacgactgcgtggttaagcccatagacgaccggttcgccacagccctgacggccctgaacgacatgggtaaggtgcgcaaggacataccccagtgggaaccaagcaagggttggaacgactggcagcaggtccctttctgcagccaccacttccaccagctcatcatgaaggacgggcgggagatcgtcgtgccgtgccgtaatcaagacgagctggtgggccgcgcccgcgtcagccagggcgcggggtggagcttgcgggagacggcctgcttaggtaaatcctacgcccaaatgtggcagctgatgtacttccaccgccgggacctgcgactcgccgcgaacgccatctgcagcgccgtgcccgtggactggatcccaacttcacggaccacgtggagcatacacgcccaccaccagtggatgaccaccgaggacatgctgtctgtttggaaccgtgtgtggatcgaggagaacccctggatggaggataagacccacataagctcctggggcgacgtgccgtacctgggcaagcgcgaggaccagtggtgtgggtcactcattggcctgacggccagggcgacctgggccaccaacatccaggtcgccatcaaccaggtacgccggttaatcggaaacgagaactacctggactatatgacatccatgaagcgcttcaagaacgagagcgaccccgagggggcactgtggtga

SEQ ID NO: 24315 - RNA, 9879 nt, synthetic construct
  misc_feature 1..9879: note = derived and/or modified CDS sequence (opt11) from DENV-1__JF937597__SS-prME
  source 1..9879: mol_type = other RNA
agcgtgaccatgctgctcatgctgatgcccaccgccctggccttccacctcaccacgaggggcggggagcctcacatgatcgtcagcaaacaggaacggggcaagagcctgctgttcaagaccagcgccggggtgaacatgtgcaccctcatagcaatggacctgggggagctgtgcgaggataccatgacctataaatgcccccgcatcaccgaggctgagccagacgacgtggattgttggtgtaacgccaccgacacgtgggttacctatgggacctgcagccaaaccggcgagcaccggcgagataagcggtccgtggccttagcgcctcacgtgggcctcgggctggagaccaggaccgagacctggatgagctccgagggcgcctggaagcagatccagcgggtggagacctgggccctccgccatccagggtttacagtgatcgccctctttctggcgcatgctatcggcaccagcatcacgcagaaggggatcatcttcatcctcctgatgctggtgaccccttccatggccatgagatgcgtcggcataggcagccgcgatttcgttgagggcctctccggcgccacgtgggtggacgtcgtgctggaacacgggagctgcgtaaccaccatggccaaggataaacccaccctggacatcgagctcttaaagaccgaggtcacgaaccccgcggtattgaggaagctgtgcatcgaggcaaagatctcaaacaccaccacggacagtaggtgcccgacccagggagaggctaccctggtggaggagcaggacgccaatttcgtctgccggcgcaccttcgtagacagaggctgggggaacggatgtgggcttttcggtaaggggtccctcatcacgtgcgctaagtttaagtgcgtgaccaagctggagggaaaaatcgttcagtacgagaacttgaagtacagcgtgatagtgaccgtccacaccggtgatcagcaccaggtggggaacgagtccacggaacacggcaccaccgcgaccatcacgccgcaggcacccacgacagagatccagctcacagactacggggccctgacactggactgcagcccacgcaccggcctcgatttcaacgagatggtcctgctgaccatgaaagagaagtcctggctcgtgcacaagcagtggttcctggacctgcccctcccctggaccagcggggccagcacctcccaggagacctggaaccgtcaggacctgctggtgaccttcaagaccgcacacgcgaagaagcaggaggtcgtggtgctcggcagccaggagggcgccatgcacaccgccctaacgggggccaccgagattcagacctcaggcaccacgaccatattcgcggggcacctaaaatgccgcctgaagatggacaagctcaccctgaagggcatgagctatgtcatgtgcacagggtcatttaagttagagaaggaggtcgcggagacgcagcacggcaccgtgctggtccaaatcaaatacgaaggtacagacgctccctgtaagattcccttcagcacccaggacgagaagggggtgacacagaacggaagactgatcaccgctaaccctatcgttaccgataaggaaaagcccgtcaatatcgaggctgagccacccttcggcgagtcatacatcgtgatcggcgcgggcgaaaaggccttgaagttgtcttggttcaagaaagggtctagcatcggcaagatgttcgaggctaccgcccgtggggcccggcgcatggcaatcctgggcgacaccgcctgggactttggatccataggcggcgtgttcactagcgtcgggaagctggtgcaccagattttcggcaccgcctacggggtcctcttctctggcgtaagctggactatgaaaatcgggatcggggtactgctgacgtggctcggactgaactcgcgcagcacctccctgtctatgacttgcatcgcggtcgggttagtcaccctgtacctgggcgccatggtgcaagcggattcggggtgcgtgatcaattggaaggggcgggagttaaagtgcgggtcgggaatttttgtaacaaacgaggtgcacacttggacagagcaatacaagttccaggctgacagcccaaagcgtctgagtgccgccatcggcaaggcctgggaggagggagtttgcggcatccggtccgcgacacgcttggagaacattatgtggaaacagatctccaacgagttgaaccatatcctgctggagaacgacatgaaactcaccgtcgtggtaggggatgtcgctggcatcttaggtcagggcaaaaagatgatcaggccccagcccatggagtacaagtacagctggaagtcctggggcaaagccaagatcatcggggccgacgcgcagaacacgacgtttatcatcgacggccccaacacaccggaatgccccgacgaccaacgcgcctggaacatctgggaagtggaggactatggattcggcatcttcaccacgaacatctggcttaaactccgcgactcctacacccaggtgtgcgaccaccgcctgatgtccgcggccatcaaggatagcaaggccgtccacgcggacatgggctattggatagagtccgagaagaatgagacctggaagctcgccagggccagcttcattgaggtgaagacctgcatctggcccaagtcgcacacgctctggtcgaacggtgtgttggaaagcgagatgattatccccaagatctacggcggacccatcagccagcacaactaccgacccggctatttcacccaaacagcagggccctggcatcttggcaagctcgagttagactttgacttatgcgaagggaccacggtcgtggtggacgagcactgcggcaaccgtggcccatccctccgcaccaccacggtcacggggaagatcatccacgagtggtgctgccgatcttgcaccctaccgcccctgcgcttcagaggcgaggacggatgctggtacggcatggagatcaggccagtgaaggagaaggaggaaaacctcgtgaagtccatggtttcagccggcagcggggaggtggactcctttagcctaggactgctctgcatatccatcatgattgaggaggtgatgcggtcacgctggtcccggaaaatgttaatgaccggaacccttgcggtctttttcctgctgatcatgggccagttaacatggaacgacttgatacgcctgtgcataatggtgggggccaacgccagcgaccggatgggcatgggcaccacctacctggctctcatggccacttttaagatgcggccgatgttcgcggtggggctgctgttccgccgtctcacttcgcgcgaggtcctgctgctaaccatcggattgagcctagtcgcctccgtggaactacccaactctctggaggagcttggggacggcctagctatgggaattatgatcctgaagctgcttaccgactttcagtctcaccagctgtgggcaaccctgctgagcctgacgttcatcaagacgaccttctccttacattacgcgtggaagaccatggccatggtgttgagcatcgtgtccctgttccccctgtgcttaagcacgacgtcccagaagaccacctggctgcccgtactgctgggaagcctgggctgcaagccgctgaccatgttcctcatcgctgagaacaagatctggggtagaaagtcgtggcccctgaacgagggcataatggccgtcgggatcgttagtatcctgctcagctccctgctgaagaatgatgtccccctcgccggccccctcatcgcgggtgggatgttgatagcctgctacgtgatcagcggcagtagcgcagacctgtccctggagaaggctgccgaggtgagctgggaagaggaggcggagcattccggggctagccataacatcttagtcgaagtgcaggatgacggcaccatgaagatcaaggacgaggaaagggatgacaccctcacgattctgctgaaggccaccctcctggccgtgtctggggtatacccgctgagcatccccgcgactctcttcgtgtggtacttctggcagaaaaagaaacaacggtccggcgtgctgtgggacaccccttcaccacccgaggtcgaacgcgctgttctggacgacggcatctatcggatcatgcagcgagggctcctcggacggtcccaggtcggggttggggtgttccaggagaacgtgttccacactatgtggcacgtcacgcgtggggccgtgctgatgtaccagggtaaacggctggagcccagctgggcctcagtgaagaaggacctaatctcgtacggagggggctggcggctaagagggtcctggaacacgggagaagaggtccaggtgatcgccgtggagcccgggaagaacccgaaaaacgtccagaccgcccctggcaccttcaagacccccgagggagaggtgggggcgatcgccctggacttcaagcccggcacgagtgggtccccgatcgtgaaccgggaggggaaaatagtcggtctctacgggaatggcgttgtgacgacctctgggacgtacgttagcgccatcgcgcaggcaaaggcctcgcaggagggccccctgccggagatcgaggacgaggtgttccgtaagcgcaacttaacgataatggacctccaccccggtagcggcaaaacccgtaggtacctaccagccatcgtgcgggaggccatcaaacgcaagctacgcactctcatcctcgctcccacccgggtcgtggcgtcagagatggctgaggccctgaagggcatgcccatccgctaccagacgaccgctgtcaagagcgagcacaccgggaaggagatcgtcgacctcatgtgccacgccaccttcacgatgcgccttctgtccccagtgcgcgtgccgaactataacatgatcatcatggacgaggcgcacttcaccgacccctcgtccattgctgctcggggctacataagcacacgcgtaggtatgggcgaggccgccgcgatctttatgaccgccacaccgcctgggtccgtggaggcctttccgcagtctaacgccgtgatccaggacgaggagcgggacatccccgagcgctcctggaacagcggttacgagtggatcaccgactttcccggtaagacagtctggttcgtgccctccatcaagagcgggaacgatatcgcgaactgccttcgtaagaacggcaagagagtcatccagctatcccggaagactttcgatacggagtaccagaagaccaagaacaacgactgggattatgtcgttaccacagacatcagcgagatgggggcgaacttccgcgccgatagagtaatcgacccgcgccggtgtttgaagcctgtaatcctaaaggatggccccgagcgcgtgatcctagccgggccaatgccggtgacggtcgcctccgcggcccagcggcgcggccggatcggccgcaaccacaacaaggagggcgaccagtacatctacatgggccagcccctaaataacgacgaggaccacgcccattggaccgaagcaaagatgctactggacaatataaacacccccgaggggatcatccccgcgctattcgagcccgagcgcgagaagtccgcggccgtggacggtgagtatcggttacgcggggaggcccgcaagacctttgtcgagctcatgcgtcggggcgacctaccagtgtggctttcgtacaaggtggcaagcgagggcttccagtactcggatcgaagatggtgcttcgacggggaaagaaacaaccaggtcctggaggagaacatggacgtagagatatggacgaaagagggcgaacggaagaagctacgcccccggtggctcgacgcccgtacctactccgaccccctggcgttacgggagtttaaggagttcgcagccggtcgccggagcgtgtcaggggacctcatactggaaatcggcaagctccctcaacacctcacccagcgcgcccagaacgcgctggacaacttagtcatgttacacaacagcgagcaaggcggccgagcctaccgccacgccatggaggagctacccgacactatcgaaacgctgatgctcctggccctgatcgccgtgctgacagggggtgtcaccctgttcttcttgtcaggccggggcctcggcaagacctctatcgggctgctctgcgtcatggcgtccagcgtcttgctgtggatggccagtgttgaaccccattggattgccgccagcatcatcctggagttctttctcatggtgttgctgattccagagcctgacagacagcggacgccccaggacaaccagctagcctacgttgtaatcggcctgctgttcatgatcctcacggtcgcggccaacgagatgggcctgttggagaccaccaagaaagaccttgggatcgggcacgtggccgtggagaaccaccaccatgccgcgatgctagacgtagatctgcatcccgcttccgcctggaccttatatgccgtcgccacgaccattatcaccccgatgatgcgccacactatagagaacacaaccgccaacattagcctaacagcaattgctaaccaggctgccatactgatgggcctagacaagggctggccgatctccaagatggacatcggggtgcccctgctggcgctcggctgctacagccaggtcaaccccttgaccctgacagccgctgtcttgatgcttgtcgcccattatgctataattgggccaggcctccaggcgaaggccacccgtgaggctcagaagcgtaccgccgcggggatcatgaagaacccaaccgtcgacggcatcgtggcgatcgacttggatcccgtggtctacgatgctaagttcgagaaacagcttggccagatcatgctgctgatcctgtgcacgagccagatcctgctcatgcgtaccacctgggccctgtgcgaatccatcacgctagcaacggggcccctcaccacgctgtgggagggctccccggggaagttctggaacaccacgatcgccgtgagcatggcaaacatattccggggctcctacctggccggcgccgggctcgccttcagcctgatgaagtcgctgggcggaggccgccggggtaccggcgcgcagggcgagaccctcggggagaagtggaagcgccaactgaaccaattatccaagagcgagttcaacacctacaagcggtcgggtatcatggaggtggaccgcagcgaggccaaggaggggctcaaacggggcgagacgactaagcacgctgtctcccgcgggactgccaagctgaggtggttcgtggagcgcaacctggtgaagcccgagggcaaagtcatcgacttaggttgcgggcgaggcgggtggtcgtactactgcgcaggcctcaaaaaggtgaccgaggtaaaggggtacacaaagggcggccccgggcacgaggagcccatcccgatggcgacctacggttggaatctagtcaagctccactccgggaaggacgtgttctttatcccgccagaaaagtgcgacaccctgttatgtgacatcggcgagagctcccccaacccgacaattgaggaggggcgcaccctgcgcgttctcaagatggtcgagccgtggctgcgcggcaaccagttttgcattaagatcctgaacccctacatgcctagcgtggtggaaaccctcgagcagatgcagcggaaacatggcgggatgctggtgcgcaacccgctgtcccgaaacagcacccacgagatgtactgggtctcctgtggcacaggtaacatcgtttctgccgtcaacatgacttcccgcatgctattgaaccgcttcacaatggcccatcggaagcccacctacgagcgcgacgtggatctaggcacaggcactcggcatgtggccgttgagcctgaggtcgccaacttggacataattgggcagcgcatcgagaacatcaagcatgagcataaaagcacgtggcactacgacgaggataacccctacaagacctgggcgtatcatgggtcctatgaagttaagccgagcgggtccgcaagcagcatggtcaatggcgtggtgaaattactgactaaaccctgggacgtgatcccaatggtgacccagatcgccatgacagatacgacacccttcgggcaacagcgtgtcttcaaggagaaggtcgacacccggaccccgaaggccaagcgggggaccgcccagattatggaggtcactgcccgctggctctggggcttcctgtcccgaaataagaagcccagaatctgcacccgggaggagttcacccgaaaggtccggagcaacgcagcaatcggggcagtgttcgtggacgagaaccagtggaactccgcgaaagaggcggttgaggacgaacgcttttgggacctggtgcacagagagcgggagctacacaaacagggcaagtgtgcgacctgcgtttacaacatgatggggaagagagagaagaagttgggagagttcgggaaggccaaaggctcacgcgccatctggtacatgtggctgggagcgcggttcttagagttcgaagccctggggttcatgaatgaggaccactggttttcccgcgagaactcactgtccggcgtcgagggggagggattgcacaaactggggtatattctgcgagacatctccaagatccctggcggtaacatgtatgccgatgacacagccggctgggacaccaggatcacagaggacgacctccagaacgaagctaagatcaccgatatcatggagccggagcatgcactgctggctaaggctatattcaagctcacctaccagaataaggtggttcgtgtccagcggcccgctaagaacggcacggtcatggacgtgatcagtcgccgggaccagcgcggaagcggccaagtcggcacgtacgggctgaacacattcaccaatatggaggcccagctgatacggcagatggagtcagagggcattttcagccccagtgagcttgagacccccaacctggcggagagagcactgaactggctcgagaagtacggagtggagcggctcaagcgcatggccattagcggcgatgactgcgtggtcaagccgatcgacgaccggtttgccacggcactgaccgcactcaacgatatggggaaggtgcgcaaggacatccctcagtgggagccctccaagggctggaacgactggcagcaggtacccttctgcagccaccatttccaccagctgatcatgaaagacggccgggaaatcgtcgtgccgtgccgcaaccaggacgagctagtggggcgggcccgcgtcagccagggtgccggctggagcctgcgggagaccgcctgcctggggaagtcctacgcgcagatgtggcagctgatgtactttcaccgccgtgatctccgcctggccgccaacgcgatctgttccgccgttcccgtggactgggtccccacctctagaaccacatggtccatacacgcgcaccatcagtggatgaccaccgaagacatgctgtccgtttggaacagggtgtggatagaggagaacccctggatggaggacaagactcatattagcagctgggaggacgttccgtatctcgggaagcgcgaagaccagtggtgcggctcactgatcggactgacggcccgggccacttgggccaccaacatccaggtggccatcaatcaagtgcgccggctcatagggaacgagaactatctggattatatgacaagcatgaagcgattcaagaacgagtcagaccccgagggcgcgctgtggtga

SEQ ID NO: 24316 - RNA, 9879 nt, synthetic construct
  misc_feature 1..9879: note = derived and/or modified CDS sequence (opt11) from DENV-1__GQ868609__SS-prME
  source 1..9879: mol_type = other RNA
tccgtcaccatgctgctgatgctgatgccaaccgctttagccttccacctcacgacccgcggcggtgagccgcacatgatagtcaccaagcaggagcggggcaagagcctgttgtttaaaacgagcgccggtgttaacatgtgcacgttaatcgctatggacttaggagagttgtgcgaggacaccatgacctataagtgccccagaatcacggaggccgagcccgacgacgtggactgctggtgtaacgccaccgatacgtgggtgacctacgggacttgctcccaaacaggcgaacaccggcgcgacaagcgcagcgtggccttagcaccccacgtgggcctgggtcttgagacccgcaccgagacttggatgtcctcagagggcgcgtggaagcaaatacaacgggtcgagacatgggccctccgccaccccggattcactgttatcgccctgttcctggcgcatgccatcggtacctctatcacccaaaaggggatcatctttatcctgctgatgctggttacgcccagcatggccatgcgttgcgtcggaatcggctcccgcgacttcgttgaagggctaagcggcgctacttgggtagacgtcgttctggaacatgggtcctgcgtcaccaccatggccaaggacaagcccacgctggatattgaactcctgaagaccgaggttaccaaccctgcggtactgcgcaaactctgcatagaggccaaaattagcaacaccacgacggacagtaggtgccccacgcagggagaagcgaccctgatggaggagcaggacgccaacttcgtctgtaggcgaacgtttgtagaccggggatggggcaacgggtgcgggctgttcggcaaggggtctttgataacgtgcgccaagtttaagtgcgtgaccaagctagaaggcaagatcgtacaatacgagaacctgaagtactcggtgatcgtgacagtgcataccggagaccaacatcaggtcggtaatgagagcaccgagcatggcactaccgcgacaatcacgccgcaggcgcccacctccgaaatccaattaacggactacggggccctcaccctggattgcagcccccgcacggggctcgactttaacgagatggtcctgctgactatgaaggagaaaagctggctcgtccacaaacagtggttcctcgacctcccgctcccctggacctccggcgcaagtacttcccaggagacctggaaccgacaggacctgctggtgacgttcaaaaccgcacatgcaaagaagcaggaggtggtagtgctcggcagccaggagggcgcgatgcacaccgccttaacaggggccacagagattcaaacatccggaaccacgacaatcttcgccggccatttgaagtgcaggctgaagatggacaagttaacactcaagggtatgagctacgtgatgtgtaccgggtccttcaaactagagaaggaggtcgcggagacgcagcatggcacagtcctggtgcagatcaaatacgagggcacggacgcgccgtgtaaaatccccttctcaactcaggacgagaagggcgtcactcaaaacggccgactgatcacagccaaccccatcgtgaccgacaaggagaagccagtgaatatcgaagccgaaccgccattcggggagtcctacatcgttatcggcgccggggagaaggcccttaaattgtcctggttcaagaaagggtcaagcatcggaaagatgttcgaagctacagcccgtggggcgcggagaatggcgatcctgggtgatacggcctgggactttgggtctgtgggcggggtctttacgtctgtggggaagctcgttcaccagatcttcggcactgcctatggtgtattattctcgggcgtgagctggacgatgaagatcgggataggcgtactcctaacgtggttaggactgaactcccgaagcacctccctgtcgatgacctgcatcgccgttggcttagtcacactgtacctgggtgttatggtgcaggcggactccgggtgtgtgatcaactggaaaggccgggagttgaagtgcgggagcggcatcttcgtgacgaacgaggtgcacacttggacggagcaatacaaattccaagcagacagcccgaagcgcctatccgctgccatcgggaaggcctgggaggaaggagtctgcggcatccgcagtgcgacccgcctcgagaatatcatgtggaaacagatctccaatgagctcaatcacatcctgttggaaaacgacatgaagtttactgttgtggtcggggacgtggtgggcatcctcgcgcaggggaagaaaatgattcggccccagccgatggagcacaagtacagttggaagagttggggaaaagccaagataattggcgctgatgtacagaacaccaccttcatcatcgatggacccaacaccccggagtgccccgatgatcagcgcgcgtggaacatatgggaggtggaggactatggttttggaatctttacgactaacatatggctgcggctgcgcgactcatatacccaggtatgcgaccacaggctgatgtccgcggccatcaaggactctaaggccgttcacgcagacatgggctactggatcgaatccgaaaagaatgagacgtggaagctggcccgtgcgtcattcatcgaggtcaagacatgtatctggcccaagtcccacacattgtggagtaacggcgtgcttgagagtgagatgatcattcctaagatctacgggggcccgatcagccagcacaactaccggcccgggtacttcacgcaaaccgccggcccttggcacctagggaagctggagctcgacttcgacctgtgcgaaggcaccacagtcgtggtggacgagcattgcggcaaccgcgggccgtcactgcgtacaaccaccgtcacgggaaagatcatccacgagtggtgctgccgaagctgcacgctgcctccgctccggttcaagggtgaggacggctgctggtacgggatggagatccggcccgtaaaggagaaggaagagaacctggtcaagagcatggtcagcgccgggagtggcgaggtagatagctttagcctcgggttactgtgcatctctatcatgatcgaggaagtgatgcggtcacgttggtcacggaagatgctcatgaccggcaccctggccgtctttcttctccttatcatggggcagctgacgtggaacgacctcatccgcttatgcatcatggttggcgccaatgcgtcagacaggatgggtatgggcactacctacctggccttaatggccaccttcaaaatgcggccgatgtttgccgtaggcctcctgtttcgcagactaacttccagagaggtcctgttactcaccatcggtcttagcctggtggcctctgtcgagctccccaatagcctggaggagttgggcgacgggctcgcgatgggaattatgattcttaagctactgaccgatttccagtcccaccagctgtgggccactctactatcgttgaccttcatcaaaaccaccttatcccttcactacgcatggaagaccatggccatggtgctatcgatcgtgtccttgttccccctctgcctctcgacgacgtcccagaagaccacctggctgcccgtcctcctgggaagcctaggatgcaagccgttaacgatgtttctgattaccgagaacaaaatctggggtagaaagagctggcccctgaacgagggtatcatggcggtgggagtggtgagtatcttactcagctccctgttgaaaaacgacgtgcccctagccggtccgctgatcgcaggcggcatgctcattgcctgctatgtaatcagcgggtcaagcgctgacctgtccctagagaaggcggcggaagtttcctgggaggaggaggccgagcactccggagccagccataacatcctggtggaggtccaggatgacgggaccatgaagattaaagacgaggaacgcgacgatactctaactatcctgttgaaagccacgctcctagccgtgtccggggtgtacccgctatctatccccgccaccctgttcgtgtggtatttctggcagaagaagaagcagcggtcgggggtgctgtgggacacaccaagcccgcccgaggtagagcgtgccgtgctggatgatggcatctaccgcatcatgcagcggggcctactggggcggtcccaggtcggtgtgggggtattccaagaaaacgtcttccatacgatgtggcacgtgacgcgcggtgccgtgctgatgtaccaggggaagcggttggagcccagctgggcatccgtcaagaaggacctgatcagctatggcggcgggtggcgtctgcagggctcgtggaacaccggggaggaggtccaggtgatcgccgtcgagcccggcaagaaccccaagaatgttcagaccgcacccgggaccttcaagacgcccgagggggaggtgggtgccatcgccctcgatttcaagcccggcacttcgggttcccccatcgtcaatcgggagggtaaaatcgtgggcctgtacggcaatggggtggtcacgacctcaggcacctacgtgtcagcgatcgcgcaggccaaggcctctcaggaggggcctctgcccgagatagaggacgaggtgttccgcaaacgaaacctcaccattatggacttgcatcccggcagtggcaaaacgcgccggtaccttccggctatcgtacgcgaggcaataaagcgaaagcttcgcacacttatcctggcccccacgcgcgtggtggccagcgagatggccgaagctctcaagggaatgcccatccggtatcagaccacggcggtgaagagcgagcacaccggcaaggagatcgtagacctgatgtgccacgccacgttcaccatgcgcctgctctctcccgtccgtgtcccgaactacaacatgataatcatggacgaagcccactttactgatcccagctctattgcagcccgcgggtatatctctactcgggtgggtatgggcgaggcggccgccatcttcatgacagccacgccgcccggctccgtagaggccttcccgcagagcaatgccgtcatacaagatgaagagcgggacatccccgagcggtcatggaactcgggttacgagtggatcaccgactttccgggcaagacagtttggtttgtaccctccattaagtccggcaacgacatcgcgaactgccttagaaagaacggaaaacgagtcatccagctgtcccgaaagacctttgatactgagtaccagaagacaaagaataacgattgggactacgtggtgaccacggacatcagtgagatgggcgccaatttcagagccgaccgcgtcatcgatccgcggcgctgcctaaagcccgtaatcctcaaagacgggcccgagagggtgatcctcgcggggcccatgcctgtgaccgtggccagcgccgcgcagcgccgggggcggatcggccggaaccataataaagagggcgaccagtacatatatatggggcagcccctcaacaacgacgaggaccacgcacactggaccgaggcgaaaatgctgttagacaatattaacacccccgagggcatcattcccgccctcttcgaaccggagcgcgaaaaatccgccgccatagacggagagtaccgtctgcggggagaagccagaaagacgtttgttgagttgatgagacgcggggacctacccgtgtggttatcctataaagtggctagcgagggcttccagtactccgatagacgctggtgcttcgacggcgaacggaacaatcaggtcctggaggagaacatggatgtggaaatttggaccaaagagggggagcgtaaaaaactaaggcccagatggcttgacgcacgtacctactccgaccccctcgcattacgcgagttcaaggagttcgctgcgggccggcgcagcgtgagtggagacctcatcctggagatcggtaagctcccacagcacttaacccagcgggcgcagaacgcactggacaacttagtgatgctgcacaacagtgagcagggcggtcgcgcgtacaggcacgccatggaggagctgcccgacacgatcgaaaccctcatgctgttggctctcatagccgtgctgactggcggggttactctgttcttcctctctggccgcggacttggaaaaacttctatcggcctcctatgcgtcatggcctccagcgtgctgttatggatggccagtgtggaaccccattggatcgccgcgagcataatcctcgagtttttcctgatggtcttgctaatccccgaaccggatcgtcagcgcaccccccaggacaaccagctggcctacgtggttattgggcttctgtttatgatactgaccgtggccgccaacgagatgggtctcctcgagacgacaaagaaggatttagggatcgggcacgtggcggttgagaatcaccaccacgcgacgatgctggacgtcgatctccaccccgcctccgcctggacgctgtacgccgttgccaccaccatcataacgcccatgatgcggcacaccatcgagaacaccaccgcgaacatcagcttgacggccatcgctaaccaggccgcaatcctgatgggtctggacaagggttggcccatctcaaagatggacatcggcgtccccctcctcgcactggggtgttactcacaggttaacccactgaccctcaccgccgccgtgttgatgctggtggcacattacgcgataattggccctgggctccaggccaaagccacacgagaggcgcagaagcgcacggccgcaggcatcatgaagaaccccaccgtcgacggcatcgtggccatcgacctggaccccgtggtctacgacgcaaagttcgagaaacagctgggacagatcatgttgttaatcttatgcacctcacaaatcctcctcatgaggaccacgtgggccctatgcgaaagcatcaccctggccaccggacccctgaccacgctgtgggaggggtccccgggcaagttctggaatacaaccatcgccgtaagcatggctaacatcttcagggggtcctatctcgccggtgccggcctagcgttcagcctgatgaagagtctagggggcggtcggagaggcaccggtgcgcaaggcgagacgttaggtgagaagtggaaacgacagctgaaccagctctccaagtcagagtttaacatctataagaggtctgggatcatggaggttgaccggagcgaggccaaggagggcttgaaaaggggtgagactacacgtcatgccgtgagccgcggaactgccaagctgcgttggtttgtcgaacgcaacctggtgaagcccgaggggaaggtcatcgacctcggctgcggccgaggtgggtggagctactactgcgccgggttgaagaaggtcaccgaggtaaaggggtataccaaaggcgggcccggtcatgaggagccgatcccgatggccacctacgggtggaacctggtcaagctccactctggtaaggatgtgttctttacgccaccagagaagtgcgacacgctgttatgcgacatcggcgaaagttcccccaatccgaccatagaggaaggccgaaccctcagggtgctgaaaatggtcgagccctggctgcgcgggaaccagttctgtatcaagatcctcaacccctacatgcccagcgtggtcgaaaccctggaacaaatgcagcgaaagcatggcggaatgttagtgcggaaccccctctcccggaacagcacccacgagatgtactgggtatcctgcgggacgggcaatatcgtaagcgccgtcaatatgacttcgaggatgttacttaaccgtttcaccatggcccaccggaagcccacctacgaaaaggatgttgaccttggagccggcacgcgccacgttgccgtagagcccgaggttgccaatctggacatcatcggccagagaatcgagaacatcaaacacgaacacaagagcacctggcactacgacgaggacaacccctataagacctgggcctaccacgggtcatacgaggtcaagccttccggctcggcctccagcatggtgaatggggttgttaagctactcacgaagccgtgggacgtgatcccgatggtgacgcagatagccatgacggatacaacccccttcggacagcagcgagtcttcaaggagaaggtagacactcggaccccgaaggccaagcgtgggaccgcgcagataatggaggtcacggcccggtggctgtggggcttcctgtcacgtaacaagaaaccccggatttgcacgcgagaggagtttacgcggaaagtccgttcaaacgccgcgatcggcgcggtgtttgtggacgagaatcagtggaattccgccaaggaggcggtcgaagacgagcggttctgggatttggtgcaaaaggagagggaactacataagcaaggcaagtgcgcaacctgcgtgtacaacatgatgggcaagcgggagaagaagctgggtgagttcggcaaagcgaaggggagccgcgccatctggtacatgtggctcggcgctcgtttcctcgagttcgaagctctcggcttcatgaacgaggaccactggtttagccgcgagaactcactctccggggtcgagggcgagggactgcacaagcttggatacatcctgagagacatatctaagatccccggtggcaatatgtacgccgacgacaccgctggctgggacacccggatcacggaggacgacctgcaaaatgaggccaaaatcaccgacataatggaacctgagcacgctctgctagccacaagcatcttcaagctgacgtatcagaacaaggtagtgcgggtccagcgacctgccaagaatggcaccgtgatggacgtcatcagtcgccgggaccagcgcggatccgggcaggtcggcacctacggcctgaataccttcacgaacatggaagcgcagttaattcggcagatggagagcgagggaatattcctcccctccgagcttgagacccccaacctagccgagcgggtcctagattggctggagaaatacggggttgagcgtctcaaaaggatggccataagtggggacgactgtgtcgtaaagcctatcgatgacaggtttgccactgcgcttaccgcgctgaacgacatgggcaaggtgcgcaaggacataccacagtgggagccaagcaagggctggaacgactggcagcaggttcccttctgctcgcatcacttccatcagctcatcatgaaggacggccgtgagattgtggtcccatgccgcaaccaggacgaactggtcgggcgggcccgcgtgagtcagggcgccgggtggagcctgagggaaacggcttgcctcggtaagagctacgcccaaatgtggcagctaatgtacttccaccggcgggacctgcgtctcgctgccaacgcaatttgctctgccgtgcccgtcgattgggttcccacaagccgcacgacctggtccatacacgcgcaccaccaatggatgactaccgaagacatgctgtctgtttggaaccgcgtctggatagaagagaacccctggatggaggacaagacccacgtttcctcttggggcgacgtaccgtacttagggaaacgggaagaccagtggtgcggttcgctcatcggcctgaccgcgcgcgccacttgggcaagtaatatccaggtcgccatcaaccaggttcgcaggctgatcgggaacgagaactacctcgactacatgacctccatgaagcgcttcaaaaacgagggcgaccccgagggcgccctgtggtga

SEQ ID NO: 24317 - RNA, 9879 nt, synthetic construct
  misc_feature 1..9879: note = derived and/or modified CDS sequence (opt11) from DENV-1__GQ199803__SS-prME
  source 1..9879: mol_type = other RNA
tcggtcaccatgctcctcatgctcatgcccacggcattagcgttccacctaacgataagaggaggagaaccacacatgatcgtgtcgaaacaagaacggggcaagtcattactctttaaaactagcgcgggagtcaatatgtgcacgctaattgccatggatcttggcgaactgtgcgaagataccatgacctataagtgccccaggatcaccgaagctgaaccggatgacgtagactgctggtgtaacgcgaccgacacctgggtaacctatggaacgtgcagccaaaccggagaacataggagggacaagaggagcgtagcactagcaccacacgtcggcctcggcttagaaaccagaaccgaaacctggatgtcctctgaaggggcgtggaagcaaatccaacgggttgaaacctgggccttgcgccaccccggcttcacggtcatcgcattattcctagcacacgcgataggcacgagcattactcaaaagggaataatcttcatattactgatgctagtaactccgtccatggcaatgagatgcgtcgggattggctcgagggatttcgtcgaaggtctgtctggggctacgtgggtggacgtcgtactcgagcatggaagttgcgtcaccacaatggccaaggacaagccaacgttagatatcgagctcctgaagacagaagtaacgaatccggccgtacttcgaaaactatgcatcgaggctaagatatccaacactacaaccgactccaggtgcccaactcaaggagaggcaaccctagtagaagaacaagacgcgaacttcgtatgccggcgtacgttcgtcgaccgcggctggggcaacgggtgtggactatttggaaagggctcattaataacctgcgcgaaattcaaatgcgttacaaaacttgaagggaagatcgtccagtacgagaacctaaagtatagcgtgatcgtgacagtccataccggtgaccagcaccaggtgggaaacgaaagcactgagcatgggacgacagcaaccattacgccgcaggctccaacgaccgaaattcaactcacggactatggcgccctcactttagactgcagtccacgtactggactcgatttcaacgagatggtactcctcaccatgaaagaaaagtcctggctggtccacaagcagtggtttctcgatctgccactaccatggacatcaggagcaagcacatcccaagagacatggaaccgccaagacctgctagtaacgttcaaaaccgcccacgccaagaaacaagaagtggtggtactcgggagccaggagggcgcaatgcacacggcactgacgggcgctacagagattcaaacctcgggtacaacaacaattttcgcgggccacctcaaatgccgcctcaagatggacaagttaacactgaagggcatgtcgtacgtgatgtgcaccggatcgtttaagctagagaaggaagttgccgaaacccagcacggcaccgtcctcgtgcaaataaaatacgagggaaccgacgcaccgtgcaagatcccattctccacacaagatgaaaaaggcgtgacccagaatggaaggctgataacggcgaaccccatcgttaccgacaaggaaaaaccagtaaatatagaagccgaacccccgtttggcgaatcttacatagtaattggcgctggagagaaggccctcaaactgagttggtttaagaagggctcgagcatcggaaagatgttcgaggctacagcaagaggagcacgccgcatggccatactaggagataccgcgtgggacttcgggtcgataggcggggtgtttacgtcggttggaaagctcgtacaccaaattttcggtactgcctacggagtactgtttagtggcgtatcgtggacaatgaagatagggattggggtgctactgacatggcttggactcaacagtagatccacatcgctctccatgacctgcatagctgtaggcctagtgaccctttatctgggagttatggtccaggcagacagtggatgtgtaatcaattggaaaggacgagagttgaaatgcggaagcggaatttttgtaaccaacgaagtccacacatggacggagcaatataagttccaggctgacagccctaagagactgtcagccgcaatcgggaaagcctgggaggaaggcgtttgcgggatacgaagcgcgacgcgactagagaacataatgtggaaacagatcagcaatgaactaaaccacatcctacttgaaaacgacatgaagttaacggtggtagttggagatgtggctggcatactagggcaggggaaaaagatgatccgcccgcagcccatggagtacaaatactcatggaaaagctggggaaaagcgaaaattataggcgcggatgcccaaaacaccaccttcatcatcgacggccccaacacaccggaatgccctgatgaccagcgagcatggaacatctgggaggtagaggactatgggttcggaatcttcacgaccaacatctggctcaaactacgagacagctacacgcaagtgtgcgatcatagactcatgagcgctgcaataaaagacagcaaagccgttcacgctgacatgggatactggatcgagagcgagaaaaacgagacttggaaacttgcccgggcatcattcatcgaagtcaagacctgtatatggccgaaaagccacacattatggagcaatggggtgctagagagcgaaatgataattcccaaaatctacggcggccctatttcacaacacaactaccgcccaggatatttcacgcagaccgccgggccgtggcacctcggcaaactggagttggatttcgatctatgcgaaggcactacggtagtggtagacgagcactgtggaaaccgaggcccctcgctccgcacaaccacggttactggaaaaatcattcacgagtggtgctgtagatcgtgcactctacccccactgagattcagaggggaagacggatgttggtatggaatggagatccgacccgttaaagagaaagaggaaaaccttgtgaaatccatggtatccgcgggctcgggcgaggtggactcgttctcgctcggtctgctgtgcatctcgataatgatagaggaagtgatgcgaagtaggtggagccggaagatgctcatgacaggaacactcgcagtcttcttcctactaataatgggacaactcacctggaatgatctaatccgactatgcatcatggtaggcgccaacgcaagcgacaggatgggtatggggaccacttatctcgctctcatggctactttcaagatgcggcccatgttcgcggtcggtctcctcttccgcagactcacctcgcgggaggtactgcttctaaccataggcctaagccttgttgcctccgttgagctcccctcaagtttagaggagctcggggacggcctcgcgatgggaatcatgatactaaagctgcttacagacttccaatcacaccagctatgggcaacactactaagcctaacattcatcaaaaccgccttctcactacactacgcctggaaaacaatggcaatggtgctctccatagtgagtcttttccctctatgcctaagcactacatcccagaaaacaacgtggctgccggtgctgctaggatcactcggctgtaagccgctcaccatgttcctcatagcagagaacaaaatctgggggcggaagtcatggccgctcaacgaaggaataatggcagtcggaatcgtttccatcctcctatcatcattgctaaagaatgacgtaccactcgccgggcccttaatcgcgggaggcatgctcatagcctgctacgtcataagtggctccagcgccgatctgtcccttgaaaaagccgcggaagtctcctgggaagaagaagcagaacacagcggagcatcgcacaatatcctagtagaagttcaagacgacggcacaatgaagattaaggacgaagaacgcgacgacacactgacgatactacttaaagcgactttacttgctgtgagcggggtctaccccctgtcgattccagctacactcttcgtgtggtacttctggcaaaagaagaaacaacgatcaggcgttctgtgggacacaccctcacctccggaagtcgagcgtgcagttctcgacgatggcatctacagaattatgcaacgggggctcttaggaagaagccaagtaggagtaggggtgttccaagagaacgtattccacactatgtggcacgtcacacgaggagcagtcctaatgtaccagggcaagagactggaaccaagctgggcgagcgtcaaaaaggacctcatatcctacggaggtggatggcgactgaggggatcatggaacacgggagaagaagtccaagtaatcgccgtggagccggggaaaaatcccaaaaacgtacaaacagcgcctgggacattcaaaaccccggaaggggaggtaggggccatagcactcgacttcaaaccaggcaccagtgggagcccgatagtaaaccgagaaggaaagatagtaggcctctacggaaacggtgtggtgaccacaagtggaacgtacgtttctgccatcgcccaagccaaggcgagccaagaagggccgctcccagaaattgaagacgaagtttttcgaaaacggaatctaacaataatggatctacatccgggatcagggaaaactagacgctacctcccagccatcgtgcgagaagctataaagagaaaacttagaactctaatactcgcgcccacgagagtggtcgcctcggaaatggccgaggcccttaaaggcatgcccatcagataccaaacgacggccgtcaagtcggagcataccggtaaggagatagtagacctgatgtgccacgctacctttactatgagactactctcacccgtccgagtgcctaactacaacatgataataatggacgaagcccattttacagacccgagctctattgcagcacggggatatatatctacccgagtaggcatgggggaagctgcggcgatcttcatgacagcaacgccacccgggtcggttgaggccttcccacaatcaaatgctgtaatccaggacgaggaaagagatataccggaaagatcgtggaacagcggctatgaatggataacagacttcccaggaaaaaccgtgtggttcgtaccatccataaaaagcggaaacgacatcgcgaactgcctgcggaaaaatgggaaaagagtcatacaactctctcgaaaaactttcgacaccgagtaccagaaaaccaaaaacaacgattgggattatgtcgtaaccaccgacatctccgaaatgggagcaaacttccgcgccgacagagtaatcgatccacgacgctgtctgaagcccgtaatccttaaagacggccctgagcgcgtgatcctcgcggggcccatgcctgtgacagtcgccagtgcagcacagcgacgaggccgaatagggagaaatcacaacaaggaaggagatcagtacatatatatgggacagccactaaataacgacgaagaccacgcacattggaccgaagcaaaaatgctgctagacaacatcaacactcccgaggggatcataccggcgctgtttgagccagagcgtgagaaaagcgcggccgtagacggggagtaccgcttgcgaggcgaagcccgaaagacgtttgtagaacttatgagaagaggagacctaccggtatggctatcatacaaagtggcctcagaagggttccaatacagtgatcgaaggtggtgttttgacggcgaacgaaacaatcaggtacttgaggagaacatggacgtcgagatctggactaaggagggagaccggaagaagctgagacccaggtggctcgacgcacggacctactcagacccacttgccctccgagagttcaaagagttcgcagcaggcagacggagtgtaagcggcgacttaatcctagaaattggaaaactccctcaacacttgactcaacgggcacaaaacgctctggacaacctagtgatgctccacaacagcgaacaagggggccgggcatacaggcacgccatggaagaactgccggataccatagagacccttatgctcctcgccctaatagccgtactaactggaggcgtcacattgtttttcttgtcggggcgtgggctcggaaaaacgagcattgggttactatgcgtaatggcaagctcagtgctactgtggatggcaagcgtcgagccgcactggatcgctgcctcaataatactagagttctttctaatggtgctcctcatcccggagccagacagacaacgcacaccccaagacaaccaacttgcatacgtcgtgatcgggcttctctttatgatcttaacagttgctgccaacgagatgggtctacttgaaacgaccaagaaagacctaggcatagggcacgtcgcagtggagaaccaccaccatgctgccatgctcgacgttgacctgcaccccgcctcggcctggacactgtacgcggtggcaactacaatcataacaccaatgatgcgtcacacaatagaaaacaccacagcgaacatatctttaacggccatagcaaaccaggcagcaatcctaatgggcctcgacaaaggctggccgataagtaagatggacatcggagtgcccttgctagccctgggatgctatagccaggtaaatccgctcacccttacagccgctgtactaatgctagttgcgcactatgcaattattggtccaggactgcaagctaaggcaacgcgggaggcccagaaaaggacagcagcggggataatgaagaaccccaccgtggacgggatagtagctatagacctcgatccggtagtgtatgacgccaaattcgaaaagcagctcggacagataatgctattaatactctgcacgtcacaaatcttgctcatgagaacaacctgggctctctgtgaatcaataacactagccactggtccactaaccacactatgggagggatcacccggcaagttctggaatactacaatcgcagtgagcatggcgaacatctttcggggcagctacttggccggcgcgggattagccttcagcctaatgaagtcgttaggcggcggacgaaggggcactggtgcacaaggggaaaccctgggcgaaaagtggaaaagacagttaaaccaactcagcaaaagcgagttcaacacgtataagagaagcgggataatggaagtcgacaggagcgaagcaaaggagggcctcaagcgcggggagacgacgaaacatgccgtatcccgtggcactgcgaaattaagatggtttgtagaaaggaacctcgtaaaaccagaaggtaaggtaatagacttaggctgtgggcgaggaggatggtcatactactgcgcgggactaaagaaagtgacggaagtaaagggctacacgaaaggagggcccggtcacgaagaacccatccctatggccacatacgggtggaacttggtcaaactacactcaggtaaggatgtcttcttcatcccaccagaaaagtgcgacaccctgctttgtgacataggggaatcttcacccaacccgaccatagaagaaggtcgcacactccgagtcctgaagatggtagagccttggctccgcgggaaccaattctgcatcaaaattctcaacccgtatatgccatccgtagtagaaacgctcgaacagatgcaacggaaacacggcggcatgctcgtccgtaacccactatcgcggaacagcacacacgaaatgtattgggttagctgcggcaccgggaacatcgtcagtgcagtcaacatgaccagtagaatgctactgaaccgcttcaccatggcccaccgaaaaccaacatacgagcgcgacgtggacttaggaacgggaacacgacatgtggcggtcgagccagaggttgctaacttggacatcatcgggcaaagaatcgaaaacatcaaacatgaacacaagagtacctggcactacgatgaagacaacccatacaagacctgggcctaccatggatcgtacgaggtcaaaccgtcaggatccgcgtcatcaatggtgaacggggtcgtaaaattgctcacaaagccatgggacgtaatacctatggtcacacagatagcgatgaccgacacaacaccattcggacaacaaagagtgttcaaggagaaagtcgatacccgcacaccaaaggcaaaacgcggaacggcccaaataatggaagtcacagctagatggctatggggctttctaagtcgaaacaagaagccacgcatttgtaccagagaagagttcaccagaaaggtacgatccaatgcagcgatcggggcggtgttcgtggacgaaaaccaatggaacagtgccaaggaagcagtagaagacgaaaggttctgggacctggtacaccgggagagggagctacacaaacaggggaaatgcgcaacctgcgtatataatatgatgggaaaaagagagaagaaactaggggagttcggcaaagccaaaggttcccgagcaatttggtatatgtggttgggggcgagattcctagagttcgaagctctagggttcatgaacgaggatcattggttcagtcgtgaaaacagcctgagcggcgtggagggtgagggcttgcataagctcgggtacatcctgagagacatctcgaaaatacccgggggtaacatgtacgcagacgacacagcagggtgggacacaaggataaccgaagacgacctacaaaacgaggcaaagatcaccgatatcatggaacccgaacacgcactactcgccaaagctatatttaagttaacataccagaacaaagtcgtgcgggttcaacggcctgcaaagaacggcaccgtgatggacgtcatctccagaagggaccagcgcggatcaggacaagtgggcacatacggcctgaatacgtttacaaacatggaagcgcaactcattcgacagatggaaagcgaaggtatcttctctccaagtgagcttgaaacgccgaatttggcggagcgagcgttagactggctggaaaaatatggggtggagagactcaagcgcatggcaattagcggcgatgactgtgtagttaagccaatagacgatagatttgcgactgccctaacagcgctaaacgacatggggaaagtaagaaaagacatcccccagtgggaaccctcgaagggatggaacgactggcaacaagtacctttctgctcgcatcacttccaccaactcatcatgaaggatgggcgcgaaatcgtcgtcccatgccgaaaccaggacgaactcgtcggtcgggcacgcgtttctcaaggcgcaggatggagtttacgtgagactgcttgcctcggcaagtcatacgctcaaatgtggcagctaatgtatttccaccgacgcgatctgagattggcagcgaatgccatttgctcagccgtcccagttgactgggtaccaacgagtcggacaacatggagcatacacgcgcaccaccaatggatgactactgaagacatgctgagtgtatggaatagagtttggatagaagaaaacccatggatggaagataaaactcacatttccagctgggaggatgtaccttatctaggaaagagagaggaccaatggtgtggaagcctaataggtctaacggcacgcgccacttgggccaccaacattcaagtagctatcaaccaggtcaggcgcctgatcggcaatgagaattatcttgactacatgacctccatgaaaaggttcaaaaacgagtcagaccccgaaggcgcgttgtggtaa

SEQ ID NO: 24318 - RNA, 9879 nt, synthetic construct
  misc_feature 1..9879: note = derived and/or modified CDS sequence (opt11) from DENV-1__GQ199804__SS-prME
  source 1..9879: mol_type = other RNA
agcgtgaccatgctgctcatgttgatgcccaccgcactggcctttcacctcaccacgcggggcggggaaccccacatgatagtgagcaagcaggaacgcgggaaatcgctcctgtttaaaaccagcgccggcgtgaacatgtgtaccctcatcgcaatggacctgggcgaactctgcgaggataccatgacgtacaaatgtcccaggatcaccgaaaccgagccagatgacgtggactgctggtgcaacgccacggatacctgggtgacgtatgggacgtgcagccagaccggcgagcatcggcgggacaagcggtctgtggccctcgcgccacacgtgggattagggctagagacacggaccgagacatggatgagctccgagggcgcatggaagcagatccagcgtgtcgagacgtgggccctccgtcatcccgggtttaccgtgatcgccctattcttagcacacgtaatcggaacctctatcacacagaaaggaataatattcatcctcctgatgctggtcacaccctccatggcgatgcggtgcgttggaatcggcagccgcgacttcgtagaggggctctccggggccacgtgggtcgacgtcgtgctagagcacggaagctgcgtcaccacgatggcgaaggacaagcccacgctggatatcgagctcctgaaaaccgaggtcaccaaccccgcagtgctgcggaagctgtgcatcgaggccaaaatctccaacaccacgaccgacagccgttgcccgacgcagggcgacgccaccctagtcgaagaacaggacgcaaatttcgtgtgccggcgcacgttcgtggaccgaggctgggggaacggctgcgggctattcggcaaggggagcctcatcacgtgcgccaagttcaagtgcgtcaccaaactggaggggaagatcgtgcagtatgagaacctgaaatacagcgtgatcgttaccgtgcacacgggcgaccaacatcaggtcgggaacgagagcacggagcatggcacaacggccaccatcacgccacaggcccccaccaccgagattcagctcacggactacggtgctctcacgctggactgcagcccccgcaccggcctcgacttcaacgagatggtgttgttaaccatgaaggaaaagagctggctcgtgcacaagcagtggttcctggaccttcccctgccttggaccagcggggccagcacgtcccaggagacgtggaatcggcaagatctgctggtcacctttaagaccgcccacgccaagaagcaggaggtggtggtcttgggctcgcaggagggcgcgatgcacacggcgctgaccggcgctaccgaaatccagacatccggcacgaccacgattttcgcaggtcacctgaagtgccgactcaagatggacaaactgaccctgaaaggcatgagctacgtgatgtgtactggctccttcaagctcgagaaagaagtggccgagacccagcatggcaccgtcctggttcagatcaagtacgagggcacggacgctccctgcaagattcccttcagcacgcaggatgagaagggggtgacccagaacggccggctgatcaccgcaaacccgatcgtcaccgacaaggagaagcccgtgaacatcgaggccgagccgcccttcggagaatcgtacatcattatcggcgccggcgagaaagccctgaaactttcctggttcaagaagggatcgagcatcgggaagatgtttgaagcaacggcccgcggggcccggcgcatggccatattgggtgataccgcctgggatttcgggtccatcggcggggttttcacttcagtcgggaaattggtccaccagatcttcggtaccgcgtatggggtgttgttttccggcgttagctggactatgaagatcggaatcggcgtgctgctgacgtggttaggtctgaactccaggagcaccagtctgagcatgacctgtatcgcagtggggctcgtcactctgtacctgggcgtgatggttcaggccgactccgggtgcgttatcaactggaaaggccgggagctcaagtgtgggtcaggcatcttcgtgaccaatgaggttcacacctggaccgagcagtacaagttccaggcggactccccgaagcgcctgagtgccgcgatcggcaaggcttgggaggaaggggtctgtggcatccggagcgccactcgcctggagaacattatgtggaagcagatctccaacgagctcaaccacatcctcctggagaatgacatgaagttcaccgtcgttgtcggggacgtggctggcatcctagcacaggggaaaaagatgatccggccccaacccatggagtacaaatacagctggaagtcctggggcaaggcgaagataatcggtgccgacgtccaaaacacgacctttatcatcgacggtcccaataccccagagtgccccgacgaccagcgcgcctggaatatctgggaggtcgaggactacggcttcgggatcttcacgaccaacatatggctcaagctgcgggacagctacacccaagtgtgcgaccaccgcctcatgtccgccgctatcaaggacagcaaggccgtgcacgccgacatggggtactggatcgagtccgagaagaacgagacgtggaagctcgcccgtgccagcttcatcgaggtgaagacctgtatctggcccaagtcccacaccctgtggagcaacggcgtcctcgagtctgagatgatcatccccaagatctacgggggcccaatcagccagcacaactaccggcccgggtacttcacgcagacagcgggaccgtggcatctgggcaagctggagctcgacttcgacctgtgcgagggtacgaccgtggtcgtcgacgagcactgcggcaaccggggaccttcccttaggacaaccacggtaaccggtaagatcattcacgaatggtgctgccgaagctgcaccctgccgccccttcgctttagaggggaagacggatgctggtacggcatggagatccgccctgtgaaggagaaggaggagaacctggtcaagtccatggtgagcgccggcagcggggaggtcgactccttcagcctgggcttactgtgcatctccatcatgattgaggaagttatgcggagtaggtggtcccgcaagatgctcatgaccggcacgctggccgtgttcttcctgttaattatgggacagttgacttggaacgacctgatccggctctgcatcatggttggcgccaacgcctctgaccgcatggggatgggcaccacctacctggccctgatggctacgttcaagatgagaccgatgttcgccgtggggctactgttccgccggctgacctcccgcgaggttctccttttaaccatcgggctcagcctggtcgcatccgttgagctgccgaacagcttggaggagctgggcgacgggctggccatgggtattatgatcctcaaactcctcaccgacttccagtcccaccagctctgggccacactgctgtctctcaccttcattaagacaaccttcagtctgcactacgcctggaaaacgatggctatggtactgagcatcgtgtcgctattccccttgtgcctctctaccacgtcgcagaagaccacgtggctcccagttcttctaggctctctcggctgcaagccgctgaccatgttcctgatcgccgaaaacaaaatctgggggcggcgctcctggcccctcaacgaggggattatggcggtgggcattgtttccatcttactgtcttccttactcaaaaacgacgtgcccctggccggtcccctgatcgccggtggcatgctgatcgcgtgctacgttataagcgggtccagcgcggatctgtccctcgagaaagcggccgaggtaagctgggaggaggaggctgagcactccggcgcctctcacaacatcctggtggaggtacaggatgacgggacaatgaagatcaaggacgaggagcgggacgacaccctgaccatcctcctgaaggccacgctgctcgcggtctccggcgtgtacccgttgagcatccccgccactctgttcgtctggtacttttggcagaagaaaaagcaacgcagcggggtgctctgggatacccctagcccacctgaggtggaacgggccgtcctggacgacgggatctatcgcatcatgcagcggggcctactggggaggtcccaggtgggcgtgggagttttccaagagaatgtgttccacacaatgtggcatgtgacacgaggcgcagtcctcatgtaccagggtaaacgactggagccctcgtgggcctccgtgaaaaaggatctgataagctacggcggcgggtggcggctccagggatcctggaataccggggaggaagtgcaggtcatcgcggttgagcccggcaagaaccccaaaaacgtacaaaccgcccccggcaccttcaagacccccgagggcgaggttggcgccattgcgctggacttcaagccagggaccagcggttcccccatcgttaaccgcgaggggaaaatcgtgggcctttacggcaacggagtcgtgaccacctcaggaacctacgtgtccgccatcgcgcaggccaaagcctcacaggagggcccgctccccgagatagaggacgaggttttccggaagcgcaacctgaccatcatggatctacacccgggcagcgggaagacccggcgctatctcccggcgatcgtgcgggaggcgatcaagcggaaacttcgtaccctgatcctcgcccccacgcgggttgtcgcgtcggagatggccgaggcgctgaagggcatgcccatccgctaccagaccaccgcggttaagagcgagcacaccggtaaggagatcgtggacctgatgtgccacgccacgttcaccatgcgactcctctcgcccgtccgggtgccaaactacaacatgatcatcatggacgaggcccacttcaccgaccccagctccatcgccgcgcgggggtacatcagcactcgagtgggcatgggcgaggcggccgccatttttatgacggcaacgccgccaggctccgttgaggcgttccctcagtcaaacgcagtaatccaagacgaggagagagacatcccagagcgctcctggaacagcgggtacgagtggattaccgacttccccggcaagacagtgtggttcgttccttcgataaagagcggaaacgacatcgccaattgcctgcggaagaacgggaagcgcgtgattcagctctcccgaaagacattcgacaccgaataccagaagaccaagaacaacgactgggactacgtggtcactactgatatttctgagatgggcgccaacttccgcgccgaccgggtgatcgacccgcgtagatgcctgaagcccgtgatcctgaaggacgggcctgagcgcgtcatcctcgctggccccatgccagtaaccgtcgcctccgctgcacagaggcgcgggcggataggccgcaaccacaacaaggagggcgatcagtatatttatatggggcagcccctgaacaacgacgaggaccacgcgcactggaccgaggccaagatgctgctcgacaacatcaacacccccgagggtataatccctgccctattcgagccggaaagagaaaagagcgcagctattgatggggaatacagattgcgcggcgaagcccggaagacgttcgtagagctcatgcgccgcggagacctgcccgtgtggctgagttacaaagtggcgtcggagggattccagtactctgaccgccggtggtgttttgacggcgagcgcaacaaccaggtactcgaggagaacatggacgtagaaatctggaccaaggagggggagcggaagaagctgcgcccccggtggttggacgcccgcacctactccgaccccttggcccttcgggagttcaaggagttcgcagctgggcgccggagcgtctccggagacctgatcctcgaaatcggcaagctgccgcagcacctgacccagcgggcgcagaacgcgctcgacaacctggtgatgctgcacaacagcgagcagggcgggcgggcttaccgccacgccatggaggaactcccggacacgatcgagaccctaatgctgctcgcactgatcgctgtgcttaccggcggtgtgacgctattcttcctgtccggccgggggctgggaaaaaccagcattggactcctgtgcgtgatggcctccagtgttctgctctggatggcctccgtcgagccccactggatcgccgcgagcatcatcctggagttcttcttaatggtgctcctgatccccgagccggaccgccagagaacgccccaggacaaccagctggcatatgtcgtgatcggactcctgttcatgatcctgaccgtagccgccaacgagatgggcctcttggagaccaccaagaaagatctgggtatcggacacgttgccgtcgagaatcaccaccatgctgccatgctcgacgtggatctgcaccccgcttccgcgtggacgctgtacgcggtggcgaccaccattatcaccccgatgatgcgccacacaatcgagaacaccacggccaacatctcactcaccgccatagccaaccaggcggcgatactgatggggctggacaaggggtggcccatctctaagatggacatcggcgtcccattgctggccctagggtgttacagccaggtgaaccccctcacgttgactgctgccgtactgatgctagtcgcgcattacgccatcatcggcccggggctgcaagccaaggccacccgagaggcccaaaagcggaccgcggccggcatcatgaagaaccccacggtggacggtatcgtggccatcgacctggaccctgtcgtttacgacgccaagttcgagaagcagctcggacagatcatgctcctaatactctgcacctcccagatcttactgatgcgcaccacttgggctctctgcgagagcatcacgctggcgacaggcccactgaccacactctgggaagggtccccgggcaagttctggaacacgaccatcgccgtgagcatggccaatatcttccgggggtcctacctggccggcgccggtctggcgttctccttaatgaagtccctgggcggcgggcgccgggggaccggggcccagggcgagaccctgggagagaagtggaagcgtcagctcaaccagctctccaagagcgagttcaacacgtacaagcggtccgggataatggaggtggatcggtctgaggccaaggagggcctgaagcgcggggaaacgaccaagcacgctgtgtcccgcggcacggcgaagctaaggtggttcgttgagcgcaacttagtcaagcccgaggggaaggtgatcgatctgggctgcggcagaggaggctggagctactactgcgccgggctgaagaaggtgacggaggtcaagggctacaccaaaggcggtcccggccacgaagaaccaattccgatggccacctacgggtggaacctcgtcaaactgcactccggcaaagatgtgttcttcatcccacccgagaaatgcgataccctgctctgcgacatcggggaatcaagtcccaatccgacgatcgaggaaggccgaaccttaagagtactcaagatggtggaaccctggctccgcgggaaccaattctgcatcaagattctgaacccctacatgccgagcgtggtcgagaccctggagcaaatgcagcggaagcacgggggtatgctcgtgcgcaacccgctttcgcgaaattcaacccacgagatgtactgggtgtcttgcgggaccggcaacattgtcagtgccgtaaacatgacctcccgcatgctgctcaaccgctttactatggcccaccggaaaccgacctacgagcgagacgtggacctgggggcgggcacgcggcacgtcgcagtggagcccgaggtggccaacctcgacatcatcggccaacgcatcgaaaatattaaacacgagcacaagagtacgtggcactatgatgaagacaacccctacaagacctgggcgtaccatgggtcctacgaggtgaagccgagcggctccgccagcagcatggtgaacggagtcgtgaagctcctgaccaagccctgggacgtgatccctatggtcactcagatcgcgatgacggatacaacgccgtttggccaacaacgggtgtttaaggaaaaggtggacacccgcacgccgaaggccaagagggggaccgcccagatcatggaggtcactgccaagtggctgtggggcttcttgtcccgcaacaagaagccgcggatctgcacccgcgaggagttcactcgtaaggtgcgctccaatgccgctatcggcgctgtcttcgtcgatgagaaccagtggaactccgctaaggaggccgtcgaggatgagcgattctgggacttggtacaccgcgagcgggagctacacaagcaggggaagtgtgcgacctgcgtctataacatgatgggaaagcgcgagaagaagctcggggagttcggcaaggccaagggatcacgtgccatctggtatatgtggttgggcgccaggttcctcgagttcgaggccttaggcttcatgaacgaagatcattggttttcccgtgagaacagcttaagcggggtcgagggcgagggtctgcacaagctcggctacatcctgcgggacatcagcaagatcccagggggcaatatgtacgccgacgacaccgctggctgggacacccgaatcacggaggacgatctgcagaatgaagcccgcatcaccgacatcatggaaccggagcacgccctcttagcaaagtccatctttaagctgacctaccagaacaaggtggtccgggtgcagcgtcccgcgaaaaacgggaccgtgatggacgtcatcagccgacgggatcagcgcggctcggggcaagtggggacgtacggcctcaatacgttcaccaacatggaagctcagctaatcagacagatggagagcgaggggattttctccccctccgagctggagacccctaacctcgccgagagagtgctggactggttggagaagtacggcgtcgaacggttgaagcgcatggccatctccggggatgactgcgtggtgaagccgatcgatgaccggttcgccacggcgctgaccgccctgaacgacatgggcaaggtccgcaaggacatcccccagtgggagcccagtaaggggtggaatgactggcagcaggttcccttctgctcgcatcacttccaccaactcatcatgaaggacggccgggagattgtggtcccctgccgcaaccaagacgagctggtgggtcgagccagagtgtcgcagggagccggctggagcctgcgggagaccgcctgcctcggcaagtcctacgcgcagatgtggcagttgatgtactttcaccggcgagacctgcgcctcgctgctaatgcaatctgcagcgcggtccctgtagactggattcccacttcccggacgacgtggagtatccacgcccaccaccagtggatgaccacagaagacatgttatcggtatggaaccgggtctggatcgaggagaatccgtggatggaggataagactcacatcagttcctggggagacgtaccgtacctggggaagcgcgaagaccagtggtgcggcagcctcataggcctgacagcacgagccacctgggccaccaacatacaggtggccatcaaccaggtccgccggctgattgggaacgagaactaccttgactatatgacgtccatgaagcgctttaagaacgaatcggatcctgagggagctctatggtga

SEQ ID NO: 24319 - RNA, 9879 nt, synthetic construct
  misc_feature 1..9879: note = derived and/or modified CDS sequence (opt11) from DENV-1__GQ199805__SS-prME
  source 1..9879: mol_type = other RNA
agcgttaccatgctgttgatgctgatgcctacagccctggccttccatctcactacgagagggggcgagccccacatgatcgtgaccaagcaagaacggggcaagagcctcctgttcaagaccagcgctggggtgaacatgtgcaccctcattgcgatggacctgggggagctgtgcgaggacaccatgacctacaagtgtccccggataaccgaagccgagccggacgacgtggactgctggtgcaatgccactgacacctgggtgacttatgggacatgcagtcagacgggcgagcaccggcgcgacaaacggtcggtagcccttgctccacacgtggggttagggctggagacccgcaccgagacctggatgtccagcgagggtgcctggaagcaaatccaacgggtcgagacgtgggcacttcgccatcctgggttcaccgtgatcgccctgttcctggcacacgtaatcgggacctcaatcacccaaaagggcataatcttcatactcctgatgctagtcacgccctcgatggccatgcgctgcgtggggatcggctcccgagacttcgtggaggggttaagcggcgcgacctgggtcgacgtggtgttagagcacgggagctgcgtaaccacgatggccaaggataaacccaccctggacatcgagctcctgaagaccgaggtgaccaacccagccgtgctgcggaagctctgcatcgaggctaaaatctcaaacaccacaaccgactcccgttgccctacccaaggtgaggccaccctgatggaggagcaggatgctaacttcgtttgccggcgcacgttcgtggaccggggctgggggaatggctgcggtctgttcggaaaggggagcctcatcacatgtgcaaagttcaaatgcgtgaccaagctggagggcaagatcgtccagtacgagaacttgaagtactccgtgatcgtgaccgtccacacgggagaccagcaccaggtcgggaatgaaagcaccgagcacggcaccaccgccaccatcacaccccaggctcctacctccgaaatacagctcaccgactacggggccctgacactggactgttcacccagaacgggcctcgacttcaatgagatggtcctcctcacgatgaaggaaaaatcctggctcgtacacaagcaatggtttctggatcttccgctcccctggaccagcggggccagcacgtcgcaggagacgtggaaccggcaggacctgctggttaccttcaagaccgcccacgccaagaagcaggaggtcgtggtgctcggctcgcaggagggcgcaatgcacaccgccctgacgggggccaccgagatccagaccagcggcaccacgaccatcttcgccgggcacctgaagtgccgcctcaagatggacaaacttaccctgaagggaatgagttacgtcatgtgcaccggatccttcaagttggagaaggaggtagcagagacgcagcacgggaccgtgctggtccagatcaagtacgagggtaccgacgcgccctgcaaaatcccctttagcactcaggacgagaagggtgtgacgcagaacggccggctgatcacagccaatccgatagtaaccgacaaagagaagcccgtgaacatcgaggctgagccgcccttcggggagagttatatcgtgatcggcgctggcgagaaggcgctaaaacttagctggtttaaaaaggggagttctatcggcaagatgttcgaggccaccgcccggggagctcggcgcatggccatcttgggagacacggcgtgggattttgggtccatcggcggtgtgttcacctctgttgggaaactggttcaccagatcttcggtaccgcctacggtgtgctgttttccggtgtcagctggaccatgaaaatcgggctgggcgtgttactaacatggctcggccttaattcccgctcgacgtccttaagcatgacctgtattgctgttgggctggtcaccctgtacctcggtgtgatggtgcaggccgactctgggtgcgtaatcaattggaaaggtcgggagctaaagtgcgggagcgggatcttcgtaacgaacgaagtacacacctggacggagcagtacaagttccaggccgattcgccaaagcgcctgtccgcggccatcggcaaggcatgggaggagggggtctgcggcatcaggagcgccacccgactcgagaacattatgtggaagcaaatctccaacgaactgaatcacattcttctcgaaaacgacatgaagtttacggtggtggtcggcgacgtggtgggcatcctggcacaaggtaagaagatgatccggccccaacccatggagcacaagtacagctggaagtcctggggcaaggcgaagataattggagccgatgtgcaaaacacgaccttcatcatcgacgggcccaatacccctgaatgccccgacgaccagcgggcctggaacatctgggaagttgaggactacggatttggcattttcaccactaacatatggctgaaactcagggacagccacacccaggtgtgcgaccatcggctgatgagtgccgcaatcaaggactcgaaggccgtgcatgccgatatgggctactggatagaatccgagaagaacgagacctggaagttagccagggccagcttcatcgaggtgaagacctgcatctggcccaaatcccacacgttatggtcaaacggcgtgctggagtccgagatgatcatccccaagatctacggaggtccgatcagccagcacaactaccgtcccgggtacttcacccaaaccgcgggaccgtggcacctggggaagctcgaactggactttgacctgtgcgagggcacaactgtcgtcgtggacgagcactgcgggaaccgggggccgtccctccggaccaccaccgtcacgggtaagatcatccacgagtggtgctgccggtcttgcacgctgccgcccctgcgctttaagggggaggacggctgttggtacgggatggagatccggcccgtgaaggagaaagaagagaacctagtgaagtcaatggtcagcgcaggctcgggggaggttgatagcttcagcctagggttgctttgtatctctattatgatcgaagaggtgatgcgctcacgttggtccaggaaaatgctaatgacgggcacgctggccgtcttcctcctgcttataatgggacaattaacgtggaacgacctgacccggctttgtataatggttggagcaaacgcctcggaccgcatggggatgggcaccacatacctcgcattaatggccaccttcaaaatgaggccgatgttcgcggtaggcctcctgtttcgccgtttaacctcccgggaggtcctgctcctgaccattggtctgagcctcgtggcaagcgtagagctgcccaatagcctggaggaactcggagacgggctggctatgggcatcatgattctgaagctcctgaccgacttccagtctcaccagttatgggcgactctccttagcttgactttcattaagacgaccctctccctgcactacgcctggaagacgatggcaatggtgctgagtatcgtctccttattccccctgtgcctgtccactacctcccaaaagaccacgtggctacccgtgctactgggctcactcgggtgcaagccgctggctatgttcctgatcgccgagaacaagatctgggggagaaagagttggcccctcaacgaggggataatggccgtcggcgtggtctcaatccttctgagctccttactgaagaacgacgtgccactggccgggcccctcattgccggcggcatgctgatcgcctgctacgtgatcagtgggtcctcagcagacctgtctttggagaaagccgccgaagtgagctgggaagaggaggcggagcattccggcgcaagccacaacatcctggtggaggtgcaggatgacggcactatgaagataaaggatgaggagcgcgacgacactctgaccattctcctgaaggcgaccctgttagccgtctccggcgtgtacccgctgagcatccccgccacgcttttcgtgtggtatttttggcagaagaagaagcagcgttccggggttctgtgggacacacccagcccgcccgaggtggaacgggccgttctcgatgacggtatctaccgcatcatgcagcgcggcttactggggcgaagtcaggtcggcgtgggggtgttccaggagaacgtctttcatactatgtggcacgtaacccgaggcgcagtgctcatgtaccaggggaagcgcctggaacccagctgggcttccgtgaagaaagacctgattagctacggtggcgggtggcggctccagggctcctggaacacaggggaagaagtgcaggttatcgccgtagaacccggcaagaacccgaagaacgttcaaaccgctcctggtacctttaagacccccgagggggaggtgggcgccatcgccctggatttcaagcccggcactagcggaagcccaatcgtcaaccgcgaggggaagatcgtgggcctgtatggcaatggggtggtcacgaccagcgggacctacgtgagcgcgatcgcacaggccaaggcctcccaggaggggccgctccccgaaattgaggacgaggtgttccggaagcggaacctgacgattatggacctgcacccgggcagcgggaaaacccggcgctacctcccggcgatcgtccgtgaagccatcaaacgcaaactgcgaaccctgattctcgccccaacacgggtggtggcctccgagatggccgaagcgctgaagggcatgcccatccgctaccagactacagcagtcaagagtgaacatacgggcaaggagatcgtcgaccttatgtgccatgccaccttcacgatgcggctcctgtcgcccgtgcgcgtccctaattacaacatgataatcatggacgaggcccactttaccgaccccagctccatcgcggcgcgagggtacatcagcacaagggtgggcatgggagaagccgctgctatcttcatgacggccacgccgccaggctctgtggaggcgtttccgcagtcaaacgccgtcattcaggacgaagaacgggacatcccagaacgctcctggaacagcgggtatgagtggatcacggacttccccggcaaaaccgtatggttcgtaccctccatcaagtcagggaacgacatcgcaaactgcctgcggaaaaacgggaagcgagtgatacagctgtcccgtaagacgttcgatacggagtaccagaagacaaagaataacgactgggactacgtggtgaccaccgatatcagcgagatgggcgctaactttcgcgccgaccgggtaatcgacccgcgacggtgcttaaagcctgtgatactgaaggatggtccagagcgcgtaatcctcgccggccctatgcccgtgacggtcgcctccgcagcccagcggcgcggtcggattggcaggaaccacaacaaggagggggaccagtatatatacatggggcagcccttgaacaacgacgaagaccacgcgcactggacggaggccaagatgctgttagacaacatcaatacccccgagggcatcatcccggccctgttcgagcctgaacgggagaagtccgccgccatcgatggggagtaccgcctgcgcggcgaggcacggaagaccttcgtcgagcttatgaggcgcggggaccttcctgtgtggctgtcctacaaggtggcctctgagggcttccagtacagtgaccgccggtggtgcttcgacggggagagaaacaaccaggtactggaagagaatatggacgttgagatctggacgaaggagggggagaggaagaagctgcgtccccggtggctggacgcccgcacctactccgaccccctcgcgctgcgggagttcaaggagtttgccgccggcaggcgttcagtatccggtgaccttatcctcgagatcggcaagctgccgcagcatctgacccagcgcgcccagaacgccctcgataatttggtcatgttgcacaacagcgagcaaggaggccgggcctacagacatgctatggaggagttacccgacaccatcgagactctgatgttgctcgcgctgatagcagtgttgaccggtggagtgaccctcttctttttaagcggccgggggctgggaaaaaccagcatcggcctcctgtgcgtcatggcctccagcgtattgttatggatggcctccgtggagccacattggatcgctgccagcatcatcctggagttcttcctgatggtcctcctgattccggagccggaccgccagcggactccccaagacaatcagctggcctacgtggtcatagggctactcttcatgatcctgacagtagccgcaaatgagatgggtttactggagaccaccaagaaagacctggggattggccacgttgcggtggaaaaccaccaccacgcgaccatgcttgacgtcgacctgcatcccgcctctgcatggacgctgtatgcggtggccaccaccatcataaccccgatgatgaggcacaccatagagaacaccaccgcgaacataagcctcaccgccatcgccaaccaggccgctatactgatggggctggacaagggctggcccatttccaagatggacatcggcgtccccctcctggctctcgggtgctatagccaggtcaacccattgaccctgacggccgccgtgctgatgctcgtggcgcactatgcaatcatcggcccgggactgcaagccaaggccactcgcgaggcccagaagcgcactgcggccggcatcatgaagaatccaacggtggacggaatcgttgccatcgatctcgacccagtggtgtacgacgccaagttcgagaagcagctaggccagatcatgctgttgattctctgcacctcccagattctgcttatgcgcaccacctgggccttgtgtgagagtattacgttggccaccggccccctgaccaccctctgggaggggtccccggggaagttctggaacacgaccatagccgtgtcgatggcgaacatcttccgaggctcctacctagctggcgccggcctggcgttcagccttatgaaatccctcgggggaggccgcagagggactggggcccagggcgagaccttgggcgagaagtggaagcgccagctgaaccagctgagtaaaagcgagttcaacatctacaagcggtccggtatcatggaggtagacagatctgaggccaaagagggcttaaagcgcggggagactacccgccatgccgtctcccgaggtaccgcgaagctgaggtggttcgtggaaaggaacctcgtgaagcccgaggggaaggtaatcgacctgggctgcggccgcggtggctggagctactactgtgcggggctcaagaaagtcaccgaggtgaagggttatacgaaaggagggcctggccacgaggaacctatccccatggccacctacgggtggaacctcgtcaagttgcacagtggcaaggacgtatttttcactccgccggagaagtgcgacactctgctctgcgatatcggggagagctccccgaatccgacgattgaggagggacggaccctgcgtgttttgaagatggtcgagccctggttacgggggaaccagttttgcatcaaaatcctgaacccctacatgccctcggtggtggagacgctggagcagatgcaacgcaagcacgggggtatgttagtcaggaacccattgtcacgcaacagcacccatgagatgtattgggtctcctgcggtacaggtaacatcgtgtcggccgtcaacatgacatcgcgaatgctgctcaatcgcttcaccatggcccaccgaaagcccacgtacgaacgggacgtcgacttgggtgcgggcacccgccatgttgctgtcgagcccgaggttgccaacctcgacatcattggtcaacggatcgagaatatcaagcacgagcataagagcacgtggcactacgatgaggacaacccatacaaaacctgggcctatcacgggtcctacgaggtaaaaccgagcggctccgcatcaagcatggtgaacggagtggtaaagctccttacgaagccctgggacgtgatccccatggtgacccagatcgcgatgacggataccactcccttcggtcaacagagggtcttcaaggaaaaagtggacacccggacgccgaaggcaaagagagggaccgcccagataatggaggtgaccgcccggtggctgtggggctttctctcccggaacaagaagccgaggatctgcacccgcgaggagttcacgaggaaagtccgctcaaacgccgccatcggcgccgttttcgtggacgagaaccagtggaacagcgcaaaggaagcagttgaggacgaacgtttctgggatctggtgcaaaaggagagagagctccacaagcagggcaaatgcgcgacctgcgtgtacaacatgatggggaaacgggagaagaagttaggcgaatttggtaaagccaaagggagcagggccatctggtacatgtggctgggggcccggttcctggagttcgaagccctcggcttcatgaacgaggaccactggttctcgcgcgagaacagcctgtctggggtagagggcgaaggacttcacaagctcggatatatattgcgggacatctccaagatccccgggggcaacatgtatgccgacgacaccgccggctgggacacccggataacggaggacgatctgcagaacgaggctcggatcactgacatcatggagccggagcacgccctcctggccacttccatatttaaacttacgtaccagaacaaggtggttagggtccaacgccccgcaaagaacggtactgtgatggatgtcataagcaggagggaccagcggggaagtgggcaggttggcacgtacggcctaaacaccttcacgaatatggaggcccagctgattcgccaaatggagagcgaaggaatttttctgccctccgagttggagacccagaacctggcggagcgggtgttggactggcttgaaaagtacggcgtggagcggctgaagcggatggccattagcggggacgattgcgttgtcaagcccatcgacgacaggtttgcgacagcgctaaccgccctcaacgatatgggcaaggtacggaaggatattccacagtgggagccctcgaaggggtggaacgattggcaacaagtgcctttctgctcccaccacttccaccaactgatcatgaaggacggacgcgaaatcgtggtgccctgccgcaaccaagacgagctggtcggcagggcccgggtgtcccagggggccggctggtccctccgcgagaccgcctgcctcggcaagagttacgcgcagatgtggcagctgatgtacttccaccggcgcgacttgcggctggcggccaacgccatctgctccgcggtaccagttgactgggtgcccacaagccggaccacctggtccatccatgctcaccaccaatggatgaccactgaggatatgttgagcgtctggaaccgtgtctggatcgaggagaacccctggatggaggacaagacccacgtgtcaagctggggcgatgtgccatacctcgggaaacgtgaggaccagtggtgcggctcgctgatcggactgaccgcgagagctacctgggctagcaacatccaagtcgccatcaaccaggttcggcgcctcatcggaaacgagaactacctggactatatgactagcatgaagaggtttaagaacgaaggagacccggagggggccctttggtga

SEQ ID NO: 24320 - RNA, 9879 nt, synthetic construct
  misc_feature 1..9879: note = derived and/or modified CDS sequence (opt11) from DENV-1__GQ199806__SS-prME
  source 1..9879: mol_type = other RNA
tctgtaacaatgctcctcatgctaatgcccaccgcgctcgcattccacctcaccacccgggggggcgagccccacatgatcgtatcaaagcaagaacggggcaagagtctattgttcaagaccagcgcaggggtcaacatgtgcacactgatagcgatggatcttggcgagttttgcgaggataccatgacatacaagtgccctcgaataaccgaagcggagccagacgacgtcgattgctggtgcaatgctacggatacctgggtaacatacggtacctgctcccagaccggcgaacacagaagagacaaacggagtgtagccctggcaccccacgtgggactgggacttgaaacaagaacggaaacctggatgagctccgaaggagcttggaaacagattcaacgagtagaaacttgggccctgagacacccaggatttactgtaatcgcgttgtttttagctcacgcgatcgggacgagcatcacacaaaaggggattattttcatactgctaatgctcgtaacaccgtccatggccatgcgctgcgtagggatcgggagccgagactttgtagaagggctgagcggcgccacatgggtcgacgtagtactagagcacggctcatgcgtgaccacaatggcgaaggacaaaccaacgctcgacatagagctcttgaaaacggaggtcacaaaccccgcaatactccgaaaactgtgcatagaagccaaaatcagcaacacaacaacggatagtagatgcccaacccaaggcgaagccacgctagtagaggaacaggacgctaattttgtctgcagaagaaccttcgtcgaccgaggctggggaaacggctgtggactatttggcaaaggaagcctaatcacatgtgcaaaattcaagtgcgtcacaaaactggaggggaagatagtacagtatgagaatctcaagtacagtgtcatagtcacagtgcacacaggcgatcagcaccaggtgggaaatgaatcgacagagcacggaacgacagcgacgattacgccacaagcacccagcacggagatccaactaaccgactatggggccctgacattggactgtagtccgagaacgggacttgacttcaatgaaatggttctgctaaccatgaaggaaaaaagctggttagtccacaaacaatggttcctcgatctcccgctgccatggacttccggtgcatcaacgtcgcaggagacatggaatcgcaaagatctactggtgacgttcaaaaccgctcacgcgaaaaaacaggaagcagtggtccttgggagccaagaaggcgcgatgcacaccgccctaaccggtgccactgaaatccagacctccggtactaccaccatctttgcgggccacctgaaatgccggctgaaaatggataaactcacactcaaaggaatgtcatacgtcatgtgcacaggttcgttcaaactagaaaaagaggtagccgagacccaacacggaacggtacttgtccagataaaatacgaaggcacggatgcgccctgcaagataccgttcagcacccaggatgagaaaggggtaacgcagaacgggcgcctcataactgccaacccaatcgttacagacaaggagaagccggtcaacatcgaagcggaaccccccttcggagaatcgtatatcgttataggagcgggagaaaaggccctaaaactaagttggttcaagaaaggatcaagtatcggcaagatgtttgaagccacggctcgtggagccagacgaatggccatcttgggagacaccgcgtgggactttggcagcataggtggagtcttcacatccgtgggaaagttagtacatcaaatattcggaacagcatacggggtccttttcagcggtgtaagttggacaatgaaaattggaattggggtgctgctaacctggctcgggctaaactcccgatcgacttctctaagcatgacatgcatagtggtcggcttagttactctctacctgggagtgatggtccaggccgattctggttgcgtgataaactggaaggggcgcgaactcaagtgtggcagcgggatatttgtcacgaacgaagtccacacatggaccgaacaatacaagttccaagccgattcccctaaacgactgtccgcggcaatcggtaaggcttgggaagaaggagtctgtggaataagatctgccacccgcctggaaaacataatgtggaaacagatttcaaatgaactaaatcacatactactagaaaatgacatgaagtttaccgtagtagtcggagatgtcgcgggaatcctcgctcaaggcaaaaagatgatccgcccccaaccaatggaatataaatactcgtggaagtcatgggggaaagcgaagattatcggcgcagacgtccaaaacaccacctttattatcgacggccccaataccccagaatgtcctgacgaccagagggcatggaacatctgggaagtcgaggactatgggtttgggatctttacaacaaacatctggctcaaattgcgcgactcgtacacccaggtctgcgaccaccgactgatgagtgccgccataaaagacagcaaagcagtacacgccgatatgggatattggatagagtccgagaaaaatgagacctggaaactcgctcgggcgtccttcatagaggtaaaaacatgtatatggccaaagagccacacactgtggtccaatggagtactcgaatctgagatgataattcctaagatttacgggggaccaataagccaacacaactatcgaccggggtacttcacacaaacggcggggccatggcacctgggcaaactggaattagactttgatctatgcgaagggacaacagtcgtagttgacgagcactgcggcaacaggggtccctccctccggaccaccactgtcacagggaagataatccacgaatggtgctgtagatcatgcactctgccaccactgcggttcaaaggcgaggacggctgctggtacggcatggagattcgaccagtgaaagaaaaagaggaaaatttggtaaaaagcatggtctccgcggggagcggtgaggttgacagtttcagcctcggactcctctgcatttcgatcatgattgaagaggtgatgcggtcaaggtggagccgaaagatgctcatgactggtacccttgcagtgtttttcctgctcatcatgggccagctgacgtggaacgacctaatccgattatgtatcatggtcggcgcgaacgccagtgaccggatgggaatgggcacaacataccttgcactaatggccaccttcaagatgcggccaatgttcgcagtcggactcctatttagaaggctcacgtcacgagaagtgctgcttctaactatcggcctgagcctcgtcgcgagcgtcgagctcccaaactccctggaagaactaggagacgggctcgcaatgggtataatgatattgaaactcttgaccgattttcagtcacaccagctatgggcaacgctgttgagcttgactttcatcaagaccacgttctcactccattacgcctggaaaacaatggccatggtcctgtcgatagtcagtctctttccactatgcctcagcacaacttcgcagaaaacaacatggctaccggttctcctgggaagcctcggctgcaaacccctaacgatgttcttgatagccgagaacaaaatctggggtcggaaaagctggcctctcaacgaaggaatcatggctgtcgggatagtgtccatactcctgagctcacttctgaaaaatgacgtaccattggccggcccgctcatagcaggcggcatgctgatcgcgtgctatgtcatatcagggtcatcggccgacctatctctagagaaggccgccgaagtcagctgggaggaagaagccgagcatagcggcgcatcccataatatcctagtggaagtacaagacgacggaaccatgaagattaaggacgaagagagagacgacaccctgacaattctactcaaagccacattattggcagtcagtggcgtgtaccccctgtcaatacccgcaacactatttgtctggtacttctggcagaagaaaaaacagcgatcaggcgtgctctgggacacgcccagccctccggaggtagaaagggcagtactagacgacggcatatacaggataatgcagaggggccttctaggaaggtcccaggtcggggtcggcgtcttccaagaaaatgtattccatacaatgtggcatgtgacacgcggtgcggtactaatgtaccaaggcaaaaggctcgaaccctcctgggcatctgtaaagaaggatctcatatcatatggaggtggatggaggctgcaggggagctggaacaccggggaagaagtacaagtgatcgcggtggaaccgggaaagaaccccaaaaacgtccagacagcacccgggacgtttaaaacatcggaaggagaagtcggggcgatcgccctggacttcaagccaggcacctcgggtagcccgatcgtaaaccgcgaaggcaaaattgtcggactctacggcaacggggtggtgactacgagcggcacctatgtcagtgcgatagcgcaggcgaaagcctcccaggacggacctctaccggaaatagaggacgaagtattcagaaagagaaaccttaccattatggacctgcacccaggatcagggaaaaccagacgatatctacccgcaatcgtgagagaagcgattaaacgcaagcttcgcacattaatactagctcctacccgtgtggtagcctccgaaatggctgaggctctcaagggcatgcccatcagatatcagaccacagccgtcaaaagcgaacacacaggaaaggaaatcgtcgacctcatgtgccacgctacctttacaatgcgcctcctcagtcctgtccgagtccccaactataacatgataataatggatgaagcgcactttacagaccccagctcaatcgccgcgcggggatacatatcgacgagagtcggcatgggggaagccgccgccatatttatgaccgcaacacccccaggatcggttgaggcattcccacagagcaacgcagtaatccaagacgaagaacgcgacatacctgaacggtcgtggaacagcggctacgaatggatcaccgactttccaggcaaaaccgtctggttcgtgccgagcataaaaagcgggaatgacatcgccaactgtctgaggaaaaatgggaaaagagtgattcaactcagtcgcaaaacattcgacaccgagtaccagaaaaccaagaacaacgattgggactatgtcgtaactactgacattagcgaaatgggggcaaatttcagagcggatcgcgttatcgatccccggcgttgcttgaaaccggtaatcctcaaagacgggcctgaacgggtaatcttagcaggccctatgcccgtaacggtggcctcagccgcgcaaaggagagggcgaataggcaggaaccataacaaagaaggggaccaatatatttacatgggtcagcctctgaataatgacgaggatcacgcacattggacagaagccaaaatgctcctagataacataaacacacccgagggaatcataccagcactgttcgagcccgagcgcgaaaaatcggcagccatcgacggggagtaccgcttgagaggagaggcacgcaagacattcgtggagctcatgcgccggggagacctgcccgtatggctgtcttacaaggtagcatcagagggctttcaatattccgatcggcgctggtgcttcgacggcgagcggaataaccaagttctagaggaaaacatggacgtagaaatctggacgaaggagggagagcggaaaaagttgagacctaggtggttggacgccaggacgtatagtgacccattggcactgcgcgaatttaaggaatttgcagcagggaggcggtcggttagcggcgacctaattctggagatcgggaagcttcctcaacacctgactcagcgagcgcagaacgcactcgataacctcgttatgcttcacaatagcgagcaaggcggaagagcgtaccgtcacgccatggaagaactcccggacaccatagaaaccctaatgctgctcgcgcttattgcagtccttaccggaggagtgactctgttttttcttagcggacgcgggttagggaaaacaagtataggtctcctctgtgtaatggcctcttctgtcctgctatggatggcatccgttgaaccgcattggatcgctgcgtcgataatattagaattcttcctaatggttctcctaattccagagccagatcggcaacgcacaccccaggataatcaacttgcctacgtggtaataggcctactattcatgatactcaccgtggcagcgaatgaaatgggcttgctagaaaccacaaagaaagacctgggtattgggcacgttgcagtagagaaccaccaccatgcagccatgctggacgtcgacctgcacccagcctcagcctggaccctatacgcagtcgcaaccacgataataaccccgatgatgcgtcataccatagagaacaccaccgccaatatatcgctgacggcaatagccaaccaagccgcgatacttatgggcctggacaaaggttggcctatttccaaaatggacatcggcgtcccattattagcactagggtgctacagccaggtaaacccactaacactgacggcggcagtattaatgttagtggcccattacgcaataatcggtcccggactccaagctaaggcaacacgggaggcccagaaacgaaccgccgccggaataatgaaaaaccccaccgtggacgggatagtcgctatagaccttgatccggtggtttacgacgccaaatttgagaaacagctagggcaaataatgctcctgatactgtgtaccagccagatcttgctaatgcgtactacctgggccctatgtgagagtataacccttgcgactggcccgttgacgacgctatgggagggcagcccaggaaaattttggaatacaacgattgcggtgtcgatggcgaacatattcaggggctcttacctggcaggggcgggtctcgccttctcactcatgaagtcgctcggaggtggcagacggggcacgggggcacagggcgaaacccttggagaaaagtggaaacggcaactcaaccaactaagcaaaagtgagttcaatacctacaaacgcagcggaataatggaagtggacaggagcgaggcaaaagagggactgaaacggggtgaaactaccaaacatgcagttagcaggggcaccgcaaaactacggtggtttgtggaaagaaacctggtaaaaccagaaggaaaggtaatagacctcgggtgtggacgtggaggttggagctactattgtgcgggattaaaaaaagtcacggaagtgaagggatacaccaagggcggtccaggccatgaggagcctatacccatggccacgtacggatggaatctggtaaaactgaactccgggaaagacgtgttctttataccgccagagaagtgcgacacgctcctgtgcgatataggcgaaagttcacccaacccgacgatagaggaagggcgcaccctgcgtgtgcttaaaatggtagaaccatggctaagaggcaaccagttctgcatcaagatcctgaatccatacatgccaagcgtggtagagacactagaacaaatgcaacggaagcacggggggatgctggtacgcaacccactctcaaggaactctacacatgaaatgtactgggtgtcatgtgggactggaaacatcgtcagcgctgtcaatatgacaagccgaatgttgctaaaccggttcaccatggcacacagaaagcctacttacgaacgggacgtggatcttggggcgggcaccaggcacgtcgcggtagaaccagaagtagccaatttagacataatagggcagcgaatcgaaaacatcaaatacgagcacaagagcacatggcattacgacgaagacaacccatacaagacctgggcctaccacgggagctacgaagtcaagccgtcaggctctgcgagcagcatggtcaacggtgtcgttaagctactcacaaaaccatgggacgtaatacccatggtgacccagatagcaatgaccgatactacgccattcggacaacaacgcgtcttcaaggaaaaggttgacacccgcacaccaaaagccaagcgaggcacagcccaaataatggaggtgacggccaagtggctgtggggtttccttagccgaaataagaagccacgaatctgcacgagggaggagttcacaagaaaggtacgcagtaacgcggccattggggctgtcttcgtagacgaaaaccaatggaactccgccaaagaagccgtagaggacgaaagattctgggacctcgtccacagagaaagagaactgcacaaacaagggaaatgcgcaacatgcgtctataacatgatgggaaaacgcgaaaaaaaactaggggaattcggtaaggcgaagggaagcagggcgatctggtacatgtggctaggagcaagattcctagagtttgaagcgctgggtttcatgaatgaggaccactggttttcacgtgagaacagcctaagcggcgtagaaggagaaggactgcataagctggggtacatcctacgggatatctccaaaatcccggggggcaacatgtacgcagacgacaccgcgggctgggacacccgaattacggaagacgacctacaaaacgaagctaagattaccgatattatggagccggaacatgcactgcttgccaagtctatcttcaaacttacctatcaaaacaaggtagtcagagtccagaggccagcaaagaacggcacagtcatggacgtcatcagccgccgggatcaacggggaagcggacaggtcggtacatacggcttgaacacattcacaaatatggaagcccaacttatacgacagatggagagcgaaggaatatttagcccaagcgagcttgaaacacccaatctggcagggcgagtcctcgactggttagagaagcacggcgtggagcgcctaaaacgcatggcaatcagcggggatgattgcgtggttaagccaatcgacgacaggttcgcaactgcactaaccgcgctaaacgacatggggaaggtgcgcaaggacataccccagtgggagccctcaaaaggctggaatgactggcagcaagtcccattttgctcgcatcacttccatcagcttataatgaaggatgggcgcgagatcgttgtcccgtgccgtaaccaggacgagctggtcggtcgggcgagggtgagtcaaggcgccggctggagtctcagggaaacagcctgcctaggaaagagctacgcacaaatgtggcagctgatgtacttccatagaagagatctacggctcgcagcaaatgccatctgttcggcagtgccagtagattgggtccctacgtcccgaacaacctggagcatccacgcccaccaccagtggatgacgacggaggacatgctgtcagtatggaaccgggtctggatagaagaaaacccctggatggaggataaaacacacatctcaagctgggaagatgtaccataccttggcaaacgcgaagaccagtggtgcggcagcctgataggcctgactgcaagggccacgtgggccacaaatatacaggtcgccattaaccaggtgcggcgcctcatagggaacgaaaactacctcgactacatgactagcatgaagagatttaaaaacgagagcgacccagaaggcgcactgtggtga

SEQ ID NO: 24321 - RNA, 9879 nt, synthetic construct
  misc_feature 1..9879: note = derived and/or modified CDS sequence (opt11) from DENV-1__GQ199809__SS-prME
  source 1..9879: mol_type = other RNA
tcggtgactatgttgctcatgttgatgcccacagccctggcgttccatctcaccacccgtggcggggagccccacatgatcgtaaccaagcaggaaaggggcaaatcccttctgttcaaaaccagcgcgggggtgaacatgtgtaccctcatcgccatggatttgggtgagctgtgcgaggacaccatgacctacaagtgtccccggatcaccgaggccgagcccgacgacgtggactgttggtgtaacgccactgacacctgggtgacgtacgggacctgcagccagaccggtgaacaccgcagggacaaaagaagcgtcgctctcgcgccacacgtcgggctggggctggagactcgcaccgagacctggatgtcgagcgagggtgcctggaagcagatccagagggtggaaacttgggctctccgccaccccgggttcaccgtgattgctttattcctggctcacgcaatcgggactagtatcacccagaaggggatcatattcatcctactcatgttagtaacaccaagcatggccatgcgttgcgtgggcatcggctcgcgcgacttcgtagagggcttgagcggagccacgtgggttgatgtcgtactggaacacgggtcctgtgttaccaccatggccaaagacaagcctacgctcgacatcgaactcttaaagactgaagttaccaacccggcggttctgcggaagctctgcatcgaggccaagataagcaacactacgaccgactcccgctgtccaacccagggtgaggccaccctgatggaggagcaggacgccaacttcgtgtgccgtcgaaccttcgtcgaccggggctgggggaacgggtgtgggttgttcggcaagggttctctcatcacatgtgcaaagttcaagtgcgtcacgaagttggagggaaaaattgtgcaatacgagaacctgaaatactccgtgatcgtgaccgttcacacgggcgaccagcaccaggtcgggaatgagagcaccgagcacggaaccacagcgaccatcacgccccaagcccccacttctgagatccagctcactgactacggtgccttaaccctagattgctccccacgaacaggcctagactttaacgaaatggtattgctgaccatgaaggagaagtcttggctcgtccacaagcagtggttcctcgacctgcccttgccctggacctccggggctagcacgtcccaggagacctggaatcggcaagacctcctggtcacctttaaaacagcgcatgctaaaaaacaggaagtggtcgtgctcgggagccaggagggggccatgcacacggccttgacgggggctacggagatacagacctccggcaccaccaccatattcgccgggcacctgaagtgccggttaaagatggacaagctgacactgaaaggcatgtcctacgtgatgtgcactggatcctttaagttggagaaggaagtagcggagacacagcatggcacggtgctggtgcagatcaaatatgagggcaccgacgcaccatgcaaaatccccttctctacacaggacgagaagggggttatccagaatgggcggctgatcacggccaacccgattgttaccgacaaggagaaaccggtaaatatagaagccgaaccgcccttcggggagtcatacatcgttatcggagtgggcgagaaggcgctgaagctcagctggttcaaaaaagggtccagcatcggcaagatgttcgaagccaccgcacgcggagcccggcgcatggccatcttgggcgacaccgcgtgggacttcgggtccatcggaggcgtgttcacgtccgtcgggaagctagtccatcagatatttgggacagcctatggggttctgttcagtggcgtctcgtggacgatgaaaatcggcatcggcgttctcctgacctggttgggcctgaactcccgcagcacgtccctgagtatgacatgcatcgccgtggggctcgttacactgtatctgggcgtgatggtgcaggccgactcaggatgcgtcatcaactggaaagggcgggaactcaaatgcgggagcggcatcttcgtgacaaacgaggtgcacacttggactgagcagtacaagttccaagccgactctccgaaacgcctgtccgctgcaatcggcaaggcctgggaagaaggcgtgtgtggcatccggtcggtaacacgcctggagaacattatgtggaaacaaatatccaacgagctcaaccacatcctgctggagaacgacatgaagtttacagtcgtcgtgggcgacgtggtcggcatactcgcccaaggaaagaaaatgatccggccccagcctatggagcacaaatatagctggaagtcgtggggcaaggcgaaaatcatcggtgcggacgtacagaacaccacgtttatcatcgacggccccaataccccggagtgccccgacgaccagcgcgcctggaacatatgggaggtggaggactacggcttcggaatctttaccaccaacatctggctaaagctgcgggacagctacacccaggcgtgcgatcaccgcctcatgtccgcggccatcaaggattcaaaagccgtccatgccgacatgggctactggattgagtccgaaaagaacgagacttggaagctcgcccgggcctcgtttatcgaggttaagacctgcatctggcccaagtcccatactctatggagcaacggtgtgctcgagtccgagatggttatccccaagatctacggtggccccattagccagcacaactaccgccccggctacttcacacagaccgcaggcccctggcaccttgggaagctggagctcgattttgacctgtgcgaaggcaccacagtcgtggtcgacgagcactgcgggaaccggggaccgtctctacgcacgaccacagtgactggaaaaatcatccacgagtggtgctgccgtagctgcactctgcctcccctccgcttcaaaggcgaggacggatgctggtacggaatggaaatccggcccgtgaaggagaaggaggagaacctggtaaagtccatggtgtccgccggctcgggcgaagttgattcgttcagccttggtctcctgtgcatctcaattatgatcgaggaggttatgcgaagccggtggtcccgcaagatgctcatgaccggcacgttggcagtgttcctgttgctgatcatggggcaactgacctggaacgacctcatccgactgtgcatcatggttggtgccaatgctagcgacagaatggggatgggcacgacctacctggcgctcatggcaaccttcaagatgcgccctatgttcgccgtcgggctgctattccgccgactcacctcccgggaggtgctgctactgacaatcgggctgagccttgtcgcatccgtagagctgcctaacagcctggaggagttaggcgacgggctcgccatgggcataatgatcctgaagctgcttaccgactttcagtcccatcagctgtgggctacactgctcagcctgaccttcataaaaaccacactaagtttgcactacgcctggaaaaccatggccatggtgcttagcatcgtttctctgttcccgttatgcctgagcaccacatcccagaagaccacctggctgccggtgctcctgggatcactgggttgcaagccgcttacgatgttcctgatcgccgagaataagatctggggtcgcaagtcctggcccctaaacgaggggatcatggccgtgggcgtcgtgagcatccttctgagctcattgctcaaaaacgatgtgcccttggcggggcccctgattgccggcggtatgctgatcgcatgctacgttattagtggatccagcgccgacctgtcactagagaaggcggccgaggtcagctgggaggaggaggccgagcattccggcgccagtcacaacattctcgttgaggtacaagacgacggaacaatgaaaatcaaagacgaggagcgagatgataccctgacaatcctgctcaaagccaccctgctggcggtgtccggcgtgtatccgctaagtatacctgcgaccctgttcgtctggtacttctggcagaagaagaaacagcgctctggcgtgttatgggacacgcccagcccgcccgaggtggagcgggcagtcctggacgacggcatttaccgcataatgcagcggggcctcctggggcgcagccaagtgggagtgggggttttccaggagaacgtgttccatacaatgtggcacgtgacccggggagcagttctgatgtaccaaggcaagcgactcgaacccagctgggcgagtgtgaagaaggacctgatatcatatggaggcgggtggcggctgcagggctcctggaatacgggggaggaggtccaagtcatcgcggtagagcccggcaagaacccaaaaaacgtgcagacggcccccggtaccttcaaaactccggagggcgaggtcggagccattgccctcgacttcaagcccgggaccagcggatcccctatcgtaaaccgtgaggggaagatcgtgggtctgtatggcaatggggtagtgacgacgtccggaacctacgtgagcgccatcgcgcaggccaaagcatcccaggagggcccactgcccgagatagaagacgaggtctttagaaagcgtaatctcaccataatggacctccaccctggcagcgggaagactcggaggtacttaccagcgatcgtgcgagaagccatcaagcgaaagctccggaccttgatccttgccccgacgcgcgtggtggcgtcagagatggccgaggcccttaaaggcatgccgatccgctaccagaccacggcggttaaaagcgagcacacaggcaaggagatagtggacctgatgtgtcacgccacattcacgatgagattgctatctcccgttcgcgttccgaattacaatatgattatcatggacgaagcccactttacggaccccagctccattgccgcccgggggtacattagcacccgcgtgggcatgggggaagcggccgcgattttcatgaccgccactccccccggctccgtcgaggccttcccccaaagcaacgcggtgattcaggatgaggagagggacatccctgagcgctcatggaactccggttacgagtggataacggacttccccgggaagacagtatggttcgtcccctctatcaagagcggcaacgatatcgcgaattgtctacggaaaaacggaaagcgcgtgatccaactctcacggaagaccttcgataccgagtaccagaagaccaagaacaacgactgggactacgtggtcaccactgacatcagcgagatgggcgctaacttcagagccgaccgagtgatcgacccccgccggtgtctcaagcccgtgatccttaaagatggccctgaacgcgtgatcttagcggggcctatgcccgtgaccgtggcctccgccgcccagagacgcgggagaatcggccgaaaccacaacaaagaaggcgaccagtacatctacatggggcagcctctcaacaacgacgaggaccacgcccattggaccgaggcgaagatgttgctggacaacattaacacccccgaaggaatcatccccgccttgttcgagccggagcgagagaagtccgccgcgatcgacggagagtaccgcctgcgcggcgaagcccggaagaccttcgtggagttaatgcgccgaggggacctccctgtgtggctgtcctacaaagtcgctagcgagggcttccagtattccgacaggcggtggtgcttcgacggcgagcgcaataaccaggtgctggaggagaacatggatgtggagatctggactaaagaaggggagaggaaaaagctcaggcctcgttggttagacgcccgcacctactccgatccgctggctctccgtgagttcaaggaattcgcggccggccgcagatccgtctcgggcgatctaatcctggaaattgggaagctcccgcagcacctaacccagagggcgcagaatgctttggacaatctcgtgatgttgcacaactccgagcagggcgggcgggcttatcgccacgcaatggaagagctgcccgataccatcgagacccttatgctgcttgcactaatcgcggttctgacgggcggtgtcacactgtttttcctctccggcagagggctggggaagaccagcatcgggctgttatgcgtgatggcctccagcgtgttgctctggatggcctctgtcgaaccccattggatcgccgcgtcaatcatcttagagtttttcctgatggtgcttctcattccggaacccgacaggcagcggacgccccaggataaccagcttgcctatgtggttatcggccttctctttatgatcctgaccgtggccgccaacgagatgggcctactcgagacgaccaagaaagacctgggcatcggccacgtggcggtcgagaatcaccaccacgcgaccatgctcgacgtggacctccacccagccagcgcgtggaccctgtatgccgtggccacgacaatcatcactccgatgatgcgccatacgatcgaaaacacgacggctaacatttccctgaccgccatcgcaaaccaggctgcgatcttaatggggctggataagggttggccaatctccaagatggacatcggtgtccccctgctcgcgctggggtgctatagccaggtgaatccgttgacgctcacggccgccgtgctcatgttggtagcccactacgcgatcatcggacccgggttacaggcaaaggctacgcgggaggcccagaagaggaccgcagctggcatcatgaagaatccaaccgtggacgggattgtggccatcgacctggatcccgtcgtgtatgacgctaagttcgagaaacaactcggacagatcatgctcctgatcctttgcacttcccagatcctgctaatgcgcaccacttgggccctgtgcgagagtataaccctcgcaacagggcccttgaccaccctgtgggaggggtccccgggcaagttctggaacaccacaatcgcggtgagcatggcgaacatctttcggggttcctatctcgccggcgccggcctggccttctcgctgatgaagtcactgggcggcgggcgcagaggcaccggggcgcagggcgagaccctgggcgaaaaatggaaaaggcagctgaaccagctgtctaagagtgagtttaacatatacaaacgctccggcatcatggaggtcgaccgcagcgaggccaaggagggcctgaagaggggagagactaccaggcacgccgtgtcccggggcaccgcaaaattaaggtggttcgtcgaacggaacctggtcaagcccgagggaaaagtgatcgacctcggctgcggccgtggtggctggagctactattgtgcggggctgaaaaaggtaaccgaggtcaagggctatacgaaagggggtcccggccacgaagaacccataccaatggccacgtacgggtggaacctcgtgaagctccactcaggcaaggacgtgttttttacgccgcccgagaaatgtgacacactgctgtgtgacatcggtgaatccagccccaacccaaccatcgaggaaggccggacccttcgcgtactaaagatggtggagccctggctgcgggggaaccagttctgtatcaagatactcaacccgtacatgccgagtgtcgtcgagactctggaacagatgcaacgcaaacacggcggcatgctagtgcgaaacccgctctcccgcaattcaacccacgaaatgtactgggtgtcctgcggcaccggcaacatcgtctcggctgtgaacatgacctcccgcatgttactgaacaggtttacgatggcacaccgcaagcccacctacgagcgggacgtggacctgggtgccggcacccgccatgttgcagtcgagcctgaggtcgccaacctcgacatcatagggcaaaggatcgagaacattaaacatgaacacaagagcacctggcactacgatgaggacaacccctacaagacgtgggcctaccacgggtcttacgaagtcaagccttcaggatctgccagctcaatggtgaacggggtggtgaagctgttgaccaaaccttgggacgtaatccccatggtaacacaaatcgccatgaccgacacgacccctttcggacagcagcgcgtgttcaaagagaaggtcgatacccggacccctaaagcgaagcgcggcactgctcaaattatggaggtaacggcccgctggctgtggggctttctatcccgaaacaagaaacctcggatctgcacccgggaagagttcacccggaaggttcgcagcaacgccgccatcggcgcggtgttcgtcgacgagaaccagtggaactccgcgaaggaggcagtggaggatgagcggttttgggatcttgtgcaaaaggagcgcgagcttcacaaacaggggaagtgtgccacgtgcgtgtacaatatgatgggcaaaagagagaagaagctaggggagtttggtaaggcgaaggggagccgcgcgatctggtacatgtggttgggcgcccggttcctggagttcgaagccctgggattcatgaacgaggatcactggttctcccgcgagaacagtctctctggggtggaaggggagggcttacacaagcttggctacatcctccgggacatctctaagatccccggcggcaacatgtacgccgacgacaccgcggggtgggacacccgcatcactgaggacgaccttcagaacgaagccaagattacggacatcatggagccggagcacgccctgcttgcaacatccatattcaagctgacctaccaaaacaaggttgttcgggtgcagcgccccgcaaaaaacggaaccgtcatggacgtaatatcaagacgcgaccagcgcggttcaggccaggtgggcacttacggcctcaatacattcacgaacatggaggcgcaactcatccggcaaatggagtcagaggggattttcctgccgagcgagctggaaacaccgaacttagcagagagggtgctagattggctggagaagcatggagtagagcggctcaagcgaatggcgatcagcggggatgactgcgtagtgaagccgatcgatgaccgattcgcaacggctttgaccgcgttaaacgacatggggaaggtacgcaaggacattccccagtgggagccatcaaagggatggaatgactggcaacaggtccctttttgcagccaccacttccatcagctcatcatgaaggacggtcgtgagatcgtggtcccgtgtcgcaaccaagatgagctggtgggccgggcgcgcgtctctcagggagctggctggagcctgcgggaaacagcctgcttgggcaaaagctacgcccagatgtggcagttgatgtacttccaccgtcgtgacctaaggctagctgccaacgccaactgctccgcggtccctgttgactgggtaccaaccagccggaccacctggtccatccatgcgcaccaccagtggatgaccacggaggacatgctgagcgtgtggaaccgcgtgtggatagaggaaaacccctggatggaggacaagacgcacgtgtccagctggggcgacgtcccctacctggggaagcgggaagaccagtggtgcggatccctgatcgggttgaccgcgcgcgccacctgggccagcaatatacaggtagctatcaaccaggtgcgacggctaattgggaacgagaactatctagactacatgacatccatgaagcgcttcaagaacgagggggaccccgaaggggctttatggtaa

SEQ ID NO: 24322 - RNA, 9879 nt, synthetic construct
  misc_feature 1..9879: note = derived and/or modified CDS sequence (opt11) from DENV-1__GQ199810__SS-prME
  source 1..9879: mol_type = other RNA
agcgtgaccatgcttctgatgctgatgcccaccgccttagcattccacctcaccacacggggaggtgagccacatatgatcgtcagcaaacaggagcggggaaagtcgctgctgttcaagacctcagccggcgtcaacatgtgcaccctcattgcaatggacctgggcgagctgtgtgaggacacgatgacctataagtgcccccggataaccgagaccgagccagatgacgttgattgctggtgcaacgccacggacacctgggtcacctatggcacctgcagccagacgggcgagcaccgacgggacaagcggtccgtagccctagcaccccacgttggcttagggctggagacacgcacagagacctggatgagcagtgagggcgcgtggaaacagattcaacgggtcgaaacctgggccctgcgtcatcccgggtttaccgtgatcgccctgttcctggcccatgcgatcggtacaagtatcactcagaaggggatcatcttcatcctcttgatgttagtgacgcccagcatggccatgcggtgcgtcgggatcggcagccgcgactttgtagagggcctgtccggcgccacctgggtggacgtcgtactggagcacgggagctgcgtcaccaccatggccaaggataagcccacgctggacatcgagctcctgaagaccgaggtcaccaaccccgccgtactgcgaaagctctgcatcgaggcaaagatctccaacaccacaaccgacagccgctgcccgacccagggggaggcgactctggttgaggagcaggacgccaactttgtctgtcggcggacattcgtcgatcgaggctgggggaatgggtgcgggttattcgggaagggttcactcatcacttgcgccaagttcaagtgcgtgaccaagctggaggggaagatcgtacaatacgagaacctcaagtactcagtgatcgtgacagtccacacgggcgaccagcaccaggtggggaatgaatccaccgaacacggcaccaccgccacaatcacgccgcaggcacccactaccgagatccagctcactgactacggcgccctgacccttgactgcagcccccgcaccggcctcgacttcaacgagatggtcctgcttacaatgaaagagaagtcctggctggtgcacaagcagtggttcctggacttacccctaccctggaccagcggggccagtacgtcacaggagacatggaaccggcaggacctgcttgtcaccttcaagaccgcccacgcaaaaaagcaggaagtcgtcgttctcggctcgcaagagggcgcgatgcatactgccctgacaggggccaccgagattcagacatcgggcacgactaccatcttcgccgggcacttgaagtgtcgcctcaagatggacaagctgaccctgaagggaatgagctatgtcatgtgcacggggtccttcaagctcgaaaaggaggtggccgagacccagcacggaaccgtgctggtccagatcaaatacgagggcaccgacgcgccgtgcaaaatccccttccttacgcaggatgagaagggggtgacccagaacggacggctgatcacagccaaccccatcgtgaccgacaaggagaagcccgtaaacatcgaggccgagccaccctttggggagagctatatcatcatcggcgccggcgagaaagcgctcaagctctcttggttcaagaagggttcatccataggcaagatgttcgaggctacagcccgcggggcccggcgaatggccatcctgggtgacaccgcgtgggacttcgggagcattgggggcgtgttcacatccgtgggtaagctcgtccaccagatatttgggacagcatacggtgtgctgtttagcggagtgagttggacgatgaagataggtatcggagtcctgctcacctggctgggccttaatagccgctcgaccagtctctccatgacctgcattgccgtggggctggtgactctgtacctcggcgtgatggtgcaggccgacagcgggtgcgtaatcaactggaagggacgagagctgaagtgcgggtccggcatctttgtcaccaacgaggtgcacacgtggaccgagcaatacaagttccaggcagacagcccgaagcgcctatctgcggccatcggaaaggcctgggaggagggtgtgtgcggcatccggtccgcaaccaggctagaaaatatcatgtggaagcagatcagcaacgagctaaaccacatactgcttgaaaacgacatgaagttcacggtcgtagtcggggacgtcgccggaatcctcgcccagggtaagaagatgatccggccccagcccatggagtacaagtactcctggaagtcctggggcaaggctaagattatcggtgccgacgtgcagaacaccaccttcatcatcgacgggcccaataccccggagtgccccgatgaccagagggcctggaacatttgggaggtcgaggactacgggttcggtatcttcacgaccaacatatggctgaagctccgggattcgcacacacaggtatgcgaccacagactgatgagcgcggccatcaaagattccaaggctgtgcacgccgacatgggctactggatcgagagcgagaaaaacgagacctggaaactggcccgggcgtctttcatcgaagtaaagacgtgcatatggcccaagagccacaccctgtggtccaacggagtactggagagcgagatgatcatccccaagatctacggcggcccaatatcccagcacaactaccggcccggctacttcacccagaccgccggcccgtggcacttagggaagttagagctggattttgacctttgcgagggcactacggtggtggtcgacgaacactgcggaaatcggggaccgagcttaaggaccacaacggtgacgggcaagattatccatgaatggtgctgccgttcctgcaccctgccgccgctgcggttccgcggcgaggacggctgctggtacggaatggaaatccgccccgtgaaggagaaggaggagaacctcgtgaagagcatggtgtccgccggctctggcgaggtggacagcttctccctggggctgctctgcatctccattatgatcgaggaggtaatgcggtcccgctggagccggaaaatgctgatgaccggcacgctggccgtctttttcctcctgatcatgggtcagctgacctggaatgacctcatcaggctgtgcatcatggtgggtgccaacgcgtccgaccgcatggggatggggacaacctacctggccttaatggccacgttcaagatgcggccgatgttcgccgtcggactgctgttccgccgccttaccagccgcgaggtgctgctgctcaccatcgggctgtctctggtagcctcagttgagctcccgaattcgctggaagagctgggtgatggcttagcgatggggatcatgatcctgaagctgctcacagactttcaaagccaccagctgtgggccacgctgctctctctgactttcatcaagaccacattcagcctgcattacgcctggaagacaatggccatggtgctctccatcgtaagcctgttccccctgtgcctgtcaaccaccagccagaagaccacgtggctgcccgtgctgctcggctccctggggtgcaagccgctgacgatgttcttaattgcggagaacaagatctggggacggcgcagctggcctctgaatgagggaatcatggccgtgggcatagtctccatcctgcttagcagcctgctaaagaacgacgtacctctcgcagggcctctgatcgccggcggcatgctgatcgcctgttatgtgatctccgggagctccgcggacctcagcctggagaaggcggccgaagtatcctgggaagaggaggttgagcactcgggagcctcccacaacatcctggtggaggtccaggacgacgggaccatgaagatcaaggacgaggagcgggacgatacgttaacaatactgctgaaggccacgttgttggcagtgtcaggcgtttacccgctgagcatccccgccacccttttcgtctggtacttttggcagaagaagaagcagcggagcggggtgttatgggacacccccagcccgcccgaggtagaacgagcggtcctcgacgatgggatttaccgcatcatgcagcgcggcttgctcggtcgcagtcaggtgggcgtgggggtcttccaggagaacgttttccacaccatgtggcacgtgacgcggggcgccgtcctgatgtaccagggcaagcgcctcgagccttcctgggcctctgtgaagaaggacctcatctcatatgggggtgggtggcggttgcagggtagctggaacaccggcgaggaggttcaggtcatcgcggtggagcccggcaagaaccctaagaacgtgcagaccgcccccgggaccttcaagacacccgagggcgaggtcggggcaatcgccctggactttaagcccgggacctcagggagccccatcgtgaaccgggagggaaaaatcgtcggcctctacggaaatggggtcgtcacaaccagtggcacgtacgtgtctgccatcgcacaggccaaagccagccaggaggggccgctacccgagatcgaggacgaggtcttcagaaagcgcaacctgaccatcatggacctacaccccgggtccgggaagacccggcgctacctgcctgccatcgttcgggaggctattaagcgcaagctgcggactctgatcctagcccccacgcgtgttgtcgcctcggagatggcagaggcgctcaagggcatgcctattcgctaccaaacaaccgcggtgaaatccgagcacactggcaaggagattgtggatctaatgtgtcacgccacgttcacaatgcggctgctgtcccctgtgcgcgtgcctaactacaacatgatcatcatggacgaggcccacttcaccgacccctccagcatcgccgcccgggggtatatctccacccgcgttggcatgggggaggcggccgccatctttatgactgccactccgccgggctctgtcgaggccttcccgcagtccaatgcggtcatccaggacgaggaacgggacatcccggagcgctcctggaactctgggtacgagtggatcaccgactttcccggcaagaccgtgtggttcgtccctagcatcaagtccgggaacgacatcgctaactgcctacggaaaaacgggaaacgcgtgatccagctgagtcggaagacgtttgacaccgagtaccagaagaccaagaacaacgactgggactacgtggttaccacggacatcagtgagatgggggccaacttccgcgcggaccgggtgatcgacccgcgccgatgcctgaagcccgtgattctcaaggacgggcctgagcgcgtcatcctggcgggtcccatgccggtgacggtcgcgagcgctgcccagcggcgggggcgcatcggaaggaaccacaacaaagagggagaccagtacatctacatggggcagcccctaaacaacgacgaggaccacgcccactggaccgaagctaagatgctcctagataacatcaacacccccgagggcatcatccccgccctgttcgaaccggagcgagagaagtccgccgcgatcgacggggagtaccggctgcgcggagaggcccgtaagacgttcgtggaacttatgagacgcggggatctgcctgtctggcttagctacaaagtcgcatcagagggcttccaatactcggaccgacggtggtgcttcgatggcgagcgaaacaaccaggtgctggaggagaacatggacgtggagatctggaccaaggaaggggagcggaagaagctgcgtccccgctggctcgacgcccgtacttactcagaccccctggccctgagggagttcaaggaattcgccgccggccgcaggtccgtaagcggggacctcatccttgaaatcggcaagttgccgcagcacctaacccaaagagctcagaacgctctggacaacctggtgatgttgcataattccgagcagggcgggcgggcctaccgccacgctatggaggagctgcctgacactatcgagaccctgatgctcctagcgctgatcgccgtgctcaccggcggggtcaccctgttcttcttaagcggccgggggctcggcaagacctcgattggcctgctgtgtgtgatggccagctccgtgcttctgtggatggccagcgtcgagccccactggatcgccgcctccatcatcctggagttcttcctcatggtactgctgatccccgagccggaccgccagcggacgccacaggacaaccagctggcctacgtggtgatcggcctgctttttatgatcctcaccgtggccgccaacgagatgggcctgctggaaacgacgaagaaggatctcgggatcggccacgtggccgtcgagaatcaccaccatgcggcgatgcttgacgtggacctgcatcccgccagcgcctggacgctctacgccgtagctaccacaatcataaccccgatgatgcgccacacgatcgaaaacaccacagccaacatctccctgactgctatcgccaaccaggccgctatcctgatggggctggacaaggggtggcccatcagcaagatggatatcggcgtccccttgctggctctcggttgttattcccaagtgaacccattaacgctgactgccgccgtgctaatgctggttgcacactacgcaataatcggcccggggctgcaggccaaagccacccgggaggcgcagaaacggaccgcggccgggatcatgaagaaccccacagtggacgggatcgtggccatcgacctcgacccagtggtgtatgacgccaagttcgagaagcagttgggtcagattatgctgctcatcctatgcaccagtcagatcctgctcatgcggaccacatgggccctgtgtgagtccataacgctggcgacgggccccctcactaccctgtgggagggtagcccgggcaagttctggaacaccaccatcgccgtgtccatggccaacatctttcgggggagctacctggccggggccggcttagcattctccctgatgaagtccctcgggggcgggcgccgggggaccggggcccagggcgagaccctcggtgagaagtggaagcgacaactgaaccagctgagcaagtcggagttcaacacttacaagcggagtgggatcatggaggtcgaccgctccgaggccaaggaaggcctcaagcgcggggagaccaccaagcacgccgtcagccgtgggaccgcgaaactgcggtggttcgtcgagcgcaatctggtcaagcccgaggggaaagtgattgacctgggctgtggccgtggcgggtggtcctactactgcgccggattaaagaaggtgacggaggtgaaggggtataccaagggcggccccggccacgaggagcccataccgatggccacctacggatggaacctggtgaagctacattcgggcaaagatgtcttcttcattccgccagagaagtgtgacaccctcctgtgtgacataggcgagtccagccccaacccgactattgaggagggccgcaccctgcgtgtcttgaagatggtggaaccctggctgcgcgggaaccagttctgtatcaagatcctgaatccctacatgccctccgtggtcgagaccctcgaacagatgcagaggaagcatggtggcatgctggtacgcaacccgctaagccggaacagtacccacgaaatgtattgggtcagctgtgggaccggcaatatagtctctgccgtgaacatgacgagccgcatgctcctaaatcgcttcaccatggcccaccggaagccgacctacgaacgcgacgttgacctgggtgcgggtactcggcacgtcgccgtggagcccgaaatcgccaacctcgacattataggccagcgcatcgagaacatcaaacacgagcacaagagtacgtggcactacgatgaagacaacccctacaaaacctgggcctatcatggaagctacgaggtgaagcccagcggcagcgcctccagcatggtcaatggggtggtcaagctcttaaccaaaccctgggacgtgatccccatggttacacagatcgcgatgacggataccaccccgttcggtcagcagcgcgtctttaaggagaaggtggatactagaacgccgaaggccaagcgggggactgcgcagatcatggaggttacggccaagtggctctggggcttcctgagtcgcaacaagaaaccccgtatctgcacccgcgaggagttcactagaaaggtccgctccaacgccgcgatcggcgcggtttttgtggacgagaaccagtggaacagcgccaaggaggccgtcgaggacgaacggttctgggacctcgtgcatcgcgagcgggagctccacaagcaagggaagtgcgcgacctgcgtttacaacatgatgggcaagcgcgaaaagaagttaggggaatttggcaaagccaaggggtcccgggccatctggtacatgtggctaggcgcccgctttctcgagtttgaggccctgggatttatgaacgaggaccactggttctcccgggaaaactccctcagcggggttgagggcgagggactgcacaaactgggctacatcctgcgcgacatctccaagatccccgggggcaacatgtatgccgacgacaccgccggctgggacaccagaataacggaggacgaccttcagaatgaggcccgcatcactgacatcatggagccggagcatgccctgctggccaagtctatcttcaagcttacctaccagaataaggtggtgcgggtccagcggcccgcgaagaacgggacggtgatggacgtgatcagtcgccgggatcagcgcggcagcgggcaggtcggcacgtacggactgaacaccttcaccaacatggaggctcagctgatcaggcagatggagtccgaggggatcttcagcccctccgagttggagacccccaacctggcggagagagttctggattggcttgagaaatacggcgtagaacggctgaagagaatggcgatcagcggggacgactgcgtcgtgaagccaatcgacgaccggttcgccacggcgttaaccgcccttaacgacatgggcaaggtgcggaaggacatcccccagtgggaaccctcgaaggggtggaacgattggcagcaagtccccttctgctcacaccacttccaccagctgatcatgaaggatggccgggagatcgtcgtgccgtgtagaaatcaggatgagctggtcggccgggcccgcgtgtcccagggggctggatggagcctccgggaaaccgcctgtctcggcaagagctatgcgcagatgtggcagctgatgtactttcaccgccgggacctacgcctagcagccaacgcgatatgctccgcggtgccggttgactggatacccaccagccggacgacctggagtatccacgcgcatcaccagtggatgaccaccgaggacatgcttagcgtgtggaaccgcgtttggatcgaggagaacccctggatggaggacaagacgcacatctccagttggggcgacgtaccgtacctcgggaagagagaggatcagtggtgcggctccctgatcggcctaaccgcccgggccacctgggccaccaacatccaggtagctatcaaccaggttcgccggctcatagggaacgagaactaccttgactacatgaccagcatgaagcgttttaaaaacgaaggcgaccccgagggggccctgtggtga

SEQ ID NO: 24323 - RNA, 9879 nt, synthetic construct
  misc_feature 1..9879: note = derived and/or modified CDS sequence (opt11) from DENV-1__GQ199811__SS-prME
  source 1..9879: mol_type = other RNA
agcgtgaccatgctcctgatgctgatgcccaccgccctggccttccacctcacgacccgaggcggggagccccacatgatcgtcagcaagcaagagcgaggcaagtcactgcttttcaagacctctgccggtgtgaatatgtgcaccctcatcgccatggacttaggcgaattctgcgaggacaccatgacctataagtgtccccggattaccgaggccgagcccgacgacgtggattgctggtgcaacgccaccgacacttgggtgacctacgggacctgcagccagaccggcgagcatcggcgcgacaagcggtccgtggcgctggcaccgcacgtaggcctcgggctggagactagaactgagacctggatgagctccgaaggggcatggaagcagatacagcgagtcgagacctgggccctgagacaccccggcttcacggtgatcgcgctcttcctggcacacgcaatcgggaccagcataacccagaagggaataatattcatacttctcatgttagtgaccccgtccatggccatgaggtgcgtcggcataggcagccgcgattttgtggaggggttatccggcgccacttgggtggatgtcgtgctcgagcatgggagctgcgtaaccaccatggccaaggacaagcccaccctggacatcgagctccttaagactgaagtcactaaccctgcggtcctgcggaagctgtgtatcgaggccaaaatctccaacaccaccacggactcgcgctgcccgacccaaggtgaggccaccttagttgaggagcaggacgccaacttcgtctgccggcgcacgttcgtcgaccggggatgggggaacggctgcgggctgttcggtaagggttccctgattacgtgcgccaaattcaagtgcgttaccaagctcgagggcaagatcgtccagtacgagaacctgaagtacagcgtcatcgtgactgtccataccggggaccaacaccaggtggggaacgagtccacagagcatggcaccacggcgaccatcacgccccaggccccctcaacggagatccaactgaccgactacggggccctcacgcttgactgcagcccccggaccggcctggacttcaatgagatggtcctcttgacgatgaaggagaagtcttggctggtgcataagcagtggttcttggaccttccgctgccctggacgagcggggcatccactagccaggagacctggaatcgccaggacctgctagtgacgttcaagaccgcccacgctaagaaacaggaagtcgttgtgctgggctcgcaggaaggtgccatgcatacggcactcacaggagccacggagatacagaccagcggcaccacgacaatcttcgccgggcacctgaagtgccgcttaaagatggacaagctcaccctgaaaggaatgtcctatgtcatgtgcaccgggagcttcaagctggagaaggaggtagcggagacccagcacgggaccgtgctcgtccagattaaatacgagggtaccgacgccccgtgcaagatccccttctcgacacaggacgagaagggcgtaacccagaacggccgtctaataacggccaaccctatcgtgaccgacaaggagaagccagtgaacatagaagcagagccgcccttcggagagagttatatcgtcataggcgccggagaaaaggcactgaagctgtcctggttcaagaagggaagctctatcggaaagatgttcgaagccactgcacgcggggccaggcgcatggcaatactcggcgacactgcctgggactttggatcaatcggaggcgtcttcacgtccgtcgggaagctggtacaccaaatcttcgggaccgcctatggggtgctgttcagcggggtctcctggaccatgaaaatagggatcggcgttctcctgacctggctgggcctcaatagccggtccacgagcttatccatgacctgcatcgcagtcgggttagtcaccctttacctgggggtaatggtgcaggccgattcggggtgtgtcattaactggaagggtcgggagctgaagtgcgggagcggcatcttcgtcacgaacgaagtgcacacatggaccgagcagtataagtttcaagcggactcccccaagcgcctctcggcagccatcggaaaggcctgggaagagggggtctgcggcatccgcagcgccacccgcctggagaacataatgtggaagcagatctctaatgagctcaattatatcctcctagagaacgacatgaagctgacagtggtggtcggggatgtggcaggcatcctcgcccagggaaagaagatgattcgaccacagcctatggaatacaagtactcctggaaaagctggggcaaggccaagatcattggcgccgacgtacagaataccacgttcatcattgacggtcccaacaccccagaatgccctgacgaccagagagcttggaacatctgggaggtcgaggactacggcttcgggatcttcaccaccaacatatggctgaaactgcgggactcctacactcaggtatgcgaccaccgcctcatgagcgcagccattaaggactccaaggcggtgcacgccgacatgggctactggatcgaatcagagaagaacgagacttggaagctggcgcgggcctcctttatcgaggtcaagacctgcatctggcccaagagccacaccctgtggtccaacggggtgctcgagtcggaaatgataatacccaagatctacggcggcccgatctcccagcacaactaccgccccgggtacttcacccagacagccggcccttggcacttgggcaagctcgagctcgacttcgacctgtgcgagggcaccacagtggttgtagacgagcactgcggcaaccgggggcccagcctgcgcacaaccacggtaacgggcaagatcatccacgagtggtgttgccggtcctgcaccctgccgcctctccgcttcaagggagaggacggctgctggtacgggatggagatccggccagtaaaggaaaaagaggagaatctggtcaagtctatggttagcgccggctccggcgaagtggattcgttctccctcgggctgctgtgtatcagcataatgatcgaggaggtgatgcgctcccggtggtcacgcaaaatgctaatgactggcaccctggcagtgtttttcctgttaatcatggggcagctcacatggaatgacctgatccggctctgcataatggtcggtgctaatgcctccgaccgcatggggatgggaactacatatctggccctgatggccaccttcaaaatgcgcccaatgttcgccgtggggctcctgtttaggaggttaacctcccgggaggttttgctgctgacaatcggactctccttagtagcgtctgtggaactgcccaattcgctcgaagagctgggcgacgggctggccatgggcataatgatacttaagctgttaaccgacttccagagccaccagctctgggccaccctgctcagcctaacctttgttcgaacgacctttagcctgcactacgcctggaagaccatggcgatggtgctgtccatcgtgtcgctcttccccttatgcctatccaccacgagccagaaaacaacgtggcttcccgtactgcttgggtccctcgggtgcaagccgctaaccatgttcctgatcgccgagaacaagatttggggccgcaagagctggccactcaacgagggcatcatggccgtggggattgtgagcatccttctgagcagcctcctgaagaacgacgttcccttagccggtccactcatcgctggcggcatgctgatcgcgtgctacgtaatttcagggagcagtgccgacctgtccctcgaaaaggccgccgtggtctcctgggaagaggaggcagagcacagcggagcgagtcacaacatcctggtggaggtgcaggacgacgggacgatgaagatcaaggacgaggagcgcgacgacaccttaacaatccttctgaaggcaacactgttagctgtcagcggtgtatatccgctgagtatacctgcgactcttttcgtgtggtacttctggcagaaaaagaagcagcgaagcggggtcctgtgggatacgcccagcccgcctgaggtagagcgggccgtgctggatgacggcatttaccgaatcatgcagcggggcctgctgggacggagccaggtcggcgtaggggtgtttcaagagaacgtcttccacaccatgtggcatgtgacccgtggcgctgtgcttatgtatcaaggaaaacggctagagcccagctgggctagcgtcaagaaggaccttatctcgtacggcggggggtggcgtctccaaggcagctggaacaccggggaagaagtgcaagtaattgccgtcgaacccggcaagaaccctaagaacgtgcagacggctcccgggaccttcaaaacctctgagggcgaagtgggcgcaatcgcgctagactttaaacccgggaccagcggcagccccatagtaaaccgtgaggggaagatcgtgggcctttacggcaacggggtggttacgacctctggcacttacgtgagcgccatcgcccaagccaaggcctcccaagaggggcctctccctgagattgaggacgaagttttcagaaagcggaatctgactattatggacctgcaccccggtagcgggaaaacgcgccgatatctccccgccatcgttcgcgaggcaatcaagcggaagctccgcactctgatcctggcgccgacgcgggtggtggccagcgaaatggcggaggcactcaagggcatgcccatacgataccagactacggccgtcaagagcgagcacacaggcaaggagatcgtagacctgatgtgtcatgccaccttcaccatgcgcctcctgtcccccgtccgggttcccaactataacatgattatcatggacgaggcccatttcacggacccaagctccattgcggcccgggggtatatttccactagagtgggtatgggggaggccgccgccatcttcatgaccgcgaccccgcccggctccgtggaggccttcccacagagcaacgcagtcattcaggatgaggagcgcgatatcccggagcgcagctggaatagcgggtacgaatggatcacggactttcccggcaaaaccgtttggtttgtgccctctatcaagagcggcaatgatatcgctaactgtctgcgcaagaacgggaagcgcgtcattcagttgtccagaaagacctttgataccgaataccagaagacgaagaacaacgattgggactacgtggtcaccaccgacatctccgaaatgggcgcaaacttccgcgcagatcgcgtcatagacccccggcgctgcctgaagccggtgatcctgaaggacgggcccgagcgggtcatcctcgccggccccatgcccgtgaccgtggcctcggccgcgcagcgccgtgggcgcatcggtcggaaccacaacaaagagggcgaccagtacatctacatggggcagccactgaacaacgacgaggaccacgcccactggacagaggcgaaaatgctgctcgacaacatcaacaccccagaaggcatcatcccagctctgttcgaacctgagcgcgagaagagcgccgcgattgacggggagtaccgcctccgaggcgaggcccgcaaaaccttcgtcgagcttatgcgccgtggggatctgcccgtgtggctcagttacaaggtcgcgtccgagggatttcagtacagcgacagacgctggtgcttcgacggcgagcgaaacaaccaggtcctagaggagaacatggacgtcgagatctggaccaaggagggggaaaggaagaagctgcgacctcgctggctggacgcgaggacgtactctgaccccctcgccctgcgcgaattcaaggaatttgctgcgggccggcgctccgtgtccggggacctgatattggagatcggtaagcttccccagcacttgacccagcgggcccagaacgccctcgacaacctggtaatgctgcacaacagcgagcagggcgggcgcgcttaccggcatgctatggaggagctcccggacacaattgagaccctgatgctgctcgcccttatcgccgtgctgacgggcggcgttaccctcttcttcctgtccggaagagggctggggaagaccagcatcggtctactgtgtgtcatggcttccagcgtcctgctctggatggctagtgtagagcctcactggatcgccgccagcataatcttagagttcttcctgatggttctcctgatcccagaacccgaccggcaacgcacaccgcaggacaaccagctggcttacgttgtgataggtctcctgttcatgatcctgaccgtcgcagcgaacgagatgggcctccttgaaacgaccaagaaggatctggggattggccacgtggccgtagagaaccaccaccacgccgcgatgctcgatgtcgacctgcaccccgcttccgcgtggaccctgtacgccgtcgccacaacgatcatcacccccatgatgcgacacaccatcgaaaacacgacggccaacatctctctcaccgccatcgcgaaccaagccgccatcctgatggggctggacaagggatggccgataagcaagatggatatcggcgtacctctcctggccctgggttgctactcacaggtcaatcccttgaccttaaccgcggcagtactgatgctcgttgcccactacgccataataggccctggcctgcaggccaaggcaacacgcgaagcccagaagaggactgcggccggcatcatgaaaaacccgacggtcgacgggatcgtggccatcgacctggaccctgtagtctacgacgcgaagtttgagaagcagctaggccaaatcatgttactgattctctgcactagccagatcctcctgatgcgtactacctgggccctctgtgagagcatcaccctggccactggtcccctgacgacactttgggagggctcccccgggaagttttggaataccaccatcgccgtgagcatggccaacatattcagagggagttacctggcgggcgcgggtttggcgttctcactcatgaagtccctcgggggcggccggcgcgggacgggggcccagggcgagacgctgggcgagaaatggaagcggcagctcaatcagttatccaaatcggagtttaacacttataagcgctccgggatcatggaggtggaccggagcgaagcgaaagaaggcctgaagcgcggcgagacaactaagcacgctgtcagccggggcactgcaaagcttcgctggtttgttgagcgcaacctggtgaagccggaggggaaagtgatcgatcttggttgcggccgcgggggctggagctattactgcgccgggctgaaaaaggtgaccgaggtgaagggttataccaagggcgggcccggccacgaagagcccatccccatggcgacgtacggatggaacctcgtcaagctgcatagtggcaaggacgtgttcttcatcccgcccgagaagtgcgacaccctgctctgcgatatcggggagagctcccctaaccccacaatcgaagaggggcggaccctgagagtgctgaaaatggtcgagccgtggctccggggtaaccaattctgcatcaaaatcttaaacccttacatgccatccgtggtggagacgctggagcagatgcaacgcaagcacggcggcatgctcgtacgtaaccccttgtccagaaacagcacgcatgagatgtattgggtttcctgtggaaccggcaatatcgtgagcgcggtcaatatgacctctcggatgctacttaaccgcttcacgatggcccacaggaagccgacatacgagagggacgtggacctgggggccggaacccgccacgtggccgtcgagccagaggtggcgaacttggacatcatcggccaacggatagagaacatcaagcacgaacacaaatctacctggcactacgacgaggacaacccctataaaacgtgggcgtaccacggttcctacgaggttaagccctctggctcggcctccagcatggtgaatggagtggtcaagctcctcacgaagccatgggacgtgatccccatggtgacccagatcgcgatgaccgataccacgcccttcggacagcaacgcgtcttcaaggagaaggtggatacccggacccccaaagccaaaaggggaaccgcacagattatggaggtgacggctaagtggctgtggggcttcctcagccgtaacaagaagccgcgtatctgcacgcgagaggaattcactcgtaaggtgcggagcaacgcggcaatcggcgccgtgttcgttgacgaaaaccagtggaattccgcgaaagaggccgtcgaggacgagaggttctgggacctggtgcaccgggagcgcgagttgcacaaacagggaaagtgcgcgacctgcgtgtacaacatgatgggcaagagagagaagaagctcggggagttcggcaaagccaaagggtcacgcgccatctggtacatgtggctgggcgcgcggttcctcgagttcgaagccttgggattcatgaacgaggaccactggttcagccgcgaaaacagcctgtccggagtggagggcgaggggctgcacaagctcggctacatcctgcgggacatcagcaagatccccgggggcaacatgtatgccgatgacactgcaggttgggacacccgcatcactgaggacgacctgcaaaacgaggccaagatcaccgacatcatggagcccgagcacgctctactggccaagtccatatttaagctgacgtaccagaacaaggtggtacgggtacaacgcccagccaagaacgggaccgtgatggatgtgatcagccgccgggaccagcgcggctccgggcaggtcggcacctacggcctcaacaccttcactaatatggaggctcagctgatacggcagatggaaagcgaggggattttttcccccagcgagctggaaacccccaacctcgccggccgagtgttagactggctggagaaacacggggttgagagactcaaaagaatggcgatctccggtgacgactgcgtcgtgaagcccattgacgaccgattcgcaacggcgctcaccgccctgaatgatatggggaaggtgcgcaaggacatcccgcaatgggagccctcgaaaggttggaacgactggcagcaggtccctttctgcagccaccatttccaccagttgatcatgaaggatggcagagagatagttgtgccctgccgcaatcaagacgagctggtcgggcgggcacgcgtgtcccagggtgcggggtggagccttcgggagacggcctgcctcggcaaatcctacgcccagatgtggcagcttatgtacttccaccgccgggaccttcgcctcgccgcgaacgcaatctgcagtgctgttccggtcgattgggtgcctacttcccggaccacctggagcatccacgcccaccaccaatggatgaccaccgaggacatgctgtccgtgtggaaccgcgtctggattgaggagaacccgtggatggaggacaagacccacatctcgtcatggggagacgtgccctacctgggcaagagagaggaccaatggtgcggcagcctcatcgggctgactgccagagcgacgtgggccacaaatatccaggtggccatcaatcaggtgcgccgactattggggaacgagaactacttggattacatgacttcgatgaagcgcttcaagaacgagtcggacccagagggcgctctctggtga

SEQ ID NO: 24324 - RNA, 9879 nt, synthetic construct
  misc_feature 1..9879: note = derived and/or modified CDS sequence (opt11) from DENV-1__FJ882549__SS-prME
  source 1..9879: mol_type = other RNA
tctgtgaccatgctgctcatgcttatgcccactgccctggcctttcacctcaccacccggggcggcgagccccacatgatcgtgagcaagcaggagcgaggcaagtcgctgctgttcaagacaagcgcaggagtgaatatgtgtaccctcatcgccatggacctgggcgagctgtgcgaggacaccatgacctataagtgcccccgcatcactgaagtagaacccgacgacgtggattgttggtgtaatacgaccgacacctgggttacctacgggacctgctcgcagactggagaacaccggagagacaagcgcagcgtggcgctcgcaccccacgtcggcttggggctggagacccgggctgagacatggatgtcttccgagggcgcttggaagcagatccagaaagtggagacctgggcgttgcggcaccccgggtttacggtgatcgctcttttcctagcccacgcgataggaaccagcatcacccagaaggggatcatattcatcctgctgatgctggtaacaccttccatggccatgcgctgcgtagggattggcagccgggattttgtcgagggtctttccggagcaacgtgggtcgacgtagtgttagaacacgggtcttgcgttaccaccatggccaaggacaaacctacactggacatcgagctcctgaagacggaggtgaccaaccccgccgtgctgcgcaaattgtgcatcgaggcgaagatctctaacacaaccacggactcacggtgtccgacgcagggggaggccaccctagtcgaggaacaggatgctaacttcgtgtgccgccggacattcgtcgaccgcggttggggtaatggctgcgggctgtttggcaaagggtccctcatcacttgcgcgaagttcaagtgcgtcaccaagctggaagggaagatcgtgcaatatgagaacctgaagtactcagtgatagtcaccgtgcacacaggagatcagcatcaggtcgggaacgagagcactgaacacggcactaccgcgactattacgccccaggcgcccaccagtgagatccagttgacggactacggagccctaaccctagactgcagcccccggacgggcctagacttcaacgagatggtgctgctgaccatgaaggaaaaatcctggttagtgcacaagcagtggttcttggacctgcccctcccctggaccagcggagcgtccacatctcaagaaacatggaaccgccaggatctgttggttacgttcaagaccgcccacgccaagaaacaggaggtggtggtcctcggcagtcaggagggggcgatgcacacggccctgaccggggccacagagatccagacttctggcacgaccacgattttcgccgggcacctgaagtgccggctcaagatggacaagttaacccttaaaggaatgtcctacgtgatgtgtacagggtcattcaagctcgagaaagaagtggccgagacgcagcacggcacggtcctagtacagatcaaatacgagggcaccgatgcgccttgcaagatccccttctccacccaagacgaaaagggggtcacccagaacggccgcctgatcacagcgaacccgatcgtcaccgataaggagaagcccgtgaatattgaggccgagccgcccttcggagaaagctacatcgtcataggcgccggcgagaaggccctcaagctctcctggttcaaaaaggggagttccataggcaagatgttcgaggccaccgcccgcggagccagacggatggcaatcctgggcgacacagcctgggacttcggctccatcggcggcgtctttacgtccgtggggaagctggtacatcagatcttcgggacagcgtacggggtgctcttcagcggggtgagctggactatgaaaatcgggatcggggtgctgctgacctggttaggcctgaatagcaggtcaacaagcctgtcgatgacctgcatagccgtcggtctcgtgacgctctacctcggagtcatggtccaagccgacagcgggtgcgtgatcaactggaagggccgcgaattaaaatgtgggtctggcatcttcgtgacgaacgaggttcacacgtggaccgagcagtacaagttccaagccgactcgccgaagcggctgtcggcggccataggcaaggcctgggaggaaggggtgtgcggcatccgctccgccacccggctggaaaacatcatgtggcgccagatcagcaatgagctcaatcacatactgctggagaatgacatgaaattcaccgtggtcgtgggggacgtcgtgggcatattggctcaagggaagaagatgatccggccacagcctatggagcacaagtactcttggaagtcctggggcaaagcgaagataatcggagcggacgtgcagaatactacgtttattatcgacgggcccaacacccctgaatgccccgacgatcagcgcgcctggaacatctgggaggtggaggactatggtttcgggatcttcaccaccaacatctggctgaaactgcgagattcatacacgcaagtctgcgaccacagacttatgagcgccgccatcaaagactccaaggccgtgcatgccgacatgggctattggatcgagagcgagaagaacgagacctggaaactggcccgagcgagtttcatcgaggtcaagacctgcatctggcccaaaagccacacgctgtggtccaatggcgtcctcgaaagcgagatgatcatcccgaagatatatggtggccctatctcccagcacaactatcgcccgggttacttcacacagacggcgggcccctggcacctgggcaaactggagctcgactttgacctgtgcgagggcaccaccgtagtggttgacgagcactgcggcaatcgagggccgtcccttcgcacgaccactgtgaccggcaaaatcatccacgagtggtgctgtcgttcctgcacacttccgcccctccgattcaagggggaggacggctgctggtacggaatggagatccggcctgtaaaagaaaaggaagagaatcttgtcaagagcatggtatctgccggctccggcgaggtcgacagcttttccctcggtctgttgtgtatcagcatcatgatcgaagaggtcatgcgctcccggtggagccgcaagatgctgatgaccggcaccctggccgtcttctttctcctcatcatggggcagctgacttggaatgacctgatccgctcctgcatcatggtaggcgccaacgctagtgacagaatggggatgggcacgacctacctcgcgctgatggcaaccttcaagatgcgcccaatgttcgccgtggggttactgttccggcgcctgacctcccgagaagtgcttctcctcacgatcgggctgagccttgtcgcctcggtggagctaccgaacagtctggaggagttaggcgacgggctggccatgggcataatgattctgaagttactgaccgacttccagtcctaccagctgtgggcgaccctactgagcctgactttcatcaaaacgacattctcgctccactacgcctggaaaactatggccatggtgctgagcatcgtctccctactccccctgtgcctcagcaccacctcccaaaaaaccacatggctgccggtgctgctggggagcctagggtgcaagccgcttaccatgtttctgatcgccgaaaataagatatggggccgcaagagctggcccctaaatgaggggatcatggccgtgggtatagtctccatcctgctttcatcactcctgaagaacgacgtgcccttggccgggcccctcatcgccggtggcatgctgatagcctgctacgtgatttcggggtctagcgcggacctgtccctagagaaggcagccgaggtatcctgggaggaggaggcagagcactccggcgcatcgcacaacatcctcgtcgaggtgcaagacgacgggacaatgaaaatcaaggatgaggagcgggacgacactctgacaatcctccttaaggccaccctgctcgccgtttccggtgtgtacccgctgtcgataccagccacccttttcgtgtggtacttctggcagaagaagaagcagcgctccggggtactctgggacacaccctcgccgcccgaggtggagcgggccgtgctggatgacggcatttaccgcattatgcagcggggcctactgggacgctcgcaggtcggcgttggggtgtttcaggagaatgtgttccataccatgtggcacgtgacccggggcgccgtactaatgtatcaagggaaacgcctggagcccagctgggcatccgtgaaaaaggacttaatatcgtacggcggggggtggagactccagggctcctggaataccggggaagaggtacaggtgatagcagtcgaaccgggcaagaaccctaagaacgtgcagacggccccagggacatttaagactcctgaaggcgaagtgggggccatcgccctggattttaagcctgggacctctggaagccccattgtcaatagagaagggaagatcgtgggtctatacggcaatggagtcgtcacgacctccggcacctatgtgagcgccatcgcgcaggcaaaggcttcacaggaggggccgctccccgagatcgaggatgaggtattccgcaagcgtaatcttaccatcatggacctgcaccctggcagcgggaagacaagacgctacctaccagccatcgtccgggaagctatcaaaaggaagctgcggacattgatcttagcccccaccagagtcgtcgcctcggagatggcggaggcactgaagggcatgccaatacgctatcagaccacagcggtcaagtccgagcacaccggccgggagattgtagatctgatgtgtcacgcgacattcaccatgaggctcctgtcccccgtgcgggtcccgaattataacatgatcatcatggacgaggcccacttcacggacccctcgtccatcgccgctcgtgggtacattagtacccgggtgggcatgggcgaggcggcagccatcttcatgaccgccacgccgccgggctccgttgaggcctttccgcagagcaatgcggtcatccaggacgaggagcgcgacatccccgagcggtcctggaactcaggatacgagtggatcacagacttccccggcaagaccgtttggtttgtgccatccattaagagtggcaacgacatcgccaattgcctgagaaagaacggcaagcgagtcatacagctatcccgaaagaccttcgacaccgaataccagaagacgaaaaacaacgactgggactatgtggtaactaccgacatcagcgagatgggcgccaactttcgggccgaccgcgtcattgatccgcggcggtgcctgaagcccgtgatactgaaggacgggcccgagcgtgtgatcttagcggggcccatgccggttaccgtggcatccgcagcccagcgacgggggcgcataggacggaaccacaacaaggagggcgaccagtacatatacatgggccaacccctgaataacgacgaggaccacgcccattggacagaggcgaagatgctgctcgacaatatcaatacgcccgagggcataatccccgccctgttcgagccggagcgcgagaagtctgcggcaatcgacggggagtaccgactgcggggcgaggcgcgcaagaccttcgtcgagcttatgaggcgcggggatctgcccgtatggttgtcgtacaaggttgcgtccgaaggattccagtactctgacagacgctggtgctttgacggcgagcggaataaccaggtcctcgaggagaatatggacgtggaaatctggaccaaagagggtgagcgtaaaaagctgcggccacgctggcttgatgccagaacgtattccgatcccctcgccctgcgcgagttcaaggagtttgccgccggccggcgctctgtgtccggggacctcatcttggagataggcaagttacctcagcatttgacgcagcgggcgcagaatgctcttgataatctggtcatgctccacaactcggagcagggcgggcgagcgtacagacacgctatggaagagctacccgatacgatcgaaacactgatgttactcgcactaatcgccgttctaacgggcggtgttaccctcttcttcctgtccggcaaggggctgggcaagacaagcatcggcctcctgtgcgtcatggcgtccagcgccctgctttggatggcgtccgtggagcctcactggatcgcggcctctatcatcctggagttcttcctgatggtgctcctcatccccgaaccggaccgccagcggacgccacaggacaaccagctggcgtacgtagtcatcgggctcctgttcatgatcctgaccgtggcggccaacgagatgggcctcctggagaccaccaagaaagatctgggtatcggtcacgtcgccgtggagaaccaccaccatgccacgatgttggacgtggacctacaccccgcatccgcctggacattgtacgctgtcgcgacgaccatcatcacaccgatgatgcgccacaccatcgagaacacgaccgccaatatctctctcaccgcaatagccaaccaagccgcgattctaatggggctggacaagggctggcccatcagcaagatggatataggcgtgcccctcctggcactggggtgttactcgcaggtcaaccccctcaccctgaccgccgccgtcctgatgttggtggcgcactatgcaatcatcggcccggggcttcaggccaaggccacacgcgaggcacagaagcgcaccgccgccggcatcatgaagaaccccaccgtggacgggatcgtcgccatagacctggaccccgtcgtttatgatgccaaattcgaaaagcagcttggccagatcatgctgctgatcctctgtacgtcacagatcctgctgatgcgcacaacatgggccctctgcgagtcaatcacactggcaacgggcccactaaccacactctgggaagggagcccgggcaagttctggaacaccacgatcgccgtaagcatggccaacatcttccgggggagctatctggccggcgctgggttggccttctccttgatgaaaagcctcggtggagggcggcgggggaccggggcccagggtgagacactgggcgagaagtggaagaggcagctcaaccaactgtccaaatcagagttcaatacctataagcgttccgggatcatggaagtcgaccgcagcgaggctaaggagggcctgcggcgaggggagacgaccaagcacgcggtctccagagggacagcgaagctccgctggtttgttgagcggaacctggtaaaacccgaggggaaggtgatcgacctgggctgcggacgcgggggctggagctactactgcgccggcctgaagaaggttaccgaggtaaaaggctacacgaagggtggacccggccacgaagagccgatccccatggctacgtacgggtggaacttggtaaagctacactccggcaaggacgttttcttcatcccccccgagaagtgcgacaccctactctgcgatatcggtgagagctcccctaatcctacaatcgaggagggccggacactgcgcgtactgaagatggtggagccgtggttgcgggggaaccagttttgcatcaagattctcaacccctacatgccctccgtggttgagacgcttgagcagatgcagcgcaagcacggcggcatgctcgtgcggaacccgttaagccgcaattcgactcatgagatgtattgggtctcctgcggtacaggcaacatcgtgagcgccgtgaacatgaccagccggatgctcctcaaccggttcacgatggcccaccgcaagcccacctacgaacgggacgtcgatctgggggcggggacccgccacgttgcggtggagccagaggtcgcaaacctggacatcatcggccagcggatagagaacattaagcacgagcacaagagcacctggcactacgatgaggacaacccctacaagacatgggcctaccacgggtcctacgaggtgaaaccgtccggcagcgcgagctctatggtgaacggggttgtgaagctcctgaccaagccctgggacgtaatcccgatggtaacgcagatcgcgatgaccgacacgaccccattcggacaacagcgcgtgctgaaggagaaagtggacacccggaccccgaaggccaagcgagggacggcacaaataatggaggtgaccgcaaaatggctctggggcttcctgtcccggaacaagaaaccccgcatctgcacgcgcgaggagtttacgagaaaggtgcggtccaatgcggcgatcggcgccgtctttgtggatgagaaccagtggaactccgccaaggaagctgtcgaggacgaacgcttctgggatttggtacaccgggagcgcgagctccataagcaggggaagtgcgcgacctgcgtgtacaacatgatgggcaagcgggagaagaaactgggggagttcggcaaagccaagggtagccgcgctatatggtatatgtggctgggtgcccggtttctcgagttcgaggccctgggcttcatgaacgaggaccattggttttcccgcgaaaattcactgtccggggtggagggcgagggactccacaagctgggctatatcctgcgggacatcagcaagattcccgggggcaatatgtatgccgacgacaccgcagggtgggacactcgcatcaccgaggacgacttacaaaacgaggccaagattacggacatcatggaaccggagcacgccctgctggcaacctccatattcaagctaacctaccagaataaggtagtgcgggtgcagcgccccgctcgcaacggcaccgtcatggatgtgatcagcaggcgagaccagcggggatccggtcaggttggaacgtatggcctgaacaccttcacaaacatggaagcccagcttatccgccagatggagtcagagggaatattctccccttccgagctcgagacccccaacctggcagaacgcgtgctggattggctcgaaaagcacggcgtagaaagactgaaaaggatggccatcagtggcgatgactgcgttgtcaagccgatcgacgaccgcttcgccacggcgctgtccgccctcaacgacatgggcaaggttcgtaaggacataccccaatgggagcccagcaaggggtggaacgactggcaacaagtcccattctgctcccatcactttcaccagctgataatgaaagacggccgtgagatagtcgtgccctgccgtaaccaggacgaattggtgggtcgtgccagggtcagccagggcgccggctggagtctccgagaaaccgcctgccttggcaagagctacgcgcaaatgtggcagctgatgtacttccaccggagggacttacgtctggcggcaaacgcaatctgcagtgcggtacccgtggactgggttcccactagccgcaccacctggtccattcacgcccatcaccagtggatgaccacggaggacatgctatcagtgtggaaccgggtgtggatcgaggagaacccctggatggaggacaagactcacatttccagctggggggacgtaccgtaccttgggaagcgcgaggaccaatggtgtggttccctcatcggactcacggcacgcgccacctgggcgactaacatccaagttgcaatcaaccaggttagaagacttatcggcaatgagaactacctggactacatgacctccatgaagcgattcaagaatgagtctgaccccgaaggggccctgtggtaa

SEQ ID NO: 24325 - RNA, 9879 nt, synthetic construct
  misc_feature 1..9879: note = derived and/or modified CDS sequence (opt11) from DENV-1__GQ199814__SS-prME
  source 1..9879: mol_type = other RNA
agcgtgaccatgctgctcatgctgatgccgaccgcccttgcattccacctcactaccagaggcggggaaccccacatgatcgtgtccaaacaggagcggggcaagagcctgctatttaagaccagcgcgggcgtaaacatgtgcacgctaattgccatggacctgggagagttctgcgaggatacgatgacctacaagtgtccccgcatcaccgaggcagagcccgacgacgttgactgctggtgcaacgctaccgacacgtgggtcacctacgggacctgcagccagacaggggaacatcggagggacaagcggtccgtggccctggcgcctcatgtgggcctaggtcttgaaacgagaaccgagacctggatgtcgtccgaaggcgcctggaagcagatccagagagtcgagacctgggcgctgcgccacccagggttcactgtgattgccctcttcctggcgcacgccatcggcacaagcatcactcaaaaggggatcatattcatcctgctcatgctggtcactccttccatggcaatgcggtgtgtcggtatcgggtcaagggacttcgtggaggggttatctggcgccacctgggttgacgtcgtgctcgagcatgggagctgcgttaccaccatggccaaagacaagcctacgctagatatcgagctgttaaagacggaagtcacgaaccccgcagtgcttcggaagctatgcatcgaagcgaagatatccaataccaccactgacagccgctgcccgactcagggagaggccaccctggttgaagagcaggacgccaatttcgtctgtcggcgcaccttcgtggatcgcggctggggtaatggctgcgggctgttcggcaagggatccctgattacgtgcgctaaattcaagtgcgtgacaaaactggaaggcaagatcgtacaatacgagaacctgaagtactccgttattgtaaccgtccacactggcgaccagcaccaggttggcaacgagtcgacggagcacggtaccaccgcgaccatcacgccccaagcccctagcacggagatccagctgacggactacggggcactcactctggattgcagccctcggaccggcctggacttcaacgagatggttttgttgacgatgaaggagaagtcctggctggttcacaagcagtggtttctcgacctgccgctgccctggacctctggtgcctccactagccaggaaacctggaaccggcaggatctactggtgacattcaagaccgcccatgcgaagaagcaggaggtcgtggttcttggcagccaggagggtgcgatgcacactgccctcaccggagccacggagatccagaccagcggtaccaccacgatattcgccgggcacttaaagtgcaggctgaagatggacaaactcaccctgaaaggcatgtcctacgtcatgtgcaccgggagcttcaagttagagaaggaagtggcggagacacagcatggcactgtgctcgttcaaataaaatacgagggcaccgacgccccctgtaagatcccattctccacacaggatgagaagggtgtgactcaaaatggccggctgatcaccgcaaacccaatcgtaaccgacaaggacaagcccgtcaacattgaggccgagccgccttttggggagagctacatcgtgatcggggcgggcgaaaaagccctgaagctgtcctggttcaagaaagggagctccatcgggaaaatgttcgaggccaccgcacgcggggcccggcgcatggctatcctcggggacactgcctgggactttgggagcatcgggggtgtgttcacgtcggtcgggaagctggtgcaccagatcttcggcactgcctacggggtgctctttagcggcgtcagttggaccatgaaaataggcataggcgtgctcctaacctggctggggctcaatagccgctctacgtctctgtccatgacctgcatagccgtagggctggtcaccctctacctgggcgtgatggtgcaggccgatagcggctgtgttattaactggaagggcagagagctgaagtgtggctctggcattttcgtgaccaacgaagtgcacacgtggaccgagcagtacaagttccaggcggacagtccgaagcgcttgagcgcagccattggcaaggcgtgggaggagggcgtgtgcggcatccggtccgccacccgcctggagaacattatgtggaaacagatcagcaacgaactgaatcatatcctcctggagaatgacatgaaattcaccgtggttgtcggggatgtggcgggaatcctggcacaggggaaaaagatgatccggccccagccaatggagtataagtactcgtggaagtcctggggcaaagccaaaatcataggcgcggacgtgcagaacaccaccttcatcatcgacggacccaacacaccggaatgccccgacgaccagagagcgtggaacatatgggaggtcgaggattacggcttcgggatcttcaccaccaatatctggctcaagctgcgggactcctacacccaggtgtgcgaccatcgcctgatgagcgccgccataaaggactccaaggccgttcatgccgatatgggctattggatcgagagcgaaaagaacgaaacctggaagctcgcgcgagcctcatttatcgaagtcaagacctgcatttggcctaagagccacacactgtggtccaacggcgtcctcgagagcgagatgatcatccccaaaatctacgggggaccgatctcccagcacaactaccgccccgggtattttacccagaccgccggcccttggcacctcggtaagcttgagctggacttcgatctctgcgaaggcaccactgtcgtcgtggacgagcactgcggaaacagagggccttccctgcgcactaccacggtaaccggaaaaatcatccacgaatggtgctgtcgctcctgcacgctgccacccctgcgctttaagggggaagatggctgctggtacgggatggagatcaggcctgtcaaggaaaaggaggagaacttggtgaaatccatggtgagtgccggctcaggcgaagtagacagtttttccctagggctactgtgcatcagcatcatgaccgaggaggtgatgagatccagatggagccggaagatgctgatgaccgggacactcgcggtgttcttccttctgataatggggcaactcacctggaacgatctcatcaggctatgtatcatggtcggggcgaatgcatccgaccgcatggggatggggacaacctacctcgcccttatggcgacctttaagatgcgaccgatgttcgccgtggggttgctgtttcggcgcttaacgtctcgggaggtgcttctcctaaccatagggttgtcgctcgtcgcgagcgttgagctgccgaacagtctggaggagctcggagacggcctagccatgggtataatgatactgaagctcctgactgacttccagtcgcaccaattgtgggcgaccttgttgagcttaacgtttatcaagactactttcagcttacactatgcctggaagaccatggcgatggtcctgtccatcgtgagcctattccccctctgcctgagtaccactagccagaagaccacgtggctgccagtactgttaggctccctggggtgtaagccgctaacgatgttcctcattgccgagaataagatctgggggcgcaaaagttggccgctgaacgaggggatcatggccgtcggcatcgtgtccatcctcctcagtagcctgctcaaaaatgatgttcccctggccgggcccctaatcgccggcggcatgttgatagcgtgctacgtcatctccgggagctccgccgatctgtccctagagaaggcagccgaagtgtcctgggaggaggaggcggagcacagtggggcttcccacaacattctcgtggaggtccaggacgatggaaccatgaagatcaaggacgaggagcgcgacgacaccctaaccattctcctcaaggccaccctccttgccgtgagcggcgtctaccctctctcaatcccggccaccctgttcgtctggtacttctggcaaaagaagaagcagcgctcgggggtgctgtgggacacccccagccctccggaggttgagcgagccgtcctcgacgacggaatataccggattatgcagcgcggactattggggcgcagccaggtgggcgtgggggtctttcaggagaacgtattccataccatgtggcacgtgacccggggcgcggtcttgatgtatcaggggaagcgcctcgagcccagctgggccagcgtgaagaaagacctgatctcctatggcgggggttggcggcttcagggctcatggaacacgggggaggaggttcaggtcatcgccgtggagcccggcaaaaaccccaagaacgtacagacggctcccggtacattcaagacctccgagggcgaagtcggcgccatagctctcgatttcaagccagggacgagcggctcccccatcgtgaatcgcgaggggaagattgtgggcttatacgggaacggggtcgttaccacctccggcacctacgtgagcgccattgcccaggccaaggcatcccaggaagggccactgcccgagatcgaagatgaggtcttccggaagcgcaaccttacgatcatggacttgcaccccgggtcgggaaagacacggcgctatctgcctgccatcgtgagagaggccatcaagcgcaagttacggacccttatcctggccccgacgagagtagtagcctccgaaatggcggaagccctcaagggcatgcccatccgctaccagactacagcggtcaagagcgagcacaccggcaaggagattgtagacctaatgtgccacgccaccttcacgatgcgtcttctctccccggtccgcgtgcccaactacaacatgatcatcatggacgaggcccatttcacagacccgagctcaattgcggcccgggggtacataagcacacgtgtgggcatgggggaagccgccgccatcttcatgaccgcgaccccacccggcagcgtcgaagctttcccccagtcgaacgccgtgatccaggacgaggagagggacataccggaaagatcctggaacagcgggtacgaatggatcacggatttccccggcaagaccgtgtggttcgtcccctccattaaaagcggcaatgatatcgcaaactgcctgcggaaaaatggtaagcgcgtgatccagctgtcccggaagacttttgacacagagtaccagaagaccaagaacaatgactgggattacgtcgtcaccaccgacatcagcgagatgggcgccaattttcgcgcggatcgggttatcgacccccgtcggtgcctcaaaccggttatcctgaaggacggacccgaaagagtcatccttgccggccccatgcccgtgacggtagcctccgccgctcagcgccgcgggcggataggacgcaaccacaataaggagggcgaccagtacgtttacatgggtcagccgttgaacaacgacgaggaccacgcccattggacggaggccaagatgctgctggataacattaataccccagaggggatcatcccagccctcttcgagcccgagcgtgaaaaatccgcagccatcgatggggagtaccgcttacgcggcgaggcaagaaagaccttcgtggaactcatgcgccgcggggatctcccggtctggctgtcctacaaggtcgcttccgagggtttccagtacagcgacaggcggtggtgcttcgatggagagcgcaacaaccaagtgctggaggagaacatggacgtagagatctggacaaaggagggagagaggaagaagctcagaccccggtggctagacgcccgcacctactccgaccccctggccctccgggaatttaaggaattcgcggctggccgtaggagcgtgtccggggaccttatcctggagatcgggaagctaccacagcacttgacccaacgcgcccagaacgccctggataacctcgtgatgctgcataatagcgagcaaggcgggcgggcgtaccgccacgccatggaggaactccccgacacgatcgaaaccttgatgcttctggccttgatagccgtcctgaccggcggcgtgaccctgttcttcctctcaggccggggtctgggcaagaccagcatcggcctactatgcgtgatggcctccagcgtcttgctgtggatggcgtccgtggagccccattggatcgccgccagtatcatcttagagttctttctgatggtgctgctaatccccgaacccgaccgccagaggaccccacaagacaatcagctcgcttatgtggtgatagggttattattcatgatcctgacggtggcggcaaacgagatgggcctgttggaaactaccaaaaaggacctggggatcgggcacgtagccgtggagaaccatcaccacgctgccatgctggatgtggaccttcaccccgcctcagcatggaccctgtacgccgtcgccacgacaatcatcacccccatgatgcgacacacgatcgaaaacacaaccgcgaacatctctctcaccgccatagcgaaccaggcagcaattcttatgggcctggacaagggctggccgatctctaagatggacatcggcgtgcccctgctcgccctggggtgctacagccaggtcaatcctctgaccctcactgcggccgtcctgatgctggtagctcactacgccatcattggccccgggctgcaggccaaggcaacgagggaggcccagaagaggaccgccgccggcattatgaaaaacccaaccgtagacggtatagtcgccatcgatctggaccctgtggtgtacgacgcgaaattcgagaagcagttgggtcagattatgctcctgatcctgtgcacgtcccagatcctcctgatgcgcaccacctgggccctgtgcgagtcgatcacccttgccaccggccccctgaccaccctgtgggaagggtctcccggcaagttctggaataccactatagctgtgagcatggccaacatttttagggggagttacctcgccggcgctggcttggccttcagtctgatgaagtccctagggggcgggcgccgcggcacgggggcccaaggcgagaccctgggcgagaagtggaagcgccagctaaaccagctctccaagagcgagtttaacacctacaagagaagcggaatcatggaggtcgaccgcagcgaggccaaagagggacttaagcggggggagactaccaagcacgccgtgtcccgcggtaccgccaagctgcgatggttcgtcgaacgcaacctcgtgaagcccgaaggcaaggtgattgatctcggctgcggtcgcggcgggtggagctactactgcgccggactgaaaaaagtaaccgaggttaaggggtatacgaagggagggcccggccacgaggagcctatacccatggcaacctatgggtggaacctggtgaagctccactcgggcaaggacgtcttctttatcccgcccgagaagtgcgacaccctgctgtgcgatataggggagtcctcccccaacccaacgattgaggagggccgcacgctccgggtgctgaagatggtggagccatggctgcgcgggaaccagttctgtatcaagatcctcaacccctacatgcccagcgtcgttgagaccctagagcagatgcagcggaagcacggcggcatgctggtacgcaaccccctctcccgaaacagcacacacgaaatgtactgggtctcttgcggaactgggaatatcgtgtcggccgtaaacatgacctcccgcatgctgctgaacagattcacaatggcccatcgcaagccgacttacgagcgcgacgtcgatctcggtgccggcacccggcacgtggcagtcgagcccgaggtcgctaatctggatattatcggccaacgcatcgagaatatcaagcacgagcacaaaagcacctggcattacgacgaggacaacccttacaagacgtgggcgtaccacgggtcgtacgaggtgaagcccagtggcagcgcctcaagcatggtcaacggggtggtgaagctgttgaccaaaccgtgggacgtcatccccatggtgacccagatagccatgaccgacacgacccccttcggccaacagcgtgtgttcaaggagaaggtcgatacccgcacccctaaggcaaaacgtgggacggcccagatcatggaggtgaccgccaagtggctttggggcttcctgagtcgcaacaagaagccccggatttgtacgagagaggaattcacaaggaaagtccgcagcaacgcagccataggcgccgtcttcgtggacgagaaccaatggaacagtgcgaaggaggccgtggaagacgagcggttttgggacctcgtccatagagagcgggaactgcacaagcaagggaagtgcgcgacgtgtgtgtacaatatgatgggcaagcgcgagaagaagctgggagagtttgggaaggccaaggggagccgggccatatggtacatgtggctcggcgcgcgctttctggagttcgaggccttagggttcatgaacgaggaccactggttctcccgggagaacagcctatccggggtggagggtgaggggttgcacaagctgggctacatcctaagggacatctccaagatccccgggggaaacatgtacgcagacgataccgctggctgggacactaggatcactgaggacgacctacagaacgaggccaagattacggacatcatggagcccgaacatgcccttctggccaaatccatcttcaagctcacctaccagaataaagtcgtgagggttcagcggccggccaaaaacgggaccgtcatggacgtgataagccgccgagaccagaggggttccggacaggttggaacctacggcctcaacacattcaccaatatggaggcccaattgattcgccagatggagagcgaggggatcttctctccctctgagttggagactcctaacctggcgggaagggtcctcgactggcttgagaagcacggggtggaaagactgaaacggatggccatctccggagacgattgcgttgtcaaaccgatagacgatcgctttgccacagccctcacggccctgaacgacatggggaaggtgcggaaagacatcccgcagtgggagcccagcaagggttggaacgattggcagcaagtgcccttttgcagccatcactttcaccagcttatcatgaaggacgggcgtgagatcgttgtgccctgtcggaaccaggatgagctcgtcggacgcgcccgggtatcccagggcgcgggttggtcgttacgcgagaccgcatgcctggggaaatcctacgcccagatgtggcagctcatgtacttccaccgccgtgacctgcggctggcagccaacgcaatctgcagcgctgttcccgtcgactgggtccccacctcccggaccacgtggagcatccatgcgcatcaccaatggatgaccaccgaggacatgttatctgtgtggaacagggtttggattgaggagaatccatggatggaagacaaaacccatatctcaagctggggcgacgtgccctacctgggcaagcgtgaggaccaatggtgcggcagcctgatcgggctcacggctcgtgcaacctgggctaccaacatccaggtcgccatcaaccaggtgcgccgcctgataggcaacgaaaactatcttgactacatgacatccatgaagcggtttaagaacgagtcggacccggagggggccctgtggtaa

SEQ ID NO: 24326 - RNA, 9879 nt, synthetic construct
  misc_feature 1..9879: note = derived and/or modified CDS sequence (opt11) from DENV-1__GQ199816__SS-prME
  source 1..9879: mol_type = other RNA
agcgtgaccatgctgcttatgctgatgccgaccgccctggccttccacctaactactagggggggggagccccacatgatcgtatccaagcaggaacggggtaaaagcttgctgtttaagacctccgcgggcgtgaacatgtgcaccctcatagccatggacctgggggagttctgcgaggacacgatgacatacaagtgccctcgaatcacggaggccgaacccgacgacgtggactgctggtgtaacgcgacagatacgtgggttacctatgggacgtgtagccagaccggggaacaccgacgggacaagcggtccgtcgccctggcgccccatgtcggcctcgggctagagacgcgcacagaaacttggatgagctccgaaggcgcctggaagcaaatccaaaaagttgagacctgggccctacggcaccccggtttcacggtgatcgccctcttcctggcgcacgccatcgggacctcaatcactcaaaaagggatcatctttatcctgctcatgcttgttacgccctccatggccatgcgctgcgtcggcatcggcagccgcgactttgtggaggggctgtccggagctacgtgggtggacgtcgtgttagaacacgggagttgcgtgaccaccatggccaaggacaagcctactctggacatcgagctgctaaagacggaggtgactaacccggctgtgctgcgaaagctgtgcatcgaggcaaagatttccaacaccactacggacagccgatgcccgactcagggagaggccaccctcgtggaagaacaggacgccaacttcgtctgccgcaggaccttcgtcgatcgcggttgggggaacggctgcgggctgtttggtaaggggtcccttattacatgcgcgaagttcaagtgcgtgaccaagctcgagggcaagacagtacagtatgagaatctgaagtacagcgtgatcgttaccgtacacacgggcgaccaacaccaggtgggaaatgaatccacagaacacggtaccaccgcaacgataacgccgcaggcccccagtaccgaaatccagctgacagactacggggccttaaccctggattgctccccccggacgggcctggacttcaacgagatggtcttgctgaccatgaaggaaaaggcctggttggtgcacaagcaatggttccttgatctgcccttgccttggaccagcggggccagcacttcgcaggaaacgtggaatagaaaagacctcctggtgaccttcaagaccgcccatgccaaaaagcaggaggtcgtggtgctcggctcgcaggagggtgcgatgcacacagcactcaccggagcaaccgaaattcagacctccggcaccaccaccatcttcgctgggcacctcaagtgccggctcaagatggataagctgaccctgaaagggatgagctacgtgatgtgcaccggcagtttcaagctggagaaggaggtggccgagacacagcacggcaccgtgctcgtccagatcaagtacgaaggcacggacgcaccatgtaagataccctttagcacccaagacgagaaaggggtgacacagaatggacgacttatcaccgccaacccgatcgtaaccgacaaggagaaacccgtcaacatcgaggcggagccgcccttcggggagtcctacattgtaatcggggccggagagaaggccctgaaactgagctggttcaagaaggggtcctctattggcaagatgttcgaagcaaccgcccgcggagcgaggcgcatggccatcctcggcgacacggcctgggatttcgggtccatcggcggggtctttaccagcgtagggaaactggtgcatcagatcttcggcaccgcctacggagtgttgttttccggtgtctcgtggaccatgaagatcgggatcggcgtgctcctgacctggctgggcctgaactcccgcagcacctcccttagcatgacctgtatcgccgtcggtctggtcaccttatacctgggcgtcatggtccaagcggactctgggtgcgtcatcaattggaagggccgtgagctgaagtgcgggtctggcattttcgtgacgaacgaggtgcacacctggaccgaacagtacaagttccaggccgactcgccgaagcggctcagtgctgcgatcggaaaggcgtgggaggagggggtttgcggcatccggagcgctacccggctcgagaatatcatgtggaaacagatcagcaatgagctgaaccacatcttgctggagaatgacatgaagtttaccgtggtagttggggacgtggccggtatcctggcccagggcaagaagatgatccgcccccaacccatggagtacaagtacagctggaaatcctgggggaaggccaagatcatcggcgcggacgtgcagaacgccacatttataattgatggacccaacaccccggagtgccccgatgaccaaagagcctggaacatctgggaggtagaggactacggattcggcatatttaccaccaacatctggctcaagctgagagacagctacacccaggtctgcgaccacagactgatgtccgccgccatcaaggactcgaaggcggttcacgccgacatgggctactggatcgagagcgaaaaaaacgagacgtggaaactggcccgagcctctttcatagaagtaaagacctgcatctggcccaaatcccatactctgtggtccaacggcgtactcgagtccgagatgatcatccccaagatatacgggggccccatcagccaacacaattaccgacccgggtacttcacgcagaccgctggtccctggcacctcgggaagctggagttggattttgacctctgcgaaggcaccaccgtggttgtggatgagcactgcggcaaccgaggcccatccctgcggacgaccactgtgactggcaagataatacatgagtggtgctgccggagctgcaccctgccccccctgcgcttcaagggggaggacggatgctggtacggaatggagatccgccccgtcaaggagaaggaggagaacctggtcaagtccatggtcagcgcgggctcgggcgaggtcgactccttcagccttggtctcctgtgcatctccataatgatcgaagaggtcatgcggagccgctggtcccgaaagatgctaatgaccggtatcctcgccgtgttctttctgctgattatggggcaactaacctggaacgacctgattcgtctgtgtatcatggtaggcgccaatgcctcagatcggatggggatgggcaccacgtacctcgccctgatggcgacttttaagatgcgtccgatgtttgccgtgggcctgttatttaggcggctgacctcccgcgaagtgctgctcctcacgatagggctgagcctggttgccagtgtggagctgccaaattcccttgaggagctcggcgacggcctggccatgggcattatgatcttaaaactccttacggacttccagagtcaccagttatgggcgacactcttgagccttacctttataaagaccaccttctctctccactatgcctggaagaccatggctatggtcttaagcatcgtgtcccttttccccctctgcctttctaccacctcgcagaaaacgacctggctgcccgtgctcttggggagcctgggatgtaagcctctcaccatgttcttaatcgccgagaacaagatctggggccggaagagctggcccctgaacgaagggatcatggccgtggggattgtcagcatactcctgagctccctgctcaaaaacgacgtgcctctggccgggcccctgatcgccggtggcatgctgattgcctgttacgttattagcgggtcgtcggccgacctgtccctggagaaggccgcggaggtgagctgggaggaggaagcagagcacagtggcgccagccacaacatccttgtcgaggtccaggacgacgggacgatgaaaatcaaggacgaggagcgcgacgacactcttaccatcttgctcaaggccaccctgctagccgtgtcgggcgtgtacccgctctcaatcccagcgacgctgttcgtctggtacttctggcagaagaaaaagcagcggtcgggcgtgctgtgggacacaccctctccgcccgaggtggaacgcgcagtactcgacgacgggatataccggatcatgcaacgcggcttactagggcggagtcaggtgggcgttggggtcttccaggaaaacgttttccacaccatgtggcacgtgaccaggggcgccgttctgatgtaccagggtaagagactggaacccagctgggcctccgtgaagaaggatctgatttcatacgggggcggatggcgcctgcagggcagctggaacaccggggaggaggtgcaggtcatcgccgtggagcccggcaagaaccctaagaacgtccaaaccgcacccggtacgtttaagaccagcgagggagaggtcggcgcgatcgcccttgattttaagcccgggaccagcggttctcccattgtgaaccgggaggggaagatcgtaggcctgtacggtaatggagtcgtgaccactagcggcacctacgtttccgctatcgcccaagccaaggcgagtcaggagggtcctctgccggagatcgaagacgaggtctttagaaagcggaacctcaccatcatggacctccacccaggctccgggaaaacccgccgttatctgccggccatcgtgcgcgaggccattaagagaaagctccgcacgctgatactggcaccgactcgggtcgtcgccagcgagatggcagaggccctcaagggcatgcccataaggtaccaaaccaccgccgtgaagtccgagcatacgggcaaggaaatagtcgacctgatgtgccacgcgacattcaccatgcgcttactctccccagtgcgggtgcccaactacaacatgattatcatggacgaggcccacttcaccgacccttccagcattgccgctcgcgggtacatcagcacccgggtggggatgggggaggcggcagccatctttatgaccgcaacgccgccaggatccgtggaggccttcccccagtctaacgcggttatccaagacgaggaacgcgacattccggagcggagctggaactccgggtatgagtggataaccgactttcccggcaaaacggtgtggttcgttccgtcaatcaagtccggcaatgacattgctaattgcctgcgcaagaacggtaagagggtgatccagttgagccgcaagacatttgacacagaataccagaagaccaagaataacgactgggactacgtagttacgaccgacatctccgagatgggcgccaacttccgcgccgaccgcgttatcgacccccgtcgctgcctcaagccagtgatactcaaggacggtcccgagagagtcatactagccggccctatgccggtgaccgtggcgagtgccgcgcagcgccgggggcgcattggccggaaccacaacaaagagggcgatcagtacatatacatggggcaaccgttaaacaatgatgaagaccacgcccactggacagaggccaagatgctgctggacaacatcaacacgcctgagggtatcattcctgcactattcgagcccgagcgcgaaaaatccgcagccatagacggggagtaccggctgcgcggcgaagcccgcaagacattcgtggagctgatgcggcggggggacctcccggtctggctaagctacaaggtagctagcgagggcttccagtattcggaccggcgctggtgtttcgatggcgagcgaaataatcaggtcctggaagaaaacatggacgtggagatttggacgaaggagggagagcgcaagaagctccggccacgctggcttgacgcgcgcacttactcggaccccctcgcccttcgcgaattcaaggaatttgccgcgggccggcgatccgtcagcggggaccttattcttgagatcggcaagctaccccagcacctgacgcagcgggcgcagaacgccctagacaacctcgtgatgctgcataacagcgagcagggagggcgcgcctacaggcacgccatggaggagttaccggacaccatcgagacgctcatgctgctggccctgattgcggtgctcaccggcggagtcacgctgttcttcttgagcggcagagggctgggcaagacttccatcggactgctctgtgttatggcgagctccgtgctgttgtggatggccagcgtcgagccacactggattgccgcctccatcatactcgagttcttcctgatggtgctcctaattcccgaacccgaccggcagcgcaccccgcaggataatcagctggcgtacgtagtcatcgggctcctattcatgatactgaccgtcgctgccaacgagatgggcctgctcgagaccacgaagaaagacctggggattggtcacgtggccgtcgagaaccaccaccacgccgcaatgctagacgttgacctccaccccgcaagcgcctggaccctttacgctgtcgccaccactattattacgcccatgatgcggcataccatcgagaacaccaccgcaaatatctccctgacggccatcgccaaccaggccgcaatccttatgggccttgacaagggctggccgataagtaagatggacatcggggtccccctgcttgcattagggtgctacagtcaggtgaaccctctgactctaactgccgcagtgctgatgctggtcgcccactacgctatcattggccctgggctccaggccaaggccacccgcgaggcgcagaagcgaacggctgcggggataatgaagaatccgaccgttgacgggatcgtggccatcgaccttgaccccgtcgtgtacgataccaagtttgagaaacaactggggcagattatgttactgatcttatgcacctctcaaatcctgctaatgcgcaccacctgggccctgtgcgagtccataaccttagccacaggccccctgacgaccttatgggaggggtcacccggcaaattctggaacaccaccatcgccgtttctatggccaatatcttccgaggaagctacctcgctggcgctggcctggcgttctcactcatgaaatccctcgggggggggcgacgcggtacaggggcacagggggagactctcggcgagaaatggaagcggcagctgaaccagctcagcaagtccgaatttaacacctataagcgcagcgggatcatggaggtcgaccggtcagaggccaaggagggcctgaagagaggggagaccacaaagcacgccgtgagccgcgggactgccaagctgcgctggtttgtggagaggaacctcgtcaagccggagggtaaggtcatcgacctaggctgcggccgcgggggctggtcctactactgcgccggtctgaagaaggtgacggaggtcaagggctacaccaagggcgggcccggtcacgaggagcccatacccatggcgacgtacgggtggaacctggtgaagctccacagcggcaaggacgtgtttttcattcccccggagaagtgcgacaccctgctgtgcgacatcggggaatcgagccccaatcctaccatcgaggagggacggaccctccgcgtcctgaagatggtggaaccgtggctgcgtgggaaccaattctgtatcaagattctcaatccgtacatgccctccgtggtcgagactctggagcagatgcagcgcaagcacggaggaatgttagtaaggaatcccctcagccgcaactcaacccacgagatgtattgggttagctgcgggaccggcaacatcgtctccgctgttaacatgaccagccgaatgctgctgaatcgctttaccatggcccatcgtaagccaacgtacgagagggacgttgacctcggcgccggcactcgccatgtggccgtggagcccgaggttgcgaacctggacatcattggccagcggatagagaacatcaagcacgaacacaagtccacctggcactacgatgaagacaacccctacaaaacctgggcctaccacgggagttacgaggttaagcccagtggctcagcgagctccatggtgaacggggtcgtaaagttgctaacgaaaccctgggatgtaatacccatggtcacacagatcgccatgaccgacaccacgcccttcgggcagcaaagggtgtttaaggagaaagtagacacccggacccccaaggccaagcgcgggaccgctcagatcatggaggttacagccaagtggctgtggggattcctgagccggaacaagaagccccgcatctgcacccgggaggaattcacccgcaaggtccggagtaacgccgccataggcgcggtgttcgtcgacgagaaccagtggaactcagcaaaagaggccgtcgaggacgagaggttctgggacctcgtgcaccgtgagcgcgaactccacaaacagggtaagtgcgcgacctgcgtctacaatatgatgggcaagcgggagaagaagctcggggagtttggcaaggcaaaaggttcccgtgcaatatggtacatgtggttaggtgcacgattcttagagttcgaagccctgggcttcatgaatgaggaccactggttcagccgcgagaacagcctctctggggtggaaggcgaagggctccacaagctgggctacatcctgcgggacatcagcaagatccccggaggaaacatgtacgccgacgacacggcaggatgggacacgcggatcaccgaggacgacctacagaacgaggcgaagatcactgacatcatggagcccgaacacgcgcttttggcaaagagcatcttcaaattgacgtatcagaacaaggtggttcgggtacagcgcccggccaaaaacgggactgtgatggatgttatttcccgaagggaccagagaggtagcgggcaggttggcacatacggcctaaatacgttcacgaatatggaggcgcagctcatccggcagatggagtccgaggggatcttctcgccctcagagctggaaacccccaatctggcgggtcgcgtgctcgactggctggaaaagcacggggtcgagcggctgaagcgaatggccatctcaggtgacgactgcgtagtgaaacccatcgacgatcggttcgccacagccctcacggccctgaacgacatgggtaaagtccgcaaggatataccgcagtgggagccttccaagggctggaacgactggcagcaggtccccttctgtagccatcacttccatcaattaatcatgaaggacggccgagagatcgtggttccctgcagaaatcaggacgagctcgttgggcgggcgcgcgtgagccagggcgccgggtggagtctgcgggagacggcatgtttaggtaagtcgtacgcccaaatgtggcaactaatgtacttccatcgccgggacttgcgcctggcagctaacgcaatctgcagcgccgtcccggtggactgggtgcccacctcccggaccacctggtccatccacgcccatcaccaatggatgactaccgaagatatgctctccgtctggaaccgcgtttggatcgaagagaacccctggatggaggataaaacgcacatctccagctggggagatgtcccctacctgggcaaacgggaggaccaatggtgcggctccctgatcgggttgaccgcgcgcgccacgtgggccaccaatatccaagtcgcaatcaaccaagttcgccggctgattggcaacgagaactatctggactacatgaccagcatgaaaaggttcaaaaacgagatcgacccggaaggggccctctggtaa

SEQ ID NO: 24327 - RNA, 9879 nt, synthetic construct
  misc_feature 1..9879: note = derived and/or modified CDS sequence (opt11) from DENV-1__GQ199817__SS-prME
  source 1..9879: mol_type = other RNA
tctgtaaccatgctgctgatgctgatgcccaccgcgttagcctttcacctaacgacccggggtggcgagccccacatgatcgtgagcaagcaggagcggggcaaaagcctgctgtttaagacgtctgcaggcgtgaacatgtgtacactcattgccatggacctgggcgagttctgcgaagacaccatgacatacaagtgcccccggatcaccgaggccgagccagacgatgtggactgctggtgcaatgccaccgacacgtgggtgacctacgggacatgcagccagaccggggagcaccggcgggataagcggtccgtggcccttgcgccccacgtaggtttgggactggagacgcgcaccgaaacgtggatgagctccgaaggtgcctggaagcaaattcagcgggtggagacttgggccctgcgccatcccgggttcacggttatcgccctcttcctggcgcacgccatcggcaccagcattacccagaagggtataatattcatcctgctcatgctggtgaccccgtcgatggccatgcggtgcgtcggcatcggcagccgcgacttcgtggaggggttatccggcgcgacgtgggtagacgtcgtgctcgagcacgggagctgcgtaaccaccatggccaaggataaacccaccctggatattgaactgctaaagacagaggtcaccaacccagcggtgttacgaaagctgtgcatcgaggccaagatatccaacaccaccacggacagccgctgcccgactcaaggcgaggctaccctagtcgaggagcaggacgccaacttcgtctgccggcgcaccttcgtcgaccgaggctgggggaacggctgcgggctgttcggcaaggggtccctgatcacgtgcgccaaattcaagtgcgtaaccaagctcgaggggaagatagtccagtacgagaacctgaagtacagtgtgatagtgacggttcacacgggcgatcagcaccaggtggggaacgagtccacagagcacggcacaaccgcgaccatcactcctcaggcccccagcacggagatacaattgaccgattacggggccctcacccttgattgtagccccagaaccggtctggacttcaacgagatggtcctcctcacaatgaaggagaagtcctggttagtgcacaaacagtggtttctcgacctgccgcttccgtggacaagcggggcatccaccagccaggagacgtggaacagacaggacctcctggtgacgttcaagacagcccatgcaaagaagcaagaggtcgtagtgctcggctcccaggagggagccatgcacaccgccctcaccggggccacagagatccagacctctggtaccaccacaatatttgccgggcacctgaagtgcaggctgaagatggacaaactcaccctgaagggcatgtcctacgtaatgtgcaccgggagctttaaattggagaaggaggtcgccgagacacagcacggcacggtcttagtccagatcaagtacgaaggcaccgacgctccgtgcaagatcccgttctcgacccaggatgaaaagggggtgacgcaaaacggccggctaatcacggccaatccgatcgtgaccgacaaagagaagcctgttaacattgaggcggagccgcccttcggggagagctacattgtgattggagcgggtgagaaggcgttgaaactgtcctggtttaaaaaggggagctccatcggaaagatgttcgaagccacggcccgcggggcccggcgtatggccatcttgggggacaccgcatgggacttcggcagcatcggcggcgtttttacgtctgtcggcaagctggtgcaccaaatcttcggcaccgcctacggggtcctgttcagcggcgtcagttggaccatgaagatcgggatcggcgtgctcctgacctggctgggcctcaactcccgatccacgagcctctccatgacctgcatcgccgtggggttagtgaccctctacctgggcgtgatggtgcaggccgacagcgggtgcgtcatcaattggaaaggccgggaactgaagtgcgggtcaggcatcttcgtaaccaacgaagtgcatacgtggaccgagcagtacaaattccaggcggattcccctaagcgcctcagcgctgccattggcaaggcctgggaggaaggggtctgcggaatacggtccgcaacccgcctggagaacatcatgtggaagcaaatcagcaatgagctgaaccacatcctcctggagaatgacatgaaattaacagtggtggtcggcgatgtggcgggcatcctcgcccagggtaaaaagatgattcggccacaaccgatggagtacaagtactcctggaagagctggggcaaagccaagataatcggagcggacgttcagaacaccactttcatcatcgacggacccaacaccccggaatgccccgacgaccagcgcgcgtggaacatctgggaggtcgaagactatggtttcgggattttcacaaccaatatctggcttaagctgcgggactcttacacacaggtgtgtgaccaccgcctcatgagcgccgccatcaaagactccaaggcggtgcacgccgacatgggatactggatagagtcggagaaaaatgagacttggaagctagcgcgggcctccttcatcgaagtcaagacctgcatctggcccaagagccataccctgtggtccaacggcgtgttagaaagcgagatgatcatccccaagatttacgggggcccgatctcccaacacaactaccgccctgggtacttcacgcagacagcaggcccctggcatctggggaaactggagctcgacttcgacctgtgcgagggaaccaccgtggtggtggacgagcactgcggaaaccgggggccgtccctgcgtacgaccactgtgaccggcaaaatcatacacgagtggtgctgccggtcctgcacgctgcctccattgcgctttaagggggaagacggctgctggtacgggatggagatccggcccgtcaaggagaaggaagaaaacctggtgaagagcatggtgagcgccggctccggcgaggtcgacagcttctccctcgggctgctgtgcatcagcatcatgatcgaggaggtcatgcgctcccggtggtcgcggaagatgctcatgactggcaccttagctgtgttcttcctgttgattatggggcagctgacctggaacgacctaattcggctctgcatcatggtcggcgcgaatgcctccgaccgcatggggatggggactacctacctggccctgatggccactttcaaaatgcgcccaatgttcgccgtaggcctcctgttccgccgccttactagccgggaggtcctcctcctgacgatcgggctctcactggtcgcgtctgtggagctgccgaactccctcgaggaactaggagacgggctggccatgggcatcatgatcttaaagcttctgaccgacttccagagtcaccagctctgggccaccctgctgtccctcaccttcatccgcacgacattctcgctgcactacgcttggaaaactatggccatggtcctgtccattgtgagcctcatccccttgtgcctgtctactaccagccagaaaaccacttggctgcccgtgctcctcggctccctcgggtgcaagccgcttaccatgtttctcatcgccgagaacaagatatggggccgaaagagctggccgctcaacgaaggtataatggcagtcggcatcgtgagcatcctactgagcagcctgctgaagaacgacgtcccgctcgccgggcccctcatcgccggtggaatgctgatcgcgtgctacgtcatctccgggtcgtccgccgacctgagcctcgaaaaggctgctgaggtgtcctgggaagaggaagccgaacacagcggagcgtctcacaacattctggtggaggtgcaggacgacggcacgatgaagatcaaggacgaggagcgcgacgacaccctgaccatactcctgaaggccaccttattagccgtgtccggagtctacccgctgtccatccctgccaccctgttcgtctggtgtttctggcagaaaaagaagcagcgcagcggtgtgctatgggacacaccctccccgcccgaggtggagcgcgcggtactggacgacggcatttaccgcatcatgcaacgcggcttactggggcgatcacaggtgggcgtcggggtcttccaggaaaacgtgttccataccatgtggcacgtgacgcgcggggcggtcctgatgtaccaagggaagcggctggagccctcctgggccagcgtgaagaaggatctgatcagttatggcggcgggtggcgtctccaaggaagttggaataccggggaggaggtgcaggtcatcgccgtcgagcccgggaagaaccctaaaaacgtacagactgcacctggcacatttaagacctccgaaggcgaggtcggagcaatcgctctcgacttcaagcctggcaccagcggctcgccgatcgtgaaccgggaggggaagattgttggcttatacggcaacggggtggttacgacctccggcacctacgtgagtgccatagctcaggctaaggcaagtcaggaagggccccttccggagatcgaggacgaggtcttccgcaaacgcaacctgaccataatggaccttcatcccggcagcggcaaaacgcgccggtatcttcccgctatcgtgcgcgaggccattaaacggcgactgcgaaccctaatccttgccccgacacgggtggtcgcctccgagatggcggaggccctgaagggtatgccaatccgctaccaaaccacggccgttaagtctgagcatactggtaaagagattgttgatctgatgtgccacgccaccttcaccatgcggctcctgagtcccgtcagggttcccaactacaacatgatcatcatggacgaggcccacttcacggacccgagctccatcgcagcccgggggtacattagcaccagagttggcatgggggaggccgccgctatcttcatgaccgcgaccccgccgggttccgtcgaagccttcccccagagcaatgccgtgatccaggacgaggagcgggacattccggagcgctcctggaacagcgggtacgagtggattacggactttcctgggaagaccgtatggttcgtcccttccataaagagcggcaacgacatcgccaactgcctgaggaagaacgggaagcgcgtgattcaactctcccggaagaccttcgacaccgagtaccaaaagacgaagaacaacgactgggactacgtggtcaccactgacatcagcgagatgggcgccaacttccgcgccgatcgggtgatcgacccccgccggtgtctgaagccggtgatcctgaaggatgggccggagcgcgtcatcctcgccggccccatgcccgtgacggtcgcctccgcagcacagcggcgcgggcgtatcggccgcaaccacaacaaggagggagaccagtacatctatatgggtcagccgctgaacaacgacgaggaccacgcccactggacggaggccaagatgctcctcgacaacatcaacacacccgagggcatcatccccgcgctgttcgagcccgagagagagaagtccgctgcgatcgacggggagtaccgcctgaggggcgaggcccgtaagaccttcgtggaattaatgcgccgcggggacctgccggtgtggctgtcttataaggtcgcctccgaaggtttccaatacagcgaccgccggtggtgcttcgacggtgaacgtaacaaccaggtgctcgaggagaacatggacgttgagatttggaccaaggagggggagcggaagaagctgcgcccccggtggctggacgccaggacttattccgatcccctcgctctgagggagttcaaggagttcgcggcgggccgccggagcgtctccggggacctgattctagagatcggcaagctgccccagcacctgactcagcgcgcccaaaacgccctagacaacctggtgatgctgcacaactcagagcagggagggcgcgcgtatcgccacgccatggaagagttaccggacactatcgagaccctgatgctcctcgccctcatcgcggtactgactggcggggtcacactcttcctgctgtcgggccgggggctcggtaagaccagcatcggcctgctgtgtgtgatggcctccagcgtcctcctgtggatggcgagtgtcgagccccactggattgccgcctccatcatcctggagttcttcctcatggtgctgctgatccccgagcccgaccgtcagcggaccccgcaggacaatcagctcgcctacgtagtaattgggttgctgttcatgatcctcaccgtggcggcaaacgagatggggctgctggagacaaccaagaaggatctcgggataggacacgttgctgtcgagaaccaccaccacgccgccatgttggatgtcgacctgcatcctgcttccgcgtggactctttacgcagtggcgaccacgatcatcaccccgatgatgaggcacacgatagagaacaccaccgctaacatcagcctcaccgccattgcgaatcaagccgccatcctgatgggactcgacaaaggatggccgatctccaagatggacatcggcgtccccctgctggccctcgggtgctactcccaggtgaacccccttaccttgaccgcggcggttctcatgctggtcgctcattacgcgatcatcgggccgggactgcaggctaaggcgacgcgcgaggcccagaagcggaccgccgccggcatcatgaaaaaccctaccgtggacgggattgtggctatcgacttggaccccgtcgtgtacgacgcgaagtttgagaaacaactaggtcaaatcatgcttctcatcctgtgcacctcgcagatcctgctgatgcgcaccacctgggcgttgtgtgaatctatcaccctagccaccggccccctcactaccctgtgggaaggttcccccggaaaattctggaacaccaccatcgcggtgagcatggctaacatcttccgggggagctacctggcgggcgccggcctcgccttctctctgatgaagtccctcgggggcgggagacgggggacgggggcccagggcgagaccctgggcgaaaagtggaaacgccagctgaaccagttatccaaaagcgagttcaacacctacaagcggtccggcatcatggaggttgaccgcagcgaggcgaaggaggggctcaagcgcggggaaaccacgaagcacgcggtgtcgagaggcaccgccaagctgcggtggttcgtggagcgcaacctggtgaagccggaagggaaggtgatcgacttaggttgcggccgcggcgggtggagctactattgtgccggcctcaagaaggtgaccgaggtaaaggggtataccaagggcggcccaggccacgaggagccaatacccatggccacgtacgggtggaacctggtcaaactccactccggcaaggacgtgtttttcatcccgcccgagaagtgcgacaccttactgtgcgatatcggggagagctcccccaaccccaccatagaggagggccggacactgcgggtcctcaaaatggtagagccgtggctgcgcgggaatcaattctgcataaagatattaaacccctacatgccctcagtagtcgagacgttagagcagatgcagcgtaagcacggcggcatgctggtgcgcaaccccctgtcccggaacagcacccacgaaatgtactgggtgtcctgtgggaccggcaatatcgtcagcgcggtgaacatgacctccagaatgctccttaacagattcaccatggcccaccggaagccgacgtacgagcgtgacgtggacctgggggccggcacacgccatgtcgccgtggagccagaggtggccaacctcgacatcattggacaacgcatagagaacatcaagcacgagcacaaaagcacctggcactatgatgaggacaacccgtacaagacctgggcgtaccacgggtcctacgaggtcaagcctagtgggtctgcgtccagcatggtgaatggcgtcgtaaagctgctgacgaagccgtgggacgttatccctatggtcacccagatcgccatgacggacaccacgccctttggccagcagagggttttcaaggagaaggtggacacccgcacccccaaggccaaacgagggaccgcccagattatggaggtaacggcgaagtggctgtggggtttcctgtcccgcaacaagaagccgcgtatctgcacccgcgaggaattcacacggaaggtgcgcagcaatgccgccatcggcgccgtgtttgttgacgagaaccagtggaactcggcgaaagaagccgtggaggacgagagattttgggacttggtgcaccgcgagcgtgaattacacaagcagggaaagtgcgcgacttgtgtatacaacatgatgggcaagcgtgagaagaagctgggggaattcggtaaagccaagggttcacgcgccatatggtacatgtggctgggcgcgcggttcctcgagtttgaggcgttaggcttcatgaacgaggaccactggttttcgcgggagaatagcctgtccggggtggagggcgaaggcctccacaaactcgggtacatcctacgcgatatcagtaagatcccagggggcaatatgtatgccgatgataccgccggatgggacacccgcataacggaagacgacctccagaacgaggccaagattaccgacataatggaacccgagcacgcgctgcttgccaagtccatcttcaaactcacataccagaataaggtggtccgcgtgcagcgcccggccaagaacggtacagtgatggacgtcatcagccggcgcgatcagagaggctccggccaggtgggcacttacggcctgaacacctttacgaacatggaggcccagctgatccgccagatggaatctgaggggatcttcagccccagcgagctggagacccccaacctggccggccgagttctggactggcttgagaagcacggggtagagcgcctgaagagaatggcgatcagcggagacgactgtgtggtgaaacccatcgacgaccgcttcgccaccgccctgacagcccttaacgatatggggaaggtccggaaagacattccgcaatgggagccctctaagggctggaatgattggcagcaggtccccttttgcagccatcattttcaccagctgatcatgaaggatggccgcgagatcgtggtcccctgccggaatcaggacgagctggtggggcgcgcccgggtgtcccagggtgcagggtggtcgctacgcgagacggcctgccttgggaagtcctatgcccagatgtggcagctaatgtacttccaccggcgcgatctccggctggctgctaacgccatctgcagcgccgtccctgtggactgggtgcccacatcccgcaccacatggagcattcacgctcaccaccaatggatgacgaccgaggatatgctgtcagtctggaaccgggtgtggatagaggagaacccctggatggaggacaaaacccatgtgtctagttggggcgacgtcccctaccttggcaagcgcgaggaccagtggtgtggcagcttgatcgggctcaccgcccgcgcgacgtgggccacgaacatccaggtcgccattaaccaggtgcggcgcctcctggggaacgaaaactatctggactacatgacttccatgaaacgtttcaagaacgaaagtgacccggaaggagctctctggtga

SEQ ID NO: 24328 - RNA, 9879 nt, synthetic construct
  misc_feature 1..9879: note = derived and/or modified CDS sequence (opt11) from DENV-1__FJ882550__SS-prME
  source 1..9879: mol_type = other RNA
agcgtaaccatgctgttaatgttaatgcccaccgccctggcgtttcacctcaccacacggggcggtgaaccccacatgattgtgacgaagcaggagcggggcaaaagcctgctgttcaagaccagcgccggcgtgaacatgtgtaccctcatcgccatggaccttggcgaactgtgcgaggacaccatgacgtacaagtgccccagaatcaccgaggccgagcccgacgacgtggactgctggtgcaacgccacggacacctgggtgacttatgggacgtgcagccagacgggtgagcaccggagagacaaaaggagcgtggccctcgctccccacgtaggtctcgggctggaaacccgcaccgaaacgtggatgagtagcgagggcgcctggaagcagatacaacgggtcgagacgtgggctctccgacaccccggcttcaccgtaatcgcgctgttcctggcgcacgccatcggcacttccatcacccagaaggggatcatctttatcctcttaatgctcgtgacgcccagcatggctatgcgatgcgtcgggatcgggtcccgcgacttcgttgaggggctcagcggcgctacctgggttgatgtcgttcttgagcacgggtcctgcgtgactactatggccaaagataaacccacgctggatatcgagttacttaagactgaggtcaccaatcccgctgtgctacggaagctatgtatcgaggccaagatctcaaacaccacgaccgactcccgctgtccaacccagggcgaggccacccttatggaggaacaggacgcgaacttcgtgtgccggcggacgtttgtagaccggggctggggtaacggctgcgggctgttcggcaaggggtcgctcatcacgtgcgccaagttcaagtgcgtgaccaagctagagggcaagatcgtccaatacgaaaatctgaagtactccgtgatcgtaaccgtgcacacgggcgaccagcaccaagtcgggaacgaaagcacggaacacggcaccaccgcgaccatcacgccccaggctcccacgtctgagatccaacttacggattacggggccctgaccctggactgtagtccccgcacgggcctcgacttcaacgagatggtgctgctgaccatgaaagagaagtcatggctcgtccataagcagtggttcctggacctgccgttaccctggactagcggcgcctcaacttcccaggagacgtggaaccggcaggacctgctggtcaccttcaagactgcccatgccaagaagcaagaggtggtcgttttaggcagccaggagggcgccatgcataccgccctgacgggggccacagagatacagacctccggcatgaccacgattttcgcggggcatttgaagtgtcgactcaagatggataagctgaccctgaagggcatgagctacgtgatgtgcaccgggtcatttaagctcgagaaagaagtcgcggagacccagcatggcacggtgctggtgcagatcaagtacgaaggcaccgacgccccctgcaagatccccttctcgacccaggacgagaaaggggttacccagaacggccggcttatcacggccaacccgattgtgaccgataaggagaagcccgtgaacatcgaagcggagccgcccttcggggagtcttacatcgtcatcggcgcaggcgagaaagccctcaaactcagctggttcaaaaaggggtccagcatcggcaagatgttcgaggctaccgcccgcggggcccggcgaatggctatcctcggtgacaccgcgtgggacttcgggtcagtgggcggagtgttcactagcgtcgggaagctggtgcaccagattttcggcaccgcctacggggtcctgttctccggcgtcagctggaccatgaagatcggaatcggcgtgcttctgacctggctcggcctgaactcccgcagcacatccctgagcatgacctgtattgcagtggggctcgtaaccctgtatctgggcgtcatggtacaggccgattcagggtgtgtcattaactggaagggccgcgagctcaagtgcgggagcggtatctttgtgaccaacgaagtgcacacgtggaccgagcagtacaagttccaggcggactcccccaagcgcctgtccgccgcaatcggcaaggcctgggaggagggtgtatgtggcatccggtcggccacccgcctggagaacatcatgtggaagcagatctccaacgaactaaaccacatcctgctggagaatgacatgaaattcaccgtggtcgtgggggacgtagtaggtattctcgcgcaggggaagaagatgatccgtccccaacccatggagcataagtacagctggaaaagttggggcaaagctaagatcatcggcgcagacgtccagaacacgacgttcatcatcgacggtcccaacaccccggagtgccccgatgaccagcgcgcctggaatatttgggaggtggaggactacggcttcgggatcttcactaccaacatctggctgaagctgcgggacagctatacccaggtctgcgaccacagactcatgtccgcagccattaaggactccaaagctgtccacgccgacatgggatactggatcgagtccgagaagaacgagacctggaagctggccagagcgtcgttcatagaggtcaagacctgcatctggcccaaatcccacaccctatggagtaacggtgtgcttgagtccgagatgatcatccccaagatctacggaggtccgatcagccagcataactacagacccggatacttcacacagacggccggcccttggcacttaggcaagctcgagctcgactttgatctgtgcgagggcacgaccgtcgtggtggacgagcactgtggcaaccggggtccgagtctgagaactacaaccgtgaccggcaagatcattcacgaatggtgctgccgctcgtgcacgctgccacccctgcgcttcaagggggaggacggctgctggtatgggatggaaatcagacccgtgaaagagaaagaggagaacctggtgaaatccatggtcagcgccggcagcggtgaggtggactccttcagtctgggcctgctctgcatcagtatcatgatcgaggaggtgatgcgctctcggtggtcccggaagatgttgatgaccgggacactggccgtctttctgctgctgatcatgggacaattgacctggaacgatctcatccggctgtgcataatggtgggcgccaacgcgtcggaccgcatgggtatgggcacgacgtaccttgccctcatggctaccttcaagatgagaccgatgttcgccgtggggctgctgttccggaggctcacctctcgggaggtcctgctgctcacgatcgggctgagcctcgtggcctccgtcgagctccccaacagcctagaagaactgggcgacgggctcgcgatgggcatcatgatcctgaagctgctcaccgacttccagagtcaccagctgtgggccaccctactcagcctcactttcatcaaaacgacgctgtccctccactacgcctggaagaccatggccatggtcttgtcaatcgtgtcactattccccctctgcctatcaacaacgagtcagaaaacaacatggctgccggttcttctgggctctctggggtgcaagccgctcacaatgttcctgataacggagaacaaaatctggggccgcaagtcctggcccctgaatgaggggatcatggcggtgggcgtggtcagcatcctcttgtcctccctgctcaaaaacgacgtgccactggccgggcccctgatcgccggcggcatgctgatcgcctgctacgtcatcagcgggtctagcgccgacctgtccttagaaaaggcggccgaggttagctgggaggaggaggcggagcactccggcgcctcacacaacattctggtcgaggtacaggatgacgggaccatgaagatcaaggatgaggaacgggatgacaccctgaccatcctgctcaaagctactctactggcagtaagcggcgtttacccgctcagtatccccgcgacactgttcgtgtggtacttttggcagaagaagaagcagcgctccggggtgctttgggacacccccagtccacccgaggtggagcgggccgttttagatgacggcatttaccgtatcatgcaacggggcctcctggggcgctcacaagtaggcgtgggagtgttccaggagaacgtcttccacaccatgtggcacgtgacaaggggcgcagtgctgatgtaccaggggaagcgcctagagcccagctgggcaagcgtcaaaaaggatctgatctcttacgggggcgggtggcggctgcagggctcgtggaacacgggcgaggaggtccaagtgatcgccgtcgaaccaggcaaaaacccgaagaatgtgcagacagcccccgggacctttaagacccccgagggcgaggtgggcgccattgccctcgacttcaagcccgggacgagcggctcccccatcgtcaaccgcgagggtaaaatcgtgggcctgtacgggaacggagtggtgacaacaagcggcacatatgtgtcggccattgcacaggccaaggcatcccaagagggcccgctgcccgagattgaggacgaggtattccggaagcgcaacttgacgatcatggacctgcaccccggttccgggaagacccggcgctacctaccggccatcgtccgtgaggcgatcaagcgcaagctccggaccctaatcctggccccaacccgcgtggtggcctccgagatggctgaggccctcaagggcatgcctatccgataccagacgacggcagttaagtccgagcataccgggaaggagattgtggacctcatgtgccacgccaccttcacgatgagactgctctcccccgtgcgcgtcccgaactacaacatgatcatcatggacgaggcgcacttcactgacccatctagtatcgccgccagaggttacatcagcacccgcgtgggcatgggtgaggcggcggccatcttcatgaccgccactccgcccggctccgtggaggccttcccgcagagcaatgcggtcatccaagacgaggagcgggacatccccgaacgctcctggaactccgggtacgagtggatcacggacttccccggcaaaaccgtgtggttcgtgcccagcatcaagagcggtaatgacatcgccaactgcctgagaaagaatgggaaacgggtcattcagctttcccggaaaacgttcgacacggaataccagaagacgaagaataacgactgggactacgtggtcaccacggacatcagcgagatgggtgccaacttccgagccgatcgggtcatcgatccgagacgctgcctcaagcccgtgatcctcaaggacgggcccgagcgcgttatccttgcaggaccgatgccggtcacggtggcctccgccgcccaacggcgcggacgtatcggacgcaaccataacaaggagggcgaccaatacatctacatggggcagcccctgaacaacgatgaggaccacgcgcactggaccgaggcgaagatgttattggacaacatcaatacccccgagggaataatacccgcccttttcgagccggagcgagagaagtccgccgccatcgacggggaataccgcctgcgcggcgaggctcggaagactttcgtggagctgatgcgccgcggggacttacccgtgtggctgtcctacaaggtggcgagcgagggcttccaatatagcgaccgccggtggtgcttcgacggcgagcgcaataaccaggttctagaagagaacatggatgtggagatctggactaaagagggtgaacgcaagaagctccgcccccgttggctcgatgcccgaacttactcggaccccttggccctccgtgagttcaaggagttcgccgccggccgccggtctgtgtccggggacctcatccttgagatcggcaaacttccgcagcacctgacccagagggcgcagaacgccttggacaatctcgtcatgcttcataatagcgagcagggcggacgtgcctaccgccacgccatggaggaacttcccgacaccatcgagacgctcatgctgctggcgcttatcgccgtgctgaccggcggggtgaccctgttcttcctctccggccggggcctgggcaagaccagcatcggcctgctctgtgtcatggcctcctccgtgctgctatggatggcgtccgtggaaccccactggatcgcagctagcataatcctcgagttcttcttaatggtcctgctcatccccgagccagaccgccagcggacgccccaagacaaccagttggcttacgtggtgatcgggctcctcttcatgatactaacggtcgccgccaacgagatgggcctgctcgagaccaccaagaaagacctagggatcgggcacgtggcggtggagaaccaccaccatgcgaccatgctggacgtagacctgcatccggcgtccgcctggacgttatatgctgtggccactaccatcatcactccgatgatgcgccacacgatcgagaacactaccgcgaacatcagccttacggccatcgcaaaccaggccgctatcttgatggggctggacaagggctggcccatctcaaagatggacatcggcgtccccctgctcgcgctggggtgctacagccaagtcaaccccctgaccctaacggccgccgtcctcatgctggtggcccactacgcgattataggcccgggtctccaagctaaggccacccgtgaggcccagaagcgtaccgccgcgggcatcatgaagaaccccaccgtcgacggtatcgtggctatcgacctcgaccccgtagtctacgacgcaaagttcgagaagcaactgggacagataatgctcctgatcctctgtacctcccagatcctcctcatgcgcaccacctgggccctgtgtgagtccatcacgctcgccacaggccccctcactaccctgtgggaggggagtcctggtaagttctggaacactaccatcgctgtgagcatggccaacatctttcggggttcctacctcgccggggccgggcttgccttcagcttaatgaagtccctcggcggcggcagacgcggcacaggggcccaaggggagactctgggcgagaagtggaagcgccagctgaaccaactatctaagtccgagttcaacatatacaagcggtccgggatcatggaggtggaccgttcagaggccaaggaaggcctgaaacgcggagagacgaccaggcacgcggtctcgagaggcaccgccaaattgcgctggttcgtggaacggaaccttgtgaagcccgagggtaaagtcatcgacctcggctgcggacgtgggggctggagctattactgcgcgggcctcaagaaggtgactgaggtcaagggatacacgaagggcggacccggccacgaggagcccatcccgatggcaacctacgggtggaacctggttaagttgcacagcggcaaggacgtgttctttacgcctcccgagaagtgcgacaccctgctgtgcgacattggcgagagcagcccgaacccgactatcgaggaaggccgcacgctccgcgtgctgaagatggtcgagccctggctgcgggggaaccagttctgcatcaagatcctaaacccctacatgcccagcgttgtcgagaccctggaacagatgcagcgcaagcacggcggcatgctcgtccggaacccgctttcccgcaacagcacccacgaaatgtattgggttagctgcgggaccggcaacatcgtcagcgccgttaacatgacgtcccggatgctgttgaaccggttcacgatggcacaccgcaaacccacctacgagcgcgatgtggatctcggtgcaggcacccgccacgtcgcggtcgagccggaggtggccaatctggacatcatcggccaacggatcgaaaatatcaagcatgagcacaagagcacgtggcactacgacgaggacaacccatacaagacatgggcctaccacgggtcatacgaggttaagccgtcaggtagcgcttcaagcatggtgaacggggttgtcaagctcctcacgaagccctgggacgtgatccccatggtgacccagatagccatgactgacaccacccccttcggccagcagagggtcttcaaggagaaggtggatacccggacgccaaaggcgaagagggggaccgcacagattatggaggtgaccgcccggtggctgtggggcttcctgtcccgcaacaagaagccgcggatctgtacccgcgaagagttcacgcgtaaagtccgctcaaacgctgctatcggcgcagtgttcgtggatgagaaccagtggaactccgctaaggaggccgtcgaagacgagcgtttctgggacctagtgcagaaggagcgggagctgcacaagcagggaaagtgcgcgacctgcgtgtacaacatgatggggaagcgggagaaaaagctgggggagttcggcaaggctaaggggagtcgtgccatttggtacatgtggttgggagcccggttcctggagtttgaagccctggggttcatgaatgaggaccactggttctcccgcgagaacagcctctccggtgtggaaggcgagggcctgcacaagctgggctacatcctccgggacataagcaagatccccggagggaacatgtacgccgacgacaccgcgggctgggacacccgcataaccgaggacgaccttcagaacgaggccaagatcacggacatcatggaaccggaacacgctctgcttgcgacctccatcttcaagctgacctaccaaaataaggtggtgcgggtccagcgccccgccaagaacgggacagtgatggacgtgatctcacggagagatcagcgcggcagcgggcaggtaggtacctacggcctgaacacctttaccaacatggaggcgcagttaatccgtcagatggagtctgaagggatcttccttccctccgagctcgagacgcccaacctcgccgagcgcgtgttggattggctggagaagtacggcgtagagcggttgaagcgcatggccatcagcggggacgactgcgtcgtgaaaccaatcgatgatcggttcgcgaccgccctgacggcgctgaacgatatgggcaaggttcgcaaggacatcccccaatgggagccctccaaggggtggaacgactggcaacaggtgccattctgcagccaccatttccaccagctcatcatgaaagacggccgggagatcgtggtgccgtgccgcaatcaggatgagctggtgggacgggcccgcgtttcccagggcgcgggctggtcgctgcgggagacggcctgcttaggcaagtcgtacgcccagatgtggcagttgatgtacttccaccgccgggacctgcgcctcgcggctaacgccatctgttccgccgtgcccgtggactgggtccccacgagtcggaccacctggagtatccacgcgcaccaccagtggatgaccacggaggacatgctgagcgtgtggaatcgcgtgtggatcgaagaaaacccgtggatggaagacaagacccacgtgtccagctggggcgacgtgccgtacctggggaagcgggaagaccagtggtgcggctccttaattggcctaaccgcgagggccacctgggcctcgaacatacaggtcgccatcaaccaggtgcgccgtctgatcgggaacgagaactacttagattacatgaccagcatgaagcgattcaagaacgagggagaccccgagggggcgctgtggtga

SEQ ID NO: 24329 - RNA, 9879 nt, synthetic construct
  misc_feature 1..9879: note = derived and/or modified CDS sequence (opt11) from DENV-1__FJ882551__SS-prME
  source 1..9879: mol_type = other RNA
agcgtgaccatgttgctaatgttaatgcctaccgccctggccttccacctcacaacgcgcggcggtgaaccccacatgatcgtgagcaagcaggagcgaggcaagtcactgctgttcaagaccagcgcgggggtgaacatgtgtaccctcatcgccatggacctgggcgagttttgcgaggataccatgacctacaagtgccctcgcatcaccgaggcggagcccgacgacgtggactgctggtgtaatgccaccgacacgtgggtaacgtacggaacctgtagccagaccggggagcaccggcgcgacaagaggtccgtggcactggcgccacatgtgggcctcgggctggagacgcgtaccgagacctggatgagctccgagggcgcctggaagcagatccagcgggtcgagacatgggcccttcgccatccggggttcacggttattgccctcttcctggcacacgccatcggcacctccattacccagaaagggattatcttcattctgctcatgttggtgaccccctctatggctatgcggtgcgttggaatcgggagccgcgactttgtggaagggttgagtggggccacatgggtggacgtcgtgttagagcacggcagctgcgtgaccaccatggccaaggacaagcccaccctggacatagagctgttaaagacggaggtaaccaaccccgcagtgcttcggaagctgtgcatcgaggccaagatcagcaataccaccacggacagccgctgcccgacacaaggcgaggccaccctagtggaagaacaagacgccaattttgtgtgccggcgcaccttcgtagaccggggctggggaaacggctgcgggctgttcggaaaggggtcgctgatcacgtgcgccaagttcaagtgcgtgaccaagttggagggcaagatcgtccaatacgagaacctgaagtacagcgtgatcgtgaccgtccataccggcgaccagcaccaggtgggcaacgagtccacggagcacggtaccaccgcgaccatcacaccgcaggccccctcaacagagatccagctgactgattacggggccctcaccttggactgctcgcctcggaccggcctggactttaacgaaatggtgctcctgacgatgaaagagaagtcctggctggtacacaaacagtggttcctcgacctgccgctgccgtggaccagcggggccagcacaagtcaggagacctggaacagacaggacctcctggttacgttcaagacggcgcacgcaaagaagcaggaggtcgtggtgctgggctctcaggagggcgccatgcacaccgcgttaaccggggcaacagagatacagaccagcggcaccacgacgatcttcgccggacacctcaagtgccggctcaagatggacaagcttaccctgaagggcatgtcctacgtcatgtgcaccgggagctttaagctcgaaaaggaggtggcggagactcagcacggcacggtgctagtccagatcaagtacgagggaaccgacgccccgtgtaagatcccgttctccacacaggatgagaagggcgtgacgcagaacggacggctgataacagccaacccgatcgtgacggacaaggagaagcccgtcaacatcgaggccgagcctccgttcggcgagagctacatcgtcatcggcgctggcgaaaaggccctgaagctgtcctggttcaagaaggggtcgtccatcgggaaaatgtttgaggccaccgctcgcggggcccgacgcatggcgatcctcggcgacaccgcctgggacttcgggagtataggcggagtcttcacttccgtcggaaagctcgtgcaccagatcttcggaaccgcctacggagtgctgttcagcggagtttcctggactatgaagatcggtatcggcgtactcctgacgtggcttggcctcaatagccgctccacgagcctgtccatgacctgcatcgccgtggggctggttactctctatctgggcgtgatggttcaagccgacagtggctgtgtcatcaattggaagggccgggaactgaagtgcggtagcggcatcttcgttaccaacgaggtccatacgtggaccgagcagtacaagttccaggcggactccccgaaacgcttaagcgccgccataggcaaagcctgggaggagggtgtctgcggcatcagatccgccacacgtctggagaatattatgtggaagcagatcagcaacgagctgaaccacatcttgctagaaaacgatatgaagctgacagtggttgttggtgacgttgcgggcatcctcgcccaggggaagaaaatgattcggcctcagcccatggagtacaagtactcctggaagtcctggggcaaggcaaagatcattggcgcggacgtgcagaacaccacattcatcatcgacggaccaaatacgccggagtgccccgacgaccagcgcgcatggaatatctgggaggtggaggactacggattcgggatattcacaaccaacatctggctgaagctgcgggattcctacacccaggtgtgtgaccacagattgatgagcgccgccatcaaggactccaaggccgttcacgccgacatgggctactggattgagagcgagaagaacgagacttggaaactggcgcgggccagcttcatagaggtcaagacctgcatctggcccaagagccacacactctggtccaatggagtgctcgagagcgagatgatcatccctaagatctacgggggtccgacatcccagcacaactaccgccccgggtacttcacgcagaccgccggcccttggcacctagggaagctggagctggattttgacttatgcgagggaaccacggtggttgtggatgaacattgcggcaaccgtggcccgagcctgcgcaccaccaccgtaactgggaagataatccatgagtggtgctgccggtcgtgcactctgcctcccctccgattcaagggtgaggacggctgctggtacgggatggagatacggcctgtaaaggagaaggaggagaacctggtcaagagcatggttagcgccggctccggagaggttgacagcttctccctcggcctgctgtgcatctcaatcatgatcgaggaggtgatgcgctcccggtggagtcgcaaaatgctcatgaccgggaccctggccgtgttcttccttctcatcatcgggcagctgacgtggaacgacctgattcggctctgcattatggtcggcgcaaacgcctccgaccgcatggggatgggcaccacttatcttgccctcatggccacttttaagatgcgcccaatgttcgcagtggggctcctcttccggcgcctgaccagccgggaggtgctcctactgaccatcgggctatccctcgtcgcaagcgtggagctgcctaactcccttgaggagctgggcgatggcctggcaatgggcatcatgatcctcaagctgctgaccgacttccaaagccaccaactctgggccaccttgctgtccctcacctttatccgcaccacattcagcttacactatgcctggaagaccatggccatggttttaagtattgtaagcctctttcccctgtgcctgtccacgaccagccagaagaccacctggctccccgtgctgctgggctccctcggctgcaagccgctgacgatgtttctgatcgcggagaacaagatctggggccgcaagagctggcctctcaacgagggtatcatggccgtcggaatcgtgagtatcctgctgtccagcctgctaaagaacgacgtacccctggccgggcccctcattgcgggcggcatgctgatcgcgtgctacgtcatctccggtagctccgctgacctgagcctcgagaaggccgccgtggtttcctgggaggaggaggccgagcattccggcgcgtcccacaacattctggtcgaggtgcaggacgacgggaccatgaagatcaaggatgaggagcgcgacgacaccttaaccatcctcctgaaggccacgctgctcgccgtgagcggtgtttacccgctgtccatccctgccacgttattcgtgtggtacttctggcagaagaagaaacagcggtccggggtgctctgggataccccgagcccgcctgaggtcgagcgcgccgtgttggacgacggcatctaccggatcatgcaacgcgggctgctggggcggagccaggttggcgtcggggtgttccaggagaacgttttccacaccatgtggcatgtcacacgtggcgccgtgctcatgtaccagggtaagcggctggagccctcatgggccagtgtcaagaaggacctgatctcctacggaggagggtggcgcctccagggcagctggaatactggggaagaggtccaggtgatcgccgtggagcccggcaaaaaccccaagaacgtccagaccgcgcccggcaccttcaagacctccgagggggaggtgggagccattgcgctagacttcaagcccggtacaagcggaagccccatcgtaaaccgggaggggaagatcgtcggcctgtacggcaacggagtggtgacgacatccggcacatatgtcagcgcaatcgctcaagctaaggcgagccaggaggggccgctccccgagatcgaagacgaggtattccgcaaacgaaaccttacgatcatggacctgcaccccgggagcgggaagacccgccggtacctccccgccattgtgcgcgaggctatcaagcggaaactgcgcacccttatccttgccccgacccgtgtcgtggcctcagaaatggcagaagccctaaagggtatgcccatccggtaccagaccactgctgtcaagagcgagcacaccgggaaggagatcgtagacctgatgtgtcatgccacattcacgatgcgcctcctgtcccccgttcgggtgccaaactacaacatgattatcatggacgaggcccacttcaccgacccgtcatctatcgcggctcgcgggtatataagcaccagggtcggaatgggtgaagccgccgccatctttatgacggcgactccacccggcagtgttgaagcctttccgcaaagcaacgccgtaatccaggacgaagagagagacatcccggagcggtcatggaacagcggttatgagtggattactgacttccccgggaagaccgtctggttcgtgccgtcgatcaagagcgggaacgacatcgctaactgcctgcgcaaaaacgggaagcgggtgattcagctatccaggaagacattcgatacggagtaccagaaaacaaagaacaacgactgggattacgtggtgaccactgacatctctgagatgggcgcgaacttccgtgccgacagggtaatcgacccgcgccgctgtctgaagccggtcatcctgaaagacggacccgagcgggttatcctcgcgggcccaatgccagtcacggtggcctccgccgcacagcgccgggggcgaattggtcggaaccacaacaaagagggtgatcagtacatctatatgggtcagccgttaaacaacgacgaggaccacgcccactggaccgaggctaagatgctgctcgacaacatcaacacccccgagggcatcatcccggccctgttcgaaccggaacgcgagaagtccgccgcgatcgacggggaatacaggctaagaggcgaggcccgcaagacattcgtggagctcatgcggcgcggagacttgccggtctggctgagccacaaggtagcctccgagggcttccagtatagcgaccggcgctggtgtttcgacggggagcggaacaaccaggtgctcgaggagaacatggacgttgaaatttggacgaaggagggtgagcgcaagaagctgcgaccccgctggctggacgcccggacatattccgaccccctcgccctgcgcgagtttaaggagtttgcggccggccggcgaagcgtctccggggacctgattctcgaaatcggcaagctgccccagcacctaactcagagagcccagaacgccctcgacaatctggtgatgctgcacaatagcgagcagggcgggcgcgcgtaccggcacgccatggaggaactgccggacaccatagagacgttgatgcttctcgccctgatcgccgtacttaccgggggggtgaccctcttcttcttgtccggccgcggactgggcaagactagcatcggcctcctgtgcgtgatggcctcttctgtgctgctgtggatggcgtcggtggagccccattggatcgccgcttccatcattctggagttttttctgatggtcctcttgatacccgagcccgatcggcagcgcaccccgcaagacaatcagttggcctacgtcgtaatcggactcctgttcatgatcctgacggtggcggcgaacgagatgggtctcctggagaccactaagaaggacctggggatcggccacgttgccgtcgaaaatcaccatcacgctgccatgctcgacgtggacctacatcccgcctccgcgtggaccttgtacgccgtcgccacgaccatcatcacccccatgatgcggcacaccatcgagaacacgaccgcgaacatcagcctcactgccatcgctaaccaggccgccatcctgatggggctggacaaaggatggccgatatccaagatggacatcggagtgcccctcctggctctggggtgctattcccaagtgaaccccctcaccctcaccgcggccgtcctgatgctcgtggcccactatgcgatcataggccccgggctgcaggccaaggcgacccgcgaagcccagaagagaaccgccgctggcatcatgaagaacccaacagtggacgggatcgtagccatcgacctggacccagtggtgtacgacgcgaagtttgagaagcagctcggacagatcatgctgctgatcctgtgcacgtcccagatactgctgatgcggaccacgtgggccctctgcgagagcatcaccctggccacaggccctctgaccaccctttgggaggggtcccccggcaagttctggaacacaacgatcgccgtcagcatggccaatatcttccgcgggtcctacctggcaggcgccggcctggccttcagtctcatgaaatccctcgggggcgggagacgcgggacaggggcccagggcgagaccctgggagagaagtggaagcgtcagctcaaccaactcagtaaatcagagttcaacacctacaagcgtagtggaataatggaggtcgatcgaagtgaggcaaaggagggcctgaaaaggggggagacaactaagcacgccgtgtcccggggtaccgccaagctccgctggttcgtggagcgcaatctggtcaagccggaaggaaaggtcatagacctgggctgcggccgtggggggtggtcctactactgcgccgggctgaagaaggtcaccgaggttaaaggctacacgaagggcgggcccggccacgaagaacccatcccaatggctacttacgggtggaatctcgtcaagctgcactccggcaaggacgtctttttcataccgccggagaagtgcgataccctgctctgcgatattggggagagctcacccaacccaacgatcgaagagggccggaccctaagggtgctaaagatggtggagccttggcttcgggggaaccagttctgcatcaagatactgaacccatacatgcccagcgtcgtcgagacccttgagcagatgcaacgcaagcacggcggcatgctcgtgcggaaccccctgtcccgcaacagcacccatgaaatgtattgggtgtcatgcggaactggcaacatagtgagcgcggtgaacatgacctcccggatgctactcaaccgattcacgatggcccaccgcaagcctacctacgagcgtgacgtcgacttaggggccggcacccgccacgtggccgtggagcccgaggtcgccaacctcgacatcataggtcagcggatcgagaacatcaagcaggagcacaaaagcacctggcactacgacgaggacaacccctataagacgtgggcgtaccacgggtcctacgaagtgaaacccagcggcagcgcaagtagcatggtcaacggggtagtgaaactcctgaccaagccgtgggacgtcatcccgatggttacccagatagccatgaccgacacgacccccttcggccagcagcgggttttcaaggagaaggtcgacacccggacccccaaggccaagcgcgggacggcccagatcatggaggtgaccgcgaagtggctttggggatttctctccagaaacaagaaaccgcgcatctgcactcgggaggaattcactcgcaaggtgcgtagcaacgccgcaatcggagccgtcttcgtggacgaaaaccagtggaactctgcgaaggaggccgtggaggacgagcgcttctgggacctggtccaccgggagcgtgagctgcacaagcaggggaagtgcgccacgtgcgtgtacaacatgatgggcaagcgggagaagaagttgggggagttcggcaaggccaaaggtagccgcgccatctggtacatgtggcttggtgcgcggttcttagagtttgaggccttaggctttatgaacgaggaccactggttttccagggagaacagcctgtccggggttgaaggtgagggcctgcacaagcttggctatatcctgcgggacattagcaagatccctgggggcaacatgtacgccgatgacaccgcaggctgggacacccgcatcaccgaggacgacctgcagaacgaggcgaaaatcacagacataatggagcccgagcatgcgctactggccaagtccattttcaagctcacctaccagaacaaggtcgtgcgggtgcagagaccggccaagaacgggaccgtcatggatgtgatcagccgccgggaccagcgtggaagcggacaagttggcacctacggcctgaacacgttcaccaacatggaggcccagctgattcggcagatggagtcggaggggatcttctcccccagcgagctggaaacccccaatctcgccggcagagtcctcgactggttaaagaaacacggggtggagcggctcaagcgcatggccatctcaggcgatgactgcgtggtcaagccaatcgacgatcggttcgctaccgccttgacagctctgaatgacatggggaaagtgcgcaaggacatcccgcagtgggagccctcaaagggatggaacgactggcagcaggtgcccttctgttctcaccacttccaccagctcattatgaaggacggacgggagctggtcgtcccgtgccgcaaccaggacgagctggtggggcgggcgcgtgtctcccagggcgcggggtggagcctccgggaaacagcctgcctgggcaagtcctacgctcaaatgtggcagttgatgtacttccaccgcagagacctccgcctggctgcgaacgccatctgttccgccgtgccggtggactgggtccccacctcccggaccacctggtcaattcacgcccaccatcagtggatgaccacggaggacatgctgtctgtgtggaatcgcgtgtggatcgaggagaacccctggatggaggataagacccatatcagctcttggggcgacgtcccctacctcggaaagcgggaggaccagtggtgcggctcgctgatagggctgacggcgcgcgcgacctgggccaccaacatccaggtggccatcaaccaggtgaggcggctcctgggcaacgagaactatctggactacatgacctccatgaaacgcttcaagaacgaaagcgacccggaaggggcgctgtggtga

SEQ ID NO: 24330 - RNA, 9879 nt, synthetic construct
  misc_feature 1..9879: note = derived and/or modified CDS sequence (opt11) from DENV-1__FJ882552__SS-prME
  source 1..9879: mol_type = other RNA
tctgtgactatgctgttaatgctgatgcccaccgcgctggcatttcacctcacgacccggggcggcgaaccccacatgatcgtgagcaagcaggaacggggcaaatcactgctgtttaagaccagcgccggtgtgaatatgtgtactctcatcgccatggacttgggcgagttctgtgaagatacgatgacgtataagtgcccccgcatcaccgaagccgaacccgacgatgtggactgttggtgcaatgccaccgacacctgggtcacatacgggacctgcagccagaccggtgagcaccggcgggacaagcggtccgtggcgctggctccacatgtggggctcggtctcgagactaggaccgagacctggatgtcctccgaaggggcatggaagcaaatccagcgggtcgaaacgtgggccctgcgccatccagggttcacagtgattgcactcttcctggcgcatgccatcggcaccagcatcacacagaaggggatcatcttcatactgctgatgctggtgacaccctctatggccatgcggtgcgtcggcatcggcagccgcgacttcgttgagggcctgtcaggtgcgacgtgggtggacgtcgtgctcgagcacgggagctgcgtgactacaatggctaaggataagcccaccttagacatagagctgctaaaaacggaggtcactaaccccgcggtgctgcgtaagctgtgcatagaggctaagatctccaatacgactacagacagccgctgcccgacccaaggcgaggccaccttagtggaggagcaagacgccaatttcgtctgccggcgtaccttcgtcgaccgtggctgggggaatggctgcgggctgttcggcaaggggtccctgatcacttgcgccaagttcaagtgtgtaaccaaactcgagggcaagaccgtacaatatgaaaatctgaagtacagtgtgatagtgaccgtccacacgggcgaccagcaccaggtggggaacgagagcacagaacacggcacaaccgcaacaatcacgccccaggcgcccagcacagagatccagctgaccgactatggggccctcactctggattgtagccctcggacggggctagactttaacgagatggtactattaacaatgaaggaaaagtcctggctggttcacaagcagtggttcctcgacctgcccctgccctggacctcaggggcctccacctcccaggagacctggaacagaaaagacctcctggtaacatttaagacggcccacgcgaagaagcaggaagtggttgtgctgggctcccaagaaggcgcgatgcacaccgccctgacgggcgccaccgagatacagaccagcggaaccacgacaatcttcgccggtcatctgaagtgtagactcaaaatggacaagctcacgcttaagggcatgtcatatgtcatgtgcaccgggagcttcaagctggagaaagaggtggcggagacgcaacacggcacagtgttagtacagatcaaatacgagggcacggacgcaccatgcaagatcccctttagcactcaggacgagaaaggggtgacgcagaatggccgcctgatcacagcaaatccaattgtgaccgacaaggagaagcctgtcaacattgaggccgagccgcccttcggggagtcctacatcgtgatcggcgcaggggaaaaagcactgaagctgtcatggttcaagaaggggagctccatcggcaagatgttcgaggcaaccgcgcgcggcgcacggaggatggctatccttggcgacaccgcctgggactttggaagcatcggtggcgtgttcacgtcggttgggaaactggtgcatcagatatttggcaccgcctacggggtgctgttcagcggcgtctcctggaccatgaagatagggattggagtgcttttaacgtggctcggtttgaacagccgcagcacgagcctgtccatgacctgcattgccgttggattggtcaccctctacctgggtgtgatggtgcaggctgacagtgggtgcgtaatcaattggaagggccgagagctgaagtgcggctcaggcatcttcgttacaaacgaagtgcacacctggaccgagcagtacaagttccaggctgacagcccgaagcgcctctctgcagcgatcggcaaagcctgggaagagggtgtctgcggaatccggtccgcaaccagactggaaaacataatgtggaagcagatcagcaacgaactgaaccatatcctgctggagaacgacatgaagtttaccgtggtggtcggagacgtagcgggcatcctggcccaggggaagaaaatgatccggcctcagccaatggagtacaagtattcctggaagtcctggggcaaagccaagatcatcggcgcagacgtgcagaacacgactttcatcatcgacgggccgaacaccccggaatgtcccgacgaccagcgagcatggaacatctgggaagtcgaggactatggcttcgggatctttaccacgaacatatggctcaagctacgggactcctatacccaggtatgcgatcaccgcttgatgagcgccgccataaaagattcaaaggccgtacacgcagacatgggctactggatcgagagcgagaagaacgagacttggaagttagcgcgggcctccttcattgaggtcaagacgtgcatctggcccaaaagccatacgctgtggtccaacggcgtactggagtcagaaatgatcatccccaagatctacggagggcctatttctcagcacaactaccgccccgggtacttcacacaaaccgcaggcccctggcacttagggaagctggagctggacttcgacctctgtgagggcaccaccgtagtcgtggacgagcactgcggcaaccggggtccgagtctgcgcaccacgaccgtcacgggtaagatcatacatgagtggtgttgccggagttgcaccttaccaccactgcgcttcaaaggggaggacggctgctggtacgggatggagatccggcctgtcaaggagaaagaggagaatctagtcaagagtatggtgagcgccggaagcggcgaggtggacagtttttccctggggctcctgtgcatctctatcatgatagaagaggtgatgaggtcccggtggagccgcaagatgcttatgacgggtactctggccgtattcttcttactgatcatgggtcaacttacgtggaatgatttgatccggctctgcattatggtcggcgcgaacgcctcggaccgcatggggatgggtaccacatacctcgcgctgatggccacctttaaaatgcgcccgatgttcgccgtggggctcttgttccggagactgacgagccgcgaggtcctgctcctgacaatcgggctgtcattggtcgcaagcgttgagctgcccaactccctggaggagctaggcgatgggttagccatgggcatcatgatcttgaagctccttaccgacttccagagccatcagctgtgggccacactcttgagtttaacgtttatcaagaccacttcttccctccactatgcttggaagaccatggctatggtactgagcatcgtgtccctctttcccctgtgcctgagcactacctcccagaagaccacttggctacccgtgctactgggatcgttgggctgcaaacctctgacgatgtttttgatcgccgagaacaagatttgggggcgcaagagctggccattgaacgaaggaatcatggccgtcggaatcgtttccattctcctttcctccctcttaaagaatgacgtgcctctggccgggcccctgattgccggcgggatgctcatagcgtgctatgtaatctccgggtcctctgccgacctgtccctggagaaggcagccgaagtgtcctgggaggaggaggccgagcactccggcgcgagtcacaatatactcgtggaggtccaagacgacggtaccatgaagattaaagatgaggagcgggacgacaccctgacaatccttctgaaggccacacttctggcggtgtccggcgtgtacccgctcagcatccccgccacactgttcgtgtggtacttctggcagaagaagaaacagcgctcaggggtgctatgggacacccccagcccgcctgaggtggagcgggccgtgttggatgacggcatctaccgtatcatgcagcggggcctgttggggcgatcccaggtgggggtgggggtattccaggagaacgtcttccatacaatgtggcacgtgacccggggcgcggtgctgatgtaccagggcaagcgactcgaacccagttgggcctccgtgaagaaggatctgataagctacggcggagggtggcggctgcaggggtcctggaacactggggaagaggtccaagttatcgcagtcgagcctggtaagaaccccaagaacgtacagacagcccccgggaccttcaaaacatctgagggggaggtcggcgcgatcgctctggatttcaagccaggcacgagcggctcccccatcgtgaaccgcgaggggaaaatcgtgggcctgtatgggaacggggtcgtgaccactagcggtacctatgtgtccgccatcgcccaagccaaagctagccaggaaggccccctgccggaaatagaggacgaggtcttccggaaaaggaaccttacaatcatggacctgcatcccggctcgggcaagacccggcgctaccttccagccatcgtgcgggaggccatcaagcggaagctaagaaccctaatcctggccccgacccgcgtggtggcaagcgagatggcggaagcattgaaaggtatgcccatccgctatcaaacaaccgccgtgaagtcggaacacacgggtaaggaaatcgtggatttaatgtgccacgcaactttcactatgcggctactaagccccgtccgggtgccgaactacaacatgatcatcatggatgaagcccatttcaccgacccgtcctccatcgcggcccgggggtacatctccacccgcgtgggcatgggagaggctgcagcaattttcatgacagcgactccacctggtagcgtcgaggctttcccccaatccaacgccgtcatccaggacgaggagcgggacatcccggagagatcttggaactccgggtacgaatggattacagactttcccgggaagacagtgtggttcgtaccgagcatcaaaagtggaaacgatatcgccaactgcctgcggaagaatgggaagcgtgtcatccagctctcgcggaagacctttgacacggagtaccagaaaacaaagaataatgactgggactacgtggttaccaccgacatctccgagatgggcgcgaatttccgcgccgaccgggtgatcgacccaagaagatgcctcaaaccggtgatactgaaagacggacccgagcgggttatccttgctggcccgatgcccgtgacagtcgccagcgccgcgcagcgacgcgggcggatcggacgaaaccacaacaaggagggcgatcagtacatctacatgggacagcctctgaacaacgacgaggaccacgcccactggacggaagccaagatgctgctggataacatcaacacccccgagggcatcataccggccctcttcgagcccgaacgtgagaagtcggccgcgatcgacggggaatatagactacgtggcgaggcaaggaagacattcgtcgagctgatgaggcgcggtgacctcccggtgtggctatcctacaaggtcgctagcgagggtttccagtactccgatcgccgttggtgcttcgacggtgagaggaacaaccaagtgctggaggagaacatggacgtcgaaatctggacaaaggagggggagcgcaagaaactccgtcctcgctggctggacgcccgcacctactcggaccccttggccttgcgggagttcaaggagttcgcggccggccgccggtccgtttcaggggacttaatcttagagataggcaaactaccccagcatctgacccaacgcgctcaaaatgccctggacaacctcgtgatgctgcacaactcagaacaaggagggcgagcgtaccgccacgccatggaagaactgccagatactatcgaaacgcttatgctgctcgcactaatcgccgtcttaaccggcggtgtcacgctgttcttcctatccggccgcggcttgggaaagaccagcataggcttactctgcgtgatggcctcaagcgtgctgctttggatggcgtcggtagagccgcactggatcgccgcctcgatcatcctcgagtttttcctgatggtgctgctcattcccgaacccgaccgtcagaggactccgcaggacaaccagctggcctacgtggttattgggctcttatttatgatcttaactgttgcagcgaacgaaatgggcttactcgagacaaccaagaaggacctggggatcgggcacgtcgccgtcgagaaccaccaccacgcagccatgctcgacgtggacctgcacccagcgagcgcgtggacgctgtacgctgtggcgacgaccatcatcacacccatgatgcgtcacacgattgagaacacgaccgcaaatatctcactgacagccatcgcgaaccaagcggcaatcctaatggggctagacaaaggctggccgatctctaagatggacatcggtgtccctctgctcgcattgggctgctactcccaggtgaaccctttaacactgacggcggccgtgctaatgctggtcgcccactacgccatcatcggccccgggctccaagccaaggctacccgggaagcgcaaaagcgcaccgccgccggaatcatgaagaacccgactgtcgacggaatcgtcgctatagatctcgaccccgtggtatacgacgcgaagttcgaaaaacaactgggtcagataatgctcctgatcttgtgcacgtctcagatcctcctgatgcgcaccacctgggccctgtgcgagtccattaccctcgcgacgggcccgctgaccaccctgtgggaggggtcgcccggtaagttctggaacaccacgatcgccgtgtccatggccaacattttccgggggagttatctcgctggcgccggcttagcgtttagcctgatgaagtcactagggggcgggaggcgtggcaccggggcccagggcgagaccttgggcgagaagtggaaacgccagttgaatcagctcagcaagtcggagttcaacacttacaaacggagtgggatcatggaagtcgaccgctccgaggcgaaggagggcctgaagcgcggggagaccaccaaccacgctgtttcgcgcggcaccgcaaaactccggtggttcgtggagcgcaacctagtaaagccggaggggaaggtgattgacctgggctgcggcaggggcgggtggtcttactactgcgccggtctgaagaaggtgaccgaagtaaaagggtatacgaaaggagggcctggccacgaggagccgattccaatggccacatacgggtggaacctggtgaagctccattctggcaaggacgttttctttatccctcccgagaaatgcgacacactgctctgcgacataggggaatccagccccaaccccaccatagaggagggccgcactctccgggtcttaaagatggtggaaccgtggctgcgcgggaatcaattttgtatcaagatcctcaatccgtacatgccatcagttgtcgagaccctggaacagatgcagcgcaagcatggcggaatgctggtccgcaaccccctctcgcggaactctacgcacgagatgtactgggtgagctgcgggacgggcaacattgtctctgcggtgaatatgacctcgcgcatgctactgaaccggttcaccatggcccatcgcaagccgacatacgaacgcgacgtggacctcggggccggcacccgacatgtcgccgtggagcctgaagttgccaatctagatatcataggtcagcgcatcgagaacatcaaacacgagcacaagagcacatggcactatgacgaggacaatccttacaagacgtgggcttatcatgggagctatgaggtcaagccgagtggctccgccagctcgatggttaatggtgtcgtgaaactcctcaccaaaccgtgggacgtgatccctatggtcacgcagatcgccatgaccgacacgactcccttcggccagcagcgcgtattcaaggaaaaggtggacactcgcacccccaaagccaaacggggtacggcccagatcatggaggtcaccgcaaagtggttatggggtttcttaagcagaaataagaagccgcggatctgcaccagagaggagttcacgaggaaagtgcgctccaacgccgccattggtgcggttttcgttgacgagaaccagtggaactcggcgaaggaggcagtggaggacgagcgcttctgggatctcgttcacagggagcgtgagctgcataaacagggtaagtgcgccacttgtgtgtataacatgatggggaagcgcgagaagaagctgggggagttcgggaaagccaagggatcccgtgccatctggtacatgtggctaggggcgcgctttctggaatttgaggccctgggcttcatgaatgaagaccactggttcagccgggagaacagtttgtccggtgtggagggcgagggcttgcacaagttgggctacatcctgagagacatctccaagatccccgggggcaatatgtacgccgacgacaccgccggctgggatactcggatcaccgaggatgacctgcaaaatgaggccaaaatcacggacataatggaacccgagcacgctttattggccaagagcatcttcaagttgacctaccagaacaaagtagttcgcgtccagaggcccgccaaaaatgggaccgtgatggacgtaatatcccgccgagaccagagaggcagcggccaggtaggcacgtacggcctgaatacgttcacgaacatggaggcccagctaatccgccaaatggagtccgagggaatctttagcccctccgaactggagacccccaacttggctcggcgcgtgctcgactggctggagaaacacggggtcgagcggctcaagcgcatggcgatcagtggcgatgactgcgtggtcaagcctatcgacgatcggttcgcgaccgccctcaccgctctcaacgacatgggtaaggttcgcaaagacataccgcagtgggaaccctctaaggggtggaatgactggcagcaagtcccattttgcagtcaccacttccaccaactgatcatgaaagacgggagggaaatcgtggtaccctgcaggaatcaggacgagcttgtgggccgagcccgtgtgtctcagggagcgggctggtccctgagagagaccgcctgcctgggaaagagttacgcccagatgtggcagctcatgtactttcaccgccgggacttacgcttagccgcgaacgccatctgctccgcggttcctgtggactgggttcccaccagccggacgacgtggtccatccacgcccaccaccagtggatgacgacggaggatatgctcagcgtctggaaccgcgtgtggatcgaggagaatccatggatggaggacaaaacccatatctccagctggggcgacgtgccctatctcgggaaacgggaagaccagtggtgcgggtccctcattggcttaaccgcgagggcgacatgggccacaaacattcaggtcgccataaatcaggtccgccggctgatcgggaacgagaactacttagactacatgacctcgatgaaaagattcaaaaacgagtccgacccggagggggccttgtggtaa

SEQ ID NO: 24331 - RNA, 9879 nt, synthetic construct
  misc_feature 1..9879: note = derived and/or modified CDS sequence (opt11) from DENV-1__FJ882553__SS-prME
  source 1..9879: mol_type = other RNA
tcagttacgatgcttttgatgctgatgcccaccgcactggcctttcacctcacgacccggggtggggaacctcacatgatcgtgagcaagcaagaaaggggcaagagcctactcttcaagaccagcgccggggtaaatatgtgtaccctgattgccatggacctgggcgaactgtgtgaggacaccatgacctacaagtgcccccgcatcaccgaaaccgagccggacgacgtggactgctggtgtaatgccactgacacctgggtgacctacggaacctgcagccagacgggcgagcaccggcgcgacaagcggtccgtggccctcgcgccccacgtcggtctggggctggagacccggaccgagacctggatgagctccgagggcgcctggaagcagatccagcgggtcgagacctgggcgttgagacaccccgggttcactgtgatagccctgtttctggcccacgcgatcggcaccagcatcacccaaaaggggatcatcttcatcctcttgatgctggtcacgccctcaatggccatgagatgcgtcggcatcggctcgcgcgacttcgtggaggggctctccggcgcaacctgggtggacgttgtgttagagcatgggagctgcgtgaccaccatggccaaagacaagcccaccctggacatagagctcttaaagaccgaggttaccaatccggccgtgctgcgaaagctctgcatcgaggcgaagatctccaacaccacgaccgacagccgctgcccgacccagggtgaggctaccctggttgaggagcaagacgccaactttgtctgccggcgcacgttcgtggaccgcggatggggcaacggctgcgggctgtttggcaaggggtcactcataacgtgcgccaagttcaagtgtgtgaccaagctcgagggtaaaatcgtgcagtacgagaacctgaagtacagcgttatcgtcacagtccacaccggcgaccagcaccaggttgggaatgagtccacggagcacggcaccacagcgacaataacgcctcaagcgcccaccacagaaatccagctcacggactacggggccctgactctggactgcagcccccgcacaggcctcgacttcaacgagatggtccttctgaccatgaaggagaagtcctggctcgtgcataagcagtggttcctggacttgcccctcccctggaccagcggggccagcacgtcccaagagacctggaaccgtcaggacctgttagtgacgttcaagaccgcccatgccaagaagcaggaggtggtcgtgctcgggagccaggagggcgctatgcacacagcactgaccggggccaccgagatacagacctcaggcacgaccaccatctttgcggggcatctgaagtgccgcctcaagatggacaagctgactctgaaggggatgtcatacgtgatgtgcacggggtccttcaagctcgagaaggaggtggccgagacccagcatggcaccgtactggtccagatcaagtacgaaggcaccgatgccccctgcaagatccccttcagcacgcaggacgagaagggagttacacagaacggcagattaatcactgccaacccgatcgttacagataaggaaaagcccgtaaatatcgaagccgagccacccttcggtgagtcctacatcgtgatcggcgccggcgaaaaggccctgaaactcagctggttccgcaaagggtcctccatcggcaaaatgttcgaggccacggcgcgcggcgcccgccgcatggccatcctgggggacaccgcgtgggactttggctccataggtggcgtgttcactagcgtcgggaagctggtgcaccagatcttcggcaccgcctacggggtgttgttctccggggtgagctggaccatgaagatcgggattggagtgctgctcacctggctcggtttaaactcacggagcacctcccttagcatgacctgcatcgccgtggggctcgtcacgctgtacctgggcgtgatggtacaggccgactccgggtgtgtcatcaactggaagggccgagagctcaagtgcgggagcggtatcttcgtgactaacgaggtgcacacctggacagaacagtacaagttccaggctgactccccgaaacggctgtcagcggccatcggcaaggcctgggaggagggggtatgcggaattagaagcgccacccggctggagaacatcatgtggaaacagatctccaacgagctcaaccacatactgcttgagaacgacatgaagttcacggtggtggtaggggacgtggcaggtatcctcgcgcagggtaagaagatgatacgcccccagcccatggagtataaatacagctggaagtcgtggggcaaggccaaaataatcggcgcggacgtgcagaacaccactttcatcatcgacggacccaacacccctgagtgtcccgatgaccagcgggcctggaacatctgggaggtcgaggactacggcttcgggatctttacgaccaatatctggctgaaactacgtgactcttacacccaagtgtgcgatcaccggctcatgtccgcggccatcaaggacagcaaggcagtgcacgccgacatgggctactggatcgagagtgagaagaatgagacctggaagctggcccgcgccagcttcattgaggtgaagacttgcatctggccgaagtcacacactttgtggtccaacggcgttctagagtccgagatgatcatcccgaagatctacggcggcccgatctctcagcataattaccggcccgggtacttcacccagaccgccggcccctggcacctggggaagctggaacttgacttcgacctgtgcgagggcacgaccgtggtcgttgacgagcattgcggcaacagaggcccgagcctgcgtacaacgacggtaaccggaaagattattcacgaatggtgctgtcgctcatgcaccctaccgcccctccggttccgtggtgaagacggctgctggtacgggatggagatcaggcccgttaaggagaaggaggaaaacctcgtgaagtcaatggtgagcgccggcagcggcgaggtcgattccttcagcctcggactgctgtgcatatccatcatgatcgaagaggtgatgagatctcgctggtcccgcaagatgctcatgacaggcacgctggccgtattctttctgctcatcatggggcagctgacctggaacgacctcattcggctctgcatcatggtcggcgccaacgctagcgaccggatgggcatgggcaccacctacctggccttaatggccacgttcaagatgcgcccgatgtttgccgtcggcctcctgttccgccggttgacttcccgggaggtgttgctgctgaccatcggattaagcctagtcgcttcagtagagctgcctaacagcctcgaggaactgggcgacgggctggcgatggggatcatgatactcaagctactgacggacttccagtcccaccagctgtgggctacgcttctgagcctcacattcatcaagacgactttctccctccattatgcctggaagacaatggccatggtcctcagcatcgtgtccctattccccctgtgcctgagtaccacatctcagaaaaccacgtggctacccgtgctgctgggcagcttggggtgcaagccgctgaccatgttcctgattgcagagaacaagatctggggccgccggtcctggcccctcaacgaggggatcatggccgtcggcatagtgagcatcctgttgtccagcctcctaaagaacgacgtgcccctggccgggccgctcatcgccggcggcatgctgatcgcttgttacgtcataagtggatcctcagcggacctgtccctcgagaaagcagcagaggtgagctgggaggaagaggcagagcacagtggcgccagccacaacatactggtggaggtccaggacgacgggaccatgaaaatcaaggatgaggagcgcgacgacaccctgaccatccttctcaaggccacgctgctcgccgtgtccggcgtgtacccgctgagcattcccgcgaccctgttcgtctggtacttctggcagaagaagaaacagcggtccggggtgctctgggacaccccgtcgccgcccgaggtagagcgcgccgtattggacgacggcatctaccggatcatgcagaggggactgctggggcgctcccaggtgggcgtgggcgtcttccaggagaatgtattccacaccatgtggcacgtaacgcgcggggccgtcctcatgtaccaaggcaaacggctggaaccctcttgggcgtccgtgaagaaggacctgatcagttacggcggcgggtggcgcctccagggctcctggaacaccggcgaggaggtgcaggtcatcgccgtggagcccggaaagaacccaaagaatgttcaaactgcgcccgggaccttcaagacacccgagggagaggtcggggcgatcgctttggacttcaagcccggaactagcggctcccccatcgtgaacagggagggaaagatcgtgggtctgtacggaaacggggtagttaccaccagcggcacatacgtcagtgcgatcgcccaggccaaggcctcacaggaggggccgctccccgagatcgaggacgaggtcttccggaagcggaatctgactataatggacctccaccccggaagtgggaagacccgacggtacctccccgcgatagtgcgcgaggccatcaagcgcaagctgcggacacttatcctcgcccctacgagagtggtcgcttccgagatggccgaggcgctgaagggtatgcccatccggtaccagacgaccgccgtcaagagcgagcacaccggcaaggagatagtggatctgatgtgccatgccacgttcactatgcgcctcctgtcccccgtccgggtgccgaactacaacatgatcatcatggacgaggcccacttcaccgacccaagctcaatagccgcgcgcggttacatcagcacccgggtgggcatgggagaggccgccgccatctttatgaccgccacgccgcctggctccgtggaggcgttcccgcagagcaacgctgtgatccaggacgaagaacgcgacatccctgaacggagttggaactctgggtatgagtggatcaccgacttcccgggcaagaccgtatggttcgtcccctccataaagagtggcaacgacattgccaattgcctgcgcaagaatgggaagcgggtgatccagctctcccgcaagacgttcgataccgagtaccagaagacaaagaacaacgattgggactacgtggtcaccacggacatttctgagatgggcgctaacttcagggcggaccgcgtgatcgatccgaggcggtgcctgaaacctgtaatccttaaggacgggcccgagcgggtcatcctcgctggccccatgccagtgaccgtcgcctccgcagcccagcgccgggggcggataggccgcaaccataataaagagggcgaccagtacatctacatgggtcagcccctcaacaacgacgaagaccacgcgcactggaccgaagctaagatgctgctcgacaacatcaacactcccgagggcatcatcccagccttattcgagccggagcgggagaagtcagctgccatcgacggggaataccgcttgcggggagaggcgcgcaaaacgttcgtggagctcatgcgtcgcggggacctgcccgtgtggctgagttacaaagtcgcctccgagggcttccagtacagtgatcggcgttggtgctttgacggggaacggaacaaccaagtgctcgaggagaacatggacgtggaaatctggaccaaagagggagagcgcaagaaactgcgtccgcgttggctagacgctcggacctactccgaccccctcgccctccgggagttcaaggagtttgcggcgggaagacgctccgtctccggagacctgatattagagattggaaagctgccgcagcacttaacccagcgggcccaaaatgccctcgacaatttagtgatgctgcacaactccgagcagggcgggcgcgcttaccggcacgcgatggaggagctccccgacacgatcgagacactgatgttactcgccctgatagccgtgttgacaggcggggttaccctcttcttcctgtccggccgcgggctgggcaaaacctctattggcctactgtgcgtgatggcttcctcggtgctactctggatggcctccgttgagccgcattggatcgcggcctcgatcattctcgagttctttctgatggtgctcttgatcccagagccggaccggcagcggacaccccaggacaaccaattggcctatgttgtgatcgggttactgttcatgatcctcaccgtagcggccaacgagatgggactcctggagaccaccaagaaggacctggggattggccacgtggcggtagagaaccaccaccacgctgccatgctggacgtggacctgcaccctgcctccgcctggaccctttacgcggtggccacgaccattattaccccgatgatgcgccacaccattgagaacaccaccgcaaacatctccctcacggcaatcgccaaccaggcggccatcctgatggggctggacaagggttggcccatatccaagatggacatcggcgtcccccttctggccctggggtgctacagccaggtaaaccccttgaccctgacggcggcggtgttgatgctcgtggcccattatgcaatcatcggcccgggcctgcaggccaaagccacccgggaggcgcaaaaacgcaccgccgccggcatcatgaagaaccccactgtggacgggatcgtggccatcgacctggacccagtagtgtacgacgccaagttcgagaagcagttaggacagatcatgctgctgattctctgcacatcccagattttgttgatgagaaccacctgggcgctctgcgaaagcatcacgctggccacaggcccactgactacgctctgggaggggtccccgggcaagttctggaacacgaccatcgcagtgagcatggccaacattttccggggctcctacctcgcgggcgcgggcttggccttctcactcatgaagtccctagggggagggcggcgcgggaccggggcgcaaggtgagaccctgggggagaaatggaaaagacaacttaatcagctgtccaagagcgagttcaatacgtataagcgctcagggatcatggaggtcgaccggtcagaggcaaaggaggggctgaagcgcggggagacaaccaagcacgcggtatcccgaggcaccgcaaaattacgctggtttgtggagaggaatctggtaaagcccgaggggaaagtgatcgacctgggctgcggccgcgggggctggagctattactgcgccgggctgaagaaggtgaccgaggtcaaagggtacactaaaggagggcctggacacgaggagccaattccgatggccacctacgggtggaatctcgtcaagctgcactccggcaaagacgtgttctttattccgcccgagaaatgcgacacactgctctgcgacatcggagagagctcccccaacccaacaatcgaggagggccggacgctgcgcgtcctgaagatggtcgagccctggctccgggggaaccagttctgcattaaaatcctgaacccctacatgcccagcgtggtcgaaaccctggagcagatgcagcgcaagcatggcggcatgctcgtgcggaatccgctgtcgcgcaacagtacccacgaaatgtactgggtgtcttgcgggaccggaaatatcgtttctgccgttaacatgacctcgcgcatgctcctcaaccggttcaccatggcgcaccgcaagcccacatacgagcgggacgtggacctgggggccggcacccgccatgtcgccgtagagccagaagtggccaacctggacatcatcggccagcggatcgaaaatattaaacatgagcacaagagtacgtggcactacgacgaggacaacccctacaagacgtgggcctaccacggctcctacgaagtaaagccgagcggatccgcgagcagcatggtgaacggggttgtgaaactcctgaccaaaccctgggacgttatcccgatggttacccagatcgcgatgacggacaccaccccgttcggacaacagcgcgtgttcaaggagaaagtggacacccggacgccgaaggccaagcgcgggacggcacagatcatggaggttaccgccaagtggctgtggggcttcctctcccggaacaagaagccgcggatatgtactcgtgaggagttcacgcgaaaggttcggagcaacgcggccatcggcgcggtgttcgtggacgagaatcagtggaactccgccaaagaggcagtggaggacgagcgcttttgggacctggttcaccgggagagggagcttcacaagcaggggaaatgcgcgacttgcgtctacaacatgatgggcaagcgggagaaaaagctcggcgagttcggcaaggcgaaagggagccgcgccatctggtacatgtggttaggcgcccgtttcctggagttcgaggcgctcggctttatgaacgaagatcactggttctcccgagaaaattcgctgtccggggtggaaggcgaggggctgcataagctcggctacatcctgcgggacatttcaaaaatacccgggggcaacatgtacgccgacgacacagcaggctgggacacccgtatcacggaggacgacctgcagaacgaggcccgcatcaccgacataatggagcctgagcacgcactcttggctaagtccatcttcaagctgacttatcagaataaggtggtccgtgtgcagcgccccgccaagaacgggaccgtgatggacgtcatcagccggcgcgaccaacggggctccggacaggtgggtacgtacggcctcaacaccttcaccaacatggaggcccagctgattcgccagatggagtccgaggggatcttttctccttcagagctggagacccccaacctcgctgagcgggtgcttgactggctggagaagtatggcgtcgagcgcctcaagcggatggcaatctccggggacgactgcgtggtgaagccaattgacgaccgcttcgcgacggcgctgaccgccctgaacgacatgggaaaggttagaaaggacatcccccagtgggagccctcaaaagggtggaatgactggcagcaggtcccgttctgctcccaccatttccaccagttgattatgaaggacggccgcgagatcgtggtgccgtgtagaaaccaggatgaactggtcggccgcgcccgggtgagccagggggccggctggtcgttgagagaaaccgcatgcctcgggaagtcctacgcccagatgtggcagctgatgtatttccatcggcgcgatctgcggctcgcagccaacgcgatttgtagcgccgtccccgtggattggatcccaacctcccgcacgacgtggagtatccacgcccaccatcaatggatgactaccgaagacatgttatccgtgtggaaccgagtctggatcgaagagaacccctggatggaggacaagacccacatcagctcctggggagacgtgccgtacctggggaagcgggaggaccagtggtgcggtagcctcatcggcttaacggctcgcgccacatgggctaccaacatccaagtggccattaaccaggtcaggcgcttgatcgggaacgaaaactacctcgattacatgacgagtatgaagaggttcaagaacgagagcgagcccgagggcgccctgtggtga

SEQ ID NO: 24332 - RNA, 9879 nt, synthetic construct
  misc_feature 1..9879: note = derived and/or modified CDS sequence (opt11) from DENV-1__FJ882554__SS-prME
  source 1..9879: mol_type = other RNA
tcagtgaccatgctattgatgttaatgcccaccgccctcgccttccacctcaccacccggggcggggagccccacatgatcgtttccaaacaggagcggggcaagagcttgctattcaaaaccagtgccggggtgaatatgtgcaccttaatcgccatggatctgggggagctgtgcgaggacacgatgacctacaaatgtccacgaatcaccgaaaccgagcccgacgacgtggactgctggtgcaacgcaaccgacacctgggtgacttacgggacctgcagccaaacgggggagcaccgacgcgacaagcggagtgttgccctagccccgcacgtcggcctggggctagagactcgcaccgagacctggatgtctagcgagggagcgtggaagcagatacagcgagtcgaaacttgggccctccgccaccctgggttcaccgtaatagcactgttcctggctcacgcgatcgggacgagcatcacccagaaggggataatcttcatcttattaatgctggtcacgccctcaatggcaatgcggtgcgtgggcatcggttcccgggacttcgtggaagggctctccggcgcgacctgggtggacgttgtgctggagcatgggtcttgtgtgaccaccatggctaaggacaagcccacgctagacatcgaactgcttaagaccgaggtcaccaacccggctgtgctgcggaagctctgtattgaggccaagatctcgaacactacgacggactcgcgctgcccgacccagggcgaggccaccctggtggaggagcaggacgctaacttcgtgtgtcggcgcacgttcgtggatcggggctggggaaacggttgcggcctgttcggaaaagggtccttgataacgtgtgccaaattcaagtgcgtgaccaaacttgaagggaagatagtacagtatgaaaatctaaagtacagcgtgatcgtgaccgtacacactggagaccagcatcaggtggggaacgagagcacagagcacggcaccacagccaccataacgccacaggcaccgaccactgagatccagctgaccgattatggggctctcacattggactgcagcccccgcaccggcctagactttaacgaaatggtccttttaaccatgaaggaaaagtcttggctagtgcacaagcagtggttcctcgacctgcccctcccctggacgagcggggcctcaacttcccaggagacctggaaccgtcaggacctgctggtgactttcaagaccgcccacgcaaagaagcaggaagtcgttgtgctcggttcgcaagagggcgcgatgcacacggcactgaccggggctacggagatacagacctccggcactacgaccatcttcgcggggcacctgaagtgccgcctcaagatggacaagctgaccctgaagggcatgagttacgttatgtgtacgggatctttcaagctcgaaaaggaggtagccgagacccagcacggaacagtactggtccagatcaagtatgagggcaccgacgctccctgcaagatcccctttctcacgcaggacgagaaaggagtgacccagaacggccggttgatcaccgccaacccgatcgtgaccgacaaggaaaagccagtcaacattgaggcagaacctccattcggagagagctatatcgtgatcggggccggagagaaggctctgaagctgtcctggttcaaaaaggggagctcaattggcaagatgttcgaagccacggcccgcggggcccgtcgtatggccatcctgggcgataccgcctgggacttcgggagcattggcggcgtgtttacctccgtcgggaaattggtgcaccagatctttggaacagcttacggagtactgttctctggagtctcctggactatgaaaatcgggatcggcgtccttttaacctggctgggcctgaacagccgctccaccagcctctccatgacctgcatcgctgtaggcctggtcacgttatacctaggcgtgatggtgcaggccgacagcgggtgtgtcatcaactggaagggccgggagctaaaatgcgggtccggcatttttgttaccaacgaggtacacacctggaccgagcagtacaagttccaggccgatagtccgaagcgtctgagtgctgcgataggcaaggcctgggaggagggagtctgtggcattcggtcagccacgcgcttagaaaacattatgtggaagcagatctctaatgagctgaatcacatcctgctcgagaacgatatgaagttcactgtagtagtcggggacgtagccggcatcttagcgcaagggaaaaagatgatccggccacaaccaatggagtataagtactcctggaaaagttggggtaaagctaaaatcataggcgccgatgtgcagaacacaacctttatcattgacggtcccaacaccccggaatgccccgacgaccagcgagcctggaacatttgggaagtcgaagactacggcttcggcatttttacaaccaacatttggctgaagctacgggactcatacacgcaggtatgcgaccaccgcctgatgagcgcagccatcaaggactccaaggccgtgcatgccgacatgggctattggattgagagcgagaagaacgagacgtggaagctggcacgggcttcattcatcgaagtcaagacatgcatctggcccaagagccacaccctctggagtaacggggtgcttgagagtgagatgatcatccctaaaatatacgggggcccaatctctcaacacaactacaggcctggatatttcacccaagcagccggtccctggcacctagggaaacttgagctagacttcgacctttgcgaaggaactaccgtggtagtcgacgaacactgcggcaaccggggacccagcctacgcacaacaaccgttactggaaagattatacacgagtggtgctgccgttcctgtaccctgcctcccctgcgcttccgaggtgaggatggctgctggtacggtatggaaatacgacccgtcaaagaaaaggaggagaacctcgtcaaaagcatggtgtctgccggcagtggcgaagtcgatagtttctccctcggcctgctatgcatcagcataatgattgaggaagtgatgcggtcacggtggagccggcgcatgctgatgactggcaccttagctgtgttctttctcctgatcatggggcagctgacttggaacgatctcatacggctgtgtataatggtcggggctaacgcctccgacaggatggggatggggacaacgtatttagccctcatggccaccttcaagatgcgccctatgtttgccgtggggttgctattccggcgcttgacgagccgggaagttctgttactcaccatcgggctgtccctagtagcgagcgtggaacttcccaactccctagaggagttgggcgacgggttagccatgggaatcatgatcctgaagctgctcaccgactttcagagccaccagctgtgggccactctgctctccctgacattcatcaaaaccacttttagcctgcactatgcatggaagacaatggccatggtgctctctatcgttagcctgttcccactgtgtctctccacgactagccagaaaaccacttggctgccagtgctgctcggctccctgggttgcaagccattaacgatgttcctcatcgcagaaaataagatctggggccgccggtcatggcccctgaatgagggtatcatggccgtcggcatcgtgtccattctgctctcgagcttattgaagaacgacgtgcctctcgcgggtcccctcatcgccggcggcatgctcatcgcgtgctacgtcatcagcgggagttcggccgatctctccctggagaaggccgctgaggtgtcctgggaggaggaggccgagcacagcggagccagccacaacattctggtggaggtccaggacgacgggaccatgaagatcaaagacgaggagcgcgacgacaccctcaccatcctgttaaaagctaccctgctcgctgtgagcggtgtgtacccactgtccatccctgccactctgttcgtttggtacttctggcaaaagaagaagcagaggagtggggtgctttgggatacgccaagcccgcccgaagtggagcgcgccgttctggacgacggcatctacaggatcatgcagcgcggcctgctcggccgatcgcaagttggagtgggagtcttccaagagaacgtttttcacacaatgtggcatgtaacgcgcggcgcggtcctgatgtatcaggggaagcggttagagccctcctgggccagcgtgaagaaagacctcatctcatacggcggcgggtggaggctgcaaggcagctggaacacaggggaagaggtacaagtcatcgccgtggagcccggaaagaaccccaagaatgtacaaaccgcaccggggaccttcaagaccccggaaggcgaggtcggtgccatcgcgctggacttcaaacccgggacgtcgggcagccccatcgtgaatcgggaggggaaaatcgtcggcctctacggaaacggtgtggtgacgacctccgggacctacgtgtccgccatcgcccaagccaaagccagccaagaagggccgctgcccgagatcgaggacgaggtctttcgcaagcggaacctgacgatcatggacctccaccccggctccgggaagaccaggcggtacttaccggccattgtccgcgaagctatcaagcgtaagctgcggactctcatcctcgcccctacgcgggtggtcgccagcgagatggcggaggctctgaagggcatgcctatccggtaccagacgaccgcagtaaaatcggagcatacggggaaggagatcgtcgacctcatgtgccatgcgacattcaccatgcgcctcctcagccccgtccgagtcccgaactataacatgatcatcatggacgaggcgcactttactgatccgtatagcatcgcagctagagggtacatcagcacgcgggtagggatgggggaggccgccgccatattcatgacagcgacgccacccggcagtgtcgaggctttcccgcagagcaacgccgtaataaaggacgaagagagggatatccccgagcgctcttggaacagcgggtacgagtggatcaccgatttcccgggcaagaccgtctggtttgtcccctccatcaaaagcggcaatgacatcgccaattgcctccgcaaaaacgggaagcgtgtaatccagctctccagaaagaccttcgacacggagtaccagaagaccaagaacaacgactgggattatgtggtcaccaccgacatcagcgagatgggcgctaacttccgggcggatagggtaatcgatccccggagatgtctgaaacccgtgattctcaaggacgggcccgagcgggtcatcctggccgggcccatgccggtgacagtcgcgtccgccgcgcagcgacggggtcgaatcggccgcaaccacaacaaggaaggcgaccagtacatctacatggggcaacccctgaataacgatgaggaccatgcgcactggaccgaagcaaagatgcttctggataacataaatacccccgagggtataatcccggccttattcgaaccggagcgggagaaatccgccgcgatagacggcgaataccggctacggggcgaggctcgcaagaccttcgttgagctgatgcgaagaggggacctgccagtgtggctctcctacaaggttgcaagtgaggggtttcagtactctgaccggcgctggtgtttcgacggcgagcggaacaaccaggtgctagaggaaaatatggacgtggagatctggacgaaggagggagaacgcaagaaacttcggcctcgctggctagacgcacggacctacagtgaccccctggccttacgcgagttcaaggagttcgctgccgggcggcgcagcgtctccggggatttgatcctggagatcggcaagctgccgcagcatctcacccagcgggcacagaatgccttagacaatttggtgatgctccacaactccgagcagggcgggcgggcctaccggcatgccatggaggagctgccagacactattgagacactgatgctactggcacttatcgccgtcctaaccggcggagttaccctgttctttttgtccgggcgggggctcggcaagaccagcatcggcctactgtgcgttatggcctcgtcagtcctgttgtggatggcgtccgttgagccccactggatcgccgccagtataatcctggagttctttctcatggtactgctgatcccagagcctgaccgccagcgtacgccccaggataaccagttggcctacgtggttatcgggttgcttttcatgatcctcactgtagccgcgaacgagatgggccttttagagaccaccaagaaggacctcgggataggccacgtggccgttgagaaccatcaccacgccgctatgctggacgtagacctgcaccccgcctcggcatggaccttatatgccgttgccacgaccatcatcaccccgatgatgcgccacacaatcgagaacacgaccgccaatattagtctgaccgccatcgcgaaccaggccgccatcctgatgggtctcgataaaggctggcccatctccaagatggatatcggcgtgcccctgctagccctcggctgttactcacaggtgaatcccctgaccctgacagccgccgtgttgatgctagtcgcccactacgccataatcggcccggggctgcaggccaaggccactcgggaggcacagaagcgaactgccgctgggatcatgaaaaaccccacggtggatggtatcgtggcgattgacctcgaccccgtcgtttacgacgcaaagttcgagaagcagctaggccagatcatgctgctcattctgtgcacgtcccagatcctgctcatgcggaccacttgggctctatgcgagagcatcacactggccacgggccccttgaccactctgtgggaggggtcccctggcaagttctggaacactaccatcgcagttagcatggccaacatcttccgcggtagctacctggccggtgcaggtctcgccttctccttaatgaaatcactcgggggcggtcgacgcggaaccggggcccagggggaaacactcggggagaagtggaagcgccaactcaaccagttgagcaaaagcgagttcaatacctacaagcgcagcggaatcatggaggtagatcggagcgaagcaaaggagggattaaagagaggggaaacgacgaagcatgccgtcagtagaggcaccgcgaagctgcgctggttcgttgagcggaacttggtcaagcccgaggggaaggtaatcgatttaggctgtggcagaggtggctggtcgtactactgcgccgggctcaagaaagtgaccgaggtcaaggggtacacgaaagggggaccaggccacgaggaacccatcccgatggctacctatgggtggaaccttgtgaagctccattccggcaaggacgtgttcttcattccgcccgagaagtgcgatacattgctgtgcgacataggggagtcctcccccaacccaacaatcgaggagggaagaacactgcgcgtcctcaagatggtggagccatggctgcgggggaaccagttttgcatcaaaatcctgaatccctacatgccatcggtggttgagacactcgagcagatgcagaggaagcatggtggaatgttggtgcggaaccccctgtccaggaactcaactcacgagatgtattgggtgagctgcgggaccggcaacattgtcagcgcggtgaacatgacaagtcgcatgctcctcaaccgattcaccatggcccaccggaagcccacctacgagcgggatgtggacctgggagcgggcacccgccacgtcgccgtggagcccgaggtggccaatctcgatattatcggacagcggatcgagaacatcaagcacgagcacaagagcacctggcactacgatgaagacaacccatacaagacatgggcataccacgggtcctacgaggtaaaaccgagcggctccgcaagcagtatggttaacggggtcgtgaaactgttaactaaaccctgggatgttatccctatggtcacccagatcgcaatgaccgacacgacgcctttcggacagcagcgcgtgttcaaagagaaggtggacacccggaccccaaaggccaagagggggactgcccagataatggaggtcaccgcgaagtggctctgggggtttttatcacgtaacaagaagccgcgtatctgcacccgggaagaatttactagaaaagtgcggtcaaatgccgccatcggagccgtcttcgtcgacgagaaccagtggaactccgcgaaagaggccgtggaggacgaaaggttctgggacctcgtacaccgggagcgcgagttgcacaagcaggggaagtgcgctacgtgcgtctacaatatgatgggaaagcgggagaagaaactgggagagttcggcaaagctaaggggagccgcgctatctggtacatgtggcttggcgcgaggttcttagagttcgaggccttgggattcatgaatgaagaccattggttctctcgcgagaatagcctatccggggtcgaaggcgaggggctccacaagctgggatacatactgcgggacataagtaagatccccgggggtaacatgtacgccgacgacaccgccggatgggacacacgcatcaccgaagacgacctccagaacgaggcgcgcataactgacatcatggagccagaacatgcgctgctggccaagtccatcttcaaactcacttaccagaacaaggtcgtccgggtacaacgtcctgcaaagaacggcacagtgatggatgttatcagccgaagggaccagcgtggctccggccaggtggggacctatggcctgaacacgttcaccaacatggaggcccaactgatccgtcagatggagtctgagggcatcttctccccaagcgaactcgagaccccgaacctggccgaacgcgtgctcgattggctcgagaaatacggggtcgagcgcctgaagcgaatggcgatctctggggacgactgtgttgtaaagccaatcgatgataggttcgccaccgccttgacggcactgaacgatatgggcaaggtcagaaaggacatcccgcaatgggaaccatccaagggatggaatgactggcaacaggttccattctgttcacaccacttccaccagttgatcatgaaggacggccgtgagatcgtggtcccgtgccggaaccaagatgagctcgtgggcagagctcgggtaagtcaaggtgcgggttggtcgctcagggagaccgcgtgcctgggtaagagctatgctcagatgtggcagctcatgtacttccaccggcgcgacctccgactggctgcgaacgcaatctgctccgccgtccccgtcgactggatccccacgagccgaaccacttggagcatccacgcccatcatcagtggatgaccaccgaagatatgctgtccgtgtggaaccgcgtttggatcgaggagaacccctggatggaagacaagacccacattagctcctggggcgacgtgccctacctcggcaagagagaggaccagtggtgcgggagcctgatcggcctgactgctcgcgcaacctgggccaccaacatccaggtggccattaatcaggtcaggcgcctcattggaaacgaaaactatttggactacatgaccagtatgaagcggttcaagaatgaaagcgaccccgagggcgccctgtggtga

SEQ ID NO: 24333 - RNA, 9879 nt, synthetic construct
  misc_feature 1..9879: note = derived and/or modified CDS sequence (opt11) from DENV-1__GQ868610__SS-prME
  source 1..9879: mol_type = other RNA
tcggtcaccatgctgctcatgttaatgcctacagccctggccttccacctcacaacccggggtggggagccccacatgattgttaccaagcaggagcggggcaagagcttactgttcaagacaagcgcgggtgtgaacatgtgtactctcatcgccatggatctgggcgagttgtgcgaggatacgatgacctacaagtgtccccggatcactgaagccgagcccgacgatgtggactgctggtgtaacgccacggacacatgggtgacttacggcacctgcagccagacgggcgaacaccggagggacaagcggagcgtggccttggcgccccacgtgggcttggggctggagacccgcacagagacatggatgtcgagcgagggtgcctggaagcagattcagcgggtcgagacgtgggccctacgccacccaggcttcaccgtgatcgcgctcttcctagcgcatgcgatcggtacctccatcacccagaaggggatcattttcatacttctgatgctggtcacgccctctatggccatgcggtgcgttggcatcggctcccgcgacttcgtggaaggactcagcggcgcgacctgggtggacgtcgtcctagagcacggatcctgcgtgaccaccatggccaaggacaagcccacgctggacatcgagttgctgaagaccgaggttaccaatcccgcggtactgcgcaaactctgtatcgaggccaagatctctaacaccacgaccgactcccgctgccccacccaaggcgaggccaccctgatggaggagcaggacgccaacttcgtgtgccggcgcaccttcgtggaccgtggctgggggaacggctgcgggctgttcggcaaggggagccttatcacgtgcgccaagttcaagtgcgtaacgaagctggagggcaagatcgtgcagtacgaaaacctgaaatactccgtcatcgttaccgtacacacgggtgaccagcaccaggtcgggaacgagagcaccgagcacggcaccaccgcgaccatcacgccccaggcccccaccagcgagatccagctcaccgactacggggccctgaccctggactgcagcccccgcacgggcctcgactttaacgagatggtgctgctgaccatgaaggagaagtcctggttagtccacaagcaatggttcctggacctgccgctcccgtggaccagcggagcaagcaccagccaggagacttggaaccggcaggacctgcttgtgacttttaaaaccgcacacgcgaagaagcaggaggtggtggtgctcgggtcacaggaaggcgccatgcacaccgccttaacgggggccaccgagattcagacctccgggacgacgaccatttttgccggtcacctgaagtgccgcctcaagatggacaaactgaccctgaagggcatgagctacgtaatgtgtaccgggtccttcaagttggagaaggaggttgcggagacgcagcacggcaccgtgctagtgcagatcaagtacgaaggcaccgacgccccttgcaagatccccttcagcacccaggacgagaaaggggtgacgcagaacggccggctgattaccgctaacccgatcgtgaccgacaaggagaagcccgtgaacatcgaggcggagccgcccttcggtgagtcctacatcgtgatcggcgcgggcgagaaggccctgaagctcagttggttcaaaaagggcagcagcatcggcaaaatgttcgaggccaccgcccgcggggcccggcgcatggcgattctgggcgacacggcctgggacttcggatccatcggaggcgtgttcaccagcgtggggaagctcgtccaccaaatcttcggcaccgcctacggggtgctgttctccggcgtttcttggaccatgaagatcgggatcggcgtcctgctgacgtggctcggcctgaattccagaagcacatccctgagcatgacctgcatcgccgtgggcctcatcaccttatacctgggcgtgatggtccaggccgactccggttgcgtgatcaactggaagggccgggagctcaagtgcgggagcggcatcttcgtaacgaacgaagtccacacctggaccgaacagtacaagttccaggcggactcgccgaaacgcctgtcagccgcaattggcaaggcctgggaggaaggggtatgcggcatccggagcgccacacgcctggagaacatcatgtggaagcagatctccaacgagctcaaccacatcctactggagaacgacatgaagtttaccgtggtcgtgggggacgtcgtcggcatcctcgcccagggcaagaagatgatccggccccagcccatggagcacaagtactcgtggaagtcctggggaaaggccaaaatcatcggcgccgacgtgcaaaacacgaccttcatcatcgacggccccaacaccccggagtgccccgacgaccagagggcctggaacatatgggaagtggaagactacggcttcggaattttcaccacgaacatctggctgaagctgcgggactcttacacccaggtctgcgatcatcgcctcatgtccgcggccatcaaggacagcaaggctgtgcacgccgacatgggctactggatcgagtccgaaaagaacgagacctggaaattagcccgcgcgagcttcatcgaggtgaagacctgtatttggccaaaatctcatacgctgtggagcaacggcgtgctcgaatccgagatgatcatccctaagatctacgggggcccgatcagccagcataactaccgccccgggtacttcacccaaaccgccggcccctggcacctggggaagttggagctcgatttcgacctttgcgagggcacaacggtggtggtcgacgagcactgcggcaaccggggcccatccctgcgcaccaccaccgtgacaggcaaaatcatacatgagtggtgctgtcggagctgcactctgccacccctccgcttcaagggagaggacggctgctggtatgggatggagatccggcccgtgaaggagaaggaggagaatctggtcaagtccatggtgagcgccggcagcggcgaagtcgattccttcagccttgggctgttatgcatttccattatgatcgaggaggtcatgcgcagccggtggtcacgcaagatgctcatgaccgggacactggctgtcttcctgctcctgatcatggggcagctgacgtggaacgacctcatccggctctgcatcatggttggcgccaacgccagcgaccgcatgggtatgggcaccacctatctggcactcatcgccaccttcaagatgcgcccgatgttcgccgtcgggttgctgtttcggcgactcacgtcccgggaagtgttgctcctcaccatcggcttaagtctggtggcatccgtagagctcccgaacagcctggaggagctgggcgacgggctcgcgatgggcatcatgatcttgaagctgctcaccgacttccagtcccaccagctgtgggccaccctcctgagcttcacattcataaagaccactctgtcccttcactacgcctggaagacgatggcgatggtgttaagcatcgtgtcactgttccccctgtgcctcagcacaacttcccagaaaactacctggctgccggtactgctcggcagcttagggtgcaagccgctcacgatgttcctcatagcggagaacaagatatggggccgcaagtcctggcccctcaacgaagggataatggccgtgggcgttgtgagcatactgctcagctccctgctgaagaacgatgtgcccctcgccgggcccttgatcgctgggggcatgttgatcgcctgttacgtcatcagcgggtcgagcgcggatctctccctggagaaagccgcggaggtgagctgggaggaggaggccgagcactccggcgccagtcacaatatcctggtggaagtgcaggacgacggcacgatgaaaatcaaagacgaggagcgtgacgacaccctcaccatcttactgaaggcgaccctactagctgtttccggtgtgtatccgctctcgatccccgccaccctcttcgtctggtacttttggcagaagaaaaagcagcgcagcggggtgctgtgggacacgcccagcccgcccgaggtggagcgtgccgtcctggatgatggcatctaccgcatcatgcagcggggcctgcttgggcgctcccaggtcggcgtgggtgtcttccaggagaacgtgttccacaccatgtggcacgtgacccggggggccgtcctgatgtaccaggggaagcgcctggagcctagctgggcgtccgtgaagaaagacctgatcagctacggcggcgggtggcgtctgcaggggtcgtggaacacgggggaagaggtgcaggtcatcgccgtggagcccggcaagaaccccaagaacgtgcagacggcccccgggaccttcaagacccccgagggggaggtcggcgccatcgccctggacttcaagcccgggacgtcgggctcccccatcgtgaaccgcgaagggaagatcgtgggcctctacgggaacggggttgtgaccaccagcggtacatacgtgagcgcgatagcccaggccaaggcctcccaggaggggcctctgcctgagattgaggacgaggtcttccgcaagcgcaatctgaccattatggacctccaccccggcagcgggaagacgcggcgctacttgccagcgatcgtgcgggaggcgatcaagcgaaagctgcggacactcatcctagcccccacccgcgtagtcgcatccgagatggcagaggcgctgaagggcatgcccatccgctaccagacgaccgccgtcaagagcgagcataccggcaaggagatcgtggacctcatgtgccatgccaccttcacgatgcggctgctcagtcccgtccgggtgccgaactacaatatgattattatggacgaggcccatttcactgaccccagctccatcgccgcgcgcggatatattagcacccgcgtgggcatgggggaggccgccgccatcttcatgaccgccaccccgcccggtagtgtcgaggctttcccccagtcgaacgccgtgatccaagacgaggagcgggacatccccgagcgcagttggaacagcggttacgagtggatcaccgacttccccggcaaaaccgtgtggttcgtcccctctatcaagagcggcaatgacatcgccaactgcctgagaaagaacgggaagcgcgtgatccagctgtccagaaagactttcgacacggagtaccagaagaccaaaaacaacgactgggattacgtggtaaccaccgatataagcgagatgggcgccaatttccgcgcggatcgggtgatcgacccgcgccggtgcctaaagcccgtgatccttaaagacgggccagagcgcgtcatcctggccggccccatgcccgtgacagtcgcctccgccgcccagcggcgtggccggatcgggcgcaaccacaacaaggagggcgaccagtacatctacatgggccagccactgaacaacgacgaagaccacgcgcactggaccgaggccaagatgctactagacaacatcaatactcccgaggggataatccccgccctgttcgagccggagcgggagaagtccgctgccatcgacggggaataccgcttacgcggcgaagcgcggaagaccttcgtggagctgatgcggcgcggggacttaccagtgtggttgtcttacaaggttgccagcgagggctttcaatacagcgatcgccggtggtgcttcgacggcgagagaaacaaccaggtcctcgaagagaacatggacgtggaaatctggacgaaggaaggggaacgaaagaagctgcgcccccggtggctcgacgcccgaacctattccgacccccttgccctgcgggagttcaaggagttcgctgcgggccgccggtctgtcagtggggatctcatactagaaatcggcaagctgccgcagcatctcacccagcgcgctcagaatgccctggacaatcttgtgatgctgcacaacagcgagcaaggcgggcgggcctaccgtcacgcgatggaagaattgcccgacacaatcgaaacgctgatgctcctggccctgatcgccgtgctcaccggcggggtcaccttgttcttcctgtcggggcggggcctgggtaagacctctatcggcctgctttgcgtgatggcctccagcgtcctcctgtggatggcctccgtggagccccactggatcgcggcaagcatcatcctggagtttttcctcatggtgctgcttatccccgagccggaccgccaacgtacacctcaggacaaccagctcgcctacgtagtaattgggctgctgttcatgatcctaacggtggcggccaacgaaatgggcctgctggagaccaccaaaaaggacctcggtatcggccatgtggcggtcgagaaccaccatcacgctaccatgctggacgtggacctgcaccccgcttccgcctggacgctatacgcggtggcgacaaccatcatcaccccaatgatgcgccacacgatcgagaacaccacggccaacataagcctgaccgccatcgccaatcaggccgcgatcctgatgggactcgacaagggctggccaatttccaagatggatatcggcgtccccctgctggccctcgggtgttacagccaggtgaaccccctcacgctgaccgccgccgtgttgatgctggtcgcgcactacgccatcatcggcccggggctgcaggccaaagccacccgtgaggcccagaagagaaccgcggccggcatcatgaagaacccaacggtggacgggatcgtggccatagacctcgaccccgtcgtgtacgacgccaagtttgagaagcagctggggcagatcatgttgctcatcctgtgcacctcacagatcctactcatgcgcaccacctgggcactgtgcgagagcatcacacttgcgaccggccccctcaccaccctgtgggaggggtccccgggcaaattctggaacacgaccatcgccgtatcaatggccaacatcttccgtggctcttaccttgccggggccggactagcgttcagcttgatgaagtccctcggaggcgggcgccgggggacgggggcccagggcgagaccctcggcgagaagtggaagcgccagttgaaccaactgtcgaagagcgagttcaatacatacaagagatccgggatcatggaggtcgaccgatcggaagccaaggaaggcctcaagcgcggtgagaccacccgccacgcggtgtcacggggcaccgcgaagctgcggtggttcgtggagcggaacctggttaagcccgagggaaaggtgatcgacctgggttgcggccgcgggggctggagctactattgcgccgggctcaagaaggtcacggaggtaaagggatatacgaagggcgggcccggccacgaggagcccatcccaatggccacctatggatggaacttggtgaagctgcactcgggcaaggacgtgttcttcacgccgcccgagaagtgcgacacgctcctctgcgatatcggggagagctcccccaacccgaccatcgaggagggccgcacccttcgagtcctcaagatggtagagccctggttacggggaaatcaattctgcatcaagatcttaaatccctacatgccgagcgttgtagagacactcgagcagatgcaacgcaagcacggcggcatgctggtgagaaacccgctatcccgcaatagcacccacgagatgtactgggtttcctgcggcacgggcaacatcgtaagcgccgtgaacatgacctcccggatgctcctgaaccgcttcacaatggcacaccgcaagccgacttatgagcgggacgtggacctgggggctggaacccggcacgtcgcagtcgagcccgaggtggccaacctcgatataatcggccagcggatcgaaaatatcaagcacgagcacaagagcacctggcactacgacgaggacaacccgtacaaaacctgggcctaccacgggtcctacgaggtcaagccgagcggctccgccagtagcatggtgaacggggtcgtgaagctgttaactaagccctgggacgtcatcccgatggtcacgcaaatcgcgatgaccgacaccacccccttcggccagcagcgtgtgttcaaggagaaggtggatacgcggaccccgaaggctaagcgcggcaccgcccagatcatggaagtcacggccaagtggctctggggcttcctgtctcggaacaagaagcctcgaatctgcacgcgggaggagtttacccgcaaggttcggagcaacgccgcgataggcgccgtgttcgtcgacgagaatcagtggaactccgccaaggaggcggtggaggacgagcggttctgggacctggtgcagaaggagcgggagctccacaaacagggcaaatgcgcgacctgcgtctacaacatgatgggcaagcgcgaaaagaagctaggggagtttggcaaggccaagggctcccgggcaatctggtacatgtggctgggcgccaggttcttagagttcgaggccctgggctttatgaacgaagaccactggttctcccgggagaactccctgtccggcgtggagggcgaggggctccacaaactgggctacatcctgcgcgacatcagcaaaatccctggaggcaatatgtatgccgatgatacagccggctgggacacgcggatcacggaggacgacttgcaaaatgaggccaagattaccgacatcatggagccggagcacgccctcctcgccacatccatcttcaagctcacgtaccaaaacaaggtggtccgcgtccagcggcccgcaaagaacggcactgtaatggacgtcatcagccgccgcgaccagcggggctctgggcaggtgggcacctatggcttgaacaccttcacgaatatggaggctcagctgatccgccagatggagagcgaggggatcttcctcccctcagaactggaaaccccaaacttggccgagcgggttctcgactggctggagaagtacggcgtcgagcgcctgaagcgaatggccattagcggggacgactgcgtggtcaagccgatagacgaccgcttcgcgaccgcactcaccgccctgaacgacatgggcaaggtccggaaggatatcccccagtgggaaccctccaaggggtggaacgactggcagcaggtccccttctgcagccaccactttcaccagctgataatgaaggacggccgcgagatcgtcgtcccgtgtcggaaccaggacgagctcgttggccgcgcccgggtatcccagggggccggatggagcctgcgcgagactgcctgcctggggaagagctacgcccagatgtggcagctgatgtacttccatcggagggatttgcgactggccgccaacgctatctgctccgcggtcccagttgactgggtgcccacaagccgcaccacctggtccatccatgcccaccaccagtggatgacgaccgaggacatgctctcagtctggaaccgggtgtggatcgaggagaatccctggatggaagacaagacccacgtgtccagctggggtgacgtcccgtacttagggaagcgcgaggatcagtggtgtggcagcctgatcggcctcacggcccgggccacctgggccagcaacatccaggtggcaattaaccaggttcgccgcttaatcgggaacgagaactacctggactatatgacgtccatgaagcggttcaagaacgagggagacccggaaggggccctctggtaa

SEQ ID NO: 24334 - RNA, 9879 nt, synthetic construct
  misc_feature 1..9879: note = derived and/or modified CDS sequence (opt11) from DENV-1__GQ868611__SS-prME
  source 1..9879: mol_type = other RNA
tcggtaaccatgttcctgatgctcatgcccaccgccctcgccttccacctaactacccggggcggggagccccacatgatcgtgagcaagcaggaacgaggcaagagcctcctgtttaaaacctctgccggggtgaatatgtgcactctgatcgccatggaccttggcgagctgtgcgaggacaccatgacgtacaagtgcccccgcatcactgaaaccgagccggacgacgtggattgctggtgtaacgccacggacacctgggtcacatacgggacctgcagccaaacgggcgagcaccggcgcgacaagcggagcgtagccctggcgccgcacgtcggcttggggctggagacccgcaccgagacctggatgagctccgagggtgcgtggaagcaaatccaacgggttgagacgtgggccctgcgccaccccgggttcaccgtgattgccctcttcctagcccacgcgatcggcaccagcatcacacagaaggggattatcttcatcctgctcatgctcgtgacgccctccatggccatgcggtgcgtaggcatcgggagccgcgacttcgtggaggggctgtccggcgccacctgggtggacgtcgtcctagagcatgggagctgcgtgaccacgatggccaaggacaagcccacactggacatcgagctgctaaaaacggaggttactaacccagccgtcctgcggaagctgtgcatcgaggcgaagatcagcaacaccacgacagacagccgctgcccgacccagggcgaggccaccctcgtggaagagcaggacgccaacttcgtatgccggcgcactttcgttgaccggggctgggggaacggctgcgggctcttcggaaaggggtccttaatcacgtgcgccaaattcaagtgtgtcaccaagctcgagggcaagatcgtccagtacgagaacctgaagtacagcgtgatcgtgacagtccacacgggagaccagcaccaggtggggaacgaatccaccgaacacggcaccaccgccaccatcaccccccaagcgcccaccaccgagatacaactgaccgactacggggccctcacgctggactgtagcccccgcacgggcctggacttcaacgagatggtcctcctgacaatgaaggagaagtcctggctggttcacaagcaatggttcctagacctgccactgccatggaccagcggggcctcaacgtcacaggagacctggaaccggcaggatctgctggtgaccttcaagaccgcccatgccaagaagcaggaggtagtcgtgctgggcagccaagagggcgcgatgcataccgccctcacaggggccaccgagatccagacctccggcacgaccaccatcttcgccgggcacctgaagtgccgcctcaagatggataagcttaccctaaagggcatgagctacgtcatgtgcacggggtcctttaagctggagaaggagctcgccgagacgcaacacggcaccgtgctggtgcagatcaagtacgagggcaccgacgcgccctgcaagatcccctttagcacacaggacgagaagggggtcacccagaacggccggctgatcaccgccaacccgatagtgaccgataaggagaagcccgtgaacatcgaggccgaaccgcccttcggggagtcctacatcgtcatcggcgccggcgagaaggctctgaagctcagctggttcaagaaggggtctagcatcggcaagatgttcgaggccacggcccgcggggcccggaggatggctatcctgggcgacacggcgtgggactttggctccatcggcggcgtgtttaccagcgtgggcaagctggtccaccaaatcttcggcactgcctacggggtgctgttctctggcgtgtcgtggacgatgaagatcgggatcggcgtgctgcttacatggttaggcctgaactcccgcagcacctccctgtctatgacctgcatcgccgtggggctcgtgacgctgtacctgggcgtcatggtgcaggccgactccgggtgcgtgatcaactggaagggccgcgagctcaagtgcgggagtggcatctttgtcaccaatgaggtgcacacctggaccgagcagtacaaattccaggccgacagcccgaagcgcttgagtgcggccatcggaaaggcctgggaagagggggtgtgcggcatacggagcgccactcgcttggagaacatcatgtggaagcaaatctccaacgagcttaaccacatcctgctggagaatgacatgaagttcacggtcgtggtaggggacgttgccggcatcttggcgcaggggaagaagatgattagaccccagcccatggagtacaaatactcatggaaatcctggggcaaggccaagatcatcggcgccgacgtccagaacaccaccttcatcatagacggtcccaacaccccggagtgccccgacgaccaacgcgcctggaacatatgggaagtggaggactatggtttcggcatcttcacaaccaacatctggctgaagctgcgggactcgtacacacaggtctgtgaccacaggttaatgtccgcggccataaaggacagcaaggccgtacacgccgatatgggctactggatcgagtccgagaagaacgagacatggaagttggctcgggcgtctttcatcgaggtgaagacgtgcatctggccgaaatcccacaccctgtggagcaacggcgtccttgagtcagagatgatcatccccaagatctatgggggacctatcagccagcacaactaccgcccagggtactttacacagaccgccggcccctggcacctggggaagttagagctcgacttcgacctgtgcgagggcacgaccgtagtggtcgacgagcactgcggtaaccgggggccgagcctgcgcaccaccacggtgacaggcaaaatcatacacgagtggtgctgtcggagctgtaccctaccccccctccgcttccgtggggaggatggctgctggtacggtatggaaatacgtcccgtgaaggagaaggaggagaacctggtcaagtccatggtcagcgcgggcagcggcgaggtggactcctttagcctggggctgctgtgcatctccatcatgatcgaggaggtcatgcggagccgctggtcccggaagatgttgatgaccggcacgctggccgtgttcttcctgttaattatggggcagctcacctggaacgacttgatcagactctgcatcatggtgggtgcaaacgcaagcgaccgcatggggatgggcaccacctaccttgccctgatggccacgttcaagatgcgcccgatgttcgcagtgggcctcctgttccgccggctgacctcccgcgaggtgctcctgctgaccatcgggctctcactggtggcctcggtcgagctgcccaatagcctcgaggagctgggagacgggctggccatgggcattatgatcttgaagctgctaaccgacttccagtcccaccagctttgggccacgctgctgagcctcacctttatcaagaccaccttctccctccactacgcctggaagacgatggccatggtgctgagcatcgtctccctcttccccctgtgtttaagcaccacctcccaaaaaaccacgtggttgcccgttctgctgggcagcctcgggtgcaagccgctgaccatgttcctgatcgcggagaacaagatctggggccgccgctcctggcccctcaacgaagggatcatggccgtaggcatagtcagcatactgctgagctccctcctgaagaacgacgtgcccctggccgggcccctcatcgccggcggcatgctgatcgcctgctacgtgatcagcgggtccagcgcggacctgtccttagagaaagccgccgaggtcagctgggaggaggaggccgagcacagtggcgcgagccacaatatcctggtggaggtgcaggacgacggaaccatgaagatcaaggacgaggagcgggatgacaccctgaccatactcctgaaggcgacgctgctcgccgtctccggcgtatatccgctgagcatcccggccaccctgtttgtgtggtacttctggcagaagaagaaacagcgctccggggtcctctgggacacccccagtccgcccgaggtggagcgggccgtgctggacgacggcatctatcgcatcatgcagcggggcctgctagggcgctcccaggtcggcgtgggggtgttccaagagaacgtcttccacaccatgtggcacgtgacgcggggcgccgtgctcatgtaccaggggaagcgcctggagcccagctgggcgtccgtcaaaaaggacctgatcagctacggcggcgggtggcggctccagggttcctggaacaccggggaggaggtgcaggtgatcgccgtcgagcccggcaagaaccccaagaacgtgcagaccgcccccgggacctttaagacgcccgagggcgaagtgggcgccatcgccctggacttcaaacccgggactagcggctcccccatcgtcaaccgcgaagggaagatagtgggtctgtacggcaatggggtggtcaccaccagcgggacgtacgtgagcgcgatcgcccaggcccgggcctcccaagaggggccgctccccgaaatagaggacgaggtgttccgcaagcggaacctgaccatcatggacctccaccccggcagcgggaaaacccgccggtacctcccagcgatcgtccgggaggccatcaagcgcaagctgcggaccctgatcctcgccccaacgcgcgtcgtggcctcagagatggccgaggcgctgaagggcatgcccatccggtatcagaccaccgccgttaaatctgagcacaccggcaaggagatagtggacctgatgtgccacgccacgttcaccatgcgcctcctgtcccccgtgcgggtcccgaactataatatgatcatcatggacgaggcccacttcaccgaccccagctccatagccgcgcgcgggtacattagcacccgggtgggaatgggcgaggccgccgccatctttatgacggccacgccgcccggatccgtggaggccttcccgcagagcaacgccgtcatccaggacgaggagagagacatccccgagcggtcctggaacagcgggtacgagtggatcaccgactttcccggcaagaccgtgtggttcgtgccctccatcaagagcggcaacgacatcgccaactgcctgcgcaagaacgggaagcgggtcatccagctctcgcgcaagacgttcgacaccgagtaccagaagaccaaaaacaacgactgggactatgtggtgaccacggacataagcgagatgggtgctaacttccgggcggaccgcgtcatcgacccgcggcgctgtctgaagcccgtgatcctaaaggacggacccgagcgggttatcctcgcgggccccatgccggtcaccgtggcctccgccgcccagcgtcggggacgcatcgggcgtaaccacaataaggagggcgaccaatacatctacatggggcaacctctcaataatgacgaggaccacgcgcactggaccgaagcaaagatgctgctcgacaacattaacacccccgagggcatcatccccgccctgttcgagccggagcgggagaagtccgccgccattgacggcgagtaccgcctgaggggcgaggcgcgaaagacgttcgtggagctcatgcggcgcggggacctgcccgtttggctgtcctacaaggtcgcgtccgagggcttccagtactcggaccgacgctggtgcttcgatggcgagcggaataaccaggtcctcgaggagaacatggacgtggagatctggaccaaggagggggaacgcaagaagctgcggccccgctggctggacgcccggacatactccgacccactcgccctgcgcgagttcaaggagttcgccgcgggccggcgctctgtgtccggggacctgatcctcgagatcggcaaactgccgcagcacctgacgcagcgtgcccagaacgccttagacaacctggtcatgttacacaatagcgaacaaggcgggcgcgcctaccggcacgcgatggaagagctgccggacacgatcgagacgctgatgctgctcgccctgatcgccgtgctgaccggcggggtgaccctcttcttcctgtccggccgcggtctgggcaaaacgagcatcgggctcctgtgtgtcatggcatcctccgtgctgctctggatggcctctgtggagccccattggatcgcggcgagcatcatcctggagttctttctgatggtcctgctgatccccgagccggaccggcagcgcacgccccaggacaaccagctggcctacgtggtcatcgggcttctgtttatgatcctgaccgtcgccgcgaacgagatgggcttgctggagaccacgaagaaggacctggggatcggccacgtggcggtggagaaccaccaccacgctgccatgctcgacgtcgatcttcaccccgcctccgcctggacgctgtacgcggtggcaacaactatcatcactccgatgatgcgccacacgatcgagaacaccaccgccaatatcagcctgaccgcaatcgccaatcaggcggccatcctgatggggttggataagggctggcccatctccaagatggacatcggcgtacccctcctggccctggggtgctacagccaggtcaacccccttacgctgaccgccgcggtgctgatgctcgtggcccactacgccatcatcggcccggggctgcaggccaaggcaacccgggaggcgcagaaacggaccgccgccggcatcatgaagaaccccacggtcgacgggattgttgcgatcgacctggaccccgtggtctacgacgccaagttcgagaagcagctcggccagatcatgctgctgatcctctgcacctcccagatactactgatgcggaccacctgggcgctctgcgagagcatcacgctggccaccggccccttaactaccctttgggaggggtccccgggcaaattttggaatacgactattgccgtgagcatggccaacatcttccgcgggagttacttggccggagcgggcctggccttcagcttgatgaagtcgctcgggggcggtcgacgcgggaccggggcccagggcgaaaccctgggcgagaagtggaagcgtcagctcaaccagctgtccaagagcgaattcaacacgtacaagcgctccgggatcatggaggtggaccggagcgaagccaaggagggcctaaagcggggggagacaaccaagcacgcggtatcacggggcactgccaagcttcgctggttcgtggagcgcaacttagtgaagcccgaggggaaggtcatcgacctgggctgcggccgcgggggctggagctactactgcgccgggctgaagaaggttacggaggtgaagggctataccaagggcggcccgggccacgaggaacccataccgatggccacctatggatggaacttagtcaagctccactccggcaaggacgtgttttttatcccacccgagaagtgcgataccctgctctgcgacatcggggagagttcccccaatccgactatcgaggagggccgaaccctaagggtgctgaagatggtcgagccctggctccgagggaaccagttttgcatcaagatcttgaacccgtacatgcccagcgtggtggagaccctggagcagatgcagcgcaagcacggcggcatgctcgtccggaaccccctgtcccgcaactcgactcacgagatgtactgggtgtcctgcgggaccggcaacatcgtgtccgcagtcaatatgacgtcccgcatgttgttaaaccggttcaccatggcccaccggaagcccacctatgagcgggacgtagacctgggggccggaacccgccacgtggcagtggaacccgaggtggccaacctggacataatcggccagcggatcgagaacatcaagcacgagcacaagagcacgtggcactacgacgaggacaacccgtacaagacctgggcctaccacgggagttacgaagtgaagccgagcggatccgcgagtagcatggtcaatggggtggtcaagctcctgaccaaaccctgggacgtgatacccatggtgacccagatagccatgacggacaccacccccttcggccagcagcgcgtcttcaaggagaaggtggatactcggacgccgaaggccaagcgcgggaccgcccagatcatggaggtgaccgccaagtggctgtggggtttcctctcccggaacaagaagccccgcatctgcaccagagaggagttcactcgaaaggtgcggtccaacgccgccattggcgccgttttcgtggacgagaaccagtggaactccgccaaggaggcggtcgaagacgagcggttttgggacctggtgcacagggagcgcgagctgcacaagcaagggaagtgcgcgacctgcgtgtacaacatgatgggcaagcgagagaaaaagttgggagagttcggcaaggccaaggggagccgcgccatctggtacatgtggctgggcgcacggttcctggagttcgaggcgctcggcttcatgaacgaggaccactggttctcccgagaaaactcactgtccggtgtcgagggcgaggggctgcacaagctaggctacatcctgcgtgacatcagcaaaatccccgggggcaacatgtacgccgatgacaccgcgggatgggacacccgcatcacggaggacgacctgcagaatgaggccaggatcaccgacatcatggagccggagcacgccctcctggctaaatcaatctttaagctgacctaccagaacaaggtggtgagggtacagcgccccgccaagaacgggaccgtgatggacgtgataagccgacgcgaccagcgcggctccgggcaagtcggcacctacggcctcaacaccttcaccaacatggaggcccagctgatccgccagatggaaagcgaagggatcttctctccgagcgagctggagacccccaacctcgctgagagggtgctggattggctggagaagtacggcgttgagcgcctcaagcggatggccatctccggggacgactgcgttgtgaagccgatcgacgatcgcttcgcgacggccctgaccgcactgaatgacatgggtaaggtgcggaaggacatcccccagtgggagcccagcaaggggtggaacgactggcagcaggtccccttctgctcccaccacttccaccaactaatcatgaaggacggcagagagatcgtggtgccgtgcagaaaccaggacgagctggtcggccgcgcgcgggtgagccagggggccggttggagcctgcgcgagaccgcgtgcctcgggaagtcctacgcccagatgtggcagttaatgtacttccaccggagggacctgagactcgccgccaacgcgatctgcagcgccgtgccggtcgactggatccccaccagtcgcacgacgtggagcatccacgcccaccaccagtggatgaccaccgaagacatgctttccgtgtggaaccgcgtgtggatcgaggaaaatccctggatggaggacaagacacatatcagctcttggggtgacgtcccgtacttgggtaagcgggaggaccagtggtgcggcagcctcatcggcctgaccgcccgcgccacctgggcaaccaacatccaggtggccatcaaccaggtgcggcgcctgatcggtaacgaaaactacctcgactacatgacgtccatgaagcggttcaagaacgagagcgacccagagggtgccctgtggtga

SEQ ID NO: 24335 - RNA, 9879 nt, synthetic construct
  misc_feature 1..9879: note = derived and/or modified CDS sequence (opt11) from DENV-1__FJ882555__SS-prME
  source 1..9879: mol_type = other RNA
tctgtaaccatgctgctcatgctgatgcccaccgccttggccttccacctcaccacccgcggtggggaaccgcacatgatcgtgtcgaagcaagaacggggtaaaagcctcctgttcaagacctctgccggggttaacatgtgcaccctcattgcgatggacttgggcgagttctgcgaggataccatgacctataagtgcccccgcatcaccgaggctgaacccgacgacgttgactgctggtgcaacgcgaccgacacgtgggtcacctacggaacctgctcccagaccggggagcatcgacgcgataaaagatcagtcgccttggcgccccacgtgggcctcgggctagagactcgcaccgagacctggatgtcatccgagggcgcctggaagcaaatccaacgggtcgagacctgggcactccgacatcctgggttcacggtgatcgccttatttctggcgcacgccatcggcacatcaatcacccagaaggggatcatcttcatcttacttatgctggtgacccccagcatggccatgcggtgcgtcggtatcggttcacgcgattttgtggaggggctgtcaggtgcgacgtgggtggacgtcgtgctcgagcacgggtcgtgcgtgaccacgatggccaaggacaaacccacgttagatatcgagctgctcaagacagaggtcaccaaccccgccgtgctgcgtaagctgtgtatcgaggcgaagatatccaataccaccacagacagccgctgccccacccagggcgaagccaccctcgtggaagaacaagacgctaacttcgtctgccggcgtacattcgtggatcggggctgggggaatggctgcggcctgtttggtaagggctccttaatcacgtgcgcaaagttcaagtgcgtcacaaagttagagggtaagatagtccaatacgagaaccttaagtacagtgtgattgttaccgtccacactggcgatcaacatcaggtcgggaacgaatccacagagcacggcacgacagcgacaattacgccccaagccccctctacagagatccagctgaccgactacggagccctcaccctggactgctctccgcggaccggcctggacttcaacgagatggtgttgctgacgatgaaggagaagtcctggttggtgcataagcagtggttccttgacctcccgcttccttggacctctggggccagtgcctcacaggagacctggaatcggcaggatttactggtgacattcaaaactgctcacgccaagaaacaggaagtcgtggtcctaggttcccaagaaggcgccatgcacacagccctcaccggtgcgaccgagatccagacaagcggcaccaccacaatctttgcagggcaccttaaatgccgattgaagatggacaagttgactttaaaaggcatgtcctacgtcatgtgcacagggagctttaaattggagaaagaagtggccgagacccaacatggtacagttctcgtccagatcaagtacgagggcacggatgcgccctgtaagatccctttttcaacccaggacgagaagggggtgacccagaacggcagactgatcaccgccaacccgatcgtgacggacaaggagaagcccgtcaacatcgaggccgagccacccttcggggagtcgtatatagtgataggcgcaggcgagaaggcattaaaactgtcatggttcaagaaaggttcaagcatcgggaaaatgttcgaggccacggcccgcggggcgcggcgtatggcaatcctcggcgatactgcatgggacttcggatctattggcggcgtgttcacctccgtgggtaaactggttcaccagatattcggaaccgcctacggcgttctgttctcaggcgtctcctggacgatgaagatcggtatcggcgtgttgctgacctggcttgggctgaatagtcgcagtacctctctctcaatgacctgcatagccgtgggactggtcacattatatctgggcgttatggtgcaagcagatagcggatgtgtcataaattggaaggggcgggagctgaagtgtgggagcggcatcttcgtaaccaacgaggtgcacacctggacggaacagtacaaatttcaggcagattccccgaaacgcctcagcgccgctatcggaaaagcctgggaagagggagtctgcggcatacggtccgcgacacgcttagaaaacataatgtggaaacagattagcaacgagctgaaccacatcctcctggagaatgacatgaagttaaccgtggtggtcggggatgtggccggcatactcgcccaagggaagaaaatgatccggccacagcccatggaatacaagtattcctggaaatcctggggcaaagccaagatcatcggtgcggacgtacagaacacgacctttataatagatgggcaaaacacccctgagtgtcccgacgaccagcgcgcatggaacatctgggaggtcgaggactacggcttcggtatcttcaccaccaacatatggttaaaactgagagacagttatacccaggtttgcgaccaccgactgatgtcggccgccatcaaggacagtaaggcagtgcatgcggacatgggctactggatcgagagcgagaagaacgaaacctggaagctggcccgggccagtttcattgaggttaagacttgtatatggcctaaaagccacactctgtggagcaacggtgtgctcgagagcgagatgataatccccaagatatatgggggccccatctcccagcacaactaccgcccgggttacttcactcagacagcaggcccatggcacctggggaagttggagttggactttgatctgtgcgaggggaccaccgtcgtagtggatgagcattgcgggaaccggggacccagcctgcgcaccactaccgttaccggcaagattatccacgagtggtgttgtaggtcctgcaccctcccgccgctgcgcttcaaaggagaggacggttgctggtacgggatggagatccggcctgtgaaggagaaggaagagaacctggtgaaatccatggttagcgccggctccggcgaggtcgacagcttctccttagggctgctgtgcataagcatcatgattgaagaagtgatgcgcagtcggtggtcaagaaagatgctaatgacgggtacgttagcggtgttctttctgctaataatggggcagcttacctggaacgacctgatccggctctgtattatggtcggggcgaacgcctccgataggatggggatgggcaccacatacctggccttaatggccacattcaagatgcgacccatgttcgcggtgggactccttttccggcgcctgacatcacgcgaggtgttattgctgacaatcggtctttcccttgtggccagcgtggagctgccgaacagtctcgaggagctgggcgacggactggcaatgggcatcatgatcctcaagctgctgacggactttcagagtcatcagctctgggccacgctgctgtccatgaccttcatccgtactacgttcagcctccactacgcgtggaagaccatggccatggtcctgtccatcgtgagcctgttccccctctgcctgtccaccacatcacaaaagacgacctggttacccgtactcttaggttccttgggatgcaagccgctcaccatgttccttatcgccgaaaacaagatttggggtagaaagagctggccgttaaatgaggggattatggcagtcggcatagtcagcatcctcctgtccagcctgctcaagaatgatgtcccactggccggtcccctgattgcgggcggtatgctcatcgcctgctacgtcatctcggggagcagcgccgatctgagcttggagaaggccgctgttgtttcttgggaggaggaggcggagcactctggggcatctcataatatcctcgtcgaagtgcaggacgacgggaccatgaagatcaaggacgaggaacgcgacgatacgctaaccatccttttgaaggctaccctgctggccgtttcaggcgtctaccccctctccattccagctaccttgttcgtgtggtatttctggcagaaaaagaagcaacggagcggagtcctgtgggacacaccaagccctcccgaagtcgagcgagcggtgctagacgacggcatttacaggatcatgcagagaggcctgctggggcggtctcaggtaggcgtaggtgttttccaagagaatgtattccatacgatgtggcatgtcactcggggcgccgtgctaatgtaccaggggaagcggttagagccgtcctgggcaagcgtgaagaaagatctgatctcttacggaggcgggtggcgcctgcagggctcgtggaacaccggagaggaggttcaggtgattgccgtggagcccggcaagaaccccaagaacgtccagaccgcgcccggaacattcaaaaccagcgagggcgaggtgggagctatcgccttagacttcaagccggggacgagcggaagccccatagtgaaccgggaaggaaaggtcgtcggcttatacggaaacggggtggtgaccacatctggaacctacgtctcagccatagcccaggcgaaggcgtcccaggaggggccgctgcccgagattgaggacgaagtgttcagaaaacggaacctcacgatcatggacctgcacccggggagcgggaagacccgtcggtatctacccgcgatagtcagggaagccataaagcggaagctcaggacgctaatcctggcccccacgcgcgtggtcgcgagcgagatggccgaggcgcttaaaggaatgcctatccggtaccagaccactgccgtgaagtcggagcacacgggcaaggagattgtggatctgatgtgccacgccaccttcaccatgcgcctgcttagtcctgtgcgcgtccccaactacaacatgataattatggacgaggcgcacttcaccgacccgtcatccatcgccgcacgcgggtacatcagcacccgcgtgggcatgggggaggcggccgctatcttcatgaccgcaaccccgcccggcagcgtggaggccttccctcagtccaacgccgtgatccaagatgaggagcgcgacatacccgagcgatcgtggaatagcggctatgagtggatcaccgacttcccgggcaagacggtatggttcgtgccgagtatcaaaagcggaaacgacatcgcgaactgcttacgcaaaaatggcaagcgagtgatccaactgtcccgaaagactttcgatactgagtaccaaaagaccaagaacaacgattgggactacgttgttacgaccgacattagtgagatgggcgcaaacttccgcgccgaccgagtcattgacccccggaggtgcctcaagcctgtgatcctgaaagatgggccagagagagtcatacttgccggccccatgcccgttaccgtcgcgtccgcggctcaaaggagggggcgcatcggccgcaatcataacaaggagggcgaccagtacatctacatggggcaaccactaaacaacgacgaggaccatgcccactggaccgaagccaagatgctactagataacatcaatacgcctgagggcataatcccagccctctttgagccagagagggagaagtcagcggccatcgacggagagtaccgcctgcggggcgaggcccgcaagacattcgtcgagttaatgcggcgcggggacctccccgtgtggctgagctacaaggtggcctcggaagggttccagtatagcgaccgtcgctggtgctttgacggggagaggaataaccaggtactcgaggagaacatggacgtggagatctggaccaaagagggggagcgcaagaaacttcggccgcggtggctggatgcacggacctactctgaccccctggcgctcagggaatttaaagagttcgccgccggacggcgctctgtctcaggagatctgattctggagatcggcaaactcccacaacacctgacgcagcgggctcagaacgcgcttgataacctcgtcatgctgcacaacagcgagcaaggcgggcgcgcctatcgccacgccatggaagaactgcccgacacaatagaaacgttgatgttgctggcccttatagccgtattgaccggcggagtcacactattcttcctgtccggccgcgggctgggtaagacctcaattggactactctgcgtgatggcaagtagcgtgctgctgtggatggcctccgtggaaccgcactggatcgcagcatcaatcatcctggagttcttcctgatggtattactcatacccgagcccgacaggcagaggacgccccaggataaccagctggcgtacgtggtgatcgggctcctcttcatgattttgaccgttgcggcaaacgagatggggctgttagagaccaccaagaaagacctaggcataggtcacgtggcagtcgagaaccaccaccatgccgcgatgctggatgtcgacctccacccggcatcggcctggaccctctatgccgtagccacgaccatcatcacgcccatgatgcggcacactatcgaaaacaccaccgctaacatctctctgacggcaatagccaaccaggcagctatcctcatggggctggataagggttggccgatatccaagatggacatcggcgttcctctgctcgccctggggtgttatagccaggttaaccccttaaccctgaccgctgccgtgcttatgctggttgcccactacgccataataggtcccggtctacaagcgaaggccacccgcgaggcccaaaagaggactgccgctggcataatgaagaaccccacagtcgacgggatcgtggcgattgacttagaccccgtggtgtacgacgcgaagtttgagaaacagctaggccagataatgctactcatcctgtgtacctcccaaatcttactgatgcggacgacgtgggcgctgtgcgagagcatcacattggccaccggccctctaaccactctgtgggagggctcccccggcaagttctggaacactaccattgccgtaagcatggcgaacatcttccgcgggagctacctcgccggcgccggactagccttctccctaatgaaatccctcgggggagggcgtaggggcaccggagctcaaggagagacgctgggggagaagtggaagaggcaactgaaccagctctccaagtcagagttcaacacctacaagcgctccgggataatggaggtagacagaagcgaagccaaggaagggctgaaacgcggggagaccacgaaacatgccgtctcccgagggacagccaagctgcgctggttcgttgagcgcaacttagttaagcccgagggcaaggtcatcgatctgggctgcggtcgcggcggctggtcttattactgcgccggactgaagaaggtgaccgaggtgaagggatatactaagggagggccaggccacgaggaacccatacccatggcgacctacgggtggaaccttgtcaagctccactccggcaaggatgtatttttcataccacccgagaagtgcgatacgctgctgtgcgacatcggggagagctcccccaaccccaccatcgaggaaggacggacgctgcgagttttgaagatggtcgagccctggctgcgcgggaaccagttctgtatcaagattctaaatccctacatgcccagtgtggtggagaccctagagcaaatgcagcgcaagcatggaggcatgcttgtccggaaccccctatcccggaacagcacccacgaaatgtactgggtgtcatgtgggaccggcaacatagttagcgcggtcaacatgacatctcggatgctccttaatcgcttcaccatggcccaccgtaaacccacatacgagcgggatgtggacctcggggcaggcacgcgtcacgtggcggttgaaccggaggtagcgaacctggatatcatcggccagcggatcgaaaatatcaagcacgagcacaagtcaacctggcactacgacgaggataacccctacaagacctgggcgtaccacggttcgtacgaggttaagcccagcggtagcgcatccagcatggtgaacggggtggtcaagctactcacgaagccctgggatgtcatccctatggtaactcagatcgcgatgacagacaccacaccttttgggcaacagcgcgtattcaaggagaaggtagatactaggaccccaaaggctaagcgtgggaccgcgcagatcatggaagtaacggcgaaatggctgtggggtttcctttccaggaacaagaagcctagaatttgcacgcgggaggagtttacacgaaaggtgcggagcaacgccgctattggcgccgtgttcgtggacgaaaaccaatggaactccgccaaagaggccgtcgaagacgagcgcttctgggatctcgtacaccgggagcgcgagctccacaaacaagggaaatgtgcaacttgcgtctataacatgatgggtaagcgggagaagaagttgggggagttcggaaaagccaagggatctagagcgatctggtacatgtggctgggcgcccgtttcttggagttcgaagccctgggtttcatgaacgaggaccactggttctcccgcgagaactcgctctccggtgtcgaaggtgaggggctgcacaagctaggctacatcctacgggacatcagcaaaatccccggagggaacatgtacgccgacgacacggccgggtgggacacgcgcatcaccgaggatgacctgcagaacgaggcgaagatcaccgacatcatggagcccgagcatgctctgttagccaagtccatttttaagctgacctaccaaaacaaggtggtgcgggtacagagacccgccaagaacggcacggtgatggacgtgatctcccgccgggaccagcgtggctccgggcaggtcggaacgtatggcctgaataccttcactaatatggaggcccagttaatccggcagatggagagcgaggggatcttctcaccgtccgagctggagacgcccaacctggcgggtagggccctcgactggctggaaaagcacggtgtggagcgtctcaagcgcatggctatctccggcgacgattgcgttgtcaagccgatcgacgacaggttcgccaccgccctaaccgcgttaaacgacatgggcaaggtgcgcaaggatatcccccagtgggagccaagcaagggctggaacgattggcagcaggtccccttctgttcccaccacttccaccagctgataatgaaggacggccgggagatcgtcgtcccctgccgcaaccaagacgagcttgtcggtcgggctcgcgtgtcccagggcgcggggtggagcctgcgcgaaaccgcatgtcttggcaagtcctacgcccagatgtggcagctcatgtactttcatcgccgagacctgcgtctggccgccaacgctatatgcagtgcggtgccggtcgactgggtcccgacgtcacggaccacctggagcatccacgcgcatcaccaatggatgaccacggaggacatgctttccgtgtggaaccgcgtctggatcgaggagaacccctggatggaggacaagacccacatctcatcctggggagacgtgccctacctggggaagcgggaggaccagtggtgcggaagcctgatcgggctcacagcacgcgcaacctgggctaccaatatacaagtcgcgataaatcaggtgcgccgtctgctcggcaacgagaactacctcgattacatgacttccatgaagcgctttaagaacgagagcgatccggagggggctctgtggtga

SEQ ID NO: 24336 - RNA, 9879 nt, synthetic construct
  misc_feature 1..9879: note = derived and/or modified CDS sequence (opt11) from DENV-1__GQ199821__SS-prME
  source 1..9879: mol_type = other RNA
tcggttaccatgctattgatgctaatgccgacggccctagccttccacttaacgacccgcggcggggaaccccacatgatcgtgtcaaagcaggaacggggtaagagcttactgttcaagaccagcgctggggtgaacatgtgcaccctcatcgcaatggatctgggcgagttctgcgaagacacgatgacctacaagtgcccccgcatcaccgaggcagaacccgacgacgtggactgctggtgcaatgctaccgacacctgggtgacctatggaacctgctctcagaccggtgagcaccgccgcgacaaacggtccgttgccctcgcgccgcatgtggggctcggactcgagacgcgcaccgagacttggatgagcagcgagggagcgtggaagcagatccagcgggtggagacctgggctctgcggcatccagggttcacggtgatagccctattcttggcgcacgcgatcggcaccagcatcactcagaaaggaatcattttcatcttgctcatgttggtgaccccctccatggcaatgcgatgcgtgggcatcggctctcgagacttcgtggaggggctgtccggcgccacttgggtggacgtcgtgctcgagcacgggagctgcgtcaccaccatggccaaggacaagcccacgctggacattgagctcctcaagacggaggtcaccaacccggcggtgctccgtaagctgtgtatcgaggccaagatctccaacaccacgacggacagtcgctgtccgacccagggagaggctaccctcgtggaggagcaagacgctaacttcgtctgccgtcggaccttcgtggaccggggctgggggaatggctgtggactatttggcaaggggtccctgatcacgtgtgctaagttcaaatgcgtgaccaagctagaagggaagacagtccagtacgagaatctgaagtactctgtaatcgtgaccgttcacacgggcgaccagcaccaggtagggaacgagtcgactgagcacggcaccaccgctacgattacaccccaggccccgagcactgagatacaactgacagactacggggccctcaccctggactgttcaccccggacgggtctggatttcaacgagatggttctcctgaccatgaaagagaagtcctggctggtgcacaagcagtggttcctcgacctcccactgccctggacaagcggggcctctacttcacaggagacgtggaaccggaaggatctcttggtgacgttcaagactgcccacgcgaagaaacaggaagtcgtcgtgttaggctcgcaggagggcgccatgcataccgccctcacgggggcaaccgagatccagaccagtgggaccactaccatcttcgcagggcacctaaagtgcaggctgaaaatggacaagctcaccctgaagggcatgtcctacgtcatgtgtacagggagcttcaaactggagaaggaggttgccgagactcagcacggcaccgtgcttgtgcaaataaaatacgaaggcaccgacgccccctgtaagatccctttttccacccaggacgaaaagggggtgacgcaaaacggccggttaatcacggccaacccgatcgtgaccgacaaggagaagcccgtcaacattgaggcggagcctcccttcggagaatcttacatcgtgataggcgcgggcgagaaagccctgaagctgtcatggtttaagaagggcagcagcatcggcaagatgttcgaggccaccgcccgcggggcacggcgcatggcgattctcggcgacacagcgtgggacttcggaagcataggcggcgtgttcacaagcgtcgggaagctggtacaccagatctttggcaccgcctacggggtgctgtttagcggcgtcagctggaccatgaagattggtatcggcgtgctactgacgtggctcgggttaaacagcaggagcaccagcctgtccatgacatgcatcgtggtcgggctggtcaccctgtacctgggcgtaatggttcaggccgacagcgggtgcgttatcaattggaagggccgagagttgaaatgcgggagcggcatcttcgtgacgaacgaggtccacacctggaccgaacaatacaagttccaagccgacagtccgaagcgcctgagtgccgccatcggcaaggcatgggaagagggggtctgcggcattcgctcggccacccgcctcgagaacatcatgtggaagcaaatctcgaacgagctgaaccacatactcctggagaatgacatgaagttcaccgtggtcgtcggggacgtggccggcatcctggcccaaggaaagaagatgatccgcccccagcccatggagtacaaatactcctggaagtcctggggcaaggctaagataataggcgctgacgtccaaaacacgaccttcataatcgatgggcccaacacgccggaatgtccagacgaccagcgcgcctggaacatctgggaggtggaggactacggtttcggtatcttcaccactaacatatggctcaagctgcgggactcctacacccaagtgtgcgaccatcgcctaatgagcgcggccatcaaggactccaaggccgttcacgcggacatgggatactggatagagagcgaaaagaacgaaacgtggaagttagcccgggcctccttcatcgaggtaaagacctgcatctggcccaagtctcacaccctgtggtcaaacggcgtgctggagagcgagatgataatccccaaaatctacgggggtcctatttcccagcataactaccgccccgggtactttacccagacagccggcccttggcacctggggaagctggagctggacttcgatctctgcgaggggaccacggtcgtggtggacgagcactgcggcaaccgggggccatcactgcgcacgaccactgtcaccggtaagatcatccacgaatggtgctgcagatcgtgcacactgccacccctgcgattcaagggggaggatggctgctggtacggaatggaaattaggcccgttaaggagaaagaggagaatctggtgaaaagcatggtcagcgccggcagcggcgaggttgacagcttcagtctggggctcctgtgtatctctatcatgattgaggaggtaatgcgctcgcggtggagccgcaagatgctgatgaccggcaccctagccgtcttcttcctcctgatcatggggcagctcacatggaacgacttgatcaggttatgcatcatggtaggcgccaatgcgtccgaccgcatgggaatgggcacgacgtatctcgcgctgatggccactttcaagatgcggcccatgttcgcggttgggctcctgttccgtcgcctgacgagccgggaggttctgctccttaccatagggctgtccctcgtggccagcgtcgagctgcctaattccctggaagagttgggggacggtctcgcgatgggcatcatgatcctgaaacttctgaccgactttcagagccaccagctgtgggctacgctgctgtccctgacgtttatcaagacgaccttttcactccactacgcctggaagacgatggccatggtgctgagcatcgtaagcctattccccctctgcctgtcgacgacgagccagaaaaccacctggcttcccgtccttctaggctccctgggctgcaagcccctcacgatgtttctgatagcggaaaataaaatctggggcaggaagtcttggcccctgaacgaggggatcatggccgtgggcatcgtgagcatcttactgtcatcactgctcaagaacgatgtacccctggccgggcccctgattgccggtggaatgttaatagcatgctacgtgatctccggaagctcagcggacctatcactagaaaaggcggccgaggtgagttgggaggaggaggcggagcacagcggcgcaagccataacatacttgtggaggtgcaagacgatgggacaatgaagattaaagacgaggagcgcgacgataccctgaccatcctgctcaaagctacccttctggcagtgagcggagtgtatcccctctccatcccagccacgctgttcgtgtggtacttctggcagaaaaagaagcagagaagcggggtgctgtgggacacccccagcccgcccgaggtagagcgggcagtgctcgacgacggaatctatcgcatcatgcagcggggcctgctggggcggagccaggtgggcgtcggggtgttccaggagaacgtgtttcacaccatgtggcacgtcacccggggagcagtgctgatgtaccaagggaagcgcctcgagccaagttgggcatctgtaaagaaggacctgatttcctacggcggcgggtggcggttgcagggatcatggaacacgggggaggaggtacaggtaatagccgtggagcccggcaagaacccgaagaacgttcaaaccgcgcccggcaccttcaagacctccgagggcgaagttggtgccatcgccctcgacttcaagcccgggactagcggctctcccatagtgaaccgcgaggggaagatcgtcgggttgtacggtaacggggtagtgaccacctctggcacgtacgtttctgcgatagcccaagcgaaagcctcccaggaggggcccctgcccgagatcgaggatgaggtgtttcggaagcgtaacctcaccattatggacttgcatcccggcagcgggaagacgcggaggtacttgcccgcgatcgtgcgagaggccatcaaacgcaagctccggacgcttatcctggccccgacccgcgtagtcgcctccgagatggccgaggcgttgaaaggcatgcccatccgctaccagactaccgcagtcaaaagcgaacacaccggaaaggagatcgtcgatctgatgtgccacgccaccttcacgatgcggctgctctcccctgtgcgtgtaccgaactataacatgatcatcatggacgaggcccacttcaccgacccgagctccatcgccgcgcgagggtacatatccacacgcgtggggatgggggaggccgccgccatattcatgaccgccacgccgcccgggtcggtagaggcgttcccccagtcgaacgccgtaatccaagacgaggagcgagacatccctgaacgctcctggaacagcgggtacgaatggattaccgacttcccgggcaagaccgtctggtttgtgccctccattaagagcggcaacgacatcgccaactgcctgcgcaagaatgggaaacgtgtgatacagctgagccggaaaactttcgacacggagtatcagaagaccaaaaacaacgactgggactacgtagtgaccaccgatatttcggaaatgggcgccaacttcagagcggacagggtaatcgaccccaggcggtgtttaaagccggtgatcctgaaggacggtcccgagagagtaatcctggccggccccatgcccgtcacggtggcctccgccgcccaacggcgcgggcgaattggccgcaaccacaacaaggagggcgaccagtacatatatatggggcaaccgctcaacaacgacgaggaccacgctcattggacagaggccaagatgctcctggacaacatcaacacacccgagggcatcatcccggctctcttcgagccggagagggagaagtccgcggccatcgacggggagtaccgcctccgcggcgaggccagaaaaaccttcgtcgagctcatgagacgcggggacctcccggtctggctaagctataaagtggcgtcagaaggcttccaatacagcgacagaaggtggtgcttcgacggcgagcgcaacaaccaggtgcttgaggagaacatggacgtcgagatctggacgaaggagggggagcggaaaaagctccgacccagatggctggatgcccgcacctattccgatccccttgccttgcgggagttcaaagagttcgcagcgggccgccgtagcgtgagcggagacctgattctggagatcgggaagctcccccagcacctgacccagcgcgcacagaacgctctggacaacctggtgatgctgcataactctgagcagggcgggcgggcatacagacacgcgatggaggagctgcctgacacgatagagacgctcatgctgttagccctcattgcggtcctaaccggcggggtaaccctgttcttcctcagcggccggggtctggggaagaccagcatcggcttactatgcgtgatggcgtcctcggccctcctgtggatcgctagtgtcgagccgcactggatagccgccagcatcattctcgagttcttcctgatggtgctactcatcccagaaccagacagacagaggaccccgcaggacaaccagctggcctatgtggtcattgggctcctctttatgatcctcacggtggcggcgaatgaaatgggcttgctcgagacgaccaagaaagacctgggaatcgggcacgtggccgtcgagaatcaccaccacgcagcgatgctggacgtggacctacacccagcctccgcatggaccttgtacgcggtggctacgacaatcatcacccctatgatgcgccacacaatcgagaacaccaccgcgaacatcagtctgactgccatcgcgaaccaggccgcaatcctcatggggctggacaaagggtggccgatatccaaaatggacatcggcgtcccgttactggccctggggtgctactcccaagtgaaccccctgaccctcacggcggcggttctgatgcttgtagcccactacgctatcataggacccgggctccaggccaaggctacgcgggaagcccagaagcgcaccgccgcgggtatcatgaaaaacccgaccgtggacgggatcgtagccatagatctggacccggtcgtgtacgatgcgaagttcgaaaagcaactgggccagatcatgctcctgatcctgtgcacgtcgcagatcctcttgatgaggactacgtgggccctgtgcgagagcatcacgctcgccacgggccccctgaccaccctgtgggaagggtccccaggcaaattttggaataccacgatcgcagtgagcatggcgaacattttccgggggagctatctcgcaggcgccggcctggccttctctctgatgaagagtctcgggggaggccgtcggggcacaggggcccaaggagaaactttaggcgagaagtggaaacgccagctgaaccaactctccaagagcgagttcaatacgtataagcgctccgggatcatggaggtcgatcgcagcgaggcaaaagaggggctgaagcgcggcgaaacgactaagcacgccgtgtcgagaggcaccgccaaacttcggtggttcgtggagcgtaaccttgtcaaacccgaggggaaggtgatcgacttaggttgtggcagaggcgggtggagctactactgcgccgggctgaaaaaggtgacggaagtaaaggggtacacgaaaggcgggcccggccacgaggagcccatccctatggccacctacgggtggaacctcgtgaagctccatagcggcaaggacgtgttctttatcccgcccgaaaaatgcgacaccctgctctgcgacataggggagtcgtcccccaaccccacaattgaggagggccgcacgttgcgggtcctgaaaatggtcgagccctggctgcgcgggaaccagttctgcatcaagatactcaatccatacatgccaagcgtagtcgagaccctggagcagatgcagagaaagcacgggggtatgctcgttcgcaatcccctctccagaaacagcacccatgaaatgtattgggtgagttgcggtaccggcaacatagtctctgccgttaatatgacatcgcgcatgctgctgaaccggtttacgatggcccaccgcaagccgacctacgagcgcgacgtggatctcggggccggcacgcggcatgttgcggtggaaccggaagtggcgaacctggacatcatcggccagcgcatcgaaaacatcaaacacgagcataaaagcacctggcactacgacgaggacaacccctataagacttgggcttaccacggttcctatgaagtcaagcctagtggcagcgcctccagcatggtgaacggagtagtgaagttactaaccaagccgtgggacgtgatccccatggtcacccagatcgccatgaccgacacgacaccctttggccagcagagggtattcaaggagaaggtggacacccgaacacccaaagccaaaaggggcaccgctcagatcatggaggtcaccgctaagtggctgtggggcttcctgtcccgtaacaagaaaccgcgcatctgtacacgcgaggagtttacgcgtaaggttcggagcaacgcggcgatcggcgctgtattcgttgacgaaaaccagtggaactccgcgaaagaggccgtggaggacgagcgcttctgggacttagtgcatcgcgagagagagctgcacaagcaggggaagtgcgccacgtgcgtctacaacatgatggggaagcgcgagaaaaagctcggggagttcggcaaggctaagggatcccgggccatttggtacatgtggctcggcgcgcgctttctggagttcgaggcacttggattcatgaacgaagaccactggttcagtcgggagaacagtctctctggagtggagggagaggggctccacaaactggggtacatccttcgcgacattagcaaaatccccggtggtaacatgtacgccgacgacactgccggctgggatacccgcatcaccgaggacgacttgcagaacgaggctaagatcacggacatcatggaaccggagcacgcgctgctcgccaagtccatattcaagttaacctaccaaaataaagttgtccgcgtgcagcggccagctaagaacgggaccgtcatggacgtcatatcacgccgtgaccagcggggctccggccaagtgggcacatacggccttaatactttcacaaacatggaggctcaactgatcaggcagatggagtcagaagggatcttctcgcccagtgaactggagactcccaacttggccgggcgggtgctcgactggctggaaaaacacggggtcgagcgcctaaaacggatggccatatccggcgacgactgcgtggtgaagccgatcgatgaccgattcgccaccgccctcaccgctttaaacgatatggggaaggtccgcaaagatataccacagtgggagcccagcaagggctggaacgactggcagcaagtcccgttctgctcacaccacttccaccaactgatcatgaaagatggaagggagatcgtggtcccctgccggaatcaggacgagctcgtggggcgcgcgcgggtgtcccagggcgcggggtggtctctgcgagagaccgcctgcctgggaaagtcctacgcgcagatgtggcagctcatgtacttccaccgacgagacctgcgactggccgcgaacgccatctgcagcgcggtcccagtggactgggtgccgacttcccgaaccacctggtccatccatgcccaccaccagtggatgaccaccgaggatatgctgtccgtttggaaccgggtgtggatcgaggaaaacccttggatggaggacaagacccatatctcctcttggggagatgtgccctacctgggcaagcgcgaagaccaatggtgtggttcgctgatcggactgacggcccgggcgacctgggccaccaacatccaagtggccatcaaccaggtacgtcgcctgattggaaatgaaaactatctggactatatgacgtcgatgaagcggttcaagaatgagagcgacccggagggtgccctctggtga

SEQ ID NO: 24337 - RNA, 9879 nt, synthetic construct
  misc_feature 1..9879: note = derived and/or modified CDS sequence (opt11) from DENV-1__FJ882556__SS-prME
  source 1..9879: mol_type = other RNA
tcggtgactatgttgctcatgttgatgcccacagccctggcattccacttaaccacccggggtggcgagccacacatgatagtgagtaaacaggagcggggcaaaagcttgctgtttaagacgtccgccggggtcaacatgtgcaccttaatcgccatggacctgggcgagctgtgcgaggataccatgacctacaagtgcccacgaatcacggaaaccgaacctgatgacgtagactgctggtgcaacgccaccgatacctgggtgacttacggtacctgcagccagacaggcgagcatagacgcgacaaacggtccgtcgccctcgcgccccatgtcggccttgggttagagacacggaccgagacgtggatgagttccgagggcgcctggaaacagatacagcgtgtcgagacgtgggccctccgccacccagggttcaccgtgatcgccctgttcctggcacatgcaatcggtaccagcatcacgcagaaagggattatcttcatcctcttgatgttagtgaccccctcgatggccatgcggtgcgtcggcatcggtagccgagatttcgtggaggggttatcaggagcaacctgggtagacgtcgtgctggaacatgggagttgtgttacgacaatggccaaggacaagcccacgcttgacatcgagctcctgaaaaccgaggtcaccaatccggccgtgctgcggaagctctgcatcgaggcgaaaatttccaacaccacgacggacagccgctgcccgacacagggtgaggctaccctggtggaggaacaggacgccaacttcgtttgtcggcgcacattcgtggaccggggctgggggaacggctgcgggttgttcggcaaggggagcctcatcacttgcgcgaagttcaaatgcgtaaccaaactagaaggaaaaatcgtccagtatgagaacctgaagtacagcgtgatcgtgaccgtccacacgggtgaccaacaccaggtggggaacgagtcgacggagcacggaaccaccgccactataacgccccaggcgccgaccaccgaaatacagctgaccgactacggggccttaactctggactgctcaccacgaaccggccttgacttcaatgaaatggtcctgctgaccatgaaggagaagtcctggctcgttcacaagcagtggtttctcgatctgcccttgccctggacatcgggagccagtacgtcccaggagacctggaaccggcaggacctgttagtaacgttcaaaaccgcccacgccaagaagcaggaggtcgtggtgctcggctcgcaggagggcgcgatgcacaccgccctgaccggggccaccgaaatccagacctcgggaacgaccactatcttcgccgggcacctgaaatgccgcctcaagatggataagctgaccctgaagggtatgagctatgtcatgtgcactgggtctttcaaactcgagaaggaggtggccgagactcaacatggcaccgtgctagtccaaataaaatacgaggggactgacgccccctgcaagatccccttcagcacgcaagacgagaagggggtaacccagaacggtcgtctgatcacagctaacccgatcgtttcggacaaggagaagcccgtcaacatcgaggcagagccgcccttcggggaaagctacatcgtgatcggcgccggcgagaaggcactcaagctctcctggttcaagaaggggagctctatcggaaagatgtttgaggccactgccaggggggcccgaaggatggccatcctgggcgatactgcgtgggacttcgggagcatcggaggtgtttttacctctgtcgggaagttagtgcaccagatcttcggaaccgcgtatggtgtcctgttcagcggagtctcctggacgatgaagatcgggatcggcgttcttttgacgtggctcggcctgaatagccgcagcacctcgctgagtatgacttgtattgccgtggggctggtcaccctttacctgggtgtgatggtccaggccgacagcgggtgcgtcatcaactggaaaggcagagagttaaaatgcgggagcggtatcttcgttacgaatgaggtgcacacctggacagagcagtacaagttccaggccgactcccccaagcgtttgagcgcggccatcggcaaggcctgggaggaaggggtctgcggcatccggtccgccacccgcctggagaacatcatgtggaagcagatcagcaatgagctcaaccacatactactggagaacgacatgaagttcaccgtggtggtcggggatgtggcaggaatcctcgcgcaagggaagaagatgatccggccccagcccatggagtacaagtactcctggaagtcctggggcaaggccaagatcatcggcgccgacgttcagaacacgaccttcatcatcgacggtcctaatacaccggagtgccccgacgaccagcgcgcctggaacatctgggaggtggaggattacgggttcgggatcttcaccaccaacatctggcttaaactgcgcgacagttacacccaggtgtgcgaccaccgcctcatgtcagcggccatcaaggactccaaggccgtgcatgccgacatgggctactggattgagagcgaaaagaatgaaacttggaagctagcccgggcgtcctttatcgaagtcaagacctgcatatggcccaagtcacacaccctatggtccaacggcgtgctcgagagcgaaatgattatccccaagatttatggcggtccgatttcccagcacaactaccgacctggttactttacccaggcggccggaccctggcacctgggaaagctggaattggactttgacttgtgcgagggcaccacggtggtcgtcgacgagcactgcggtaaccgggggcctagcctgcgcacgacaacagttaccggcaagataatacatgagtggtgctgcagatcctgcactttgccacccctccgcttccgcggggaggacgggtgctggtacggaatggagattagacccgtcaaggaaaaggaggagaacctggtaaagagcatggtgagcgccggctcgggcgaggtcgacagcttttccctcgggctcctttgcataagtatcatgatagaggaggtgatgcggtcccgctggtcgcggcgcatgctcatgaccggcaccctagccgtcttcttcctgctcatcatgggacagctgacctggaacgaccttatccgcctctgcatcatggtgggcgcgaacgcttcagaccggatggggatgggtacgacctacctcgccctgatggccacctttaaaatgcgcccgatgttcgcagtgggcttactttttcggcgcctgaccagccgggaggtgctcttacttacgatcgggttgtccttggtcgcttcagtcgagctgcccaattcgctcgaggagctaggggacgggctggccatggggattatgatcctcaagctgctgaccgacttccagtcgcaccagctctgggccaccctgctgtccctcactttcataaagacgaccttctcgctgcactacgcgtggaagacgatggcgatggttctgtccatagtgtcattgttccccctttgcctgtccacaacgagccagaagacaacttggctccccgttctgcttgggtccttaggctgtaagcctctgactatgttcctgatcgctgagaacaagatatggggccgccggtcttggccgctcaacgaagggatcatggccgtaggaatcgtgtctatcctgctgtccagcttactgaaaaatgatgtgcccctggcgggacccctcatcgccggcggtatgctgatagcatgctacgttatatccgggagctcagccgacctgagcttggagaaggccgccgaggtgtcctgggaagaagaggcggagcacagcggtgcctcccacaacatcctggtggaggtccaggatgacgggacgatgaaaatcaaggacgaggagcgggacgacaccctgacgatcctcctgaaggccacgctgctcgctgtgagcggagtttacccgctgtcaattcccgccacgctgttcgtctggtacttctggcagaagaaaaagcaacggagcggggtgctctgggacacgcccagcccgcccgaggtggagagagcagtcttggacgatgggatctaccggatcatgcagcgcggcctgttaggacgtagccaggtgggggtgggagtgttccaagagaatgtgttccacaccatgtggcacgtgacccgcggagcggttttaatgtaccaagggaagcggttagagccgtcctgggcttctgtgaagaaggacttaatatcctatggcggagggtggcgcctccaggggagctggaacacaggagaagaggtccaggttatagccgtggagcccggcaagaaccccaagaacgtgcagacggcccccggtacattcaaaaccccagagggcgaggtcggcgccatagccctggacttcaagcccgggacgtctggcagccccatcgtgaaccgggagggtaagatcgtgggcctgtatgggaacggggtcgttacgacctccggcacctacgtgtcggccatcgcccaggccaaggcgtcacaggaggggcccctgccggagattgaggacgaagtcttccgcaagcggaacctgaccataatggatctgcaccccgggtccggtaaaacgcgtagataccttccggccatcgtgcgagaggccattaagcgcaagctgcggacgctgatcctcgcccccacccgcgtagtcgcaagcgagatggcggaggctctgaagggcatgccgatccggtaccaaactacggccgtaaagtccgagcatacaggcaaggagatcgtggacctgatgtgccacgccacgttcacgatgagactcctgtctcccgtccgggtgccaaattacaacatgataatcatggacgaggcccactttacggatccatcaagcattgcggcccgtggatacatatccaccagggtgggcatgggggaggcagccgccatcttcatgacggcgacgccgccgggcagcgtcgaggccttcccgcagtccaacgcggtgatccaggacgaggagcgcgacatccccgagcggtcttggaactccgggtacgagtggatcacggacttccccggcaagacagtgtggttcgtccccagcatcaagtccggcaacgacattgccaactgtctgagaaagaacgggaagcgggtgattcaactcagccgcaagaccttcgacacggagtaccagaaaaccaagaacaatgactgggattacgtggtcacaaccgacatatccgagatgggcgcgaacttccgggctgacagagtgattgatcctcgccgatgcttgaagcccgtgatcttgaaggatgggcccgagagagtcatcctagccggccccatgccggtgaccgtcgcgagcgccgcgcagagaaggggacgcatcggccgcaaccacaacaaggagggagaccagtatatctacatgggccagcccctgaacaacgatgaggatcacgcccattggacggaggccaagatgctactcgataacatcaacaccccagagggcatcattcctgccttgtttgagcctgagcgggagaagtctgccgccatcgacggggagtaccgcctgcggggagaagcccgcaagacctttgtggagctcatgaggcgaggggatctgcccgtgtggctgtcctacaaagtcgccagcgaaggctttcaatattctgatcgacgctggtgcttcgacggagagcggaataatcaggtgctggaggagaacatggatgtggagatctggaccaaggagggtgagagaaagaagttacggccccgctggctggacgctagaacgtacagcgacccactcgcactgcgcgagtttaaagaattcgcggctggccggagatctgtcagcggagacctgatcctcgagatcggcaagctgccgcagcatctaacccagcgagcccagaacgccctcgacaacctggtgatgctgcacaactctgagcaaggcgggcgcgcgtacaggcatgcgatggaggaactccccgacacgatcgaaactttaatgcttctcgccctgattgccgtgctgacgggtggggtcaccctcttcttcctgtccggccgcgggctcggcaaaacctccattggcttgctgtgcgtgatggccagctccgtgttgctgtggatggcgtctgtcgagccccactggattgcggcatcaatcatcctggagttcttcctgatggtgttactgattcccgagccggaccggcagcgcactccccaggacaatcagctggcctatgtggtcatcgggctcctgttcatgatcctgactgtggcggctaacgagatggggctcctggaaacgaccaagaaggacttagggattggccacgtggccgttgaaaaccaccatcacgccgccatgctagatgtggacctgcaccccgccagcgcgtggacactgtacgcggtagccaccacgatcatcacaccaatgatgcgccataccatcgaaaacaccaccgccaacatctccctcaccgccatcgcgaatcaggcggccatcctgatggggctggacaagggctggccgatcagcaagatggatatcggtgtgcccctcctcgccctaggttgctactcccaagtgaatccgcttacgctaacggcggcagtcctgatgttggtagcccactacgccatcattggaccgggcctgcaggcaaaagcgacgcgggaggctcagaagcgcaccgccgcaggcattatgaagaatcccacggtggacgggatcgtcgctatagacctggatcccgtcgtgtacgatgcgaagttcgagaagcagctaggccaaatcatgctgctgattctctgcacaagccagatcttactgatgcggacgacctgggccctttgcgaatccatcaccctggcgacaggtcccctgacgaccctctgggaagggtccccagggaagttctggaacacgaccatagccgtgtccatggcaaacatattccgcgggagctatttagccggcgccggcctcgccttcagtctcatgaagtccctcgggggcggtcgacgcgggacgggtgcacaaggcgagaccctgggcgagaaatggaagcggcagcttaatcagcttagcaaatccgagttcaacacctacaagcgcagcggtatcatggaggtcgaccggtccgaagcgaaggagggcctgaaacgcggggagaccacgaagcacgccgtgagccgggggaccgccaagctacgctggttcgtggaacgaaacctggtcaaacccgaggggaaagtgatcgacctgggctgcggtcgcgggggctggtcctactactgcgccgggttgaagaaggtgaccgaggtcaagggctataccaagggggggcccggccacgaggagcccatcccgatggcaacgtacgggtggaacctggtgaagctgcacagtggcaaagacgtgttcttcatcccgcccgagaagtgcgataccctcctgtgcgacataggagagtccagccctaacccgaccatagaggagggccggaccctgcgtgttctgaagatggtcgagccctggctaagggggaatcagttctgtatcaagatactgaacccctacatgccatccgttgtggagacgttagagcaaatgcagcgcaagcacggaggtatgctcgttcgcaacccactctccagaaattccacccacgagatgtactgggtgtcatgcggcaccggcaacatagtctccgcggttaacatgacctctcgcatgttactcaaccggttcaccatggctcaccgcaagcctacgtacgagcgggacgtggacctgggggccggcacccgccacgtcgctgtggagcccgaggtggccaacctggacatcatcgggcagcggatcgagaatattaagcatgaacataagtccacctggcactatgacgaagacaacccctataagacttgggcgtaccacgggagctatgaagtcaagccgtccggcagcgcgagctccatggtaaacggggtcgttaagctgttgacgaagccttgggacgtgatcccgatggtcacacagatcgctatgaccgacaccacaccattcgggcagcaacgcgtattcaaggagaaggttgacacccggaccccgaaggccaagcgcggaactgcacagatcatggaggtcaccgcgaagtggctgtggggctttctcagcagaaacaagaagccacggatctgcacgcgggaggagtttacccgcaaggtccgatccaacgcggccatcggcgccgtgttcgtcgacgagaaccagtggaactcagcgaaagaggccgtggaggatgagcgcttctgggacctggtgcatagagagcgtgagctgcacaagcagggaaaatgcgcgacctgcgtttacaacatgatgggcaagagggagaagaagctcggggagttcggcaaggccaaggggtcccgcgccatttggtatatgtggctgggcgcgcggtttctagagtttgaggccctcggattcatgaatgaggatcactggttcagccgcgagaattccttaagcggcgtagaaggggagggactgcacaaattaggctacatcctgcgggacatatctaagattcccgggggcaacatgtacgcggacgataccgccggctgggacactcgcatcaccgaggacgacctgcagaacgaagcgcgcatcacagacataatggagcccgagcacgcgcttctggccaagagcatcttcaagctgacgtatcagaataaggtggtccgggtacagcgccccgctaagaacgggaccgtgatggacgtgatatcccggcgggaccagcgaggctcaggccaggttgggacctacggtctcaatactttcacaaatatggaggcgcagctcatcaggcagatggagagtgaggggatctttagcccttccgagctggagacccccaacctcgcagaacgggtactggactggctggaaaagtacggcgtcgagcgcctcaagcggatggcgatcagcggggacgattgcgttgtgaagccaatcgacgatcgcttcgcgacagctctgaccgccttaaacgacatgggcaaggtgagaaaggatatcccccaatgggagcctagtaaagggtggaacgattggcagcaggttcccttctgctcgcaccacttccaccagctcatcatgaaggatggcagagagatcgtcgttccgtgccggaaccaggatgagctggtgggtcgagcccgggtaagtcagggggcgggatggtcccttcgggagacggcttgcctcggcaaatcatatgctcagatgtggcagcttatgtacttccaccggcgcgatctgagattagcagcgaacgccatatgttccgccgttcccgtggactggatccccactagccgcaccacctggtcaatacacgcccaccaccaatggatgacgaccgaggacatgctgagcgtatggaatcgtgtctggatcgaagagaacccctggatggaggacaagacgcacatcagttcttggggcgacgtgccatatctgggaaagcgggaagatcaatggtgcggtagcctcattggtcttaccgcccgcgctacttgggccaccaacatccaggtggcaatcaaccaggtcagacgcctgatagggaacgaaaactacctcgactatatgaccagcatgaagcggttcaagaacgagtcggaccctgagggcgccctctggtag

SEQ ID NO: 24338 - RNA, 9879 nt, synthetic construct
  misc_feature 1..9879: note = derived and/or modified CDS sequence (opt11) from DENV-1__GQ199822__SS-prME
  source 1..9879: mol_type = other RNA
agcgtgaccatgcttctcatgctgatgcccaccgccctggccttccaccttaccacccgcgggggggagccccatatgatcgttaccaagcaggagcggggcaagagcctgctgtttaaaaccagcgccggggtgaacatgtgcaccctcatcgctatggacttaggcgaactgtgtgaagatactatgacctacaagtgcccccggataaccgaagccgaacccgacgacgtggattgctggtgcaacgccacggacacctgggtcacttacgggacgtgctcacagacgggcgagcacaggcgagacaagcgcagcgtggccctcgcgccgcatgtagggctggggctcgagacaaggacggagacatggatgtccagcgaaggcgcctggaagcagatacagcgggttgagacttgggccctccgccatcccgggttcaccgtcatcgccctgttcctggcgcacgccataggcaccagtatcactcagaaggggatcatcttcatcctcttaatgctggtgacgccctcgatggccatgcgttgcgtcggaatcggctcgagagacttcgtcgaggggctcagcggtgccacctgggtggacgtagtgctggagcacgggagttgcgtgaccaccatggccaaagacaaacctacgctggacatcgagcttctaaagaccgaagtcacgaacccagctgttttacggaagctctgcatcgaggccaagatcagcaacaccacaaccgattcccgctgccccacacaaggagaggccacccttatggaagagcaggacgccaattttgtgtgccggcgcacgtttgtggaccgcggctgggggaacggctgcgggctgttcggcaaggggagcctcatcacgtgcgcgaagttcaagtgcgtcaccaagctcgaaggcaagatcgtgcaatacgagaaccttaagtacagcgtcatcgtgacggtgcacaccggagaccagcaccaggtggggaatgagtcgactgagcacggaacgaccgcgaccatcactcctcaggcaccgacctctgagatccaactcacggactacggtgcactaaccctggactgctcgccccgcacaggactcgacttcaacgagatggtactgctaacaatgaaggagaagtcctggttggtacacaagcagtggttcctggacttgcccctcccctggactagcggggccagcacctcccaggaaacgtggaacagacaggacctgttggtgacctttaaaacagcccacgctaagaagcaggaggttgtggtattgggcagccaagagggcgccatgcacaccgccctgacgggagccaccgagatccagacttccgggacaacgaccattttcgctgggcatctgaagtgccgcctcaaaatggacaagctgaccttaaagggcatgtcttacgtgatgtgcactggatccttcaagctagagaaggaggtagcggaaacgcagcatggcaccgtgctggtccagatcaagtacgagggcaccgacgccccgtgcaagatccccttttcaactcaggatgagaagggcgtgacgcagaacggccggctgatcacggccaacccgatcgtaaccgacaaggagaaacctgtcaacatcgaggcggagccgccctttggtgaatcctacatcgtcatcggagcaggagaaaaggccctgaagctctcgtggttcaaaaagggatcctctatcggcaagatgttcgaggctacagcccgcggggctcggcgcatggcaattcttggggacaccgcctgggacttcgggtccgtgggcggggtgttcacctctgtcgggaagttggtacaccagatcttcggcaccgcctacggtgtgctcttctcgggcgtttcgtggaccatgaaaatcggtatcggtgtattgctgacttggctcggcctgaactccaggtcaacctcccttagcatgacctgtatcgccgtggggctagtcacgctgtacctgggcgtcatggtgcaggccgactccgggtgcgtaatcaactggaagggcagagagctcaagtgtggaagcggcatttttgtaaccaatgaggttcatacttggaccgagcagtacaagttccaggcagactcacccaagcgactgtccgcagctataggcaaggcctgggaggagggggtatgtggaatccggagcgcgactcgcctggagaacatcatgtggaagcagatttctaacgagctcaaccacatcctgctggagaatgatatgaaattcaccgtagtggttggcgatgtggtgggcatattggcgcagggaaagaagatgatcagaccccagcccatggaacacaagtatagttggaaatcctggggccgcgccaagatcatcggcgccgacgtgcagaacacgacctttatcattgatggccccaacaccccggagtgccccgacgaccaacgggcctggaacatttgggaggtagaggactacggttttgggatcttcacaacgaatatctggctgaaactgcgcgacagctacacccaggtgtgcgaccatagactcatgtccgctgcgataaaggacagcaaggccgtccacgccgacatgggctactggatcgagtccgaaaagaatgagacttggaagttggcccgcgcgagtttcatcgaggtgaaaacctgcatctggcccaagtcgcatacgctttggagtaacggggttctcgaatccgaaatgatcatcccaaagatatacgggggcccgatctcccagcacaattatcggcccggctacttcacccagacagcgggcccctggcacttagggaagctggagttagacttcgacctatgtgagggcaccactgtcgtggtggacgagcactgcggaaatcgcggcccctcgctacggaccaccactgtcacgggcaaaatcatacacgagtggtgctgccgcagctgcaccctgccgcccctcaggtttaagggggaggacggatgctggtatgggatggagatccgccccgttaaggagaaggaggagaacctcgtaaagagtatggtcagcgccgggagcggtgaggtggacagctttagcctcggactgctatgcatctctatcatgatcgaggaggtgatgcggagccgctggtcgcggaaaatgctcatgaccggcaccctggcagttttcttactcctcatcatgggacagctaacttggaacgatctgatacgtctgtgcataatggtgggagccaacgcgtctgatcgcatggggatgggcacgacctacctcgcgctgatggcgaccttcaagatgagaccgatgttcgccgtgggcctcttattccgccggctcacgtcccgagaggtcctgttgctcaccatcgggctgtccttagtggcgtcggtcgagcttcccaactccttggaagagctaggcgatgggctcgcgatgggtatcatgatcctgaagctattaaccgacttccagtcccaccaactgtgggccacgctgctctcactgacgttcatcaagaccactctgtcccttcactacgcctggaagaccatggctatggtgctaagtatcgtatccctcttccccctctgtctaagcacgacgtcccagaagaccacctggttacccgtgctgctggggagcttgggctgcaagccactcacgatgttcctgatcaccgagaacaaaatctgggggcgtaagtcctggcccttaaacgaggggatcatggctgtgggcgtggtttccattctcttatcctcgctgctcaagaacgacgttcccttagccgggcccctgattgcaggcggcatgctcatagcgtgttatgtcatcagcgggtccagcgcggacctgagcctagaaaaagcggctgaggtcagctgggaggaagaggccgagcacagcggcgccagccacaacatactcgtagaggtgcaagacgacggcaccatgaaaatcaaagacgaggagagagacgacaccctgacaatcctgctcaaggcgacactgctggcggtctccggcgtgtacccgctctcaattccagccacccttttcgtctggtacttctggcaaaagaagaagcaacgaagcggggtcctgtgggatacccccagcccgcctgaggtggagcgcgccgtgctggacgacgggatctatcgaatcatgcagcgcggcctgctggggaggtctcaggtcggtgttggggttttccaggagaacgtcttccacaccatgtggcacgtgacccgcggcgccgttctgatgtaccaggggaaaaggctcgagcccagctgggcctctgtcaagaaggacctgatctcttacggcggcggctggcgcctgcagggctcatggaacaccggggaagaagtccaggtgatcgcggtcgagccgggcaagaatcctaagaacgtccaaactgccccagggaccttcaagacgcccgaaggtgaggtcggagccatcgctctcgacttcaagccggggaccagcggctcgcccatcgtcaaccgcgaaggtaagattgtgggtctgtatggcaacggggtggtcacaacctcgggcacgtacgttagcgcgattgcgcaggccaaggcctctcaggagggcccgctgccagaaatagaagacgaggtgttccgcaagcggaatctcacaataatggacctacacccgggctcggggaagaccagacggtatctgccggccctcgttcgagaagcgataaagcgcaagctgcgcaccctcatcctggcccctacgcgtgtggttgcatccgagatggccgaggccttaaagggcatgcctatccggtaccagacaaccgcggttaagagcgagcatactggcaaggagatcgtggacctgatgtgccacgcgacattcaccatgcgcttactgagtccagtaagggtcccgaactacaacatgatcatcatggacgaggctcacttcaccgatcccagctctatcgccgccagaggctatatcagcacccgggtaggaatgggcgaggcggcagcaatcttcatgacggccaccccgcccgggtccgtggaggcgttcccgcagtccaacgcggtcattcaagacgaggaacgcgacatccccgagcgttcctggaatagcgggtatgagtggatcaccgacttccctggcaagaccgtgtggttcgttcccagtatcaagagcggaaacgatattgccaattgcctgcgtaagaacggaaagcgggtaatccagctctcccgcaagacgttcgacaccgagtaccagaagaccaagaacaatgactgggactacgtagtcaccacggacatcagcgagatgggcgccaacttccgagctgaccgcgtcatcgaccctagacggtgcttgaagccagtgatcctcaaggatggtcccgagcgggtcatcctcgcgggccccatgccggtgactgtcgcgtccgccgcccagaggcgggggcgcatcggccgaaaccacaacaaggagggcgatcagtacatctatatgggtcagcccctgaacaacgacgaggaccacgcccactggaccgaggcaaagatgctgctcgacaacatcaacacccctgagggcatcataccagccctgttcgagccagaaagagagaagtcagccgccatcgacggagagtataggctgcggggcgaggctcgaaagacgttcgtcgagcttatgcggcgcggggacttgcccgtgtggttgtcctacaaggtggcatctgagggcttccagtacagcgaccggcgctggtgcttcgacggcgagcggaacaaccaggtgctcgaggagaacatggacgtggaaatctggaccaaagagggggagcgcaagaagctgcgacccagatggctggacgcgagaacctactccgaccccctcgccctacgtgagtttaaggagttcgccgcgggccggcgcagcgtctccggtgaccttatcctcgagatcggtaaattgccgcagcacttgacccaacgggcacagaacgccctcgacaacttagtcatgctgcacaacagcgaacaaggcgggagagcttaccggcatgccatggaagagctccccgacacgatcgagactctgatgctgcttgcactgatcgccgtgctgaccggcggggtcacgctcttcttcctgtctggccgagggcttggcaagaccagcatcggccttctgtgcgtcatggcgtccagcgtgctgctttggatggcctccgtggagcctcactggatcgccgcgtcgatcatactcgagttttttctgatggtactcctgatccccgagccggaccgccagaggactccccaagacaaccagctggcctacgtggttatcgggctcctgtttatgatcttaacagtagccgcgaacgagatgggattactagagaccaccaagaaggacctcggcattggccacgtggccgttgagaaccatcaccacgcgacgatgctcgacgttgacctgcatcccgcctccgcctggactctgtacgccgtggctaccactattatcacgccgatgatgcggcataccatcgagaacaccacggccaacatcagcctcacggcgattgccaaccaggccgcaatcctgatggggcttgacaagggctggcccatctccaagatggacatcggcgtgccacttttagcactggggtgttacagccaggtcaaccctctcaccctgaccgctgccgtgctcatgctcgtggcccactacgcaattattggcccggggctgcaagcaaaagccacacgcgaggcacaaaagcgcaccgccgctggcatcatgaagaaccccaccgtcgacgggattgtggccattgacctggaccccgtggtctatgacgccaagttcgagaagcagctcggccagatcatgctgctgatcctctgcacctcccaaatcctcctgatgcggacgacgtgggccctatgtgaaagcatcaccctggctacgggccccctgaccacgctctgggaaggttccccaggaaagttctggaacaccactatagccgtaagcatggccaacatcttccgcggatcctacctggcaggggctggtctggcctttagcctcatgaaatccctcggtggcggtcggcgagggacaggagcgcagggcgagacgctgggcgagaagtggaaacggcagctaaatcagttgtcaaaaagcgagttcaacatatacaaaagaagcgggatcatggaggtggaccgaagtgaagccaaggagggcttaaagcgcggagagacgacccgacacgcggtctcccgcggcaccgccaagctgcggtggtttgtagagcgcaatctcgtgaagcccgaagggaaggtcatcgacctgggctgcggcaggggcgggtggagctactactgtgccggattaaagaaggtgacggaggtaaaaggatacaccaaaggcggaccgggacacgaggaacccatcccgatggccacctatgggtggaatttggtcaaacttcactcgggcaaggacgtgttcttcactccccccgagaaatgcgacactctgctctgcgacattggggagagctcgcctaacccaaccatcgaagagggccgcaccctgagggtgctgaagatggttgagccctggttaagagggaaccagttctgcatcaagatactcaacccgtacatgcccagcgtggtggagaccctagagcagatgcagcgaaagcacggcggaatgctcgtccgcaacccgctgtcccggaacagtacacacgaaatgtattgggtgtcctgcgggacaggcaacatcgtgagcgccgtcaacatgacctcgcgcatgctgctgaaccgctttaccatggcacaccggaagcccacgtacgagcgcgacgtagacctaggggccggaacgcgccacgttgcggtggaacccgaggtggccaacctggacatcattggccagcgcatcgagaacatcaagcacgagcataagagcacgtggcattacgacgaagacaacccctacaaaacctgggcttaccatggttcctatgaggttaagccgagtggcagcgctagttcaatggtgaatggggttgtcaagctcctgaccaagccgtgggacgtgatacccatggtgacgcagatcgccatgaccgataccaccccctttggtcagcagcgggtcttcaaagagaaagtagacacgagaactccaaaggcgaagcgggggaccgcacagatcatggaagtgaccgcccgctggctgtggggtttcctcagcaggaataagaagccccggatctgcactcgggaggaattcactcgcaaggttcgaagcaacgccgccataggggcggtgttcgtcgacgagaaccagtggaactcagccaaggaggccgtcgaagacgagcgcttttgggacctggttcagaaagagcgggaactacataaacaaggcaaatgcgcgacctgcgtgtacaacatgatgggcaagcgcgagaaaaagctcggggagttcggaaaagcgaaggggagccgagccatctggtacatgtggctgggagcccgattcctggagttcgaggccctcggcttcatgaacgaagaccattggttctcccgggagaacagcctgtccggggtcgaaggcgagggattgcacaagttgggttacatcctgcgcgacatcagcaaaatccccggcggcaacatgtatgccgatgacaccgcgggatgggacacgcggataaccgaggacgacctgcagaacgaggcaaagattaccgatatcatggagccggaacacgcactgctggccacctctatttttaagctgacctaccagaacaaagtggtgcgcgtccagcgacctgcaaaaaacggaaccgtgatggatgtgattagccggagagaccaacggggctccgggcaggtcggaacatatggcctcaacacgttcacgaacatggaggcgcaactgatccgccagatggagagcgaggggatcttcctgccctccgagctggagacccccaatctggcggagcgggtgctggattggctcgagaagtacggcgtggagcgcctgaagcgtatggcgatcagcggggacgactgcgtcgtgaagccgattgacgacagatttgccaccgccctgaccgccctcaacgacatgggcaaggtgcggaaggatatcccccagtgggagcccagtaagggatggaacgattggcaacaggtccccttctgctcccaccatttccaccagctaataatgaaagacggccgcgagattgtagtcccgtgccggaaccaggacgagttagtgggcagggccagagtgtcccagggggctggctggtctctccgcgagacggcctgtctgggcaagagttacgcccagatgtggcagctgatgtacttccatcggagagatctccggctggcagcgaatgccatctgctccgccgtgcccgtcgactgggtgccgacgtcgcgcaccacttggtccatccacgcgcaccaccaatggatgacgaccgaagatatgctgagcgtgtggaacagggtctggatcgaggaaaacccttggatggaggacaagacccatgtgtcctcgtggggcgacgtgccttacctcgggaagcgagaggatcagtggtgcggatccttaatcggcctgaccgcccgcgcaacctgggccagcaacatccaggttgccatcaaccaagtgcgacgcctcatagggaacgagaactacttagattacatgacgtccatgaagcggttcaagaacgagggcgaccccgaaggggcgctgtggtag

SEQ ID NO: 24339 - RNA, 9879 nt, synthetic construct
  misc_feature 1..9879: note = derived and/or modified CDS sequence (opt11) from DENV-1__FJ882557__SS-prME
  source 1..9879: mol_type = other RNA
tctgtaactatgctactaatgctaatgcccaccgcgctagctttccacctaacgacaagagggggcgaaccccatatgatagtcagtaaacaagagcgtggaaaaagccttctattcaaaacttcagccggtgtaaacatgtgcacccttatcgcaatggacctaggggagttatgcgaggatacaatgacgtacaaatgtccgcgtattacggaggcagagcccgacgatgtcgactgctggtgcaacgctaccgacacttgggtaacgtacgggacttgctcacaaaccggagaacaccggagggacaaaagaagtgtggcattagctccacacgtcggactcggcctcgaaacccgtaccgagacgtggatgagcagtgagggggcttggaagcagatacagcgagtagagacctgggcgctccggcaccccgggttcacagtgatcgcactatttctcgcccacgcaatcggaacgtcaatcacccagaagggtataatattcatcttgctgatgctagttacaccaagcatggcgatgagatgcgttggcataggaagtcgagacttcgttgaagggctgtcaggtgcaacttgggtcgacgtagtcctagaacacggcagttgcgtaacaacaatggcgaaggacaaacccaccctagacatcgagctgttaaaaaccgaagtgacgaaccctgcggtcttacgcaagctatgcattgaggcaaagatcagtaacactaccaccgatagcagatgcccaacccaaggcgaagccaccttagtagaggaacaggacgcgaactttgtttgcagacgaaccttcgtagacagaggatggggaaacggctgcgggctctttggaaaaggcagcctgataacctgcgccaaatttaaatgcgtcaccaaacttgaaggcaagatagtccaatacgaaaacctcaaatacagcgttatcgtcaccgtccacactggagaccagcaccaagtaggtaacgagtcgacagaacacggaacgaccgcgacaataacaccccaggcaccaactaccgaaatccagctaacggattatggggccttaaccttagattgctcgccaaggacaggattggatttcaacgaaatggtcttactcaccatgaaagaaaaatcatggctggtccataaacaatggttcctggacctgcccctaccctggacgtccggagcgagtacctcgcaagagacgtggaatcgacaggatctactggttaccttcaagacagcgcatgccaagaaacaagaagtagtggttcttggttcgcaggagggcgccatgcacacggcccttacaggcgcaaccgaaatacaaacgtctggtaccacaaccatattcgcaggacatctgaaatgccgcttaaagatggacaagctaactctgaaaggcatgtcgtacgtgatgtgtactgggagctttaaactcgaaaaagaggtggcagagacacaacacgggacagtactcgtccaaatcaaatacgagggcaccgacgcgccgtgtaagataccattctcaacgcaagacgaaaaaggcgtcacccaaaacggcagactcatcacggccaaccctatcgtgaccgataaagaaaagccagtaaatatcgaggcggaacccccattcggcgagtcctatattgtcataggcgcaggagaaaaagccttgaagctaagctggtttaagaaagggtcttccataggcaaaatgttcgaagccacagcccgcggggcacgacgcatggcgatacttggggatacggcctgggacttcggaagcatcggaggagtgttcacatcggttgggaagctgattcaccagatatttgggacggcatacggggtgctgtttagcggtgtaagctggacgatgaaaataggaatcggtgtgctcctgacctggctaggcctcaattcgaggagtacaagtttatccatgacctgcatagccgtgggacttgtaacgttatatttgggagtaatggtacaagcggatagcggatgcgttataaattggaaaggaagggaactcaaatgcggtagcggaatcttcgtgacaaacgaagtacacacctggaccgagcaatataaattccaagcagactcaccgaagcgcctatccgcggcaattggaaaagcgtgggaggaaggagtatgcggaatacgatccgccacacgtctcgaaaacataatgtggaagcaaataagtaacgaattaaaccacatccttctcgaaaatgacatgaagctaacagtagtagtcggagacgtcgcaggcattctcgggcaagggaaaaagatgatacgtcctcagcccatggagtataaatactcgtggaagtcatggggaaaggcaaaaatcatcggggctgatgcgcagaacaccaccttcataatcgacggccccaacacgccagaatgccccgacgaccagcgggcttggaacatatgggaagtcgaggactatgggttcgggatctttactacaaatatctggttaaaactacgtgacagctatacacaagtctgtgaccaccgcctcatgtcagcagctataaaagactccaaagcggttcacgccgacatgggctactggatcgaatcagaaaagaatgagacatggaagctggctcgagccagcttcatagaagtaaaaacatgcatctggccgaaaagtcatacactatggtcaaacggagttctggaaagcgagatgatcatccccaaaatatacggcggacccatctcacaacacaactatagaccaggttacttcacccaaaccgccggcccctggcacctcggcaaattggaacttgatttcgacctctgtgagggaacaaccgtcgtggtagacgaacattgcggaaaccggggcccaagcctcagaaccacgacggtcacgggaaagattatacacgagtggtgctgccgtagctgcacccttccacccctacggttccgaggagaggacggctgttggtacggcatggaaatccggccggttaaagagaaagaagagaacctcgtaaaaagcatggtttcagctggctccggtgaggtagatagcttcagtttagggttattatgcatatcgataatgatcgaagaggtcatgcgcagcagatggtcgaggaaaatgctcatgacaggcaccctcgctgtctttttcttactaataatgggacagctgacctggaacgatctcattcgcctttgcatcatggttggggcaaacgcctttgaccgcatgggcatgggaaccacctaccttgccctcatggcgaccttcaaaatgcgcccgatgttcgccgtgggactactattcagacggctaactagccgcgaagtacttttacttacaatagggctgagcctggtcgcgtcggtggaacttcctaacagcctggaggagctcggagatggcctagccatggggattatgatcctgaagctactcactgacttccaaagccatcaactatgggcgaccctactctccttaacctttataaagacgacgtttagtttacactacgcatggaagacaatggcaatggtactgagcatagtgtcacttttcccgctatgccttagcacaacatcccagaaaaccacgtggctccccgtgcttctcggaagcctaggctgcaagccactaaccatgttccttatagcagagaacaaaatctggggaaggaagtcttggccattgaacgaaggcatcatggcggtcggcatcgtgtccattctgctatcttctctgctgaagaacgacgtccccctagcagggccactaatcgccggcggcatgcttatcgcatgctatgtcatctcagggagctctgcggacctatcactagagaaagccgccgaggtctcatgggaggaggaggcagagcatagcggagcaagtcacaacatcctagtagaagtccaggatgatggaaccatgaaaataaaagacgaagagagggacgacactctgaccatactcctaaaagcaaccctgttggctgtctctggcgtttaccccctgtctataccggccacactattcgtgtggtacttttggcagaagaagaaacaaagatctggcgtcctttgggacactccttcaccgccagaagtggaaagagccgtactcgacgacggaatctacaggataatgcaaagagggctccttggacggagtcaagtaggagtcggagtctttcaggaaaacgtcttccatacaatgtggcacgtaacacggggcgccgtactaatgtatcaaggaaaacgactagagccatcatgggccagcgtgaagaaagacctaatttcgtatggcgggggctggcgactcagaggtagctggaacactggtgaggaggtgcaagtgatcgccgtggagccgggcaaaaatcccaagaacgtacaaacagctcccggcactttcaaaacccccgagggcgaagttggagctatagcactcgacttcaaaccagggacatccggaagcccaatcgtgaaccgtgaaggcaaaatagtagggctatacggtaacggtgtcgtcaccacttccgggacgtatgtttcagcaatcgcacaagccaaagccagtcaagaaggtcccctaccagaaatcgaggatgaagttttcagaaaaaggaacctaaccataatggacctacaccctggcagcggcaaaacaaggagatatctgccagccatagtgagggaggctatcaagcgaaaactccggacactcattcttgccccaactcgggtagtagcaagtgaaatggcggaagcgctaaagggtatgcccataaggtaccaaactaccgccgtcaagtccgaacacaccggaaaagaaatagtggatcttatgtgtcacgcaacattcacgatgcgcctcctgagtccagtccgggtaccgaactataacatgataatcatggacgaagctcatttcacagacccctcgagtatcgcagcaagaggatacatatccactagagtgggcatgggtgaagccgcggcaatcttcatgacggccacgccgcccggctcagtcgaagcattcccacagagcaacgcggtgatccaggatgaggaacgcgacatacctgaacgttcgtggaactccggacacgaatggataacagactttccgggaaaaactgtatggttcgtcccgtcgatcaagagcgggaacgatatagctaactgcctccgcaaaaacggtaagcgagtaatccagctcagcagaaaaacgttcgacactgagtaccagaaaacaaagaataacgactgggactacgtagtaaccaccgacatctctgaaatgggggcgaacttcagagcagatcgggtcatcgacccccgacgatgtttaaagccagtaattttaaaggatgggccagaaagggtaattctagccggtcccatgccggtaacggtagcctcggcggcccagcgtcgggggagaataggccgaaaccacaacaaagaaggagaccagtacatatacatgggccaacccttaaacaacgatgaagaccacgctcactggaccgaggcaaagatgctcttggacaacatcaacaccccagagggtataatcccagcattattcgaaccggaaagggaaaagtcggccgcagtcgacggcgagtatcggttaagaggcgaggcacgtaagacgttcgtggaactgatgaggagaggcgacctacctgtctggctctcatacaaagtagcctcagaaggttttcaatatagcgacaggcgttggtgcttcgacggggaaagaaacaaccaagtactggaagagaacatggatgttgagatctggaccaaagaaggggaaagaaagaaactgcgaccacggtggctagacgcaaggacctactccgaccccctcgcactacgagagttcaaagagttcgccgcaggccggcgctctgtctcgggggacctaatcctagaaatcgggaaactgccgcaacacctgacgcagcgagcccaaaacgccctggataacttagtgatgctccacaacagtgagcagggagggagggcataccgccatgctatggaagaactaccagacacaatcgagacactaatgctactggccctgatagcagttctcacaggtggcgttacactattcttcttgtcggggagaggcttaggtaaaacaagcatcggacttctgtgcgtcatggctagttcagtactcctatggatggcgtcggtagagccccactggatagcagcatcgatcatcctcgaatttttcttaatggtactactcatcccagaaccggaccggcaacgcactccacaagataatcaacttgcttatgttgtaatcggtctacttttcatgatattaacggtggcagccaatgaaatggggcttctggagacgacaaagaaggacctaggtattgggcacgtagcagtcgaaaatcaccaccacgcggcgatgcttgacgtcgacctacacccggcgagtgcctggaccctttacgccgtagcaaccaccataattacgcccatgatgcgacacacgatagaaaacaccactgcaaatatctccctgacagcaatcgcgaaccaagcagccatactcatgggcctagacaaagggtggcccataagtaaaatggatataggcgtcccactgttagcactagggtgttactcgcaagtaaaccccctaactatgacggcagcagtattaatgctcgtcgcacactacgccatcatcggacccggattacaagctaaagccacaagagaagctcagaaaagaacagcagcgggtataatgaagaacccaaccgttgacggaatagtcgcgattgacctcgacccagtcgtctacgacgccaaattcgagaagcaactaggccaaatcatgctactcatcctatgcacttcacagatcctactcatgcgaaccacatgggctctgtgtgagagcatcacactagcaaccgggcctctcacaacactgtgggaagggtcacccggaaaattctggaatacgacaattgccgtatctatggcaaacattttccgagggtcatacttagctggcgccgggcttgcgttcagcctcatgaaatccctaggagggggcagacgcggcacgggcgcccagggcgaaacattgggagaaaaatggaagcgacagcttaaccaactatctaaaagtgagtttaatacttacaaaagatcagggataatggaagtagatcgcagtgaggcaaaagaaggcctgaaaagaggggagacgacaaaacatgccgtatcccgcggaacggcgaaactacgctggttcgtcgaacggaacctcgtcaagccagagggtaaggtcatagacctcggctgtgggcgaggagggtggtcatactactgcgcgggactcaagaaagtcacagaagtaaaaggctacactaagggcggccccggtcacgaagaaccgataccaatggcgacatacggttggaacctagtcaaactccattcaggcaaagatgtcttcttcataccacccgaaaagtgtgacactcttttatgtgacatcggggagtcaagtccaaacccaacgatcgaggagggccgaaccctgagagtcctcaagatggtggaaccctggttaagaggaaaccaattctgtatcaagatattgaacccatacatgccgagcgtcgtagaaaccttggaacaaatgcagcgcaaacacggagggatgctcgtacgcaacccgctatcccgaaactcaacgcatgaaatgtattgggtcagctgcgggactggcaacatcgtgtcagccgtcaacatgacatcgcggatgctactgaacagattcacaatggcccaccggaagcccacatatgagcgggacgttgacctcggaacgggtacccggcacgtagcagtcgaaccagaggtcgcaaacctcgacattataggacagcggatagaaaacatcaagcacgaacacaaatctacatggcactacgacgaagacaacccatacaagacctgggcataccatggcagctatgaagttaaacccagtggatcagcgagctcaatggtaaatggcgtggtaaaactcctgactaagccgtgggacgtcatacccatggtaacacaaatcgcgatgaccgacacgacccctttcgggcagcaacgggtcttcaaagaaaaagtcgatacgcgcacccctaaggccaaaaggggcaccgcacaaatcatggaagtcacggcgcgctggctatggggatttttaagcagaaacaagaaaccgcggatctgcaccagggaggagttcactcggaaagtacgctcgaacgccgcgataggagccgtgttcgtagacgaaaatcagtggaacagcgcgaaagaagcggtagaggacgaaaggttctgggacctcgtgcatcgcgaacgcgaactccataaacagggcaaatgcgcgacctgcgtatacaacatgatgggtaagcgggagaagaagctcggtgaatttggcaaagctaaggggtcacgcgccatctggtacatgtggctcggagcgcgtttcctagagttcgaagcactcggcttcatgaacgaagatcactggttcagccgcgaaaactccctcagcggagttgaaggcgaggggctccataaactagggtatatcctaagagacatatccaaaataccaggcgggaacatgtatgcggacgacaccgcaggatgggataccagaatcacagaagatgaccttcaaaacgaagccaaaatcacagacataatggaacctgaacacgcactgctggccaaagcgatattcaagctcacgtatcaaaacaaggtcgttagagtgcagcggcctgcgaaaaacggaacagtcatggacgtcatctcgagacgggaccaaagaggctcaggtcaagtcgggacgtacggactcaacactttcacgaacatggaagcacaactcattcgtcaaatggaatcggagggaatcttttctccatctgagctagagacgccaaatcttgcagaaagagcgttagattggcttgagaaatacggcgtagaaagactcaaaagaatggcgatctccggagacgattgcgtcgtcaaaccgattgacgaccgattcgcaacggcactaacagcgcttaacgacatgggtaaagtccgcaaagacatcccacaatgggagcccagcaagggatggaatgactggcaacaggtccctttctgtagccatcacttccaccagctaataatgaaagacggccgagagatagtggtaccgtgtagaaatcaagacgagctcgttgggcgagcaagggtcagtcaaggggctggttggagcctgagggaaacagcatgtctggggaagtcatatgcacagatgtggcagctcatgtatttccacaggcgcgatctccgcctagcagcaaacgcaatctgctccgccgtacctgtcgattgggtcccaacatcacgtacgacctggtcaatccatgcacaccatcaatggatgaccacagaagacatgctctccgtctggaacagagtctggattgaggaaaacccctggatggaggacaaaacgcatatatcatcatgggaagacgtcccatacctagggaaacgtgaggatcagtggtgcggcagcttaatagggctaacggcacgcgccacctgggccacgaatatccaggtagctataaaccaagtccgccgactcataggcaacgagaactatctagactacatgacctccatgaagaggtttaaaaatgaatcggaccccgagggagcgctgtggtga

SEQ ID NO: 24340 - RNA, 9879 nt, synthetic construct
  misc_feature 1..9879: note = derived and/or modified CDS sequence (opt11) from DENV-1__FJ882558__SS-prME
  source 1..9879: mol_type = other RNA
agcgtgaccatgctgctcatgctgatgcccaccgctctggctttccacctcacgacccggggcggggagccccacatgatcgtgagcaagcaggagcggggcaagagcctgctgttcaagaccagtgccggggtgaacatgtgcacactcatcgccatggacctgggcgagttctgcgaggacaccatgacctataaatgtccccgcataaccgaagccgaaccagatgacgtggactgctggtgcaacgccacggacacctgggtcacctacggtacctgctctcagaccggcgagcaccggcgggacaagcggtccgtggcgttggcgccccacgttgggctcgggcttgagactcgcaccgagacatggatgagctccgagggagcctggaagcagatccagcgggtggagacttgggccctgcgccaccccggctttacagtgatcgccctcttcctggcacatgccatcggcacgtctatcacgcagaaagggatcatcttcatcctgctcatgttagtgaccccgtccatggccatgcgttgcgtcggcatcggcagccgcgacttcgtggaggggctgtccggcgccacgtgggtggacgttgtgctggagcacgggtcgtgcgtcaccacgatggccaaggacaagcccaccctggacatcgagttactaaagacagaggtcaccaaccctgcggtgctgcggaagttgtgcatagaggcaaagatctctaacaccacgacagactcacgctgcccgacccagggggaggccaccctggtggaggagcaggacgccaacttcgtctgccggcgtaccttcgtggaccgtggctggggaaacggctgcgggctgttcgggaaggggtccctgatcacgtgcgctaagttcaagtgcgtaaccaaactcgagggcaagactgtccaatacgagaacctgaagtacagcgtgatcgtgaccgttcatacaggtgaccagcaccaagtggggaacgagtccaccgagcatggcaccaccgcgaccatcacgccccaggccccaagcaccgagatccaattaaccgactacggggccctcaccctggactgctcaccccgcaccggactggacttcaacgagatggtgctgctgaccatgaaggagaagtcctggctggtgcacaagcaatggttcctcgacttgccactgccatggacaagcggggcctccacatcacaagagacgtggaacagaaaagacctgctagtgaccttcaagaccgcccatgcgaagaaacaggaggttgtggtgctgggctcccaggagggcgccatgcacacggccctcacgggggcaaccgaaatccagaccagcggtaccaccactattttcgccgggcacctaaagtgccgcctgaaaatggacaaattgacattgaagggcatgagctacgtcatgtgcaccgggagcttcaagcttgagaaggaagtggcggagacgcagcacgggacagtgttagtccaaatcaagtacgagggaaccgacgccccctgcaagatccctttctccacccaggatgaaaagggggtgacgcagaatggccggttgatcaccgccaacccgatcgttaccgacaaagagaagcccgttaacattgaggccgagccaccctttggagagagctacatagtcataggcgctggcgagaaggcgctaaaactgtcctggttcaaaaaggggagctcaatcggcaagatgttcgaggccaccgcccgcggggcccggcgcatggcgatcctcggcgacacggcctgggacttcgggtctatcgggggcgtgttcacctccgtcggtaagctggtacaccagatttttggcaccgcctacggggtgctttttagcggcgtctcgtggacgatgaagatcgggatcggcgtgctcctgacgtggctgggcctcaatagccgctccaccagcctgtcaatgacatgcatcgccgtcgggctggtcaccttgtacctgggcgtcatggtgcaggccgatagcggatgcgtgataaactggaagggccgggagctgaagtgtggtagcggcatattcgtgacaaacgaggtgcacacctggacggagcaatacaagttccaggccgactcccccaagcgcctcagcgccgcaattggcaaggcctgggaggagggggtctgcggcatccgatccgccacccgcctcgagaacataatgtggaagcaaatcagcaacgagctcaaccacatactgctggagaacgacatgaaattcaccgtggtcgtcggggacgtagcgggcatcctggcccaggggaagaagatgatccggccccaacccatggaatacaagtattcctggaagagttggggcaaggcgaagattattggcgccgacgtgcagaatacgaccttcatcatcgacgggcccaacacccctgagtgccccgacgaccagcgtgcgtggaatatctgggaagtcgaagactacggcttcgggatcttcacaacgaacatttggcttaagctacgggactcatacacccaggtgtgcgaccaccgcctgatgagcgcggccatcaaggattccaaggccgttcacgccgacatgggctattggatcgagagcgagaagaacgaaacctggaagctcgcgagggcctcctttatcgaggtcaaaacctgcatttggcccaaatcccacacgctgtggtccaacggcgtgctagagagcgagatgatcatccccaaaatctacggaggccctatctcccagcacaactaccgccccggatatttcacccagaccgccggcccctggcatctcgggaagctagagctggactttgacctctgtgagggcaccactgtggtcgtggacgaacactgcggcaaccgcgggccgagtctgcgtaccaccaccgtgacgggcaagatcatccacgaatggtgctgcaggtcctgcaccctgccaccattacgcttcaagggtgaggacggctgttggtacgggatggagattcggccagtcaaagagaaagaggagaacctggtgaagtcaatggtgagtgccggctccggcgaggtcgacagcttcagtttagggctcctgtgcatttccatcatgatcgaagaagtcatgcggtcacgctggagcagaaagatgctaatgaccggcaccctcgcagtgttcttcctgctgatcatgggacaactcacgtggaacgacctgatcagactatgtattatggtcggcgcaaatgcctccgatcgaatgggtatgggcaccacctacctcgccctgatggccacctttaagatgcgcccaatgttcgccgtcggtctcctgtttcggcgtcttacgagccgggaggtgctgctcctgaccatcgggctgtccttagtcgcgagcgtcgagctgcccaattcgctggaggagctcggcgacggtctcgccatgggtattatgatactgaagctcctgacggacttccagagccaccagctgtgggccactttgctgtcccttacgttcatcaagaccaccttctccctccactacgcttggaagaccatggcgatggtgctgtccatcgtgagcctgttccctctgtgtctgtccacgaccagccagaagaccacatggctgcccgttctcctgggctccctggggtgcaagccgctcacgatgttcctcatcgccgagaacaagatatggggccgtaagagctggcccctgaacgaggggataatggccgtcggcatcgtgagcatactcctatccagcctgctcaaaaacgacgtgcccctggcgggtcccctgattgcaggaggcatgctaatcgcgtgctacgtcatctcggggtctagtgccgacttaagcctggagaaggccgcggaggtctcctgggaggaggaagccgagcacagcggcgcgtcccacaatatcctcgtggaggttcaggacgacgggactatgaagattaaggacgaggagcgggacgataccctgaccatcctgctcaaggccaccctgctcacagtgagcggggtgtacccgctcagtatccctgccacgctgttcgtctggtacttttggcagaagaaaaagcagcggagcggggtgctgtgggacaccccaagcccgcccaaggtagagcgcgccgtcctcgacgatggcatctaccgcatcatgcagcgggggctgctgggccgcagccaggtgggggtgggggtctttcaagagaacgtgttccacaccatgtggcacgtgacgcgtggcgccgtccttatgtaccagggtaagcgtctagagccctcctgggcgagcgtgaaaaaggacctgatctcctatggcggtggatggcggttgcaaggcagctggaacaccggggaggaggtccaggtgatagccgtggaacccggtaaaaaccccaagaatgtgcagaccgcccctgggaccttcaagacttccgagggtgaggtcggcgccatcgccttggacttcaaacccggaacgagcggctctcccatagtgaatcgcgaagggaagattgttggcctgtacggcaacggggtcgtgaccacgtccggcacgtatgtcagcgcaatcgcccaggccaaggcctcccaggaggggcccctgccagagatagaggacgaggtcttccggaagcgcaatttaaccatcatggatctgcacccgggcagcggtaagaccagacggtacctgcccgcgatcgtgcgagaggccatcaagagaaagcttcggaccctgatcctggcgccgacgcgcgtggtcgcctcagagatggccgaagcgctcaagggcatgcccatccgctaccagacaacagccgttaagtcagagcacaccggcaaggagatcgtcgatctgatgtgccacgccacgttcaccatgaggcttctctccccggtccgcgtccccaactataacatgatcatcatggacgaggcccacttcactgaccccagctccatcgccgcgcggggttatatcagcacccgcgtgggcatgggggaggccgccgccatcttcatgacggccacgccgcccgggtccgtagaggcgttccctcagtctaacgcggtgatccaggacgaggaacgggatataccggagcgctcatggaactcagggtacgagtggatcaccgacttccccggcaagacagtgtggttcgtaccctctatcaagtcgggcaacgacatagccaactgcttgcggaagaacgggaagcgcgtgatccagctgtcccggaagactttcgacaccgagtaccagaagaccaagaacaacgactgggactacgtggttacgacggacattagcgaaatgggggctaacttcagggcagaccgggtgatcgacccccgccggtgcctcaagccggtgatcctgaaggacgggcccgaacgcgtcatcctggccggcccgatgccggtgaccgtcgcctccgccgcccagagaagggggcgcatcggacgcaaccacaacaaagagggcgaccagtacatctacatggggcagccgctcaacaacgacgaggaccatgcgcactggaccgaggccaagatgctactggacaacatcaacacccccgagggtatcatccccgcgctcttcgagcccgaacgggagaaaagtgccgccatcgacggggagtaccgccttcgaggcgaggcgcgtaagacgttcgtggagctgatgcggcgcggggacctcccggtgtggctgagctacaaggtagcctccgagggattccaatactctgaccgccggtggtgcttcgatggcgagcgcaataaccaggtcctggaggagaacatggatgtggagatatggaccaaagagggggagcgcaagaagctccgccctaggtggttagacgctaggacgtactccgatcctctggccctgcgtgagttcaaggagttcgccgctggccgcagaagcgtcagcggcgacctgatccttgaaataggcaagctgccccagcatctaacccaacgcgcccaaaatgcgttggacaacctggtgatgctgcacaactcggagcagggcgggcgggcctaccgccacgcgatggaagagctgccggacacgatcgaaacgatgatgctcctagcactaattgcagtgctcaccggcggcgtcaccctgttcttcctgtctggccgggggttaggcaagaccagcatcggcctcctgtgcgttatggcctccagcgtgttgttatggatggcatccgtcgagccccattggatcgcagccagcatcattctcgagttcttcttaatggtactgctgatccccgagcccgacagacagcggacgccgcaggataaccagttggcctacgtggtcatcggactgctttttatgatcctcaccgtagccgccaacgagatgggtctgctggagaccactaagaaggacctcggcatcggccatgtggcggtcgagaaccaccaccacgcggccatgctggacgttgacctgcaccccgcctccgcgtggacactctatgcggtggctaccaccatcatcacccccatgatgcgtcacacgatcgagaacaccacagccaacatcagcctgaccgccattgcaaatcaggcggcaatcctgatggggctcgacaaaggctggccgatctccaagatggacatcggggtgcccctactggccctcgggtgttacagccaggtaaatccgctgactctaaccgccgcggtgttgatgttagtcgcccactacgcaattatcggccctgggctccaggctaaggccactcgggaggcgcagaaacgcacggcggccggcatcatgaagaacccgacagtggacgggatcgtggccatcgatctcgacccggtggtgtatgacgccaagttcgagaaacagctgggccagatcatgctgctcatcctgtgtacaagccagatcctgctcatgcgaaccacctgggctctgtgcgagtctattacgctggccaccggccctctcacaaccctttgggaggggtcgcccgggaagttctggaacaccaccatcgccgtaagcatggccaacatcttccgggggtcgtacctggccggcgctggtctcgccttctcactgatgaagagcctcgggggcggccgccgggggactggtgcccagggggagaccctaggggagaagtggaagcgccagcttaaccaactgagcaagtccgaatttaatacgtacaaacggtccggaatcatggaggtcgaccgcagcgaggctaaggagggcctcaagcgcggggagacgaccaagcacgcggtttcccgcggcaccgctaagctcagatggttcgtggagcgaaacctggtaaagccggaagggaaagtgatagatctcgggtgcggtcgcggcgggtggtcatactactgcgctgggttgaaaaaagtgacggaggtaaagggatacaccaaaggcggccccggtcacgaagagcccatccccatggctacttacgggtggaatctggtgaagctgcactccgggaaggacgtgttcttcatcccgcccgagaagtgcgacacactcctgtgcgacatcggggagtccagtcccaacccgacgatcgaggaaggtcggactctgcgggtgctgaagatggtggagccgtggctgcgcgggaaccagttctgcatcaagattctgaacccttacatgcccagcgttgtagagaccctcgagcaaatgcagcgtaagcatggtggcatgctggtgcgcaaccccctttcccgtaacagcacccacgagatgtactgggtatcctgcgggactggcaatatcgtcagcgccgtgaatatgacgtccagaatgctcctgaaccggttcaccatggcgcaccgcaagcccacctatgagcgcgacgtggacctgggggccggcacccggcacgtcgcggtggagcctgaggtggcaaacctggacatcatcggccagcgcatcgaaaacataaagcacgaacacaagtctacttggcactacgacgaggacaacccctacaagacctgggcataccacgggtcctacgaggtcaagcccagcggcagcgcctccagcatggttaatggcgtcgtgaagctgttgacaaagccgtgggatgtgatccccatggtcacccagatcgccatgacggacaccaccccctttggccaacaacgggtgttcaaagaaaaggtggacacgcgcacacccaaggccaaacggggcactgcccagatcatggaggtcaccgccaaatggctctggggcttcctgtcaaggaacaagaagccgcgcatctgcaccagagaggagtttacgcggaaggtgaggtcaaacgcagccattggagcagtatttgtcgacgagaatcagtggaattctgcaaaggaggcggttgaagacgagcggttctgggacttagtgcaccgggagcgggagttacataagcagggtaagtgcgcgacatgtgtctataatatgatgggcaagcgcgagaaaaagctgggggagttcggcaaggccaaggggagccgggccatctggtacatgtggctgggcgcgcggttcctcgaattcgaggcgctgggattcatgaacgaggatcactggttctcacgggagaacagcctgtctggggtggagggcgaggggctccataagctgggctatatacttcgcgacataagcaagatccccgggggcaatatgtatgccgatgacaccgccggctgggacacccggatcacggaggacgacctccagaatgaggctaagattactgacatcatggagcccgagcacgccctgctcgcgaagtccatattcaagcttacgtatcagaacaaggtagtccgcgtgcaacgtccggccaagaacggaaccgtgatggacgtcatcagccgcagggaccaacgaggtagtggccaggtgggtacgtacggcctgaacaccttcaccaacatggaggcgcagctgatccgccagatggaaagcgagggtatcttctccccgagcgagctcgagacaccaaacctggctcggagggtcctagattggctagagaagcacggagtcgaacgactgaagcggatggcaatctcaggggacgattgcgtggtgaagcccatcgacgacagattcgctacggcccttaccgccctaaacgatatgggcaaagtccgcaaggacattccacaatgggagcccagcaaggggtggaacgactggcagcaggtccccttctgtagccaccactttcaccagctgatcatgaaggacggcagggagatcgtggtgccctgccgcaaccaggacgagctggtaggccgggcccgcgtgtcccagggtgccggctggtcacttcgggagaccgcgtgcctggggaaatcctacgcacagatgtggcagctgatgtatttccaccgccgggacctccggttagccgccaacgcgatctgcagcgccgttccggtggactgggtacccacgtccagaacgacatggagcatccacgctcaccaccagtggatgaccacagaggatatgctgtcagtatggaaccgtgtctggatcgaagagaacccctggatggaggacaaaacgcacatcagctcctggggggatgttccctacctggggaagcgggaagaccagtggtgcggcagcctgatcggcctgaccgcccgcgccacatgggcgacgaatatccaggtcgctatcaaccaggtacggcgattaatagggaatgagaactacctggactacatgacatccatgaagcgcttcaagaacgagagcgacccggagggcgctctgtggtga

SEQ ID NO: 24341 - RNA, 9879 nt, synthetic construct
  misc_feature 1..9879: note = derived and/or modified CDS sequence (opt11) from DENV-1__GQ199824__SS-prME
  source 1..9879: mol_type = other RNA
agcgtgaccatgctcctgatgctgatgcccaccgccctggcttttcacctcacgactcgaggcggggaaccccacatgattgtgtccaagcaagagcgggggaagtcgctccttttcaagacctccgcgggggtgaacatgtgcaccctcattgccatggacttgggcgagttctgcgaggataccatgacatacaagtgcccccgaatcactgaagcggagcccgacgatgtggactgctggtgcaacgccaccgacacctgggtcacctacggcacgtgcagccagaccggcgagcaccggcgagacaagcggtccgtggccctcgcgccccacgtgggcctcgggctggagacgcgcaccgagacctggatgagctcagagggcgcgtggaagcagattcagcgtgtcgagacctgggccctgcgccatccagggttcacggtcatcgctctcttcctggcgcacgccatcggcaccagtatcacccaaaagggtatcattttcattctattgatgctggtgaccccctccatggccatgcgctgcgtcgggatcggcagccgcgacttcgtggaagggctgtccggcgcgacatgggtggacgtagtgctcgagcatgggtcctgcgtgaccaccatggccaaggataagcccaccctagacattgagctgctcaagaccgaggtcaccaatccagcagtgctgcggaagctgtgcatcgaagccaagatttccaacacgaccacggactcccgctgccctacgcagggtgaggccaccctcgtagaggaacaggacgccaactttgtctgccggcgcaccttcgtggaccgtggctgggggaacggctgcgggctgttcggcaaggggtccctgatcacgtgtgccaaatttaaatgcgtaaccaagctcgagggcaagaccgtgcagtatgagaacctgaagtacagcgtaatcgtgaccgtccacacaggcgaccaacaccaggtggggaacgagtccaccgagcacgggaccacagcgactatcacgccccaggcccccagcacggagatccagctgaccgactacggggcactcacactggactgcagtccccggacgggcttagacttcaacgagatggtcttacttacaatgaaggagaaatcctggctcgtccacaagcagtggttcctcgacctcccgctgccctggaccagcggcgcctccacatctcaagagacttggaaccggaaggacctcctggtgaccttcaagaccgcccacgctaaaaagcaggaggtggtggtgctgggatcccaagaaggcgcaatgcatactgcgctcacgggagccacagagatccagacctcgggcacgacgacgatcttcgccgggcacctgaaatgccgtctgaagatggacaaactcaccctgaaaggcatgtcctacgtcatgtgcaccgggagcttcaaacttgagaaggaggtggccgagactcagcacggcaccgtgctcgtgcagatcaagtacgagggcacggacgcaccctgcaagatacccttctccacccaggacgagaagggggtgacgcagaacgggcggctcatcaccgccaaccctatcgtgaccgataaggagaagcccgtcaacatcgaagccgaacctcccttcggtgagtcttacattgtgatcggcgcgggcgagaaggccctgaaactgagctggttcaagaaggggtcctccataggaaaaatgttcgaggctaccgcccgcggagcccgccgcatggcgattttaggcgacactgcctgggacttcggaagcatcggcggcgtattcacctccgtcgggaagctcgtacaccaaattttcggcacggcttatggtgtattgttctccggcgtttcatggaccatgaagatcggcattggggtgctgcttacgtggctaggcctcaactctcgctccacttccctgtccatgacctgtatcgccgtaggcctggtcaccctctacctgggcgttatggtgcaggcagacagcgggtgcgtcatcaactggaagggcagggaattgaagtgcggaagcgggattttcgtgacgaacgaggtacacacctggaccgagcaatacaaattccaagcggactcccctaagcggctcagcgcggcaatcggaaaggcctgggaagagggggtatgcggcatacggtccgcgacccgcctggagaacataatgtggaagcagatccttaacgagctcaaccacatcctgctggagaatgatatgaagttcaccgtggtggtcggggatgtggcgggcatcctcgcccaggggaagaagatgatccggccccagcccatggaatacaagtactcttggaagtcctggggcaaggccaagatcatcggcgccgacgtgcaaaacacgaccttcatcatcgacgggcctaacacgccggagtgtcccgacgatcagcgggcatggaacatctgggaggtcgaggattacgggttcggaatcttcaccacgaacatctggctgaaactgcgcgacagctacacccaggtatgcgaccaccgcctcatgtccgcggccatcaaggacagcaaggccgtccacgccgacatgggctactggatcgagtcagagaagaatgagacctggaaactggcgagagccagcttcatcgaggtgaagacctgtatctggcccaagtcccacacgctgtggagcaatggcgtcctcgagagcgagatgataatccccaagatctacgggggaccgatatcccagcataactaccggcccgggtacttcacccagaccgccggcccctggcacctggggaagctggaattggatttcgacctgtgcgagggcaccacggtggtcgtggatgagcactgcgggaaccgggggccgagcctgcggacgaccaccgtcacgggcaagatcatccacgagtggtgctgccggagctgcaccctgccgccccttcgtttcaagggggaagacggctgctggtacgggatggagattaggcccgtcaaggagaaagaggagaaccttgtgaagtccatggtgagcgccggctcaggtgaggtcgattccttcagcctcgggctgctgtgcatttccatcatgatcgaagaggtaatgcgaagccggtggagtcgcaaaatgctcatgaccggtaccctggccgttttcttcctgttgatcatggggcagctgacgtggaatgacctgatcaggctctgtataatggtcggagcgaacgccagcgaccggatggggatgggcaccacctacctcgccctgatggctaccttcaaaatgcgccctatgttcgccgtgggcctcctgttccggcgcctgacgagtcgcgaggtgctcctcctgaccatcggcctcagcctggtcgcgagcgtcgagctccccaactctctcgaggaactgggcgacgggctggccatgggtatcatgatcctcaagctgctgacggactttcagagtcaccagctctgggcaaccctgttaagcctcacgtttatcaaaaccactttttccctgcactacgcctggaagaccatggcgatggttctgtccatcgtgagcctcttccctctctgcctgagcacgacctcccagaagaccacctggctcccggtgctgctgggcagcctcggttgcaagccgctaacgatgttcctgatcgccgagaataagatctggggcaggaaatcgtggccactcaacgaagggatcatggcggtaggcatcgtgagcatcctgctgagctccctcctgaagaacgacgtacccctggccgggcccctcatcgcgggcggaatgctgatcgcgtgctacgtcatctctgggtccagcgccgatctgagccttgagaaggccgccgaagtgagctgggaggaggaggccgagcattccggcgctagccacaatatcctggtggaggtgcaggacgacgggaccatgaagatcaaagacgaggagcgcgacgacaccctgaccatcttactcaaggccaccctactcgccgtgtccggcgtgtatccgctgagcatccccgctacgctgttcgtctggtacttctggcaaaagaagaaacagcgctctggggtgttgtgggacactccctccccgcccgaagttgaacgggccgtcctggacgacggcatttaccgcatcatgcagcgtggcctgctggggaggtcccaggtaggcgtgggggtcttccaggagaatgtgtttcatacgatgtggcacgtgacccggggcgcggtactgatgtaccaggggaagagattagagccgtcctgggcctccgtgaagaaggacctgataagctacggcggcggctggcggttgcaaggctcctggaacactggagaggaagtacaggtgatcgcggtagagccgggcaagaaccctaagaacgtgcagaccgcccccgggaccttcaagacgagtgagggcgaggtcggggccatcgcactggacttcaagcccggcacctccggctcccccatcgtgaacagagaagggaagattgtgggcctgtacggaaatggtgtcgtaaccaccagcggcacatacgtttccgccatcgctcaggccaaggcgtcacaggaaggccccctcccggagatagaagacgaagtcttccggaagcgtaacctgactatcatggacctacaccccggctctgggaagacccggcgctacctccccgccatcgtgcgggaggccatcaaacgcaaactgcggactctgattctagcccccacccgagtggttgccagtgagatggcggaggccctaaaagggatgcccataaggtatcagacgaccgccgtgaaatccgagcacaccggcaaggagatcgtggacctgatgtgccacgctaccttcacaatgcggctactgagcccagtccgcgtgccgaattacaacatgatcatcatggacgaggcacacttcaccgatccctccagcatcgcggctcgggggtatatctccaccagggtgggcatgggggaagccgccgccatcttcatgaccgccacgccgcccggctctgtcgaagccttcccccagtccaatgctgtgatccaggacgaggaacgggatataccggagcgcagctggaacagcgggtacgagtggattaccgacttccccggaaagaccgtgtggttcgtgcccagcatcaagtccggcaatgacattgccaattgtctgagaaagaatgggaagcgcgtgatccagctcagccggaagacttttgatacggagtaccagaagaccaaaaacaacgactgggactacgtggtcaccacagacatctcagagatgggcgcgaatttccgcgccgaccgggtaatagacccgaggcgatgcctgaagccagtaatcttaaaggacggacccgagcgcgtcattctcgccggccccatgcctgtgacggtggcctcagctgcccagcggagagggcggatcgggcgcaaccacaacaaggagggcgaccagtacatatacatggggcagcccctgaacaacgacgaggaccacgcccactggaccgaagccaagatgctgctggacaatatcaacacccctgaaggtatcatcccagccctgttcgagcccgaaagagaaaaatctgccgcgatcgacggcgaataccgcctgcgaggcgaggcccggaagaccttcgtggagctcatgagacgtggtgacttaccggtatggctgtcttacaaagtcgccagcgagggcttccagtactcggacaggcgctggtgcttcgacggcgagcgcaacaaccaggtgctcgaagagaacatggacgtggagatctggacgaaggagggggagcggaagaagctgcgaccccgatggctggacgcccggacctatagcgacccccttgcactaagagagttcaaggagttcgcggccggcagacggtccgtcagcggggacttgatactcgaaatcggaaaactgcctcagcacctgacgcagcgagctcagaacgcccttgacaacctggtgatgctacacaactccgagcaaggcgggcgggcgtaccgccatgccatggaggagctgccggacacgatcgagactctcatgctgctcgccctgatcgcagtcctgaccggcggggtgaccctcttcttcctaagcggccgggggttaggcaagacatcaatcggcctcttgtgcgtgatggccagctccgttctcctctggatggcgagcgtcgagccccactggatagcggcctccatcatcctggagttcttcctaatggtgctcctgatccccgagcccgaccgccagcggaccccacaagacaaccaactggcctatgtggtgatcgggctcctgttcatgatactgacagtggccgcgaacgaaatgggactcctcgaaaccaccaagaaggacctgggaatcggccatgtggccgtcgagaaccaccaccacgctgctatgcttgacgtagacctgcaccctgcctccgcgtggaccctgtatgccgtagcaacgaccatcatcacccccatgatgcgccacaccatcgagaacaccaccgccaacatctccctaacagccattgcaaaccaggctgctatcctgatggggctggacaagggctggccgatcagcaagatggacatcggcgtccccctcctggctctggggtgctactcccaggtgaacccactcaccctgacggcggccgtgctcatgctagtggcccactacgccatcataggcccagggctgcaggcaaaggcgactcgggaggcccagaagcgcaccgccgccggcatcatgaagaacccgaccgttgacgggatcgtggccatcgaccttgaccccgttgtgtacgacgctaagttcgagaagcagctcggccagatcatgctgctgatcttatgcacttcgcagatcctgctaatgcgcaccacctgggccttgtgcgagtccatcaccctggccacgggccccctgactaccctttgggaagggagccccggcaaattctggaataccacgatcgccgtgtccatggccaacattttccgggggagctatctggcgggcgccggattagcattcagcctcatgaagtcccttggcggcgggcgccgggggacaggggcccagggcgagaccctgggagagaaatggaagcgccagcttaaccagctgagcaagtccgagtttaacacttacaaacggtctgggatcatggaagtcgaccgttccgaggcgaaggagggcttgaaacgtggggagacgaccaagcacgcggtaagccgcggaaccgccaagttacggtggtttgtggagcgcaacctcgtaaaacctgaaggtaaggtgatcgacctgggctgtggcagaggtgggtggtcctattactgcgcagggcttaaaaaggtgacagaggtcaagggttacactaagggcgggcccggccacgaggaacccatccccatggccacatacgggtggaaccttgtcaaactgcatagcgggaaagacgtgttcttcatcccgccggagaagtgtgataccctgctctgcgatatcggggagtccagccccaatcccaccatagaagagggccgcacgctgcgggtcctgaagatggtggaaccttggctcagaggaaaccagttctgcatcaagattctgaacccctacatgccctccgtagtcgagaccctggagcagatgcagcggaaacacggcggaatgctcgtacgcaaccctctgagccgtaatagtacgcacgagatgtactgggtcagctgcgggaccggcaacatcgtgtccgcggtaaacatgaccagtcgcatgttactcaaccggttcactatggcccaccgcaagccgacctacgaacgcgacgtggaccttggggcaggcacccggcacgtcgcggtcgagcccgaagttgccaacctggacatcatcggccagcgcatcgagaacatcaagcatgagcacaagagcacctggcattacgacgaggacaacccctataagacctgggcttaccacgggtcctacgaggtaaagcccagcgggtccgccagctctatggtgaacggtgtcgtgaagctcttgactaagccgtgggacgtgatcccaatggttacgcagatagccatgaccgacacgacccccttcggccaacagcgggtttttaaagagaaagtggacaccagaacccctaaggcgaaacgtgggacggcgcagatcatggaggttaccgcgaagtggctgtgggggtttctcagccgcaataagaagccgcggatctgcacccgcgaggagttcacccggaaggtgcggtcaaacgccgccatcggggctgtcttcgtagacgagaaccagtggaacagcgcgaaagaggccgtggaggatgagcggttctgggacctggtgcaccgcgagcgggagctgcacaagcaggggaagtgtgccacgtgcgtctacaatatgatgggcaagcgcgagaagaagctcggtgagtttggcaaggcgaaggggtccagggccatctggtacatgtggctgggcgcacggtttttagagtttgaggccctcggcttcatgaatgaggaccactggttctcgcgggagaactccctgagcggggtagaaggtgaggggctgcacaaacttggctacatcctgcgcgatatctccaagatacccgggggcaacatgtacgccgacgacaccgccggctgggacacgcggatcacggaggacgacctgcagaacgaggccaagatcacggacatcatggagcccgagcacgcgcttctcgccaaaagcatcttcaaattgacctaccagaacaaggtggtacgcgtgcagcggcctgctaagaacggtaccgtgatggacgtcatctcccgcagggaccagagaggttcaggacaggtgggcacctacggcttgaacactttcacaaatatggaggcccagcttatccgccagatggagagtgagggtatattcagcccttccgagctggagacgcccaacctcgccggcagagtactggactggctcgagaagcatggggttgaacgcctcaagagaatggcgatctcaggcgacgactgcgtggtcaagcctatagatgatcgtttcgccactgctctgacggccttgaatgacatggggaaggtccggaaggacatcccgcagtgggagccctccaaggggtggaacgactggcagcaggtccccttttgcagccaccacttccaccagctcatcatgaaggacggacgtgagatagtggtcccttgccggaatcaagatgagctggtgggtagggcccgagtgagccagggcgcggggtggtccttgcgcgaaaccgcctgcctcggcaagagctatgcccagatgtggcaactcatgtacttccaccggagggacctgcggctcgccgcgaacgccatctgctccgccgtcccggtcgactgggttcccacaagcagaaccacctggtccatccacgcccatcaccagtggatgaccaccgaggacatgctgagcgtctggaaccgggtgtggattgaagaaaacccctggatggaggacaagacgcacatctcctcttggggcgacgtgccctacctgggcaagcgggaggaccagtggtgcggctccttaatcgggctcacggcacgggcgacctgggccaccaacatccaggtcgccataaatcaagtgcgccgccttattggtaatgagaattacctcgactacatgaccagcatgaagagattcaaaaacgagtccgatccggagggggccctgtggtaa

SEQ ID NO: 24342 - RNA, 9879 nt, synthetic construct
  misc_feature 1..9879: note = derived and/or modified CDS sequence (opt11) from DENV-1__FJ882559__SS-prME
  source 1..9879: mol_type = other RNA
agtgtaactatgttactcatgctgatgcccaccgccctggccttccaccttacgacacggggcggggaaccccacatgatcgttagcaagcaggaacggggtaagagcctgctgtttaaaaccagcgctggggtgaacatgtgtaccctcatagccatggatctgggcgagttctgtgaggacaccatgacatacaaatgcccgagaatcaccgaggccgaaccagatgacgtggactgctggtgcaatgccaccgacacgtgggtgacctacggtacctgctcgcagaccggcgaacaccggcgggataaacggtccgtggccctggcgccccatgtgggcctcgggctggagacgcgcaccgagacctggatgagttccgagggcgcctggaagcaaatacaaagggtggagacctgggcactccgccaccccgggttcacggttatcgccttattcctagctcatgccatcgggaccagcatcacccaaaaagggatcatcttcatactcctcatgctggtgactccctccatggccatgagatgcgtagggattggcagccgcgacttcgtggaggggctgagcggagcgacgtgggtggacgtcgtgctggagcacgggtcctgcgtgaccaccatggccaaagacaagcccaccctggacatcgagctgctcaagacggaagtcaccaaccccgcggtgctgcgtaagctgtgcatcgaagcaaagatatccaacaccaccacggactcgagatgcccgacccagggcgaggcaaccctcgtggaggagcaagacgccaacttcgtgtgccggcgcaccttcgtagaccggggctggggaaacggttgcggactgttcggcaaggggtccctgatcacatgtgccaaatttaaatgcgttactaagctcgagggcaagatcgtccagtatgagaacctgaagtactcagtaatcgtgacagtccacaccggcgatcagcaccaggtggggaacgaatccaccgagcacggcaccaccgcgaccatcacgccccaggctcccagcacggagatccaactgaccgactacggggccctcaccctggactgcagcccacggactggcctggacttcaatgagatggtcctcttgacgatgaaggagaaatcctggctggtgcacaaacagtggttcctcgacctgccgcttccctggacatccggagccagtaccagccaggagacctggaaccggcaggatctcctggtgactttcaagacggcccacgcaaagaagcaggaggtcgtggtgctgggctcccaggagggcgcaatgcacaccgccctcactggggccaccgagatccagaccagcggcaccactacgatcttcgccggtcacctgaagtgtcgactgaagatggacaaattgaccctgaagggcatgtcctacgtcatgtgcacagggagcttcaagttggagaaggaggtggcggagacccagcacggcacggtgctcgtacagatcaagtacgagggaaccgatgccccctgtaagatccccttctccacccaagacgagaagggggtaacccagaatggccggctcattacggctaatcccatcgtaaccgacaaggagaaacccgtgaacatcgaggccgagccgccctttggggagtcgtacatcgtgatcggcgcgggcgaaaaggccctgaaactgagttggttcaagaaaggaagctccatcggcaagatgtttgaggccaccgcccgtggagccagacgaatggcgatcctcggcgacaccgcttgggatttcggctcaataggcggggtgttcacgtccgtagggaagctggtgcaccaaatcttcggcaccgcctacggggtgctgttcagcggagtctcgtggaccatgaagatagggatcggcgtgctcctgacctggctgggcctcaacagccgcagcacaagtttatccatgacctgcatcgccgtgggtttagtcaccctctacctaggcgtgatggtgcaggccgacagcggatgcgtcatcaactggaagggccgggagctgaaatgcgggagcgggatcttcgtgaccaacgaggtgcacacatggacagaacagtacaagttccaggcggactcccctaagcgcctctccgccgctatcggcaaggcctgggaggagggggtctgtggcatccggtctgccacccgcctggagaacatcatgtggaagcagatcagcaacgagctaaatcatatcctccttgagaacgatatgaagttcaccgttgtggtcggtgatgttgctggcattctagcccaggggaaaaagatgatacggccccaaccaatggagtacaagtactcctggaagtcctgggggaaagcccgcatcatcggcgccgacgttcagaacaccacgttcatcatcgacgggcccaacaccccagagtgccccgacgatcagcgagcgtggaacatctgggaggtcgaggactacggcttcggtatcttcaccaccaacatctggctgcgcctgcgggactcctacacccaggtgtgcgaccacagattgatgtcagccgccatcaaggactccaaggccgtgcacgccgacatgggctattggatcgagtctgagaaaaacgagacctggaagctcgcgcgggcgtccttcatcgaggttaagacctgcatctggcccaagagccacaccctttggtccaatggggtgctggagagcgagatgatcatcccaaaaatctacggaggtccgatctcccagcacaactaccgcccagggtacttcacgcagacagccggcccctggcacctgggcaagctggagctggatttcgacctctgcgagggcaccaccgttgtcgtcgacgagcactgcggcaaccgggggccttctctgcgaaccaccaccgtgaccggcaagatcgtccacgagtggtgctgtagatcctgtacccttccgcccctgagattcaagggggaggatggctgctggtacggcatggagatccggcccgtgaaggagaaggaggagaacctggtcaagagcatggttagcgccgggtccggcgaggtggacagcttttcccttgggctcctgtgcatcagcatcatgatcgaggaggtgatgcggtcccggtggtcccgcaagatgttgatgaccggcactcttgctgtcttcttcctgctgatcatgggtcagctcacctggaacgacttgattcgcctgtgcatcatggtgggcgcgaacgcgtcagaccgaatggggatgggcatgacctacttggccctgatggccacctttaagatgcggccgatgttcgcggtcggcctcctcttccggcggctgaccagccgggaagtcctgctcttgaccatcgggctgtcccttgtggccagcgcagagctgccgaactccctggaggagctcggcgacgggctggctatgggcatcatgatcctgaagctcctgacggatttccagagccaccagctgtgggccaccctcctgtccctgaccttcattaagactacattctccctccattatgcgtggaaaaccatggccatggtcctctccatcgtctctctgttccccctctgcctgtccaccaccagccagaagaccacctggttacccgtgctactgggctccttggggtgcaagccgctcaccatgttccttatcgccgagaacaagatatggggccgcaagagttggcccttaaacgaaggtattatggccgtcggcatcgtgtcaatcctgttatccagcctgctcaagaatgacgtgcccctggctgggcccctcatcgcgggcgggatgctcatcgcctgctacgtcatctccgggagcagcgccgacctgtcactggagaaggccgccgaggtgtcttgggaggaggaggcggagcacagcggcgcatcacacaatatcctcgtggaagtccaggacgacggcaccatgaagatcaaggacgaggagcgggacgacacgctgacgattctgctcaaggcaaccttactagccgtgtcaggcgtgtacccgctctcaattcccgccaccctgtttgtgtggtacttctggcagaagaagaagcagcggagcggggtgctgtgggacacgcccagcccacccgaggtggagcgtgcggtcctggacgacggcatttaccgcatcatgcagcggggtctgctggggcggagccaggtgggcgtgggtgtcttccaggagaacgtgttccacacgatgtggcacgtgacccggggcgccgtcctgatgtaccaggggaaacgcctcgagccctcctgggcctcagtgaaaaaggacttgatcagttacggcggcgggtggcggctgcagggcagctggaacacaggggaggaggtacaggtcatcgccgtggagcctggcaagaaccccaagaacgtacagaccgcccctgggacgttcaagacctcagagggtgaagtcggcgcgatcgcattggacttcaagccggggacaagcggtagccccatcgtgaaccgcgaggggaagatcgtgggcctgtacggcaacggggtcgtaacgacgtccggaacatacgtgagcgccatagcccaggcgaaagcctcccaggaggggcctctgccggagatcgaagatgaggtcttccgtaagcgcaatctcaccattatggatcttcatccgggcagcgggaagacccggcgctatttgcccgccatcgtgagagaggccatcaagcgcaagctccgaacgctcatcttggctccgacaagggtggtcgcgtccgagatggccgaggccctcaagggcatgccaatccgctaccagaccacggccgtcaaaagcgagcatacggggaaggagatcgtggacctgatgtgccatgccaccttcaccatgcgcctgctctcccccgtccgcgttcccaattacaacatgatcataatggacgaggcgcacttcaccgacccgagctccatcgcagcccggggctacatatcgacgagagtgggcatgggagaggccgcagcgatctttatgaccgcgacgcctcccggttccgtcgaggccttcccgcagagcaacgccgtaatccaggatgaggagcgggacatccctgagaggtcctggaatagcgggtacgagtggatcaccgacttccccggcaaaacggtgtggttcgtaccctcgatcaagtccggcaacgatatcgcgaactgcctgcgaaagaacggcaaacgagtgatccagctatcccggaagaccttcgataccgagtaccagaaaacaaagaacaacgactgggattacgttgtcacgactgacataagtgagatgggcgccaacttccgcgctgacagggtaatcgacccccgccggtgcctcaagccggtgatcctaaaggacggtcctgagagggtcatcctggcaggcccgatgccagtgaccgtcgcctccgcggcccagcggcgcgggcggatcgggcgtaaccacaacaaggagggcgaccagtacatctacatgggtcagccattgaacaacgacgaggaccacgcccactggaccgaggccaaaatgctgctggacaacatcaacacgcccgagggtataatccccgcactgttcgagcccgaacgcgagaagtccgcggccatcgacggtgaataccggctgcggggtgaggcccggaagaccttcgtggagctgatgcgccgtggggatctcccggtgtggctgagctacaaggtcgcctccgaggggtttcaatatagcgacagacgttggtgcttcgacggcgagcgcaacaaccaggttctggaggaaaacatggacgtggaaatctggaccaaggagggggagcggaagaagctacggcccagatggctggacgcccgcacctacagtgaccccctggcgttacgggagttcaaggagttcgctgccggacgccggagcgtctccggggacctgatactggaaatcggcaagctcccccagcacttaactcaacgcgcccagaacgcgctggacaaccttgttatgctgcacaacagcgagcagggcgggcgggcatacagacacgccatggaggagctgccggacaccatcgagaccctcatgctgctggccctcatcgccgtactgaccggaggggttacgctgttcttcctctccggtcgtgggctggggaaaaccagcatcggcctgctctgcgtaatggcctccagcgtgctactctggatggcctccgtcgagccccactggatagccgccagcatcatactcgagttctttcttatggtgcttctcatccccgagcccgaccgccagcggaccccgcaggacaaccagctggcctacgtggtaatcgggctcctctttatgatcctgaccgtggcggccaacgaaatgggacttctagagaccacgaagaaggacctggggatcggtcatgtggccgtcgagaaccaccaccacgccgccatgttggacgtggatctccaccccgcgtcggcctggaccctgtacgcggttgccaccaccatcattacgcccatgatgcgccacaccatcgagaacaccaccgccaacatcagccttacggccatcgccaaccaggccgccatcctcatggggctggataagggctggccgatttccaagatggacatcggcgtacccttgctcgcgctagggtgctatagccaggtgaacccgctgaccctcaccgcggcagtgctgatgctggtagcccactatgctattatcggtcccgggctccaggccaaggccacaagggaggcccagaagcggacagccgccggcatcatgaagaaccctaccgtggacgggatcgtggcgatcgacctggaccccgtcgtatatgacgccaagttcgaaaagcagctgggccagatcatgctcctgatcctttgcacatcccagatcctccttatgcgaaccacttgggcactgtgtgagtccatcaccctcgccaccggccccctcaccactctgtgggaggggagccccggaaagttctggaacaccaccatcgcggtgtcaatggcgaacatcttccggggatcgtacttagccggcgccggcctggccttctccctgatgaagtccctcgggggcgggaggcggggcaccggtgcgcagggcgagacgctgggcgagaagtggaagcgacagctgaaccaactctccaagtcggagttcaacacctacaagcggagtggaatcatggaggtcgaccggagcgaggccaaggagggcctgaagcgcggggagaccaccaagcacgctgtgtcccgcggcactgccaagctgcggtggttcgtggaacgcaacctcgtcaagccggagggtaaagttatcgacctcggctgcggccgcggcgggtggagctactactgcgccgggctgaaaaaggtgaccgaggtcaaggggtacaccaagggcgggccaggccacgaggagcccatcccaatggccacctacggctggaacctagtgcgcctgcactcgggcaaagacgtgttcttcacgccgccagaaaagtgcgacaccctgctgtgcgatatcggggagtcatcgcccaatcccaccatagaggagggccggaccctccgggttctgaaaatggtggagccgtggctgcgggggaaccagttttgtataaagatactcaacccctacatgcccagcgtcgtcgagacgctggagcagatgcagcgcaagcatggcggtatgctggtgcgtaaccccctctcccgcaacagcacccacgagatgtactgggtgtcctgtgggaccggcaacatcgtcagcgcagtgaacatgaccagccgcatgctgctgaaccggttcaccatggcccatcgcaagcccacgtacgagcgggacgtggacctcggggctggcacccgtcacgttgccgtggagcccgaggtggcgaatctggacatcatcggccagcggatcgagaacatcaagcacgagcacaagagcacctggcactacgacgaggacaacccctacaagacttgggcctaccacggatcctacgaggtaaagccgagcgggagcgccagcagcatggtgaacggggtcgtcaagctgctaacgaagccgtgggacgtaatccccatggtcacacagattgccatgacagacaccacgcccttcggccagcaacgcgtgttcaaggagaaggtggataccagaacacccaaggctaagcgcggaactgtccagatcatggaggtgacggcgaagtggctgtggggcttcttgtcccggaacaagaagccgcgcatctgcacccgggaggagttcacccgcaaagtgagatcaaacgccgccatcggcgccgtctttgtggatgagaatcagtggaactccgccaaggaggccgtggaggacgagcgcttctgggacttggtccaccgggagcgagagctgcacaagcaggggaaatgcgcgacctgcgtgtacaatatgatgggcaaacgggagaagaaactgggggagtttggcaaggccaaggggagccgtgctatctggtacatgtggctcggagcgcggtttctggagttcgaggccctgggcttcatgaacgaggaccactggttctcccgcgaaaactcgctctccggagtggaaggcgaggggttgcacaagctgggttacatcctccgggacatctctaaaatacctgggggcaacatgtacgccgacgacacggcaggctgggacacccggatcaccgaggacgacctgcagaacgaggccaagatcactgacatcatggagcccgagcacgcactgctcgccaagtccattttcaagctgacgtaccagaataaggtcgtgcgcgtgcagcgaccggccaagaatgggacggtcatggacgtgatcagccgccgggaccagaggggttcgggccaggtgggaacctatggcctgaacaccttcacgaacatggaggcccagctcatccggcagatggagagcgaggggatcttttccccctcggagctggagacgccgaacctggcagaacgcgcgctcgactggctggagaagcacggcgtcgagcggctgaagcgcatggcaattagtggagatgactgcgtggtgaagcccattgacgaccggttcgccaccgccctaaccgccttaaacgatatgggtaaggtccgcaaggacataccgcagtgggagcccagcaaggggtggaacgattggcaacaggtgccgttttgcagccaccactttcaccagctgatcatgaaggacggccgcgagatcgtggtgccatgccgcaaccaggacgaactcgtgggccgggcgcgtgtgtcccagggggcaggctggagcctgcgggagacggcctgcctggggaagtcctacgcccagatgtggcagctcatgtacttccaccgccgggatctgcgcttggcggccaacgccatctgcagcgccgtcccggttgactgggtgcctacctcccggaccacctggagcatccacgcacaccaccagtggatgacgactgaagacatgctatccgtctggaacagagtctggatcgaggagaacccctggatggaggacaaaacccacatcagctcctggggagacgtgccctacttggggaagcgtgaagatcagtggtgcgggagcctgatcggcctcaccgctcgggccacttgggccaccaacatccaggtcgctatcaaccaggtgcgcagattaatcgggaacgagaactacctggactacatgacatccatgaagcgctttaagaatgagagcgacccggagggcgcactctggtga

SEQ ID NO: 24343 - RNA, 9879 nt, synthetic construct
  misc_feature 1..9879: note = derived and/or modified CDS sequence (opt11) from DENV-1__GQ199828__SS-prME
  source 1..9879: mol_type = other RNA
agtgtgaccatgctcctcatgctgatgccgaccgccctggcgttccacctcaccacccggggaggtgagccccacatgatcgtgtcgaagcaggaaaggggaaagagtctgctgttcaagaccagcgcgggggtgaacatgtgtacactcatcgccatggacctgggcgaactgtgcgaggacaccatgacctacaagtgccccagaatcaccgaggcggagcccgacgacgtggactgctggtgcaacgccactgacacgtgggtgacctacgggacttgcagtcaaaccggcgaacatcggcgcgacaaacggtccgtggctctcgcgcctcatgtaggcctggggctggagacgcgcaccgagacttggatgagctccgaaggcgcctggaagcagatccagcgggtggagacctgggccctgcgccaccccgggttcacggtcattgccctgttcctggcgcacgctatcggcactagcataacacagaaggggataatcttcattctcctgatgttagtgaccccctccatggccatgcggtgcgtcggcatcggcagccgcgacttcgtggaggggctctccggagctacgtgggtggacgtagtcctggagcacgggagctgcgtgacgaccatggccaaggacaagcctacattagacatcgagttgctgaagacagaggtcaccaaccccgctgtactgcggaagctctgcatagaggccaaaatctccaatacgaccacggactcaaggtgcccgacccagggcgaggccaccctagttgaggagcaggacgccaatttcgtgtgtcggcgcacctttgttgatcggggctgggggaacggctgcgggctgttcgggaaggggtccttaatcacctgcgccaagttcaagtgcgtgacgaagcttgagggcaagatagtccagtatgaaaacctgaagtacagtgtgattgtgacagtccacaccggggatcaacaccaggtcggcaacgagtccacggagcatggcaccaccgcgaccattacacctcaggcccccacgaccgagatacagctcaccgactacggggccctgaccctggactgctctccacgcacaggcctcgacttcaacgagatggttctactgactatgaaggaaaagtcgtggctagtgcacaagcaatggtttctggacttgcccttaccctggacgagtggggccagcacctcccaagagacctggaaccggcaagacctgctagtaacattcaagaccgcgcatgcaaaaaagcaggaggttgtcgtgctcggcagccaggagggcgccatgcataccgcgctgacgggggccaccgaaatccagacctcaggcactacgaccatctttgctgggcatctgaagtgtcgactcaagatggacaagcttactctgaaggggatgagctacgtcatgtgcactgggtccttcaagttagagaaggaggtggcggagacgcagcacggcaccgtgctggttcagatcaagtacgaggggaccgacgcgccctgcaagataccctttagcacccaggacgaaaagggagtgacgcagaacggcagactgatcactgccaacccgatcgtaactgacaaggagaagccagtcaacatcgaggccgagccgcccttcggggagtcctatattgtgatcggcgcgggcgaaaaggcactgaagctcagctggttcaagaaagggtccagcatcggcaagatgttcgaagccaccgcccgcggggcccgccgcatggccatcctgggcgacacggcgtgggatttcggcagcatcggcggagtattcaccagcgttggcaagctggtgcaccagatcttcggaactgcgtatggggtcctcttttccggcgtcagctggacgatgaagatcgggatcggtgtgctgctgacttggttaggcctgaattcccgcagcacctccctgagcatgacctgcatcgccgtggggctcgtaaccctgtacctgggggtgatggttcaggccgactccgggtgcgtgatcaactggaagggccgagaactcaagtgcgggagcggcatattcgtgacgaacgaggtgcacacctggaccgagcagtataagttccaagcggacagcccgaagcgcctctccgcggccatcggtaaagcctgggaagagggggtctgtggcattcggagcgccacccgtctggagaacatcatgtggaagcagatctcaaacgagctcaaccacatactgctggaaaacgacatgaaactcaccgtggtggtcggggacgtggcaggtatcctggggcagggcaagaagatgatcagaccccagcccatggagtacaagtactcttggaagtcgtggggcaaggccaagattataggggccgacgcccagaacacgaccttcatcattgacggccctaacacaccggagtgcccggacgaccagcgcgcgtggaacatctgggaggttgaggactatgggttcgggatattcaccacgaacatctggctgaagttgcgggacagctatacccaggtttgcgaccaccgcctgatgagcgccgcgatcaaggacagcaaggccgtgcacgccgacatgggctactggatagaatccgagaaaaacgagacctggaagctggcacgggccagcttcatagaggtaaagacatgcgtctggcccaagtcccacacgctctggtctaacggggtccgcgagtccgaaatgatcatccccaagatctacggcggtccgatcagccagcacaactaccggcccggatacttcacccagaccgccgggccctggcatctgggcaagctcgagctcgacttcgacttatgcgagggcaccacggtggtcgtggacgagcactgcgggaatcgcggcccgtccctccggacgaccaccgtaactggcaagatcatccacgagtggtgttgccgaagctgcaccctgcccccacttcgttttcgcggcgaagatggttgctggtacggtatggagatccggcccgtcaaggagaaagaggagaacctggtgaagtctatggtgtcagccggcagcggcgaggtcgactccttcagtctcggcctcttgtgcatctccattatgatcgaggaggtgatgcgcagccggtggtccagaaagatgctcatgatcgggacccttgcggtgttcttcctgctcataatgggccaactgacctggaacgacctgatccgcctctgcatcatggtcggggcgaacgcttcagaccggatggggatggggactacctacctggcactgatggcaaccttcaagatgcgcccgatgttcgccgtgggactcctcttcaggcgcctgacctcccgggaggtcctgttactgacgatagggctcagcctggtcgcgagtgttgagctgcccaactctctcgaggagctgggggacggcctggctatgggcatcatgatcctcaagctactgaccgacttccaatcccaccagctctgggccactctgctgagcctcacgtttataaagacgaccttctccttgcactacgcctggaagaccatggctatggtcctgtcgatcgtgtccttatttcccctatgtctgtccaccacatcccagaagaccacgtggctccccgtgttgctagggtctctcggctgcaagccgctgaccatgttcttaatcgctgagaacaagatctggggtcgcaagtcctggccacttaacgagggcatcatggccgttgggattgtgagcatcctgctgtcgtccctcctgaagaacgatgtgcccctggccggcccgctcatagctggcgggatgttaattgcgtgttacgtcatcagcggctccagcgccgacctgtccctcgagaaggccgccgaggtgtcatgggaggaagaggccgaacattccggggcgagccacaacatcctggtggaggtgcaagacgatggaacaatgaagattaagaacgaggaaagagatgatactctaaccatcctcctgaaggccaccctgctggccgttagcggggtgtacccgctgagcatccccgccaccctgttcgtctggtacttctggcagaaaaagaagcagcgctccggcgtactgtgggatacgcccagccctcccgaggtagagcgggctgttctcgacgacggcatctaccgaatcatgcaaagggggctgctgggcagatcccaagtgggggtaggcgtttttcaggagaacgtgttccacacgatgtggcacgtgacgcgcggggcggtcctcatgtaccagggcaaacgcctggaacctagctgggcctccgtgaagaaggacttaataagctatggcggcggatggcggcttcgcgggtcctggaacaccggcgaggaggtgcaggtcatcgcagtcgagcccggcaagaaccccaaaaatgtgcagacggcccccggcacgttcaaaacccccgagggagaggtcggggccatcgcgctggacttcaaaccaggcacgtctgggtcccccatcgtgaaccgggagggcaaaatcgtcggactctacgggaacggcgtcgttacgacctcagggacctacgtgagcgcgatcgcgcaggcgaaagcgtcacaggaggggccgctccccgagatagaagacgaggtcttccgcaagcggaacctgaccatcatggatcttcaccctgggagcgggaagacgcgccggtaccttccggccatcgtgcgcgaggcgatcaagcgcaagctgcggaccctaatcctcgccccgacccgcgtggtcgcctccgaaatggcggaggccctgaagggcatgcctatccgatatcagaccacggccgtcaaaagtgaacacaccgggaaggagatcgtagatctgatgtgccatgcaacctttacgatgcgcctgctgagccccgtccgggtgccaaactacaacatgataatcatggacgaggcccacttcacagacccttcctccatcgctgcccgcggctacatcagcacccgggtagggatgggcgaagccgctgccatcttcatgaccgcgacgccgcccgggtcggtagaggctttcccccagagcaacgcggtaatccaggacgaggagagagacattcccgagcggagttggaacagcggctacgagtggataacggatttccccggcaaaaccgtgtggttcgtcccaagcatcaaaagcgggaatgatatcgccaactgcctgcgtaagaacggcaagcgggtgatccagctctcccgcaagacgttcgacacggagtatcagaagacgaagaacaacgactgggattacgtggtcaccaccgacatctccgagatgggggcgaacttccgggcagaccgcgttatcgacccgcggagatgcctgaagcccgtcatcctgaaggacgggccggagcgggtcattctcgccgggcccatgcccgtaaccgtcgcctccgccgcgcagcgccgtgggcgaatcggcagaaatcacaataaagagggggaccagtatatctacatgggccaacccctcaacaacgacgaggaccacgctcactggacggaagcgaaaatgctgttagacaacatcaatacccccgaggggattatcccagctttattcgaaccggaacgggagaaatccgccgcggtagacggcgagtaccgcctgcgcggagaagcccgcaagaccttcgtggagcttatgcggcgcggagacctgcccgtctggctgtcctacaaggtggcgagtgagggtttccagtacagcgaccggcgctggtgcttcgacggggagcggaataaccaggtactcgaggagaacatggacgttgagatctggacgaaggagggcgagcgcaaaaagctacggccccgctggttggacgcccgaacttactccgaccccttagcccttcgagaattcaaagagttcgcggccgggcggcgcagcgtcagcggcgatctgatccttgagatcggcaaactgccgcagcacctgacccagcgtgcgcagaacgccctggacaacctggtgatgctccacaacagcgaacagggcgggcgcgcgtaccgtcacgccatggaggagctccctgacaccatcgagaccctgatgctgttggcgctgatcgccgtcctgaccggcggcgtgacgttattcttcctgtccgggcgggggctcggaaagaccagcatcggtctcctgtgcgtcatggcctccagcgtcctgctctggatggcgtccgtggagccccactggattgccgccagcatcatcctcgagttcttcctgatggtgctactgatcccggagccggaccgacagcgcacgccccaggacaaccagctagcctacgtcgtgatcggcctcctgttcatgatactgacggtcgccgccaatgagatggggctcctggagacgaccaagaaggacctgggcatcgggcacgtcgccgtggagaaccaccatcacgccgccatgctcgacgtggatctacaccccgcaagcgcgtggaccctgtacgccgtcgctaccacgatcatcaccccgatgatgcgccacaccatcgaaaacaccacggccaacatcagcttaaccgcgatcgctaaccaggccgccatcctgatgggcctggacaagggctggcccatctccaagatggacatcggtgtccccctcctggccctgggttgttactctcaggtgaacccccttaccctgaccgcggccgtcttgatgttagtggcacattacgctatcatcgggccgggactgcaagccaaggcgactcgggaggcacaaaaacgcaccgcagccgggatcatgaagaaccccacagtcgacggcatcgttgccatcgatctggaccccgtggtgtacgacgcgaagtttgaaaagcagctcggtcaaatcatgctgctgatcttgtgcacctcacagatcctgctgatgcggacaacctgggccctctgcgagtcgatcacgctggctaccggaccccttacgacgctctgggagggctctccggggaagttctggaacaccaccatcgccgtcagcatggccaatatattccgcggcagctacttggcgggcgccgggctggcgtttagcttaatgaagagtctcggcgggggccggcgcgggacgggcgctcagggcgagaccctgggggaaaagtggaagcggcagctaaaccagctgtccaagagtgaattcaacacatacaagagatccggcatcatggaagtggaccggagcgaggctaaagaggggctgaagcgcggcgagaccacgaaacatgccgtgtcccgggggactgccaaactccgctggttcgtagaacggaacctggtaaagcccgaggggaaggtgatcgatttgggctgcgggagaggtggatggagctattactgtgccggcctcaagaaggtcaccgaggtgaaggggtacaccaagggcggccccgggcacgaggagcccattccgatggccacgtatggctggaacctcgtgaagctgcactccgggaaggatgtcttcttcatcccgcccgagaagtgcgacacgctgttgtgcgacataggtgagtcctcccccaacccgaccatcgaggaggggcgcaccctgcgagtgctcaaaatggtagagccctggctccggggaaaccaattctgtatcaagatattaaacccttatatgccaagcgtcgtcgagactctggagcagatgcagcgcaagcacggcgggatgctcgtgcggaacccgctgtcccgcaactcaacccacgagatgtactgggtatcctgcggcaccgggaacatcgtcagcgcggtgaacatgacctcccgcatgctgctcaaccggttcaccatggctcacagaaagcccacgtacgagcgggacgtcgaccttgggactggcacccgccacgtggccgtagagcccgaggtcgccaacctcgacattatcgggcagagaatcgagaatatcaaacacgagcataagtcgacatggcactatgacgaggacaatccctacaagacatgggcctaccacgggtcctacgaggtgaagccgtctgggtccgctagcagcatggtcaatggcgtggttaagctccttactaaaccgtgggacgtcatcccaatggtaacgcaaatcgccatgacagacactacccccttcgggcagcagcgcgtcttcaaggaaaaggttgacacccggacaccgaaggccaaacgcggcactgctcagatcatggaggtgaccgcccggtggttatggggcttcctttcccgtaacaagaagccacggatctgcacccgcgaggagttcacacggaaggtacgcagcaacgccgccatcggggcggtcttcgtggacgagaaccagtggaactccgccaaagaagcggtggaagacgagcgtttctgggatcttgtccatcgcgagagggagctgcataagcagggtaaatgcgccacgtgcgtatataatatgatggggaagcgcgaaaagaaactcggggagtttgggaaggccaagggcagccgggccatctggtacatgtggcttggcgcgcgcttcctggagttcgaggcgctggggtttatgaacgaagatcactggttcagccgggagaactcgctgtccggggtggagggggagggcctgcacaagctcgggtacatactgcgcgatataagcaagatacccggcggcaacatgtacgctgacgataccgcagggtgggatacccgcatcacagaggacgacctccagaacgaggccaaaatcacggatataatggagccggagcatgccctcctggcaaaggccatcttcaaactgacataccaaaacaaggtcgtgagagtacaacgccccgccaaaaacggcacagtcatggacgtcatctcccgtcgcgaccagagagggagcggccaggtcggcacctacggtctcaacacattcaccaacatggaggcacagctgatccggcagatggagtccgaggaaatcttctcgccttccgagctggagacccctaacttagccgagcgggcgctcgattggctggagaagtacggcgtagaacgcctcaagcggatggccatatcaggggatgactgcgtcgtgaagccgatcgatgaccgctttgccaccgccctaacggccctgaacgacatgggcaaagtacggaaggacatcccccagtgggagcccagcaaggggtggaacgactggcagcaagtccccttctgctctcaccacttccaccagctcatcatgaaggacggccgcgaaatcgtagtcccatgccgtaaccaggatgaattagtgggccgcgcacgggtgtcccagggggccggctggagcctgcgagagaccgcctgcctcggcaagagctacgcccagatgtggcaactgatgtacttccaccggcgagacctacggctcgctgacaaggcgatcggctccgccgtcccggtggactgggtgcccacctctcgcaccacgtggtccatccatgcccaccaccagtggatgaccaccgaggacatgctgagcgtctggaatcgcgtgtggatcgaggagaacccctggatggaggacaagacccacatttcctcttgggaggacgtaccgtacctcggcaaacgggaggaccaatggtgtggctccctgatcggcttaacagcccgcgcgacctgggccaccaacatccaggtcgctatcaaccaggtacgccgcctgatcgggaatgaaaactatttagactacatgaccagcatgaagcggtttaagaacgagagtgaccctgagggcgcactgtggtag

SEQ ID NO: 24344 - RNA, 9879 nt, synthetic construct
  misc_feature 1..9879: note = derived and/or modified CDS sequence (opt11) from DENV-1__GQ199829__SS-prME
  source 1..9879: mol_type = other RNA
agcgtgaccatgctgctcatgcttatgcccaccgccttagcgttccatctcaccacccgaggcggggagccccacatgatcgtgagcaagcaggagcggggcaagtctttgttattcaagaccagcgccggcgtgaacatgtgcaccttaatcgccatggacctgggcgagctatgcgaagacacgatgacctataagtgccctcgtattaccgagaccgagcccgacgacgtggactgctggtgcaacgccacggacacctgggtgacctacggtacctgcagccagacgggcgagcaccggcgcgacaagcggtccgtggccttggcgccccacgtcggactggggctggagacccggactgagacctggatgagctccgaaggtgcatggaagcaaatccagcgcgtcgagacgtgggccctccgccaccccgggttcaccgtcattgccctgtttctggcccatgcgatcggcacgtccatcacgcagaaaggcattatcttcatcctcctgatgctggtgacgccttccatggccatgagatgcgtcggcatcgggtcacgcgacttcgttgaggggctgtccggcgccacctgggtggacgtcgtgctcgagcacgggagctgcgtgacgactatggcaaaggacaagcccactttagacatcgagctcttgaagaccgaggtcactaatcccgccgtgttgcggaagctctgcatcgaggcaaagatctctaacaccacgaccgacagccgatgtcctacccagggcgaggccacactggtggaagagcaggacgccaatttcgtctgccggaggacgctagttgaccggggctggggtaacggctgcgggttattcgggaagggctccctgatcacgtgcgctaagttcaagtgcgtgaccaaactggaaggcaaaatcgtgcaatacgagaacctcaagtacagcgtgatcgtcaccgtgcatacgggcgatcagcaccaggtggggaacgaatccacagagcacggcaccacggccaccatcacgcctcaggcacccaccaccgagatccagttaaccgactacggagcccttaccctcgactgcagcccccgcacaggccttgacttcaatgagatggtcctgctcaccatgaaggagaagtcctggctggtccacaagcagtggtttctggacctccccctgccctggacatcgggggcctctacgtcccaggagacctggaaccggcaagacctgctcgttaccttcaaaaccgctcacgcgaagaagcaggaagtggtggtgctgggcagccaggagggcgcgatgcacacggcccttaccggggcaaccgaaatacagacctccggtacgacgacaatcttcgctgggcatctcaagtgtcgcctgaaaatggacaagcttacactcaagggcatgtcatacgtcatgtgcaccgggagtttcaagctagagaaggaagtggcggagacacagcacggaaccgtgctggtccagatcaagtacgagggcaccgacgcgccctgcaaaatccccttcagcactcaggacgagaagggggtgactcagaacggccggctgattaccgcaaacccaatcgtgactgacaaggagaagccggtcaacatcgaggccgagccaccatttggggaatcatacatcgtgatcggcgcgggcgagaaagcgctcaaactgagctggttcaagaaggggagtagcataggaaagatgtttgaggccacggctcgcggggcccggcgcatggccatactgggcgacaccgcgtgggactttgggtccatcggaggcgttttcacctcagtcggaaagctcgtccaccagatcttcggcaccgcctatggcgtgctattctccggcgtctcctggacgatgaagatagggattggcgtgctgctcacctggctagggttgaactcacgcagtacgagtctctctatgacttgcatcgccgtggggctggtcactctgtacctcggcgtgatggtgcaggccgactccgggtgcgtcatcaattggaagggccgggaattgaaatgcgggagcggcattttcgtgaccaacgaggtgcacacctggaccgagcagtacaaattccaggccgacagcccgaagcgcctctccgcggccatcggtaaggcatgggaggagggggtctgcgggatccggagcgcaactcgattggagaacattatgtggaagcagatctccaacgagcttaaccacatcctgctcgagaacgacatgaaattcacggtagtggtaggggacgtggccggcatccttgcccaagggaagaaaatgatccggccccagcccatggagtacaagtacagctggaagtcctggggcaaggccaaaatcatcggcgccgacgtgcagaacaccaccttcatcatcgacgggccaaacaccccggagtgccccgacgaccagcgagcctggaacatctgggaggtcgaagactacggcttcgggatctttacgaccaacatctggctgaagctccgggacagctacacccaagtttgcgatcaccgcctgatgtcagcggccatcaaggacagcaaggccgtgcacgccgacatgggctactggatcgaatccgagaagaatgagacctggaaattagcccgagcgagcttcatagaggtcaagacgtgcatctggccccggagccataccctctggagcaacggcgtgctggaatctgagatgataattcccaagatctacgggggcccgatcagccagcacaactaccggccagggtactttacccaggcagccggcccctggcacctggggaaactggagctggactttgacctgtgtgagggcaccacggtggttgtggatgagcattgtggcaaccgagggccgagtctccggactaccaccgtaacgggtaagattatccacgaatggtgttgccgcagctgtacccttcctcctctgagattccgcggagaggatggttgctggtatggcatggagatccgtcccgtcaaggagaaggaggagaacctagtgaagagtatggtatctgcgggcagcggcgaggtcgactcctttagcctgggcctactctgcatctccattatgatcgaggaggtgatgcgcagccggtggtcccgccgcatgctgatgaccggcaccctggccgtcttcttcctcctgattatggggcagctgacatggaacgacctcatccggctgtgtatcatggtcggcgcgaacgcaagcgaccgcatgggaatgggcaccacctacctcgccctcatggccaccttcaagatgagacctatgttcgccgtcggtctgttgtttcgccggctcacgtcacgcgaggtgctgctgttaacaattgggctgagcctggtcgcgagtgtggaactccccaactcgctggaggaacttggcgacgggctcgctatgggcattatgatcttgaagcttctcacagactttcagtcccaccagctgtgggccacactgctctcactgacgttcatcaaaactaccttctcgctgcactacgcctggaaaactatggcgatggtcttaagcatagtgtcactgttccccctgtgcctaagcaccacctcccagaagaccacctggctgcccgtgctgttgggtagcctgggctgcaagcccctgacgatgtttttgatcgccgagaacaaaatctggggacggcgctcatggccgctgaacgaggggatcatggccgtcggcatcgtaagtatccttctcagctctctgctcaagaacgacgtgccccttgccggtcccctcatcgcaggcggcatgctgatagcgtgctatgtcatcagcggctcaagcgcggatctctccctggagaaggccgccgaggtctcttgggaagaagaggccgagcacagtggcgcgagccacaacatcctggtggaggttcaggatgacgggaccatgaagataaaagacgaggagcgggatgatacgctcaccattctgctgaaagccacactcctggcagtgagtggcgtgtacccgctgagcatcccggccaccctcttcgtctggtatttctggcagaaaaagaaacagcgctccggggtcctttgggacaccccctcgcctccggaggtggagcgggccgtacttgacgacggtatataccgcatcatgcagcgggggctgctcgggcgcagccaggttggagtgggggtcttccaggagaatgtgttccacaccatgtggcacgtgaccaggggtgcggtcctgatgtatcaggggaaacgcctagagcccagctgggcctcagtgaaaaaggacctcatcagctacggcggcggatggaggttacaggggtcatggaacacgggagaggaggtgcaggtcattgctgtggagccaggcaagaatcccaaaaacgtacagacggcccccgggaccttcaagacccccgagggcgaggtcggcgccatcgcactcgacttcaagccggggacgtcagggtcacccatcgtaaaccgggaggggaagatcgtcggcctctacggcaacggggtcgtgaccacgagcggtacctacgttagcgccattgcccaagccaaagcgagtcaagaggggcctctgcccgagatcgaggacgaggtttttcggaagcgcaatctgacgatcatggaccttcaccccggctccgggaagactcggagatatctgccggccatcgtgcgggaggcgatcaagcggaagttgcgcaccctcatcctagctccgacccgagtagtggcctccgagatggcggaggccctgaagggcatgcccattcgctaccagacgaccgccgtgaagagcgagcacactggcaaggagatcgtggatctcatgtgccacgccacctttacgatgagactgctctccccggtacgcgtcccgaactacaatatgatcattatggacgaggcccacttcaccgaccccagcagtatcgctgcccgtggttacatcagcacccgcgtgggtatgggggaggccgctgcaatcttcatgaccgcgacgccgcccggctccgtcgaggccttcccgcagtcaaacgccgtgattcaggatgaggagcgggacatccccgaacgtagttggaacagtgggtacgagtggattacggacttccccggcaagaccgtgtggttcgtccccagcatcaagagcggaaacgatatcgccaactgcctccggaagaacgggaagcgcgtgatccaactgtcccgaaagaccttcgatacggaataccagaagaccaaaaataacgactgggactacgtggttaccacggacatcagcgagatgggcgcgaacttccgcgcagatcgagtgatcgacccgcgcagatgcctgaaacccgtgatcctcaaagacgggcccgagcgcgtcatcttagcaggccccatgccagtgacggtagcctccgccgcgcagcggcgtgggcgcataggccggaaccacaacaaagagggcgaccagtacatctacatgggccagcccttaaacaatgatgaggaccacgcgcactggaccgaggccaagatgctcctggacaacatcaatacccccgagggtataatccccgccctgtttgagccggagcgcgagaagtccgccgctatcgacggggagtaccggttacgcggtgaggcccggaagacgttcgtcgagcttatgcgcaggggggacctgccagtgtggttgtcgtacaaggtggcaagcgaaggcttccagtacagcgaccgccggtggtgcttcgacggagagcgcaacaaccaggtgctggaggagaatatggacgtggaaatttggacgaaggagggggaacggaagaagttgcgtccgagatggctagacgccaggacctacagcgaccccctggcgctgcgggagttcaaagagttcgcggcgggtcgccggtccgtctccggtgacctcatcctggagataggaaagttacctcagcacctcacccagagagctcagaacgctttggacaaccttgtgatgctccataattctgagcagggaggacgggcgtaccgccacgccatggaggagctgcccgacaccatagagacgctgatgctcctagccctaatcgcagtgcttacaggaggggtcacactgttctttctgtccggccgggggcttggtaagaccagcatcggcttgctgtgcgtgatggcgtctagcgtgctcctctggatggctagcgttgagccccactggatagccgcctccatcatcctggagttcttcttgatggtgctgctgatacccgagccggatcgccagcgcacgccccaagataaccagctagcctacgtggtcatcgggttgctgtttatgatcctcacggtggctgcaaacgaaatgggccttttggagaccaccaagaaggacctcggcattggtcacgtggcggtcgagaaccaccaccacgctgcaatgctagacgtggacctgcaccccgcttccgcgtggaccctttacgccgtggccacgaccatcatcaccccgatgatgcggcacaccatcgaaaacacgaccgccaacatcagcctgaccgccatcgctaaccaagccgccatcctgatgggcctcgacaaaggctggcccatttcaaagatggatatcggcgtccccctgttggccctcgggtgctactctcaggtgaaccccctgaccctcacggcggccgtgctcatgctggtggcccattacgccattatcgggccagggctgcaggcaaaagcgacccgcgaggcccagaagcgcaccgccgccggcatcatgaaaaaccccaccgtggacggtatcgtggccatcgacctagaccccgtagtatacgacgcgaaattcgagaaacagcttggccagatcatgctgctcatcctgtgcacgtcccaaatcctgctcatgcggaccacctgggccctgtgcgaatccatcaccctggcaacgggccccctcaccaccctatgggaggggtcaccgggcaaattctggaacactacgatcgccgtgagcatggccaatatattccgggggtcctacctggcaggcgcgggattagccttcagcctgatgaagtccctcggcggcgggaggagggggaccggggcccagggcgagaccctcggcgagaagtggaagcgccagctgaaccagttatccaagtctgaatttaatacctacaagcggtccggtatcatggaagtcgatcgcagcgaggccaaggaaggcctaaaacgcggggagacgaccaagcacgccgtgtcccgcggcaccgccaagctgcggtggtttgtggagcgcaacctggtcaagcccgaggggaaggtgatcgatctggggtgtggccggggcgggtggagctactactgcgccgggttgaagaaagttaccgaggttaaggggtacacgaaaggcggccccggccacgaggagcccatcccgatggccacatacgggtggaaccttgttaagctgcatagtggtaaggacgtgttcttcatcccgcccgagaagtgcgacaccctcctgtgcgatatcggggagagctcccccaacccgaccatcgaggagggccgcactctgcgtgtcctgaagatggtcgagccctggctgcgtgggaaccagttctgtataaagatcctaaacccctacatgcccagcgtggttgagaccctcgagcaaatgcaacgcaaacacggcggcatgctggtgcgtaacccgctgtcccgcaatagcacccacgagatgtattgggtctcctgtggcaccggtaacatcgtcagcgctgtgaatatgacctcccggatgctccttaaccgcttcacgatggctcaccgcaagcccacctacgagcgcgatgtggacctaggggccggcacccggcacgtcgcggtcgaacccgaggtagcaaacttagacatcatcggccagcgcatcgagaacatcaagcacgagcacaaaagcacctggcactacgacgaggataacccctacaagacatgggcgtaccacgggtcctacgaggtcaaaccgagcggctccgccagctcaatggtgaacggcgtcgtgaagctcctgaccaagccctgggatgtgatccccatggtaactcagatcgccatgaccgacacgaccccattcggccagcagcgggtgttcaaggagaaggtggacacgcgcaccccgaaggccaagcgggggactgcacaaatcatggaagtaaccgcgaagtggctctggggcttcctatcccgcaacaagaagcctaggatatgtactcgggaagagttcacccggaaggtgcgctccaatgccgccatcggggccgtgttcgtagacgagaaccagtggaactccgcgaaggaagccgtggaagacgagcggttctgggacctagtgcaccgcgagcgggagctacacaaacaggggaagtgtgcgacgtgtgtctacaacatgatgggaaagcgcgaaaagaagctgggcgaattcggcaaagccaagggcagccgggccatctggtacatgtggctgggcgcgcgtttcctcgagtttgaggctctggggttcatgaacgaagatcactggttctcccgggagaactccctgtccggggtggagggcgaagggttacacaagctcggctacatcctgcgcgatatcagcaagatacccgggggcaacatgtacgcagatgataccgcaggatgggacacccggatcacagaagatgacctccagaacgaggcccggataacggacataatggaaccggagcatgcgctgcttgctaaatccatattcaagctcacctaccaaaacaaggtggtccgcgtgcagcggcccgccaagaacggaacagtgatggatgtcatcagtcgccgggaccagcgcggcagtggccaggtgggcacctacggactgaatacgtttaccaacatggaggcccagctgatccggcagatggaaagcgagggtatcttctcgccctccgagctcgagacccccaatttggccgaacgagtgctggactggctcgagaagtatggcgtcgagaggctcaagcgcatggcgatttccggggacgactgtgtcgtgaagccgatcgacgaccggttcgcaacagccctgacggccctcaacgacatgggcaaagtccgcaaagatattccccagtgggaaccgagcaagggttggaacgattggcagcaggtccccttttgctcccaccatttccaccagctgattatgaaggacggccgggagattgtggtcccgtgtcgcaaccaagacgagctcgtgggccgggcacgggtctcacagggggctggctggagcctcagagaaacggcctgtctggggaagtcgtatgcccagatgtggcagttaatgtacttccatcgtcgggacctccgcctggccgcgaacgccatctgcagcgctgtccccgtggactggatcccaacctcccgcacaacgtggagcatccacgctcaccaccagtggatgaccaccgaggacatgctttccgtatggaaccgggtctggatcgaagagaacccctggatggaggacaagacccacatatcatcctggggcgatgtgccgtacctcgggaagcgcgaagatcagtggtgcggctccttaatcggcctgacggcccgggcgacatgggccacaaacatccaggttgccatcaaccaggtccgccggctcatcgggaacgagaactacctggactatatgacctctatgaagagattcaagaacgagtctgaccccgaaggcgccctgtggtga

SEQ ID NO: 24345 - RNA, 9879 nt, synthetic construct
  misc_feature 1..9879: note = derived and/or modified CDS sequence (opt11) from DENV-1__FJ882562__SS-prME
  source 1..9879: mol_type = other RNA
tccgttaccatgctgctcatgcttatgcctaccgctctggccttccacctcaccacccggggcggggagccccacatgatcgtctctaagcaggaacggggcaagagcctgctgttcaagacaagcgccggagtgaacatgtgtaccctcatcgccatggacctgggcgagctgtgcgaggacacgatgacatataagtgccctcggatcaccgaggccgagcccgacgacgtggactgctggtgcaatgccacggacacgtgggtgacttatgggacctgctcccagaccggcgaacaccgacgcgacaagcgcagcgtggccctcgcaccacacgtaggcctagggcttgagacccgcaccgagacctggatgagctccgagggcgcttggaagcagattcagcgggtcgagacgtgggcgctccgccatcccggattcacggtgattgccctgtttctggctcatgccatcggcacctctatcacccagaaaggaatcatcttcattcttctaatgttggtgaccccatccatggccatgaggtgcgttggcatagggagccgagactttgtggagggactctctggcgccacctgggtggacgttgtgctggagcacgggtcttgcgtgaccaccatggccaaagacaagccgaccctggacatcgagctcctgaagacggaggtcaccaaccccgctgtcctgcggaagctctgcatcgaggccaagatttccaacaccaccactgacagcaggtgccccacccagggcgaggcgaccctagtggaggagcaggacgccaacttcgtgtgcaggcgcacctttgtggaccggggctgggggaatggctgcgggttatttgggaaagggtcactcatcacttgcgccaagtttaagtgcgtgaccaagctggagggcaaaatcgtccagtatgagaacttaaagtacagcgtgatcgtgaccgtgcacaccggtgaccagcaccaggtggggaatgagtcaacggagcacggtaccaccgcaaccattacgccccaggcgccgactaccgagatccagctcaccgactacggggccctgaccctggactgctcaccgcgcacgggattagacttcaacgaaatggtactgctgaccatgaaggagaagtcatggctcgtgcacaaacagtggttcctggacctgcccctgccctggacgagcggggccagcacctcccaggagacttggaaccgacaagacctgctggtgacctttaagaccgcacacgcgaagaaacaggaggtcgtcgtgctgggcagccaggagggcgccatgcatacggcccttacgggagcgactgaaattcagacctccggcacgacaaccattttcgccgggcacctgaagtgccgcctcaagatggacaagctgaccctgaagggtatgtcatacgtcatgtgtaccggatccttcaaactcgagaaggaagtagcggagacccagcatggtaccgtgctggtccaaatcaagtatgagggcaccgatgccccctgcaaaatccccttcagcacccaggacgagaagggagtgacgcagaatggtcggctgataaccgctaaccctatcgtgaccgacaaggagaaaccagtcaacatcgaagccgaaccgcccttcggtgagtcttacatcgtgatcggtgcgggcgagaaggccttgaagctcagctggtttaagaaggggtccagcatagggaagatgttcgaggccaccgcccgcggggccagacgcatggcgatactgggcgacactgcttgggacttcgggtccatcggcggcctgttcaccagtgtgggtaagctcgtccaccagatcttcggcaccgcctacggggtcctgttctctggcgtaagctggaccatgaagataggaataggcgtactgctcacgtggctgggcctgaattctcgctctacctcactcagcatgacctgcatcgccgtgggactggtgactttatacctcggcgtaatggtgcaggccgactccggctgcgtgataaactggaagggtcgcgagctgaagtgcgggagcggcatcttcgtaacgaacgaggtgcacacctggaccgagcagtacaaattccaggcggacagcccgaagcgcctgtccgccgcgataggcaaagcctgggaagagggggtatgtggcataagaagcgcgacacggctcgagaacatcatgtggaagcagatctccaacgagctgaaccatatcttgctcgagaatgacatgaagctgaccgtcgtggtgggtgacgtcgcgggcatactggcccaggggaagaagatgatccgaccccagcctatggagtacaagtacagctggaaatcctggggcaaggctaagataatcggggctgacgcacagaatacgaccttcatcatcgacgggcccaacaccccggagtgccccgacgaccagcgcgcatggaacatctgggaggtggaggactacggcttcggaatcttcaccacgaacatctggctcaagctgcgggacagctatacacaggtgtgcgaccacagactgatgtccgcggccattaaggacagcaaggccgttcacgcagacatgggctactggatcgagtccgaaaagaacgagacgtggaagttggccagggccagcttcattgaggtgaagacctgtatctggcccaaaagccacactctctggagtaacggtgtgcttgagtccgaaatgattatccccaagatctacgggggcccgatcagccagcacaactacaggcccgggtacttcacacaaactgccggcccgtggcacctcggtaagctggagctggacttcgacctctgcgagggaaccacggtcgtggttgacgagcactgcggcaaccggggtccttccttacgcaccaccactgttacgggcaagatcattcacgagtggtgttgccggagctgcaccctgccgcccttaagattccgtggggaggacggctgttggtacgggatggagatccgccccgttaaggagaaggaggagaatctggtgaaatcgatggtcagcgccgggagcggcgaagtcgactcattcagcttggggctcctgtgcatatccatcatgatcgaggaggtgatgcggtcacgctggtcccgaaaaatgctgatgaccggcacccttgcggtattcttcctgttgatcatgggccagctcacctggaacgacctgattcgcctgtgcatcatggtgggtgctaacgccagtgaccgcatggggatgggcaccacatacctcgccttaatggcgaccttcaagatgcgtcccatgttcgcggtggggctcctgttcagacggctgacctcgcgcgaggtcctgctcttgactatagggctgtcactcgtggcctccgtggagctgccaaactctctggaggagctcggcgacgggcttgcgatgggcataatgatccttaagctcctaaccgacttccagtcccaccagttgtgggccaccttactgtctctgacgtttataaaaactacgttttctttacactacgcttggaagaccatggccatggtcctgagcatcgtctccctgttccccctctgcctgagcacgaccagccagaagactacctggctgcctgttctcttgggcagcctcggatgcaaacctctcacgatgttcctcattgcggagaacaagatatggggaaggaagtcctggccactgaacgaggggatcatggcggtgggtatcgtgagcatccttcttagctccctactcaagaacgacgtcccgctcgccgggcccttaatcgctggcggcatgctcatcgcgtgctacgtgattagcgggtcctcagccgacctttccctggagaaggccgctgaggtgagctgggaggaggaggcggagcactccggggctagtcacaacatcctcgtcgaagtccaggacgacgggaccatgaaaataaaagacgaggagcgtgacgacaccctgaccatactgctcaaagccacactgttagccgtgtccggggtgtacccgctaagcatccccgcgacgctatttgtctggtacttctggcagaaaaagaaacagcggtcaggagtgctgtgggacacccccagcccgccagaggtcgagcgcgctgtgttagatgacggcatctaccggattatgcagcgcggcctcctggggagatcacaggtgggcgtcggcgtattccaagagaacgtgtttcacactatgtggcacgtcacccgcggcgccgtactgatgtaccagggcaaaaggctcgaacccagctgggcgagcgtgaaaaaggacctaattagctacggcggcgggtggcgcctgcaaggctcctggaatacgggggaggaggtccaggtgatagccgttgagcccggcaagaacccaaagaacgtccagaccgctcccggtaccttcaaaacccccgaaggcgaggtaggagcgatcgccctcgacttcaagcccggaacgagcggctcccctatcgtgaaccgggagggcaagattgttgggctctacgggaacggcgtggtgactaccagcggcacctacgtaagcgcaattgcccaggccaaagcctcccaagaggggccgcttccggagatagaggacgaggtgttccgcaagcggaacttaacgatcatggacctgcaccccggcagcggcaagactcgccggtacctgccggccatcgtaagggaagccatcaaacggaagctccgcaccctgatcctggcccccacccgcgtcgtggcttccgagatggcagaggccctcaaaggcatgcccattcggtatcagacgacagcggtcaagtcagagcacacaggcaaggagatcgtggacctgatgtgccacgccaccttcaccatgaggctgctctcccctgtccgggtaccgaactacaacatgatcatcatggacgaggcgcacttcaccgaccccagcagtatcgccgcccgcgggtacatcagcacccgggttggcatgggggaggccgccgcgatcttcatgactgccacgccgcccggtagtgtggaagcttttccgcagagtaacgccgtgatccaggacgaagagcgtgacatcccagagcggtcctggaacagcgggtacgagtggatcaccgacttccccggcaagaccgtctggttcgtgccttccatcaagtccggcaatgacatcgctaactgcttgcgaaagaacgggaaacgggtaatccagctcagtcgcaagaccttcgacacagagtaccagaagactaaaaacaacgactgggattacgtcgtgaccactgacatcagtgagatgggcgccaactttcgcgccgatcgcgttattgacccacggcgctgtctcaagcctgtcatcctgaaggacgggcccgagcgagtgatcctggccggaccaatgcctgtgacggtcgcctccgcggcccagcgccgggggcgcatcggaaggaaccacaacaaggagggcgaccagtacatttacatggggcagcccctcaataacgatgaggaccatgcccactggaccgaggccaagatgctgctggacaacatcaatacgcccgagggcattatccccgccctcttcgagccggagagagagaagtccgcggccatagacggggagtacagactacggggcgaagcccgaaagacattcgtggagctgatgagacgtggggacctccccgtctggctgtcctacaaggtggccagcgagggattccagtacagcgaccggcggtggtgcttcgacggcgaacggaacaaccaagtactggaggagaacatggacgtcgagatctggacgaaggagggggagcgcaagaaactccggccccggtggctagacgccagaacatactccgacccgctggcgttacgcgagttcaaagagttcgccgccggccgtcgcagcgtgagtggagatctgatcctggagataggcaagctgccgcagcaccttacccagcgggcccaaaatgcgttagacaacttagtaatgctgcacaacagcgagcagggtggacgcgcctaccggcacgccatggaggagctgcccgacaccatcgagacattgatgctcctcgccctcatagcggttctaaccggcggagtgaccctgttcttcctctctggccgcgggctgggcaaaactagtatcggcctgctctgcgtgatgacctcgtcagtcctgctgtggatggcgagcgtggagccccactggatcgccgccagcataatcctcgagttcttcctgatggtgctgctcatccctgaaccggaccggcagcgcacgcctcaggacaatcagctggcctatgtcgtgatcggtctcctcttcatgatcctgaccgtggcagcgaacgagatgggcctgttagagactaccaaaaaggacctgggaatcggccacgtcgccgtggagaaccaccaccatgccgccatgctggacgtggacctccatccagcctccgcgtggactttgtacgccgtcgccaccactatcatcaccccgatgatgcgtcatacgatcgagaacaccaccgcaaatatctctctgactgcaatcgcgaatcaggccgcgatcctcatgggtctggacaaggggtggcccatttccaagatggacatcggcgttcctctgctcgcccttgggtgctattcgcaggtgaacccactgacactcaccgctgccgtcctgatgctggtggcccactatgcaattatcggaccggggctccaggctaaggcgactcgtgaggcccagaagcgcaccgccgccggcatcatgaagaaccccacagtggacgggatcgtcgccatcgaccttgaccccgttgtgtacgacgcgaagttcgagaaacagctcggccagatcatgctcctgatcttatgcacctcccagatccttctgatgcggaccacctgggccctgtgtgagagcattacgctcgccacggggccccttactaccctgtgggaggggtctccgggcaaattctggaacacgaccatcgccgtcagcatggccaacatatttcgcgggtcctacctcgcgggcgccgggctagcctttagcctcatgaagagtctcggtggggggagaaggggcaccggggcgcagggcgagacactgggtgagaagtggaagcggcagctgaaccaattatccaagagcgaattcaacacgtacaagcgtagcgggatcatggaggtggaccggagcgaggcgaaggagggcctgaagcgcggtgagacgaccaagcacgctgtgtcccggggaaccgccaaactcaggtggttcgtcgagcggaacttagtgaaacccgaggggaaagtgatcgacctcggctgcggccgcggcggctggagctactattgcgccgggctgaagaaagttacggaggtgaaaggctacaccaagggcgggcccggccacgaagagcctatcccgatggccacgtacgggtggaacctggtgaagctccactccggcaaggacgtcttcttcattccacccgaaaagtgcgacaccctgctctgcgacatcggggagagctctcccaacccgacgatcgaggaaggccggacccttcgagtgctgaagatggtagaaccgtggctgcgcggcaaccagttctgcataaagatcttaaatccgtacatgcccagcgtcgtggagacactggagcaaatgcagcgcaaacacggcgggatgctggtacggaacccgctgtcgcgcaacagcacccacgaaatgtactgggtcagttgcgggaccggcaatatcgtgagcgcggtgaacatgacgtcccgaatgcttctgaaccgctttacgatggcccaccgcaaacccacctacgagcgggatgtcgacctcgggacgggcacgagacacgtggccgtggagcccgaggtcgcaaacctcgacatcatcgggcaacgtatcgagaacataaaacacgagcacaaatcgacctggcactacgacgaagacaacccctacaagacctgggcctaccacggttcctacgaagtgaagcccagcggctccgcgagctccatggtgaacggggtcgtgaaactgctcaccaagccctgggacgtcatccctatggtgacgcagatagctatgaccgacaccaccccctttggccagcagcgcgtattcaaggaaaaggttgacacgcgtacccccaaggccaagagagggaccgcccaaatcatggaggtgacggcccggtggctgtggggcttcttatcgcgcaacaagaagccacggatctgcacgcgagaggagttcacccggaaagtgcgcagcaatgcagccattggcgcagtcttcgtggacgagaatcagtggaatagcgccaaggaggcggttgaggacgaacggttctgggacctcgtgcaccgcgaacgggagctgcacaagcaagggaagtgcgcgacctgcgtgtacaacatgatgggaaagagggagaagaaactaggtgagttcggaaaggccaaagggagccgagcgatctggtacatgtggctcggggcacgattcctggaattcgaggcgttaggcttcatgaatgaagatcactggttctcaagagagaacagcctctccggcgtggagggcgaggggctgcataagcttggatacatcctacgcgacatcagcaagatccccggagggaacatgtacgcagacgacacggccgggtgggatacgcggataaccgaggacgacttgcaaaacgaggccaagataactgacatcatggagccggagcacgccctgctcgcgaaagcaatattcaagctcacctaccaaaacaaggtcgtgcgcgtgcagcgccccgccaagaacgggacggttatggacgttatatctcggcgcgaccagcggggtagcggccaagtggggacctacggcctgaacaccttcactaacatggaggcccagctcatcaggcagatggagtccgaggggatcttttcgccatcagagcttgagacgcccaacctggctgaacgggcgctagactggctagagaagtacggcgtcgaaaggctgaagcgtatggctatcagcggggatgactgcgtggttaagccgatagacgatcgctttgccaccgcgctcaccgcactgaacgatatgggcaaagtccggaaagatataccccagtgggagccctccaaagggtggaatgactggcagcaagtcccattctgcagtcaccacttccaccagctaattatgaaggacggccgggagattgtcgtcccttgccggaaccaggacgagctggtcggcagggcacgggtctcacagggagccggatggtcgctacgcgagaccgcttgcctgggcaaaagctatgctcagatgtggcaactcatgtattttcaccggcgtgacctccggctagcagctaacgccatctgttccgcagtcccagtggactgggtgcccaccagccgcaccacatggtccattcacgcgcaccaccagtggatgaccacggaagacatgttaagtgtctggaaccgggtgtggatcgaagagaacccttggatggaggacaagacccacatctccagctgggaggacgtgccatacctgggcaagcgggaagatcagtggtgcggttccctcatcggcttaacagcacgcgctacctgggccaccaacatccaggtcgccatcaaccaagtgcggcgcttaatcgggaacgagaactacctggactacatgacgtcaatgaagaggttcaagaacgagtccgaccccgaaggagccctctggtaa

SEQ ID NO: 24346 - RNA, 9879 nt, synthetic construct
  misc_feature 1..9879: note = derived and/or modified CDS sequence (opt11) from DENV-1__FJ882564__SS-prME
  source 1..9879: mol_type = other RNA
tcggtgactatgctgctgatgctcatgcctactgccttagccttccacttaaccacgcggggcggggagccccacatgatcgtgactaaacaggagcggggtaaatccctgctgttcaagaccagcgctggggtgaacatgtgcaccttgatcgcaatggacctgggcgagctgtgcgaggacacgatgacctataaatgccctcgcatcaccgaggccgagccggacgacgtggactgctggtgcaacgccactgatacgtgggtgacctacggaacctgcagccagacgggggaacatcggcgcgataagcggtccgtagcacttgcgccccacgtaggtctcgggctggagacccgcacagaaacctggatgtccagcgaaggtgcctggaagcagatccagcgggtcgagacatgggccttacgacaccccgggttcaccgtgatcgcgctgtttctggcgcatgccatcgggacctccatcacccagaagggcatcatattcattctcctgatgctggtaacgcccagcatggccatgaggtgcgtcggcatcggctcccgcgacttcgtggaggggctcagcggcgccacttgggtggacgtcgtgttagagcacgggtcatgtgtaaccacgatggccaaggataagcccaccctggacatcgagcttctaaagactgaggtcaccaaccccgcggtcctgcgtaagctgtgcatcgaggccaagatcagcaacaccaccaccgactcccgctgcccgacccaaggcgaggccaccctgatggaggaacaagacgccaacttcgtgtgccggcgaacgttcgtcgatagaggctgggggaacggctgcggcttgttcggcaaggggagcctcatcacctgtgcgaagttcaagtgtgtgaccaagctagagggcaagattgtccagtacgagaacctgaagtactccgtcatcgtgaccgttcacacgggtgaccaacaccaggtcgggaacgagagcaccgagcacggcaccaccgcgacgatcacgccccaggcccccacgtcggagatccaactcaccgactacggggctctgaccctagattgcagcccccgcacgggcctcgatttcaacgaaatggttttgctaaccatgaaggagaagtcctggctcgtccacaagcagtggttcttagacttaccgctcccctggaccagcggggccagcacctcccaggagacgtggaaccggcaggacctgttggtcaccttcaagacggcccacgcgaagaagcaggaggtggtcgtgctcggaagccaggaaggcgctatgcacaccgccttaacgggggctaccgagatccagacctccggcaccacgacaatcttcgccggacacctgaagtgccgcctaaaaatggacaagctgaccttgaaggggatgagctacgtgatgtgtaccgggtccttcaaattagagaaggaagtggcggagacgcagcacggcaccgttctggtgcagatcaaatacgaaggcacagatgcgccctgcaagatccccttcagcacccaggacgagaaaggggtcacgcagaacggtcggttaataaccgccaacccgatcgtgacggacaaggaaaagcccgtgaacatcgaagccgagccacccttcggggagtcctacatcgtcatcggtgcgggcgagaaggctctgaagctctcatggttcaagaagggtagcagcatcggcaagatgttcgaggccacggccaggggcgcccggcgcatggcaatcctgggggatacggcctgggacttcgggtccatcggcggcgtgtttaccagcgtggggaaattagtacaccagatcttcgggaccgcctatggggtcctgttctctggcgtgtcttggaccatgaaaatcgggataggcgtcctgctgacgtggctcggactgaactcccgctccacgagcctgagcatgacctgcatcgccgtggggctcgtgaccctgtacctgggcgtcatggtgcaggccgactccgggtgtgtgatcaactggaaaggccgcgagctcaagtgcggcagcggcatcttcgtaacgaacgaagtgcacacctggaccgagcagtacaagtttcaggctgactcgccgaagaggctgagcgccgccattggaaaggcctgggaggagggggtgtgcggcatcagaagcgctactcgcctggagaacattatgtggaagcagatctccaacgagctgaaccacatcctgctggagaacgggatgaagttcacggttgttgtgggtgacgtcgtggggatcctcgcgcaaggaaagaagatgatccgaccccagcccatggagcacaagtacagctggaaaagctggggcaaggcgaagatcataggcgccgacgtgcagaatacaacattcatcattgacggtccaaacacaccggagtgccccgacgatcaacgggcctggaacatctgggaggtagaggactacgggttcggcatcttcaccacgaacatctggctaaagctgcgggacagctacacacaggtctgcgatcatcgcctcatgtcagcggccattaaggacagcaaggccgtgcacgctgacatgggctactggatcgagtccgagaagaacgagacctggaagctggcccgagcgagcttcatcgaggtcaagacctgcatctggcccaagtcgcatactctgtggagcaacggggtcctcgagtccgagatgatcatccccaagatttatggagggccgatcagccagcacaactaccgccccgggtacttcacccagaccgccggtccctggcacctaggaaaattggagctagatttcgatctgtgtgagggcaccacggtggtcgtcgacgagcactgcggtaaccggggaccgtccctgcgcaccaccaccgtgacagggaagatcatccacgagtggtgctgtcggagctgcaccctgcctcctctccgctttaaaggcgaggatggttgctggtacggaatggagatccggcccgttaaggagaaggaggagaatttggtaaagtccatggttagcgcaggctccggggaagtcgattccttcagcctcggcctgctgtgcacctccattatgatcgaggaggtcatgcgcagccggtggtcccgcaagatgttgatgactgggacgttggccgtatttttactccttattatgggccagctgacatggaacgacctcatacgactgtgcatcatggtcggggccaatgcaagcgaccgtatgggcatgggcaccacatacctcgcgctcatggcgacgttcaagatgcgaccgatggtggccgtgggtctgctgtttcggcgcctaacctcccgcgaggtcctgctgcttacgattgggctgagcctggtggcctctgtcgagctccccaactctctggaggaattgggtgacggcctcgcgatgggcatcatgatcctgaaactgctaacggacttccaatcccaccagctgtgggccacgctgttaagcctaaccttcatcaagactaccctctctctccattacgcctggaaaacgatggccatggttttgagcatcgtgtccctgttccccctatgcctgtcgaccacctcccagaagaccacttggctgccagtcctccttgggagcctgggctgcaagccgctcaccatgttcctgatcgcggagaacaagatctgggggcgcaagtcgtggcccttaaacgagggtatcatggccgtgggggtagtgagcatcctcttaagctcgctgctcaagaacgatgttcccctagccggccccctgatcgccggcgggatgctcatcgcctgctatgtgatcagcgggtccagcgcggatctttccctggagaaggctgctgaggtcagttgggaggaggaggcggaacactcaggggccagccacaacattctcgtagaggtgcaggacgacggcacgatgaagatcaaggacgaggagcgggacgacaccctgaccatcttgctcaaggcgacgttactggcagtctccggggtgtacccgctcagcatccccgccaccctgttcgtgtggtatttctggcagaagaagaagcagcgcagtggcgtcctgtgggacactcccagcccgcccgaggtggagcgggccgtgctagacgacggcatttaccgcataatgcagcgggggttactgggccgcagtcaggtcggtgtgggagtattccaggagaatgtcttccacaccatgtggcacgtgacgcgcggggccgttctgatgtaccagggcaaacgcttagagcccagctgggcttccgtcaagaaggacctgataagctacggcgggggttggcggctgcaggggtcctggaacactggcgaggaggtccaggtgattgccgtcgagccagggaagaatccaaagaatgtccagacggcccccggcaccttcaaaacgcccgaaggagaggtgggggccatagccctcgatttcaagcccggcaccagcgggtcccccatcgtcaaccgcgaggggaagatcgtgggcttatacggcaacggcgttgtcaccaccagcggcacgtatgtgtcagcgatcgcccaggccaaggcctcccaggagggtccgctgcccgaaatagaggacgaggtgttccgtaagcgcaacctcaccatcatggacctgcaccccgggagcgggaagaccagacgctacctgccggctatagtcagggaagcaattaagcgcaagctccggaccctgatcctggcccccacacgcgtagtagcctccgaaatggccgaggcgctcaagggaatgcccatccggtaccagaccacggccgtcaagtctgagcataccgggaaggagatcgtggacttgatgtgtcacgctacgtttactatgcggttgctctccccggtccgcgtcccgaactacaacatgatcatcatggacgaggcccatttcaccgaccccagttcgatcgcagcgcggggctacatcagcaccagggtgggtatgggcgaagccgctgcaatcttcatgactgcaacgccgccaggctccgtggaggcgtttccgcagagcaacgctgttattcaggacgaagagagggacatccccgagcgatcctggaacagcggctacgagtggatcaccgatttccccggcaagaccgtatggtttgtgccctccatcaaatccgggaatgacatcgccaattgcttacggaagaacggcaagcgcgtcatccaactgtcccggaagactttcgacacggagtaccaaaagacgaagaataacgattgggactacgtggtgaccactgatataagcgagatgggggcaaacttccgcgcggaccgggtcatcgacccgcgccgctgcctgaaacccgtgatactgaaggacgggccggagcgcgtgatcctggccgggcccatgccggtgaccgtggcctctgccgcacagaggcgcggccggatcgggcgcaatcacaacaaggagggggaccaatacatctacatgggccagccgctcaataacgacgaagaccacgcacactggaccgaggcgaagatgttattggacaacatcaacacacccgaggggattatccccgcactcttcgagccggagcgggagaagtccgccgccatcgacggcgagtaccgcttgcgcggggaggcgcggaagactttcgtcgagctgatgaggagaggggacctacccgtgtggttatcctacaaggtggcctcggaaggattccagtacagtgaccgcagatggtgcttcgacggggagcggaacaaccaggttctggaggagaacatggacgttgaaatctggaccaaggagggtgaacggaagaaactccgccctcgatggctggatgcccgcacctactccgacccactggccctccgggagttcaaagagtttgccgcggggcgccgctccgtgtccggcgacctgatactggagatcgggaagctcccgcagcatctcacccagcgcgctcagaacgcccttgacaacctcgtcatgctgcacaacagtgaacagggcggacgggcctatcgccacgcgatggaggaactgcccgacacgatcgagaccctcatgttgctggccctcatagccgtgctaaccgggggcgtgaccttattcttcttgtcagggcgcggcctgggaaagacgagcatcgggttactgtgcgtcatggcctccagcgtgctgctgtggatggcatccgtggagccccactggatcgccgcgtcaataattctcgagttctttctgatggtcctcttaatccccgagcccgaccgccagcggacgccccaagacaaccagttagcctacgtagtgatcggcctcctctttatgatcctaactgtcgccgccaatgagatggggctgctcgagaccaccaagaaagacctgggcatcgggcacgtggcggtggaaaaccaccaccatgccacgatgctggacgtcgacctccatcccgctagtgcctggaccttatacgccgtggcgaccaccataatcacgccgatgatgcgccacaccatcgagaataccaccgccaacataagcctaacggccatcgccaaccaggcggcgatcctcatgggcctggataagggctggccaatttccaagatggacatcggggtccccctgctcgctctgggatgttatagccaggtcaaccccctgacgctcacagctgccgtgctgatgttggtggcgcactacgcgatcatcgggccaggactccaagccaaggctaccagggaggcccaaaagcgtacggcggccggtatcatgaaaaaccccaccgtcgacggcatcgtggccatcgaccttgaccccgtcgtatacgatgccaaattcgagaaacaactgggccaaataatgctcctaatcctgtgcacatcccaaatcctcctgatgcgcacgacgtgggccctgtgcgagagcatcaccctcgcgacggggcccctgaccacgctgtgggaaggctcccctgggaaattctggaacaccaccatcgccgtgtccatggcgaacatcttccggggctcctatctcgccggagccgggctggcgttcagcctgatgaagtccctcggcgggggccgccgggggaccggagcccagggcgagacgctgggggagaagtggaaacggcaactgaaccagctctccaagagcgagttcaatatatacaaacggtccggaatcatggaggtggatcgctcagaggccaaggaggggctaaaacggggcgagacaacccgccacgccgtctcacgggggaccgccaagctccgctggttcgtggagcggaatctggtgaagccggagggcaaggtcatcgaccttggctgcggacgcggcgggtggagctactactgcgccggccttaagaaagtgacggaggtgaaggggtatacaaaaggaggccctgggcatgaggagccaatcccgatggcgacctacggctggaacctggtcaagctccactccgggaaggacgtattcttcacgccgcccgagaaatgcgacacgctgctgtgcgatatcggcgagagctcccccaatccgaccatcgaggaggggcgcaccctacgcgttctgaagatggtcgagccctggctgaggggaaatcagttctgcataaagatcctgaacccatacatgcccagcgtggtggaaaccctggagcaaatgcaacgcaagcatggcggaatgctcgttcggaacccgctctccaggaacagcacccatgagatgtactgggtgtcctgcgggacgggcaacattgtcagcgcagtcaatatgacctctcgaatgctgctgaaccgattcacgatggctcaccgaaagcctacctacgagcgggacgtggaccttggagcgggcacccgccacgtggccgtcgagcccgaggtggccaacttggacattatcgggcagcggatcgagaacatcaagcacgagcacaaaagcacctggcactatgacgaggacaacccctacaagacctgggcttatcacggctcctacgaggttaagcctagcggatccgcgtccagcatggtgaatggcgtggtcaagctgttaaccaagccctgggacgtgatccccatggtgacgcagatcgcgatgaccgacaccacccccttcggccagcagcgcgtcttcaaggagaaggtggacacgcggaccccaaaggcgaagcgcgggaccgcccagatcatggaagtaaccgcccgatggctgtggggcttcctgtcccggaacaagaaacctcggatctgcacgcgcgaggagttcacccgcaaggtccgctccaatgctgcaatcggggccgtgtttgtggatgagaatcagtggaactctgccaaggaagccgtcgaggacgagcgattctgggatctcgtgcagaaagagcgggaactccataagcaggggaagtgtgcgacctgtgtctacaacatgatggggaagcgggagaaaaagctgggcgagttcgggaaggccaagggcagcagagcaatctggtacatgtggctcggcgcccgcttccttgagtttgaggccctggggttcatgaatgaggatcactggttctcccgcgagaactcgctctctggcgtcgagggggagggcctgcacaagctaggttacatcctccgggacatcagcaagatccccggcggcaatatgtacgctgacgacaccgccggttgggacacccgcatcaccgaggacgacctgcagaacgaggcaaagatcactgacatcatggagccggagcatgctctgcttgctacctccatcttcaagctgacgtatcagaataaggtggtgcgggtccagcgccccgcgaaaaacggaaccgtgatggacgtcatcagccgccgtgaccaacgagggtcaggccaggtcggcacatatgggctgaacaccttcacgaacatggaggcccaactcatcagacaaatggagagcgagggcatcttcctgccctccgaactggagacccccaacctcgccgagcgcgtgctagactggctggagaagtacggggtggagcggctcaagcgcatggctatcagcggcgacgattgcgtcgtgaagccaatcgacgaccggttcgccaccgccctgactgccctgaatgacatggggaaggtgcgcaaggacatcccccaatgggagccctccaaggggtggaatgactggcagcaggtccccttctgctcacaccacttccaccagctgatcatgaaggacggccgcgagatcgtggttccgtgccgtaaccaggacgagctggtagggagagcccgcgtgtcccagggagccgggtggagcttacgggagacggcttgcctaggcaagagttatgcacagatgtggcagctgatgtacttccacaggcgggacttgcgcctcgctgccaatgccatctgttccgccgtacccgtcgactgggtgcccacctcccggaccacctggtccatacacgcccaccaccaatggatgacgaccgaggatatgctgagcgtctggaaccgcgtctggatcgaggagaacccctggatggaggataaaacgcacgtgtccagttggggcgacgtgccgtacctgggcaagcgtgaggaccagtggtgcggctccctcattgggctgactgcccgcgccacctgggcctccaatatccaggtcgcgatcaaccaagtgcgcaggctgatcggtaacgagaactacctcgactatatgacgagcatgaagaggttcaaaaacgagggggaccccgagggcgcactgtggtga

SEQ ID NO: 24347 - RNA, 9879 nt, synthetic construct
  misc_feature 1..9879: note = derived and/or modified CDS sequence (opt11) from DENV-1__FJ882565__SS-prME
  source 1..9879: mol_type = other RNA
agcgtgaccatgctgctcatgctgatgcccaccgccctggcgttccatctaaccacccggggcggagagccacacatgattgttaccaagcaggaacggggcaagtcgctgctgttcaagacctcggcgggggtcaacatgtgcactctgatcgccatggacctgggcgagctgtgtgaggacacgatgacttacaagtgccctcgcatcaccgaggccgagcccgacgacgtagactgctggtgcaacgccaccgacacttgggtgacgtacgggacctgctctcagacgggcgagcacagacgcgacaagcggtccgtggcgctcgcgccccacgtaggcctcggcctggagactaggactgaaacctggatgtccagcgaaggagcctggaaacagatccagcgcgtggagacatgggccctccgccaccccggtttcaccgtcatcgccctgttcctcgcgcacgccatcgggacatccatcacccagaagggtataattttcatcctcctgatgttggtgacgcccagcatggcaatgcggtgcgtcggcatcgggtcccgcgatttcgtggaggggctcagtggtgccacgtgggtggacgtcgtgctggagcacgggagttgcgtgaccaccatggccaaggacaagccaaccctggacatcgagctcctgaagaccgaggtcaccaacccggcggtgctgcgtaagctctgtatagaggccaaaataagcaataccacgaccgattcccgctgccccacccagggggaggcaaccctgatggaggagcaagacgcgaacttcgtgtgccgtcgcacgttcgtcgaccggggctgggggaacggttgcgggctgttcggcaaggggagcctcattacgtgcgccaagttcaagtgcgtgaccaaactggagggcaaaatcgttcaatacgagaacctgaagtactccgtcattgttaccgtgcacacgggcgaccagcaccaggtcgggaacgagagcaccgagcacggcaccactgcgaccataacgccccaggcccccacctcagagatacagctcacggactacggggccctgaccctggactgcagcccccgcacgggccttgacttcaacgagatggtactgctgaccatgaaggagaaatcctggctcgtccacaagcagtggttcctggatttaccgcttccctggacctccggggccagcacctcccaggagacgtggaaccggcaggatctgctagtgaccttcaagaccgcccacgcgaagaagcaggaggtggtcgtcctcggcagccaagagggggccatgcacactgccctgaccggggccaccgagatacagacctcaggcaccacgacgatattcgccgggcatctgaagtgcaggctgaagatggacaagctgactttaaagggcatgagctacgtgatgtgcaccgggtccttcaagttggagaaggaggtcgccgagacgcagcacggcactgttcttgtgcagattaagtacgagggcaccgacgccccctgcaagatccccttcagcacacaggatgagaaaggggtcacgcagaacggccgactaattacagcaaacccgatcgtgaccgacaaggagaagcccgtgaacatagaggccgagccacccttcggggagtcctacatcgtcatcggcgcgggcgagaaggcactgaaactcagctggttcaaaaaggggtccagcatcggaaagatgttcgaggccacagcccgcggggcacggcgcatggcgattctgggagatacggcctgggacttcggatccattggcggcgtattcacaagcgtggggaaactggtccaccagattttcggcacggcctacggggtcctcttctccggcgttagctggaccatgaagatcgggataggagtgctgcttacgtggctaggcctcaattcccgctctacatccctgagcatgacctgcatcgccgtgggactcgtgaccctgtacttaggcgtcatggtgcaggccgactccggatgcgtgattaactggaagggccgagagctcaagtgcgggagcgggatattcgtcacgaacgaggtgcacacttggaccgagcagtacaagttccaggccgacagcccgaagcgcttatcggccgcgatcggcaaggcgtgggaggagggggtgtgcggcattcggagtgccacccgcctggaaaacatcatgtggaaacagatttccaacgagctcaaccacatcctgctggaaaatgacatgaagttcaccgtcgtggtgggtgacgttgtgggcatcctcgcgcaggggaagaagatgatacggccccagcccatggagcacaagtatagctggaagtcgtggggcaaggccaagatcatcggcgccgatgttcagaacacgaccttcatcatcgacgggcccaacaccccggaatgccccgacgaccagcgtgcttggaacatctgggaagtcgaggactacggtttcgggatctttaccactaatatatggctaaagctgcgggggagctacacccaggtctgcgaccaccgcctcatgtccgcggccatcaaggactcgaaggcggtgcacgccgacatgggatactggattgagtccgagaagaatgagacgtggaagctggcccgggcaagcttcatcgaggtcaagacttgtatctggcccaaatcccacacgctatggtccaacggggtgttggagagcgagatgatcattcccaagatttacggcgggccgatcagccaacacaattaccgccccggctacttcacccagaccgccgggccctggcacctgggcaagctggagctcgacttcgatctgtgcgagggcaccaccgtcgtcgtggatgaacattgtgggaatcggggcccgtccctgcgcaccaccaccgtgacggggaagattatacacgaatggtgttgccggagctgcacactgccaccattgcgattcaagggcgaggacgggtgttggtacggcatggagatccgacccgtaaaagagaaggaagagaaccttgtcaaatccatggtgagcgccggcagtggggaggtcgacagtttcagtctcggcctgttgtgcatctccatcatgatcgaggaggtcatgcgctcgcggtggtcgcgcaaaatgctcatgaccgggaccctggccgtgttccttctcttgatcatgggccagctgacgtggaacgatctaattaggctgtgcatcatggtcggggccaacgcgtcggaccgcatgggcatgggcacgacctacctggcattgatggcaaccttcaagatgcgacctatgttcgcagtggggctgcttttccggcgcctcacgagtcgggaggtactgctgctcaccatcggattgagcctggtcgcttccgtggagctccccaactccctagaggagctgggagacggcctcgccatgggaattatgatcctgaagttactaaccgattttcagtcccaccagctttgggccaccctgctcagtctgacgtttatcaaaaccaccctctcccttcactatgcctggaagaccatggccatggtcctgagcattgtatcgctcttccccctatgcctgagcacgacctcccagaagacaacctggctgcccgtgttgctgggctctctgggctgcaagccattaacaatgttcctgatcgcggagaacaagatttgggggcgcaagtcatggcccttgaacgaaggaatcatggccgttggggtggtgagcattctcctgtcctccctgcttaagaacgacgtccccctggcaggccccctgatcgctggcgggatgctcatcgcctgctacgtgatcagtggctctagcgcggatctgtccctggagaaggcggccgaagtgtcttgggaggaggaggccgagcactccggggcgagccacaacatcctcgtcgaggtgcaggacgacggaaccatgaagatcaaagatgaggagcgggatgacaccttgacaattctgctaaaggcgactctgctggccgtgagtggggtctacccgctcagcattcccgctacactattcgtgtggtacttctggcagaagaagaagcagcgctccggcgtgctatgggacactccctcgcctcccgaggtcgaaagggccgtgctcgacgacggaatctaccgcatcatgcagcgggggctgctgggtcgctctcaggtaggtgttggagtgtttcaggagaacgtgttccacaccatgtggcacgtcacccgcggggccgtgctgatgtatcaaggaaaacgcctcgagccaagctgggcgtcggtcaagaaggacctgatctcttacggtgggggatggcggctgcagggctcctggaacacaggtgaggaggtccaggtgatcgcagtcgagcccggtaaaaaccccaaaaacgtgcagaccgcccccggcaccttcaaaacccccgagggcgaggtgggggccatcgcactcgactttaagcccggcaccagcgggagtcccatcgtgaaccgcgaggggaagatcgtcggcctgtacggaaacggcgtggtgaccaccagcgggacctacgtcagcgcgatagcccaggccaaggcctcccaggagggtccgctgcccgaaatcgaggacgaagtgttccggaaacgcaacctcacgatcatggatctgcaccccgggagcggcaagacccggcgctatctgccggcgatcgtgagagaggcaatcaagcgcaagctgcggaccctgatcctggcccccacccgcgtcgtggcctccgagatggcagaggcgctaaagggaatgcccatccgctaccagacgaccgccgtcaagagcgagcacacaggcaaggagatcgtcgacctgatgtgccatgccaccttcacgatgcggctgctatcccccgtgcgcgtgccaaactacaacatgataatcatggacgaggcccatttcaccgaccctagctccatcgccgcgcgggggtacatcagcaccagagtcggcatgggcgaggccgccgccatcttcatgaccgccactcctcccgggtccgtggaagcctttccccagagcaacgccgtgattcaggacgaggagcgcgacatcccagagcgctcctggaacagcggctacgagtggatcaccgacttccccggcaagaccgtctggttcgtgccctcaatcaagagcggtaacgacatcgccaactgtctgcggaagaacggcaagcgcgtgattcagctgtcccggaagaccttcgacacggaataccaaaagactaagaacaacgactgggactatgttgtgaccaccgacatatccgagatgggagccaatttccgcgcggaccgggtcatcgacccgcggcggtgcctcaagcccgtcatactaaaggacggccccgagcgcgtgatcctggccggaccaatgcctgtcacggtggcctctgccgcccagcggcgtggccggatcggccgcaaccacaataaggagggggaccagtatatctatatgggccagcccctaaacaacgacgaggaccacgcgcactggaccgaagccaagatgcttctggacaacatcaacaccccagaggggatcatcccggcccttttcgagccggagcgggagaaatccgccgccatcgatggcgagtaccgcctgaggggagaggctcggaagacgttcgtggagttgatgcgcaggggcgacttgcctgtctggctgtcttacaaagtggccagcgagggtttccagtacagcgaccgccggtggtgtttcgacggggagcgcaacaaccaggtgctggaggagaacatggacgtcgagatctggacgaaggagggcgaacggaaaaagctccgcccccgctggctggacgcccgcacctactcagaccccctggccctccgggagtttaaggagttcgccgcggggcgccggagcgttagtggggacctcatattggaaatcggaaagctcccgcagcacctgacccagagggcccaaaacgccctcgacaacctcgtgatgctccataacagcgagcagggcgggagggcttaccgccacgctatggaagagctgcccgacacgatcgagactctcatgctcctggccctcattgccgtcctaaccgggggcgtaacgctgttcttcttgtccggccgcggcctgggaaaaacgtcaattgggttgctctgtgtgatggcctccagcgtcctgctgtggatggcctccgtggagccccactggatcgcggccagcatcatcctcgagttcttcctgatggtgttactcatcccagaaccggaccgccagaggacgccccaggacaaccagttggcatacgtcgtgatcggcctcctctttatgatactgactgtggcagccaacgagatggggttactcgagaccaccaagaaggacttaggcatcggtcatgtcgctgtcgaaaaccaccaccacgcgaccatgctggacgtcgacctccaccccgcctccgcctggacgttgtacgccgtcgcgaccacaatcatcacaccgatgatgcgccacacaatcgagaacaccactgccaacatcagcttgaccgccatcgccaaccaggccgcgatcctcatgggcctggacaaggggtggcccatctccaagatggacataggagtgcccctgctcgcgctgggatgctacagccaggtgaaccctctgaccctcaccgccgcggtcctgatgctggtggcgcactacgccatcataggccccggtctccaggcgaaggccacccgggaggcccaaaagcgcaccgcggccgggatcatgaagaaccccacggtagatggcatcgtcgccatcgacctggaccccgtggtttacgacgccaagttcgagaagcaactgggccagataatgctcctgattctgtgcacctcccaaatcctcctgatgcgcaccacctgggccctgtgcgagtctatcacattagcgaccggtcctttgaccaccctgtgggagggctcaccggggaaattttggaacacgaccattgccgtcagcatggccaacatcttccggggctcctacctcgccggcgccgggctggcgttcagcctgatgaagtccctcggcgggggacgccgggggacaggcgcccagggcgagaccctgggggagaagtggaaacgccagctgaaccagctcagcaaaagcgagttcaacatttacaagcggtccggcatcatggaggtagaccgcagcgaggccaaggaggggctgaagcggggcgagacgacccgccacgccgtgtcccgggggaccgcgaagctgcgctggttcgttgaacggaacctggtgaagcccgagggtaaggtgatcgacctcggctgcggccgtggcgggtggagctactactgcgccggcctgaagaaggtcaccgaggtgaaagggtacacgaagggcgggcccgggcacgaagagccgatccccatggctacctacggctggaatcttgtgaagctccattccggaaaggacgtcttcttcacgcctcccgagaaatgcgacaccctgctgtgcgacatcggcgagagctcccccaacccgaccatcgaggaggggcggaccctccgcgtgctgaagatggttgaaccctggttgcggggcaatcagttctgcatcaagatcctcaacccctacatgcccagcgtcgtggaaaccctagagcagatgcagcgcaagcacggcgggatgttggtgcggaacccgctttcccgcaacagcacgcacgagatgtactgggtctcctgcggcaccgggaacatcgtgagcgccgtgaatatgacttccagaatgttactgaaccgcttcaccatggcccaccgaaaacccacctacgagagagacgttgacctcggcgcgggcacccgccatgtggcggtggagcccgaagtcgccaacctggacattatcggtcagcggattgagaacatcaagcacgagcacaagagcacgtggcattatgacgaggacaacccgtataagacctgggcttaccacggctcctatgaggtcaagcctagcgggtccgcttctagtatggtcaacggggtggtgaagctgctcacgaagccctgggacgtgataccgatggtaacccaaatcgcgatgaccgacaccactccgttcgggcagcagcgcgtgtttaaggagaaggtagacacccggacgccgaaggcaaagagaggcaccgcgcagattatggaggtaacggcccggtggctgtggggcttcctgtcccgcaataagaagccccggatctgcacccgcgaagagttcacgcggaaggttcgcagcaacgccgcgattggcgccgtttttgtcgacgaaaaccagtggaactccgccaaagaggcagtggaggacgagcggttttgggacctcgtccagaaggagcgcgagctgcacaagcagggcaagtgtgcgacctgcgtctacaacatgatggggaagcgggagaagaagctgggcgagttcgggaaggccaagggtagccgcgccatctggtacatgtggctcggcgcccgattcctggagttcgaggccctggggtttatgaacgaagatcactggttctccagagagaatagcctctctggcgtggagggggaaggcctgcacaagctgggctacatcctccgtgacatcagcaagatccccggcggcaacatgtacgcggacgacaccgccgggtgggacactcgcataacggaggacgacctgcagaacgaggccaagataaccgacattatggagccggaacacgccctgctcgccacctccattttcaagctgacctaccagaacaaggtcgtccgagtgcagcgccccgcgaaaaacggcacggtcatggacgtaatctctcgccgcgaccagcgcgggtccggccaagttggtacctacggtctgaacaccttcaccaacatggaggcccagctcatccggcaaatggagagcgaaggcatcttcctgccctccgagctggagactcccaacctcgccgagcgcgtcttggactggttggagaagtatggcgtggagcggctcaagcgcatggcaatcagcggcgacgactgcgtggtcaagcctatcgacgaccggttcgccaccgcgctgaccgccctgaacgacatggggaaggttcgcaaggacatcccccagtgggagcccagcaagggctggaacgattggcagcaggtcccgttctgcagccaccacttccaccagctcattatgaaggacggccgggagatcgtcgtcccgtgcagaaaccaggacgagctggtgggacgggcgcgcgtctcccagggcgccgggtggagcctgcgggaaactgcatgcctcggcaagagctacgcgcagatgtggcagctgatgtacttccaccgccgggacttacgcctcgccgccaacgccatctgctcggcagtgcccgtggactgggtccccacgagccggaccacctggagcatccacgcccaccaccagtggatgaccacggaggacatgctgagcgtgtggaaccgcgtgtggatcgaagagaacccctggatggaggacaagacccacgtctctagctggggcgatgttccgtaccttggcaagcgggaggaccagtggtgcggctcgctcatcgggcttaccgcccgcgccacctgggccagcaacatccaggtggcgatcaaccaggtccgccggctgatcggcaacgaaaactacctcgactacatgacctccatgaagcgcttcaagaacgagggggaccctgagggcgccctgtggtga

SEQ ID NO: 24348 - RNA, 9879 nt, synthetic construct
  misc_feature 1..9879: note = derived and/or modified CDS sequence (opt11) from DENV-1__FJ882567__SS-prME
  source 1..9879: mol_type = other RNA
tcggtgaccatgcttctcatgcttatgcctaccgccctggcctttcacctgaccacgcggggcggggagccccacatgattgtgaccaagcaggaacggggcaagagcctgctgttcaagacctcagcgggggtgaacatgtgcaccctcatcgccatggacctgggcgaactgtgcgaagacaccatgacctacaagtgtccacgcatcaccgaggccgagcctgacgacgtggactgctggtgcaacgccaccgacacctgggtgacatacgggacctgctctcaaacgggcgagcaccgccgcgacaagcggagcgtggccctcgcgccccacgtgggcctggggctggaaacccgtaccgagacctggatgtcaagcgagggtgcctggaagcagatccagcgcgtcgagacgtgggccctccgccaccccgggttcaccgtgatcgccttatttttagcgcacgcaatcggcacctccatcacccaaaagggaatcatcttcatcctcctgatgctggtaacgcccagcatggccatgagatgcgtcggcatcggctcccgcgacttcgtggaggggctcagcggcgccacctgggtagacgtcgttctggagcacggctcctgcgtgaccaccatggccaaggacaagccgacgctggacatcgaactgctaaagaccgaggtcaccaaccccgctgtcttacgaaagctctgcatagaggccaagatcagcaacactaccaccgacagtcgctgcccaacgcaaggcgaggccacgctgatggaggagcaggacgcaaacttcgtctgccggcgcacgttcgtcgacagaggctgggggaacggctgcgggctattcggcaagggttcactaatcacgtgcgccaagttcaagtgtgtaaccaagctggagggcaagatcgtccagtacgagaacttgaagtactccgtcatcgtcaccgtgcacacgggcgaccagcaccaagtcgggaacgagtcgactgaacacggcaccaccgcgaccatcacgccccaggcccccacgtctgagattcagttgaccgactacggtgcccttacccttgactgcagcccccgtacaggcttagacttcaacgagatggtgcttctgaccatgaaggagaagtcctggctcgtccacaagcagtggttcctcgacctgcctctcccctggaccagcggggccagcacttcccaggagacgtggaatcggcaggaccttttggtgacattcaagaccgcacacgcgaagaagcaggaggtggtcgtgctcggcagccaagaaggcgccatgcacaccgccctgacgggagccactgagattcaaacttccggcaccacaaccatcttcgccgggcacctgaagtgcaggctcaagatggacaaactgacgctaaagggcatgagctacgtgatgtgcactgggtccttcaagctcgaaaaagaggtagccgagacacagcacggcaccgttctggtgcagatcaagtacgaaggcaccgacgccccctgcaagatccccttctctactcaggatgagaagggtgtcacgcaaaacggccggcttattaccgccaacccgatcgtcaccgacaaggagaagcccgtgaatatcgaagccgagccgcccttcggggaatcctacatcgtcatcggcgcgggcgaaaaggcactgaagctctcatggttcaaaaaggggtccagcatcggcaagatgttcgaggccactgcgcgcggggcacggcgcatggcgattttgggagacactgcctgggacttcgggtccattggcggcgttttcaccagcgtggggaagctggtccaccaaatatttggcaccgcctacggggtcctgttctccggcgtgtcatggaccatgaagatcgggatcggcgtcctgctgacatggctcgggctgaacagtcgcagcaccagcctgagcatgacctgcatcgccgtaggcctcgtgaccctgtacctgggcgtcatggtgcaagccgattctggctgcgtcatcaattggaagggccgggagctcaaatgcggaagtggcatcttcgtcacaaacgaggtgcacacctggaccgagcagtacaagttccaagcggacagcccgaagcgcctgtccgccgcaatcggcaaggcgtgggaagaaggtgtgtgtgggattcggagcgccaccagactggagaacatcatgtggaaacagatctccaacgagttgaatcacatcttgctggagaacgggatgaagttcacggtcgtagtgggcgacgtcgtggggatcctcgcgcagggcaagaagatgatccgaccccaacctatggagcacaagtactcttggaagtcctggggcaaagccaaaatcatcggggcggacgtgcaaaacacgaccttcatcatcgacggccccaatacaccggagtgtcccgacgaccaacgggcctggaatatctgggaagtcgaggactacggtttcggcatcttcactacgaacatctggctgaagctgcgcgatagctacacccaagtgtgcgaccatcggttgatgtcggcggccattaaggactccaaggccgtgcacgccgatatgggctattggatcgagtccgagaagaatgagacctggaagctggcccgggctagcttcatcgaggtcaagacatgcatatggcccaagtcccacaccctgtggagcaacggggtgttagagagcgagatgatcatcccaaagatctacggagggccaatcagccagcataactaccgccccggctacttcacccaaaccgccggcccatggcacctgggcaaactggagctggacttcgacttgtgcgagggcacgactgtggtcgtggacgagcactgcgggaacaggggaccgtccctgcgcactacgactgtaacggggaaaatcatccatgagtggtgttgcaggagctgcaccctgccgccactccgcttcaagggcgaggacgggtgctggtacggcatggagatccgacccgtcaaggagaaggaggagaacctggtgaagtccatggtgagcgccggcagcggtgaggttgactccttctcactcggcctgctgtgcacctccattatgatcgaggaagtgatgagaagccggtggtcccgcaaaatgctcatgaccgggacgctggccgtgttcctgttattgataatgggacagctgacctggaacgatctcatccggctgtgtatcatggtcggggccaacgcgagcgatcgaatgggcatgggcaccacctacctcgcactcatggccacgttcaaaatgcgcccgatgttcgccgtgggcctgctgttccggcgcctcacaagccgggaagtgctgctgctcaccattggactgagcctggtcgcgtccgtggagctcccgaacagcctggaggagttgggggacggcctcgcgatgggcatcatgatcctgaagctgctcaccgacttccagagtcaccaactgtgggctacgctgctcagcttgacctttatcaagaccaccctatccctccactatgcctggaagactatggcaatggtactgagcatcgtgagcctgttccctctctgtctgagcaccacgtcccaaaaaaccacgtggctgcctgtcctactggggagcctgggatgtaagccgctcaccatgttcctgattgcggagaacaagatctgggggcgcaagtcctggcccctgaatgagggcatcatggccgtcggggtggtgagcattctcctgagctccctgctcaagaacgacgtcccgctcgccggccccctgatcgctggcgggatgctcatcgcctgttacgtgatctcgggcagtagcgcggatctgtccttagagaaggccgccgaggtgagctgggaagaagaggccgagcactctggggcttcccacaacatcctcgtagaggtgcaggacgacggcaccatgaagatcaaggacgaggaacgggacgacaccttaactatcctcctcaaggcgacgttactggccgtgtctggggtttacccgctcagcatccccgccaccctattcgtgtggtacttctggcagaagaagaagcagcgctccggagtgctgtgggacacccccagcccgccggaagtggaacgggcagtgctggatgacggcatttaccgcatcatgcagcgtggcctactgggccgatcccaggtgggggtcggcgttttccaggagaacgtttttcacaccatgtggcatgtaacgcgtggggccgtgctgatgtaccagggcaagcgcctcgagcccagctgggcatcggtgaagaaggacctgatcagctacggcgggggctggagactccaggggtcctggaacaccggtgaggaagtccaggtgatcgccgtcgagcccgggaagaaccccaaaaacgtccaaaccgctcccggcaccttcaagacgcccgagggagaggtgggagcgatcgccctcgatttcaagccgggcaccagcgggagcccgatcgtgaaccgcgagggcaagatcgtcggcctgtatgggaatggcgtggtgactaccagcggaacgtacgtcagcgcaatcgcccaggccaaggcctcccaggagggaccgctacccgaaatagaggacgaggtattccgaaagcgcaacctcactatcatggatctgcaccccgggagcgggaagacccggcgctacctgccggcgatcgtgcgggaggccattaagcgcaagctccggaccctgatcctggccccaacgcgtgtcgtggcctcagagatggcagaggcgctcaaggggatgccaatccgctaccagacaaccgccgttaagagcgagcacaccggcaaggaaatcgtcgacctaatgtgccacgcgacgttcacgatgcggctgctctcccccgtccgcgtgccgaactacaacatgatcatcatggatgaggcccatttcaccgacccctcatccatcgccgcgagaggttacatcagcacccgagtcgggatgggggaagccgctgccatctttatgacggccacgccccccggctcggtggaggcgttcccgcagagcaatgccgtgatccaggacgaggaacgagacatacccgagcgctcctggaacagcggctacgagtggatcaccgacttccccggcaagaccgtatggttcgtgccttccatcaagagcgggaacgacatcgcgaactgtctgcgtaaaaacggcaagcgcgtgatacagctgtcccggaagacgttcgacaccgaatatcagaagaccaagaacaacgactgggactacgtggtgactacggacatatccgagatgggggccaacttccgcgcagaccgggtgatcgacccgcgccgttgcctcaagcccgtcatcctgaaggacggccccgaacgtgtgatcctggccgggcccatgccggtcaccgttgcctccgctgcccagcggcgcggccggatcggccgcaaccataacaaggagggggaccagtatatctacatgggccagcccctcaacaacgatgaagaccatgcgcactggaccgaggccaagatgctgctggacaacatcaatacacccgaggggatcatccccgccctattcgaaccggagcgggagaagtccgcggccatcgacggcgagtaccgcctgcgaggggaggcgcggaagacgttcgtggagctgatgcgacggggagacctccccgtctggctgtcctacaaagtggccagtgagggcttccaatacagcgacaggcgctggtgcttcgacggggagcgcaacaaccaggtgctggaggagaacatggacgtagagatctggaccaaggagggcgagcgcaagaagctccgcccccggtggctggacgcccgcacctactccgacccactggccctccgggagttcaaggagttcgccgcggggcgccggtcggtttccggcgacctgatcctcgagatcggcaagctcccgcagcacctgacccagcgcgcccagaacgcactggacaacttagtgatgctgcacaacagcgagcagggagggcgggcctaccgccacgcgatggaggagctgcctgacacgatcgagaccctcatgttactggccctcatcgcggtcctgactgggggcgtcaccctctttttcctatccgggcggggcctgggcaaaaccagcatcgggctgctctgcgtgatggcctcaagcgtcctgttgtggatggcctcagtggagccccattggatcgcggcaagcatcatcttggagttcttcctgatggtgctgctgattcccgagccggaccgccaaagaacgccccaggacaaccagctggcctacgtcgtgatcggcctgctattcatgatcctgactgtggccgcaaacgagatgggcctgcttgaaaccaccaagaaggacctgggcatcgggcatgtcgccgtggagaaccaccaccacgccacgatgctggacgtggacctccaccccgccagcgcctggaccctttacgccgtcgcgaccacaatcatcacgccgatgatgcgccacactatcgaaaacacgaccgccaacatcagtcttaccgctatcgctaaccaagcagcaatcctaatgggactagacaagggctggcccatctccaagatggatatcggggtgcccctgctcgccctgggctgctacagccaggtgaatcccctgaccctcaccgccgccgttctgatgctggtggcgcactacgcaatcatcgggcctgggctccaggccaaggcaacccgggaggcccagaagcgcacggccgccgggatcatgaaaaatcccaccgtggacggcattgtcgccatcgacctggaccccgtggtgtacgacgcaaagttcgagaagcagttgggccagatcatgctgctgattctgtgcacatcccagatcctcctgatgcgcaccacgtgggccctgtgcgaatcaatcaccctcgctacggggcccctaaccacgttatgggaaggcagtcctgggaagttctggaataccaccatcgccgtcagcatggccaacatcttccgaggctcctatcttgccggagccgggctggcgttcagtcttatgaaatccctcggcgggggccggcgggggaccggcgcgcagggagagacgctgggggagaagtggaaacgccagctgaaccagctctcaaagtcggagtttaacatttacaagcggtcaggcataatggaggtggaccgcagcgaggccaaggaggggctaaagcggggcgagactacccgccacgccgtgagccgggggaccgcgaagcttcgctggttcgtcgagcgcaacctggtgaagcccgagggcaaggtgatcgacctgggctgcggtcgcggcgggtggtcatattactgcgccggcctgaagaaagtcacggaggtgaagggctacaccaaaggcggacccggccacgaggagccgatcccgatggccacctatggctggaacctggtgaaactccattccgggaaggacgtcttctttacgccgcccgagaagtgcgacacgctgttatgcgacattggcgagagctcccccaaccccaccatcgaagaggggcggaccctgcgcgtgcttaagatggtggagccctggctgcggggaaaccagttctgcatcaaaattctgaatccgtacatgcccagcgtggtggagacactggagcagatgcagcgcaagcacggcgggatgctggtgcggaatcccttatcccgcaacagcacccacgagatgtactgggtctcctgcggcacggggaacatcgtgagcgctgtgaacatgacctcccggatgctgttgaatagattcaccatggcgcaccgcaagccgacttatgagcgggacgtcgacctgggcgcggggacgcgacacgtggccgtggagcccgaggtcgccaacctggacatcatcgggcagcggatcgagaacatcaagcacgagcacaaaagcacctggcactacgacgaggacaacccctataagacctgggcctatcacggctcctatgaggttaagccgagcgggtccgccagcagcatggtcaacggcgtggtcaagctgctcacaaagccctgggacgtcatccccatggttacgcagatcgctatgaccgatacaactccctttgggcagcagcgcgtgttcaaggagaaggtcgatacgcggacccccaaggccaagcgcgggaccgcccagatcatggaggtgaccgcccggtggctgtggggcttcctgtcacgcaataaaaagccccggatctgtactcgcgaggagttcacccggaaggtgcgcagcaacgccgcgatcggggccgtctttgtggacgagaaccagtggaactccgcaaaggaggccgtcgaggacgagcgattttgggacttagtccagaaggagcgcgagctgcacaagcagggcaagtgcgctacatgtgtgtataacatgatggggaaacgtgaaaagaagctgggcgagtttggtaaagccaaaggcagccgcgccatctggtacatgtggctcggtgcccggttcctcgagttcgaagccctggggttcatgaacgaagaccattggttcagtcgcgagaatagtttatccggcgtggagggggagggcctgcacaaactgggctacatcctgcgggatatcagcaagatcccgggtggcaatatgtacgcggatgacacagccgggtgggatacgcgcataaccgaggacgacctgcagaatgaggccaagatcacggacatcatggagccggagcacgccctcctcgccacctccatcttcaaactgacgtaccaaaacaaggtcgttcgggttcaacgcccagcgaagaacggcaccgtcatggacgtgatcagtcgccgtgaccagcgcgggtcaggtcaagtgggcacctacgggctgaacaccttcactaatatggaggcccagctgatccggcagatggagagcgagggcatcttcttgccctccgagctggaaacccccaacctcgccgagcgcgttctggactggctggagaaacacggcgtggagcgtctaaagcgcatggcaatcagcggcgatgattgcgtggtcaagccaatcgacgaccggttcgcaaccgcgctgactgccctgaacgacatggggaaagtgcggaaggacatcccccagtgggagccctccaagggctggaacgactggcaacaggtccccttctgcagccaccacttccaccagctcatcatgaaagacggccgggagatcgtcgttccgtgccgcaatcaagacgagctggtggggcgtgcccgcgtctcccagggcgccgggtggagcctccgggaaacggcctgcctcggaaaaagctacgcacagatgtggcagctgatgtacttccaccgccgggacctgcggcttgccgccaacgccatctgctccgcggtccccgtggactgggtcccgaccagccggaccacgtggtccatacacgcccaccaccagtggatgacgaccgaagacatgctcagcgtgtggaatcgcgtttggatcgaggagaacccctggatggaggacaaaacccacgtctccagctggggcgatgtgccgtatctcggcaagcgggaggaccagtggtgcggctccttaatcgggctgaccgcccgagcaacctgggcctctaacatccaagtggcgatcaaccaggtccgccggctgatcggcaacgaaaactacctcgattacatgacttctatgaagaggttcaagaacgagggtgaccccgagggcgccctgtggtag

SEQ ID NO: 24349 - RNA, 9879 nt, synthetic construct
  misc_feature 1..9879: note = derived and/or modified CDS sequence (opt11) from DENV-1__GQ199831__SS-prME
  source 1..9879: mol_type = other RNA
agcgttaccatgcttctcatgctgatgcccactgccctggccttccacctcaccacccggggaggggaaccccacatgatcgtgaccaagcaggagcggggcaaaagtctgcttttcaagaccagcgccggggtgaacatgtgcaccctcatcgcgatggacctgggggagctgtgcgaggacaccatgacttacaagtgcccacgtataaccgagaccgaacccgacgatgtggattgctggtgcaacgcgaccgacacctgggtgacctacggtacttgcagccagaccggggaacaccggcgcgacaaaagatctgtggccctcgcgccacacgtgggcctgggcctggagacccgcaccgagacatggatgtcgagcgagggcgcctggaagcagatccagcgggtggagacctgggccctacgccaccccggtttcaccgtgatcgccctgttcctggcccacgccataggcacctctattacgcaaaaagggattatcttcatcttacttatgctggtgacccccagcatggccatgcggtgtgtcggcatcggctcccgcgacttcgtcgagggtctcagcggcgccacctgggtagacgtcgtgctggaacatgggtcctgcgtgacgaccatggcaaaggataagccgaccttggacatcgagctcttgaagacggaagtcactaatcccgccgttctgcggaagctatgcatcgaggcgaagatcagcaatacgaccaccgactccagatgccccacccagggagaagccacgctgatggaggagcaggacgccaacttcgtgtgccggcgcaccttcgtagaccgggggtgggggaacggttgcgggctgttcgggaaggggagcctcatcacgtgcgccaagttcaaatgcgtgacgaagctggagggcaagatcgtgcagtacgagaatctgaaatactctgttatcgtcacggtgcacacgggcgaccaacatcaggtaggtaacgaatctaccgagcatggtacgactgccactattacgccccaggcgcccacctccgagatacagctcaccgactacggtgccctgacgctcgactgtagcccccgcacaggcctcgacttcaacgagatggtgctgctgaccatgaaggaaaagtcctggctcgtccacaagcagtggttcctggacctgccgctcccctggacgagcggggcgagcacgagccaagaaacctggaaccggcaggacctgctggtgacatttaaaaccgcacacgcgaagaaacaggaggtggtcgttctcggcagccaggagggcgcgatgcacacggccttgaccggggcaaccgagatacagacctccggtaccaccaccatcttcgccggtcacctcaagtgtcgcctcaagatggacaaactgaccctgaaggggatgagctacgtgatgtgcacggggtccttcaagctcgagaaagaggtcgccgagacccagcacggcaccgtgctcgtgcagatcaagtacgagggcacggacgcgccatgcaagatccccttctccacgcaggacgagaagggggtcacccagaacgggcgactgatcacggctaatccaatcgtgaccgacaaggagaagcccgtgaacatcgaggccgagccgcccttcggggagtcctacatcgtcatcggcgccggcgagaaggcgcttaagctcagctggttcaagaaggggtcctccatcggcaagatgttcgaggccacggcccgcggggcccgacgcatggccatcctgggcgacaccgcgtgggacttcgggtccatcggcggtgtgttcactagcgtggggaagcttgtccaccagatttttggcaccgcgtacggggtcttgttcagcggcgtgagctggacaatgaagatcgggattggcgtcctgttaacctggctcggactgaactccaggtctacctccctgagcatgacttgcatcgcagtggggctcgtgacgctatacctaggcgtcatggtgcaggccgactccgggtgcgtgattaactggaagggtcgggagctcaagtgcgggagcggcatcttcgtcaccaacgaggtgcacacctggaccgagcaatacaagttccaggccgactctcctaagcgcctgtcggctgccatcggcaaggcctgggaggagggggtgtgcggcatccggagcgctactcgcctggaaaacatcatgtggaagcagatatccaacgagctaaatcatatcctcctggagaacgacatgaagttcacggtcgtggtaggggacgtcgtggggatcctcgcccaggggaagaagatgatccggccccagcccatggagcacaagtacagctggaagtcctggggcaaggcgaagatcatcggcgcggatgtgcagaacaccaccttcataatcgacgggcccaacaccccagagtgccccgacgatcagcgcgcatggaacatctgggaggtcgaagactacggtttcggaatcttcacgaccaacatctggctgaaactgcgggactcatacacccaggtgtgcgaccacagactgatgtccgccgcaataaaggacagcaaggccgtgcacgccgacatgggatactggatcgaatccgagaagaacgagacgtggaagctggccagagccagcttcatcgaggtcaagacgtgcatttggcccaagtcccataccctgtggagcaacggcgtgctcgagtccgaaatgatcatccccaagatctatgggggcccgatctctcagcacaactaccgccccgggtactttacccagaccgcgggcccctggcacctggggaagctggagctcgatttcgatctgtgcgagggcacgaccgtggttgtggacgagcactgcggtaaccggggcccatccctacgcaccaccacggttaccggcaagataatccacgagtggtgctgccggagctgtaccctgccccctctacgttttaagggggaggatggctgctggtacgggatggagatccggcccgtcaaggagaaagaggagaatctggtcaagtctatggtcagcgccggcagcggcgaggtcgattccttcagcctcggtctgctgtgcatctccataatgatcgaggaggtgatgcgcagtcggtggtcccgcaagatgctcatgaccggaacactggcggtgttcctactccttatcatggggcagctgacctggaacgacctcatccggctgtgcatcatggtcggcgcgaacgccagcgacaggatggggatgggcaccacctaccttgcgttaatggccacgttcaagatgcgcccaatgtttgctgtggggctgcttttcagacgcctcacctcccgggaggtgctgctgctaaccatcgggttatcacttgtcgcctctgtggagctacccaacagcctggaggagctgggcgatggtctcgccatgggcatcatgatcctgaagcttctcaccgacttccagtcccaccagctgtgggcgacgctgttatccctgacctttatcaagaccaccctgtccctccactacgcctggaagactatggccatggtcttaagcatcgtgtccctgttccccctctgcctgagcaccacatcccagaagaccacgtggctacccgtgctcttgggctcactggggtgcaagccgctgaccatgttcctgatcgctgagaacaagatctggggtcgcaagtcctggcccctgaacgaggggatcatggcggtcggagtggtaagtatcctcctgagctccctgctcaagaacgacgtcccccttgccgggcccttgatcgccggcggaatgctcatcgcttgttacgtgatctctgggtccagcgcagacctgtccctggagaaggcggccgaggtgtcttgggaggaagaggctgagcactccggcgcaagccacaacatcctcgtggaggtgcaggacgacggcaccatgaagatcaaggacgaggagcgggacgacacactgacaatcctgctcaaggccacgctcctcgcggtgagcggtgtataccctctcagcatccccgccaccctgttcgtgtggtacttttggcagaagaagaaacagcgctccggcgtgctgtgggacacccccagcccgcccgaagtcgagcgggctgtgctggacgacggcatctaccgcataatgcagagaggcctcctgggccgctcccaagtgggcgtcggggtgttccaggaaaacgtgttccacacgatgtggcacgtcacgcggggcgcggtgttaatgtaccaagggaagcgactcgaaccctcctgggcatccgtgaagaaagatctgatcagctacggcggcgggtggcggctgcagggttcctggaacacgggcgaggaggtccaggtgatcgcggtggagcccggcaagaaccccaagaacgtccagaccgcccccgggaccttcaagacgcccgagggtgaggtgggcgccatcgccctcgacttcaagccggggaccagcgggtcccctatcgtgaaccgcgaaggtaagatagtcggcttatacggcaacggcgtggtcaccacctcaggcacatatgtcagcgccatcgcgcaggccaaggcctcccaggagggcccgctgcccgagatcgaagacgaggtgttccggaaacgcaacctcacgataatggacctgcaccccggcagcgggaagaccaggcgctacctccctgccatcgtccgggaagcgataaagcgcaagctccggaccctgattctggcgcccacccgcgtcgtagcctccgaaatggccgaggctctcaaggggatgcccatccgctaccagactaccgcggtaaaaagcgagcacaccggcaaggagatcgtcgacctgatgtgccacgccacgtttactatgcggcttctatcccccgtgcgcgtcccgaactacaacatgattatcatggacgaggcccacttcaccgaccccagctccattgccgcccgggggtacatatccacccgggtgggcatgggtgaggcggccgcgatattcatgacggccacgcctccaggatccgtcgaggccttcccgcagtctaacgcggtgatacaggatgaggagcgcgacatccccgagcgatcctggaacagcggttacgagtggataaccgacttccccgggaaaaccgtctggtttgtgccttccatcaagagcgggaacgacatcgcaaactgcctgcggaagaacgggaagcgtgtgatacagctaagcaggaagacattcgatacggagtaccagaagacaaagaacaacgactgggactacgtcgtgaccaccgacatcagcgagatgggcgccaacttccgcgccgaccgggtgatcgatccgcgtcggtgcctcaagcctgtaatcctgaaggacgggccagagcgcgtgattctggcgggccccatgccggtcaccgtggcctccgccgcccagcggcgcgggcgaatcggccgaaatcacaataaggagggcgaccagtacatatatatgggacagcccctcaacaatgacgaggaccacgcgcactggaccgaagcgaagatgctgctggacaacatcaacacccccgagggcatcatccccgccctcttcgagccggagcgggaaaagtccgccgccatcgacggcgagtaccgcctgaggggcgaggcccggaagacgttcgtggaactgatgcgccgaggagacttgcccgtctggctgtcctacaaggtggcgtcggagggcttccagtacagcgaccgccggtggtgcttcgacggcgaacgaaacaaccaggtgttggaggagaatatggacgtcgagatctggaccaaggagggggagcggaagaagctccgcccccggtggctcgacgcccgcacctactcggaccccctggcccttcgggagttcaaggagttcgccgccggccgccggagcgtgtccggggatctgatcctggagatcggaaagctcccgcaacacctgacccaacgtgcgcaaaacgctcttgacaacctcgtgatgttgcacaacagcgagcagggcgggcgggcctaccgccacgccatggaggagctacccgacacaatcgaaactctaatgctgctggcgctcatcgccgtcctgacgggcggggtgacactgttcttcctctccggccgggggctgggcaagaccagcataggcctgctctgcgtgatggcctccagcgtcttgctgtggatggcgtccgtggagccacactggatagcagcgagcattatcctcgaattctttctgatggtactgctgatccccgagccggaccgccagcggacgccccaggacaaccaactcgcgtacgtcgtaatcgggctccttttcatgatacttaccgtggcggccaatgagatgggcctgctcgagaccacaaagaaggacctggggattggccacgtcgctgtggagaaccaccaccacgcgacgatgctggacgtggaccttcacccggcatccgcctggaccctctacgccgtcgccaccaccatcatcacgcctatgatgcgccacacaatcgagaacacaaccgcgaacataagcctgacggccatagcaaaccaggcggccattctcatggggctggacaagggttggccaatctccaagatggatatcggagttcccctgctcgcgctggggtgctatagccaagttaacccgctgaccctgaccgccgccgtcttgatgctggtggcccactacgccatcatcgggccggggctacaggccaaagccacccgggaagcccagaagaggacggccgcgggcataatgaaaaaccccaccgtggacggaattgtagcgatcgacctggaccccgttgtgtatgatgccaagttcgagaagcagctgggccagataatgctgctgatcctgtgcacctcccagatcctcctgatgcgcaccacgtgggccctgtgcgagagcatcacccttgccaccggccccctgaccaccctgtgggaggggagtccgggcaaattttggaacacaaccatcgcggtcagcatggccaacatcttccgggggagttacctcgccggcgccggcctggccttcagcctgatgaagtccctcgggggcgggcgccgcggcaccggggcgcagggcgagaccctgggcgaaaagtggaagcgccagctgaatcagttgagtaagagcgagtttaacatctacaaaagatccgggattatggaggtggaccgcagtgaggcgaaggagggcctcaagcgtggggagaccacccgtcacgctgtgagtcggggcaccgcgaagctgcgctggttcgtcgagcggaacctggtgaagcccgagggcaaagtcatcgacctcggctgtggccgcgggggctggagctactactgcgcggggctcaagaaggtcacggaggtgaaaggctacacaaagggcgggcccggccacgaggagcccatcccaatggccacgtacggctggaacctggtgaagctccattcgggcaaagacgtcttcttcacgcctcccgagaagtgcgatacgctactgtgcgacatcggggagagttcccccaacccgacaatcgaagagggtcgcaccctccgagtgcttaagatggtagagccctggctgcgcggtaaccaattctgcatcaagatcctcaacccctacatgccctctgtggtcgagaccctggagcagatgcagcgaaagtacggaggcatgctggtgcggaatccgctctcccgcaacagcacccacgagatgtactgggtctcctgcgggactggaaacatcgtgagcgccgtaaacatgacctcccggatgctgttaaaccgcttcaccatggcccaccgcaagccaacctacgagcgagatgtcgacctcggtgccggcacgaggcacgttgcggtggaaccggaggtagcgaacctggacatcattggccagcggattgagaatataaagcatgaacacaagagtacatggcactacgacgaggacaacccctacaaaacctgggcctaccacggatcctatgaggtgaagccgagcggctccgccagcagcatggtcaacggggtagtgaaactgctcaccaagccgtgggacgtcatccccatggtgacacagatcgccatgacggataccacccccttcggccagcagcgtgtgttcaaggagaaggtcgacacgcggaccccgaaggctaagcgcgggaccgcccagattatggaggtgacggcacggtggctgtggggtttcctctcccgcaacaagaagcctcggatctgcacgcgcgaggagttcacccggaaggtgcgcagcaacgccgcaataggagcggtcttcgtggacgagaatcaatggaactccgctaaggaggccgtggaggacgagcgtttctgggatctcgtgcaaaaggagcgagagctgcacaagcagggtaagtgcgcgacctgtgtgtacaacatgatgggcaagcgggagaagaagctgggtgagttcggcaaggcgaaagggtctcgcgcgatatggtacatgtggctcggtgctagattcctggagttcgaggccctgggctttatgaacgaggaccattggttctcacgcgagaacagcctctctggtgtcgagggcgaggggctgcacaaactgggctacatccttcgggacatctcgaagatccccgggggcaacatgtacgccgacgataccgcgggttgggacactcggatcaccgaggatgacctgcagaacgaggcgaagatcaccgatattatggagcccgagcacgccctgctcgccacgtcaatctttaagctgacgtaccagaataaggtcgtgcgggtgcagagacccgccaagaatgggacagttatggacgtgatcagcagacgggaccagcgcggctccggccaggtgggcacctacggcctgaacacctttacgaacatggaggcgcagctcatcagacagatggagagcgaggggatcttcctaccctccgagctggagaccccgaacttggccgagcgcgtcctggactggctggaaaagtacggcgtggagcggctcaagcgcatggctatcagcggggacgactgcgtggtcaaaccaatcgacgaccggttcgccaccgccctgaccgcgctgaacgatatgggcaaggtgagaaaggacattccccagtgggagcctagtaagggatggaacgactggcaacaggtccctttttgtagccatcacttccaccagctcattatgaaggacggacgggagatagtcgtaccctgtcgcaaccaggacgagctggtgggccgggcccgcgtctctcagggggcaggctggagcctccgggaaactgcctgcctaggtaagagctatgcccagatgtggcagctgatgtacttccaccgccgggacctccgcctcgcggccaacgctatctgctccgccgaccccgtggactgggtgcccacaagccggaccacctggtcgatccatgcgcaccaccaatggatgactaccgaggacatgctgagcgtctggaaccgcgtatggatcgaggagaacccctggatggaagataagacccacgtgtccagctggggcgacgtcccgtaccttggtaagcgcgaggaccagtggtgcggctcgctcatcggcctgacggcccgcgccacctgggcttcgaacatccaggtggccatcaaccaggtgcgccgactgatcgggaatgagaactacctcgactacatgacgtccatgaaaaggttcaagaacgaaggagaccccgagggggctctttggtga

SEQ ID NO: 24350 - RNA, 9879 nt, synthetic construct
  misc_feature 1..9879: note = derived and/or modified CDS sequence (opt11) from DENV-1__GQ199832__SS-prME
  source 1..9879: mol_type = other RNA
agcgtgaccatgctgctcatgctgatgcccaccgccctggccttccacctcaccacccggggcggagagccccacatgatcgtgacgaagcaggagagaggcaagagcctgctgtttaagaccagcgcgggagtgaacatgtgcaccctcatagccatggacttaggcgagctgtgcgaagacaccatgacctacaagtgccccagaatcaccgaggccgagcccgacgatgtggattgctggtgcaacgccacggacacctgggtaacctatgggacttgcagccagacgggcgagcaccggcgggacaagcgtagcgtggccctcgcgccccacgtcggcctgggactggagacccgcacggagacctggatgtccagcgaaggcgcatggaagcagatccagcgagtcgagacgtgggcccttcggcacccagggttcaccgtgatcgcgctgttcctagcccatgccattggcacctccatcacgcagaagggtatcatcttcatcctcctgatgctggtgacgcccagcatggccatgagatgcgtcggcattggctctcgcgacttcgtggaggggctcagcggcgccacctgggtggacgtcgtgctggagcacgggtcctgcgttaccaccatggccaaggacaagccaactctggacatcgagctactgaaaacggaggtgaccaaccccgcggtactgcggaagctctgcatcgaggctaagatcagcaacaccaccaccgactcccgctgtccgacccagggcgaggccaccctgatggaggagcaggacgccaacttcgtgtgccggcgcaccttcgtcgaccggggctgggggaacggttgcgggctgtttggcaaggggtccctcatcacgtgcgccaagttcaagtgcgtgaccaagctggagggtaagatcgttcagtatgagaacctgaagtactccgtcatcgtgaccgtgcacacgggcgaccagcaccaggtcgggaacgagagcaccgagcacggcaccaccgcgaccatcacgccccaggcccccacctccgagatccagctcaccgactacggtgcccttaccctggactgcagcccccgcactggcctcgacttcaacgagatggtactactaaccatgaaggagaagagctggctcgtccacaagcaatggttcctggacctgccgctcccctggaccagcggggccagcacctcccaggagacgtggaaccgacaagacctgctggtgaccttcaagaccgctcacgcgaagaaacaggaggtggtcgtgctcggcagccaggaaggcgccatgcacaccgccctgacgggggccaccgagatccagacatccggcaccactaccatattcgccggtcacctgaaatgccgccttaagatggataagctgaccctgaaggggatgagctacgttatgtgtaccgggtccttcaagctcgagaaggaggtcgcggagacgcagcacggcacggtgcttgttcagatcaagtatgagggcaccgacgccccgtgcaagatacccttcagcacccaggacgagaaaggggttacgcagaacggccggctgattaccgccaacccgatcgtgacagataaggagaagcccgtgaacatcgaggccgagccgccctttggggagagttacatcgtcatcggcgcgggcgagaaggcccttaagctcagctggttcaagaaggggtccagcatcggcaagatgttcgaggccaccgcccgcggggcccggcgaatggcgatccttggcgacacagcctgggacttcggctccatcggcggcgtgtttaccagcgtgggcaagctggtccaccagatcttcggcaccgcctacggggtcttattctccggcgtgagctggactatgaagatcgggatcggcgtactgctgacgtggctcggcctgaactcgcgcagcacctccctgagcatgacctgcattgctgtggggctcgtgaccctgtacctcggcgtcatggtgcaggccgactccgggtgcgtgataaactggaagggccgggagctcaagtgcggcagcggaatattcgtcacgaacgaggtgcacacgtggaccgagcagtacaagttccaggcggacagcccgaagcgcctgtccgccgcaatcggcaaggcctgggaggagggggtgtgcggcatccggtcagcgacccgcctggagaacatcatgtggaagcagatcagtaatgagctcaaccacatcctgctggagaacgggatgaagttcaccgtcgtggtgggcgacgtcgtggggatcctcgctcagggcaagaagatgatcaggccccaacccatggagcacaagtacagctggaagtcctggggcaaggccaagatcataggggccgacgtgcaaaacacgacctttataatagacggccccaacaccccggagtgccccgacgaccagcgcgcctggaacatctgggaggtcgaagactacgggtttggaatcttcaccacgaacatctggctgaagctgagggacagctatacgcaggtgtgcgaccaccgcctcatgtccgcggccatcaaggacagcaaggccgtgcacgctgacatgggctactggatcgagtctgagaagaatgaaacgtggaagctggcccgggccagcttcatcgaggtcaagacctgcatctggcccaaatcccacacgctgtggagcaacggggttctcgagtccgaaatgatcatccccaagatctacggcggtcctatctcccagcacaattaccgcccaggttacttcacccagactgccgggccctggcacctgggcaaactggagctcgatttcgacctgtgcgaaggcaccactgtggtcgtcgacgaacactgcggcaacagaggcccgtccctccgcaccaccaccgtcacggggaagataatacacgaatggtgttgccgaagctgcaccctgccgcctctccgcttcaagggcgaggatgggtgttggtacggcatggagattcggcccgtaaaagagaaggaggagaacctggtgaaatccatggtgagcgcaggcagcggcgaggtcgactccttctctctcggcctgctgtgcacctccatcatgatagaggaggttatgagaagccggtggtcccgcaagatgctcatgaccgggacgctggccgtgttcctgctcctgatcatgggccagctgacctggaacgacctcatccggctgtgcatcatggttggggccaacgctagcgaccgcatgggcatgggcacaacgtacctcgctctcatggccacgttcaagatgcgcccgatgttcgccgtgggtttactgttccggcgcctcacatcccgggaggtgctcctgttaacaatcgggctgagcctcgtcgcctccgtggagctccccaacagtctggaggagctgggggacggcctcgcgatgggcatcatgattctgaagctgctcacagacttccagtcccaccaactttgggccacgctgctcagcctgactttcatcaagaccaccctgagcctccactacgcctggaagacgatggccatggtcctgagcatagtgtcccttttccccctctgcctgagcaccacttcccagaagaccacgtggctgcccgtgttgctagggtctctgggctgcaagccgctcaccatgttcctgatcgcggagaacaagatctgggggcgcaaaagttggcccctgaacgagggcatcatggccgtaggggtggtgtcgatcctcctgagctccctgctcaagaacgacgtccccctggccggcccactgatcgccggcgggatgctcatcgcctgctacgtgatcagcggctccagcgcggacctgtccctggaaaaggccgccgaggtgtcatgggaggaggaggccgagcactccggggcgagccacaacattctcgtcgaggtgcaggacgacggcaccatgaagatcaaggatgaggagagagacgacactctgaccatcctgctcaaggcgacattactcgccgtgagcggggtctacccgcttagcatccccgctaccctgttcgtgtggtacttctggcagaagaaaaaacagagatccggcgtgctgtgggacacccctagcccgcctgaggtcgagcgggccgtgctggacgacggcatctaccgcatcatgcaacgtggtctcctgggccggtcccaggtgggtgtcggcgtgtttcaggagaacgtgttccacactatgtggcacgtaacgcgcggggccgtgctgatgtaccagggcaagcgcctcgagccgagctgggcgtctgtcaagaaggacctgatcagttacggtggtgggtggcggctgcaggggtcctggaacaccggcgaggaggttcaggtgatcgccgtggagcccgggaagaaccccaagaacgtccagaccgccccaggcaccttcaagacccccgaaggcgaggtgggggcaatcgccctcgacttcaagcctggcaccagcgggtcccctatcgtgaaccgcgagggcaagatcgtcggcctgtacgggaacggcgtcgtgaccaccagcgggacgtatgtcagtgcgatcgcccaggcaaaggcctcccaggagggcccgctgcccgagatcgaggacgaggttttccggaagcgcaacctcaccataatggacctgcaccccgggagcgggaagacccggcgctacctgccggcgatcgtgcgggaggccatcaagcgcaagcttcggaccctgatcttggcccccacgcgcgtcgtggcctccgagatggccgaggcgctcaagggcatgcccattcgttaccagactaccgctgtcaagagcgaacataccgggaaggaaatcgtcgacctgatgtgccatgcgaccttcaccatgcggcttctctcccccgtgcgcgtgccaaactacaacatgattatcatggacgaggctcacttcaccgaccccagctccatcgccgcgcggggctacatcagcacccgcgtggggatgggcgaggccgccgccatttttatgacggccacgccgcccgggtccgtggaggctttcccgcagagcaacgcagtgatccaggacgaggagcgggacatccccgaacgctcctggaacagcggctacgagtggatcaccgactttcccggcaagaccgtctggttcgtgccctccatcaagagcggcaacgacatcgcaaactgcctgaggaagaacggcaagcgcgtgatccaactgtcccggaagacattcgataccgagtaccagaaaaccaagaacaacgattgggactacgtcgtcaccacggacatcagcgagatgggggccaacttccgcgcggaccgggttatcgacccgcgccggtgcctcaagcccgtcatcctgaaggacggccccgagcgagtgatcctagccgggcccatgccggtcaccgtggcctccgcggcccaacggcgcggccggatcggccgcaaccacaacaaggagggggaccagtacatttacatgggccagcccttaaacaatgacgaggaccacgcgcactggaccgaggccaaaatgttactggacaacatcaacacccccgaggggatcatacccgccctcttcgaaccggagcgggagaagtccgccgccattgacggcgagtaccgcctgcgtggggaggcccggaagacgttcgtagaactgatgcgccggggtgacctccccgtgtggctgtcctacaaggttgccagcgaggggttccagtacagcgaccgccggtggtgtttcgacggggagcgcaataaccaggtgctggaggagaacatggatgtcgagatttggaccaaggagggcgagcggaagaagctccgcccccggtggctcgacgcccgcacctacagcgaccccctggctctccgggagttcaaggagttcgcggcggggcgaaggagcgtgtcaggcgacctcatcctggagatcggtaaactcccgcagcacctgacgcagcgagcacagaacgccctggacaatctcgtgatgctgcacaacagcgaacagggcgggcgggcctacaaacacgcgatggaggaactgcccgacactatcgagacactcatgctgctggccctcatcgccgttctcactgggggcgtgaccctgttcttcttgtccgggcgcggcctgggaaagaccagcatcgggctcctctgcgtaatggcctccagcgtcctgctgtggatggcctccgtggagccccactggattgcggccagcatcatcctcgagttcttcctgatggtgctgctcatacccgagcctgaccggcagcgcaccccccaggacaaccaactggcctacgtcgtcatcggcctcctctttatcatcctgaccgtggcggcgaacgagatggggctgctcgagaccaccaagaaggacctgggcatcggacacgtcgcggtggagaaccaccaccacgccacgatgcttgacgtggacctccaccccgcgtccgcctggaccctgtatgccgtcgcgaccaccatcataacgccgatgatgcggcacaccatcgagaacaccaccgcgaacatcagtctaacagccatcgcaaaccaggccgcgatcctcatgggcctggacaagggctggcccatctccaagatggatatcggggtgccgctgctcgctctgggctgctatagccaagtgaatcccttaacccttaccgccgccgtcctgatgctggtggcgcactacgctatcattgggccgggcctccaggccaaggccacccgcgaggcccagaagcggacggcggccgggatcatgaagaaccccaccgtggacggcatcgtcgccattgacctggatcccgtggtgtatgatgccaagttcgaaaaacagctgggccagatcatgctactcatcctgtgcacttcccaaattctcctgatgagaaccacgtgggccctgtgcgagtctatcaccctcgcgaccgggcccctgaccacactgtgggagggctccccggggaagttctggaacaccaccatcgccgtcagcatggccaacatcttccgcgggtcctacctcgccggcgccgggctggcgttcagcctgatgaagtccctcggcgggggccggagggggacgggcgcccagggtgaaacgctgggggagaagtggaaacgccagctgaaccagctctccaagagcgagttcaacatttacaagcgcagtggtattatggaggtggaccggagcgaggccaaggaggggctgaagcgcggcgaaaccacccggcacgccgtgtcccgcgggaccgcgaagctgcggtggttcgtcgagcgtaacctggtgaagcctgagggcaaggtgatcgacctcggctgcgggcggggcgggtggagctactattgcgccggcctgaagaaggtcacggaagttaaagggtacaccaagggcggccccgggcacgaggagcccatcccgatggccacctatggctggaatctggtgaagctccactccgggaaggacgtcttcttcatcccgcccgaaaagtgcgataccctgctgtgcgacatcggcgagagcagtccgaacccgacgatcgaggaggggcgcaccttgcgggttctgaagatggtggaaccctggttgcgcggcaaccagttctgcatcaagatcctcaacccctacatgcccagcgtcgtggagaccctggagcagatgcagcgaaagcacggcgggatgctggtgagaaacccgctctcccggaatagcacccatgagatgtactgggtctcatgcggcaccgggaacatcgtgagcgccgtaaacatgacgtcccggatgctgcttaaccggttcaccatggcccaccgcaagcccacctacgagcgcgacgtcgacctcggcgcggggacccggcacgtggccgtggagcccgaggtcgccaatctggacataattgggcagcgcatcgaaaacatcaagcacgagcataagagcacttggcattacgacgaggacaacccctacaagacctgggcataccacggctcgtacgaggtgaaaccttccgggtcggcctcaagcatggtcaacggcgtggtgaagctgctgaccaagccatgggacgtcatcccgatggtaacccagatcgcgatgacggatacgaccccctttgggcagcagcgggttttcaaagagaaggtcgacacccgcacgccgaaggctaagcggggcaccgcccagattatggaggtgaccgcccgctggctttggggcttcctgtcccggaacaagaagccccgcatctgcacccgggaggagttcacgaggaaggtgaggagcaacgccgcgataggggctgtcttcgtggatgagaaccagtggaattccgccaaggaggcagtggaagacgagcgcttctgggacttagtccagaaggagcgcgagctgcacaagcagggcaagtgcgcgacctgtgtgtacaacatgatggggaagcgcgagaagaagctgggcgagttcgggaaggcaaagggcagcagagccatctggtacatgtggctcggcgctaggttcctggagtttgaagccctggggttcatgaacgaggatcactggttttcccgggagaacagcctctccggcgtggagggggagggcctgcacaagctggggtatatcctccgcgatattagtaagatccccggcggcaacatgtacgcggacgatactgctgggtgggacacccggatcacggaagacgacctgcagaacgaagctaagatcaccgacatcatggagccggagcacgccctgctagcaacctccatcttcaagctaacctaccagaacaaggtcgtgcgcgtgcagaggcccgcgaagaacggcacggtcatggacgtgatcagccgaagggaccagcgggggtccggccaggtgggcacctacgggctcaacaccttcaccaacatggaggcccagctcatccgccagatggagagcgagggcatcttcctgccctccgagctggagacgcccaacctcgccgagcgggtactggactggctggagaaatacggggtggaacgcctcaagcggatggccatcagcggcgacgactgcgtggtcaagccgatcgacgatcgcttcgcgaccgcgctgaccgccctgaacgatatggggaaggtgcggaaggacatcccccagtgggagccctccaagggctggaatgattggcagcaagtccccttttgcagccaccactttcaccagctcatcatgaaggacggccgcgagatcgtcgtgccgtgcaggaaccaggacgagctggtggggcgtgcccgggtatcacaaggcgccgggtggagcctgcgagagacggcctgcctcggcaagagctatgcgcagatgtggcagctaatgtacttccaccggcgcgatctgcggctcgccgccaacgccatctgctccgcggtacccgtggactgggtccccacaagccgcaccacctggtccattcacgcccaccaccagtggatgaccacggaggacatgctcagtgtatggaaccgggtgtggattgaggaaaacccctggatggaggacaagacccacgtgtccagctggggcgacgtgccgtacctgggaaaacgtgaagaccagtggtgcggctccctcatcgggctgaccgcccgggccacctgggctagcaacatccaggtcgcgatcaaccaggtccgccgcctgatcggcaatgagaactacctcgactacatgacctccatgaagcggttcaagaacgagggtgaccccgagggcgccctgtggtga

SEQ ID NO: 24351 - RNA, 9879 nt, synthetic construct
  misc_feature 1..9879: note = derived and/or modified CDS sequence (opt11) from DENV-1__FJ882568__SS-prME
  source 1..9879: mol_type = other RNA
tctgtgaccatgctgctgatgctgatgcctaccgcgcttgcgtttcacctcactacccggggcggggagccccacatgatcgtgacaaagcaggagcggggcaagagcctactttttaagacctcagcgggcgttaacatgtgcaccttgatagctatggacctaggcgagctctgcgaggacaccatgacgtacaaatgcccccggatcaccgaggccgagcccgacgacgttgactgctggtgcaatgctaccgacacctgggttacttacggaacctgctcacagacgggcgagcaccgcagggacaagcggagcgtggctctcgctccccacgtgggccttgggctggagacccgcactgaaacctggatgtcctctgagggtgcgtggaagcagatccagcgggtcgagacgtgggcacttcgccaccccgggttcacagtgatcgcgctgttcttagctcacgccatcggtacatctatcacgcagaaagggatcatattcattctcttaatgctggtgacgcctagcatggctatgcggtgcgtaggcatcggaagccgcgacttcgtggagggcctgagcggcgccacgtgggttgacgtcgtgctggagcacgggtcctgcgtgactaccatggccaaagacaagcccacgctggacatagagctcctgaagaccgaggtaaccaatcccgcggttctgcggaagttgtgcattgaggccaaaattagcaataccacgacggattccagatgccccacccagggcgaggccactctgatggaggaacaagacgctaacttcgtgtgccggagaacggtcgtggaccggggatgggggaacggctgtgggcttttcggcaagggatccctcatcacgtgtgccaagttcaagtgcgtgaccaagttagagggcaagatcgtgcagtatgagaacctgaagtattctgtgattgtgaccgtccacacaggcgaccagcaccaggtgggtaatgaaagtaccgaacacgggaccacagcgaccatcactccccaggcccccaccagcgagatacaactaaccgactatggtgccctcaccctggactgcagccctaggacgggcctcgactttaacgaaatggtattgctgaccatgaaagagaagtcctggctcgtccacaaacagtggttcctggacctgccgctcccctggaccagcggggccagcacctcccaggaaacgtggaaccgacaagacctgctagttactttcaagaccgcacacgcgaagaagcaagaggtcgtggtactcggcagccaggaaggtgccatgcacaccgccttaactggggccaccgaaatacagacatcaggcacaacgaccatatttgccgggcacctgaagtgtcgcctcaagatggacaagctgacccttaaagggatgagctacgtcatgtgtactggtagctttaagctcgagaaggaggtggcggagacgcagcacggtaccgtgctggtccagatcaagtatgagggcaccgacgccccgtgcaagatccccttccttactcaggacgagaagggggtgacgcaaaatgggcgcctgatcaccgccaacccgatagtgactgacaaggagaagccggttaacatcgaagccgagccccctttcggggaaagctacatcgtgataggcgcgggcgagaaggcccttaaactgagctggttcaagaaagggagttccatcggcaaaatgttcgaagccaccgcacgcggagccagacgcatggcaatcctgggcgacaccgcctgggactttggtagcatagggggtgtgttcacgtcagtcgggaagctcgtgcaccagatatttgggactgcgtacggagtgctgttcagcggagtcagttggaccatgaagatcgggatcggcgtactgctcacgtggctcggactcaacagcaggtccactagcctctcgatgacctgtatagctgttggattggtcaccctatacctcggcgtgatggtgcaggccgacagtgggtgcgttatcaactggaagggccgggagctgaagtgcgggtccggaatcttcgtgacaaacgaagtacacacgtggacggagcagtacaagttccaagcggacagcccgaaacgcttaagtgccgccatcggcaaggcctgggaggagggagtctgcggcatcaggtctgcaacccggctcgagaacatcatgtggaagcagatctcgaacgaactgaatcacattcttcttgaaaacgggatgaagttcacggtggtcgtcggcgacgtcgttgggatactggcgcagggaaagaaaatgatccggccccaacccatggagcacaagtactcctggaaatcctgggggaaggcaaagatcatcggcgccgacgtccagaacacgacctttatcatcgacggccccaacaccccagagtgccctgatgaccagagagcatggaatatctgggaggtggaggactacgggttcgggatcttcactacgaacatatggcttaagttgcgtgactcctatacccaggtttgcgaccaccgcctgatgagcgcggctatcaaggactctaaagccgtgcatgccgatatgggctactggattgagagcgagaagaacgagacatggaaattggcaagagcctccttcatcgaggtaaagacctgcatttggcccaagagccacacgctatggtccaacggtgtactggagtctgagatgattatccccaaaatttacggggggccgatatctcagcacaattaccgcccgggctattttacccagaccgcggggccatggcacctgggcaaactcgagctggacttcgacctgtgcgaaggcacgaccgtcgttgtggacgaacactgtgggaaccggggcccgtccctgcgcaccacaaccgtcactgggaagattatccacgagtggtgttgccggtcctgcactctgccgccgttacgtttcaagggcgaagacgggtgctggtacgggatggagattcggcccgtcaaggagaaagaggagaacctcgttaagagcatggtctcggcgggaagcggggaagtagacagtttctccctgggcctactgtgcaccagcatcatgatcgaggaggtgatgcgaagtagatggtctcgcaaaatgctgatgaccgggaccctggcagtcttcctcctgctgatcatgggccaactcacttggaacgatctgattcgactttgtatcatggtgggggccaatgcatccgatcgcatgggcatgggcaccacttacctcgccctgatggcgacttttaagatgcgccccatgttcgcagtcgggctcctgttccggcgactgaccagccgggaggtccttctcctgaccatcgggctgtccctcgtagccagcgtcgaactacccaacagcctcgaagaattaggcgacggactagcgatgggcatcatgatcctgaagctcctgaccgattttcagagccatcagctgtgggcgacgctcctgagcctaacctttattaaaaccaccctcagcctgcactatgcttggaagacgatggccatggtgctgtccatagttagccttttccccctctgccttagtaccacctcgcagaagaccacgtggttacctgtcctgctgggttctctcggctgtaagccgctgaccatgttcttaatcgcggagaataagatctgggggcgcaaaagctggccgctcaatgaaggcatcatggccgtgggggtggtgagtatcttactgagcagcctcctgaagaacgatgtcccgctggcgggccccctcatagccggcggtatgttgattgcctgctacgtaatctccggcagctcggctgaccttagcctcgagaaggcagccgaagtctcctgggaggaggaggcagaacacagcggggcctcccacaacatcctagtagaggtgcaggacgacgggaccatgaagatcaaggacgaggagcgggacgacacccttacgatcctcctgaaggcgacgctgctcgccgtctcaggcgtctacccgctgagcatccccgccacacttttcgtgtggtacttttggcagaagaagaagcaacgctcgggcgtcctgtgggacacccccagcccgcctgaagtggagcgggccgttctggacgacggcatctaccgcatcatgcagcgtgggctgctgggacgcagccaggtaggagtgggcgtgttccaggagaacgtatttcacacaatgtggcacgttactcgcggggccgtgctcatgtaccagggcaaacgcttggagccgtcatgggcgtccgtcaagaaggacctaataagctacggcgggggctggaggctccagggaagctggaacactggcgaagaagtccaggtgatcgccgttgagcccgggaagaatccaaagaatgtccagaccgctccaggcacgttcaaaacgcccgagggcgaagttggggcaattgccctagacttcaagcccgggacatccggtagccccatcgttaacagggagggcaaaatcgtgggcctctatggcaatggggtggtcaccacctccggaacgtacgtgtccgcgatcgctcaggccaaagcaagccaggagggccccctccccgagatcgaggatgaagtgttccggaaacgcaacctgaccatcatggacctgcaccccggctctggcaaaacccggcgctacctcccggcgatcgtacgggaggccatcaagcgcaaactgcggaccctgatcctagcccccacacgcgttgtggccagtgagatggcggaggccctcaaaggcatgcccattcgctaccagacgaccgcagtcaaatccgagcacaccgggaaggaaatagtggacctgatgtgccacgcaactttcaccatgaggctcctgagccccgtgcgcgtcccgaactacaacatgatcatcatggatgaggcccatttcaccgacccatcctctatcgctgcgcggggctacatctccaccagagtggggatgggcgaggctgctgccatattcatgactgccacgccgcccgggagcgtggaagcgttccctcaatctaacgcagtcatccaggacgaggagcgggacatacccgagcgaagctggaactccggttatgagtggatcaccgacttcccgggaaaaacagtgtggttcgttccctctattaagtccgggaacgatatcgctaactgcctgcggaaaaacggcaagagggtcatccaattgagtcggaagacgttcgacactgagtaccagaagaccaagaacaatgactgggactacgtggtgaccacggatatcagtgagatgggggccaactttcgggcggatcgtgtcatagatccgcgccggtgcctgaagccggtcatcctgaaggatggccccgaacgcgtcatcctcgctgggcccatgccggtaaccgtggcctcagccgcccagcgtagaggccggatcggccgcaatcataacaaggagggcgaccagtatatctatatgggccagccccttaacaacgacgaggaccacgcgcactggaccgaggcaaagatgctgcttgacaacataaatacccccgaggggattataccggccctttttgaaccggagcgggagaagtccgccgccatcgacggcgaataccgcttgcgcggagaggcacggaagacgttcgtagagctcatgcgccggggggacctgcccgtgtggctgagctacaaggtggcctccgaaggcttccagtacagcgaccgcaggtggtgcttcgacggggagcgcaacaaccaggtccttgaggagaacatggacgtggagatatggactaaggagggcgagcggaagaagctgcgcccacggtggctggatgcccggacctactcggaccccctagcgctccgtgaattcaaagagttcgccgccggccgcaggtcggtgagcggcgatctgatactcgagatcggcaagctgccgcaacacctgacccagcgcgcccagaacgctctcgacaatctggtcatgctacacaactcagagcagggcgggcgggcatacagacacgcgatggaggaactccccgacacgatcgagaccctcatgctgctcgctttaatcgccgtgctgaccggaggcgtaaccctcttcttcttaagcgggcgcggcctcggcaagacctccatcggcctcttgtgcgtcatggccagctccgtactattatggatggcctcggtcgagccccactggatagcggcctcaatcattctcgagttcttcctgatggtcttgcttatcccggagccggatcgccagcggacaccacaggacaaccagctcgcctacgtggtaattggcctcttattcatcatcctgaccgttgccgccaacgagatggggctgctggagaccacaaagaaggacttaggcatcgggcacgtggcggtggagaaccaccaccacgccaccatgctcgatgtcgacctgcaccccgcaagcgcctggactctgtacgccgtggcgacaaccatcatcacgccgatgatgcgccacacaatcgagaacaccaccgccaatatctctctcacggccatcgccaatcaggcagccatactgatgggcctggacaagggctggcccatcagcaaaatggacatcggggttcccctcttggccctgggctgctacagccaggtcaacccactgacgctgaccgccgccgtgttgatgctggttgcgcattacgctataatcgggccgggtcttcaagctaaggccacccgggaggctcagaagcgcacggctgcggggatcatgaagaaccctaccgtcgacggcatcgtcgccatcgacctagaccccgtagtctacgacgccaagttcgaaaagcagctcggacagatcatgctgttgatcttatgcacctcccaaatcttgctgatgcgcacaacgtgggcattgtgtgagtccatcacgcttgcgacggggcccctaacaactctgtgggaaggctccccggggaagttctggaacaccactatagctgtgtccatggccaacatcttccgggggagctatttggccggcgctgggctggcgttctcgctcatgaagtccctgggagggggtcgcaggggtaccggcgcccaaggcgagacgcttggggagaagtggaagcgccaattgaaccaactgagcaagtccgagtttaacatctacaagcggagcgggattatggaggttgacaggtccgaagctaaggaggggctgaagcgaggagagaccacccgccatgccgtcagccggggcaccgctaaactcagatggttcgtggagagaaacctcgtgaagcccgagggcaaggtcattgacctcggctgcgggaggggcgggtggagctactactgcgctggcctgaagaaggtgacggaggttaaggggtacaccaagggtggccccggtcacgaggagcccatcccgatggccacctacggctggaacctcgtcaagctgcatagtggtaaggatgtcttcttcacgccgcccgagaagtgcgacacgctgctctgcgacatcggcgagtctagccccaatccgaccatcgaggaagggcggaccttgcgcgtgctcaagatggtcgagccctggctccggggtaatcagttttgcatcaagatcctgaacccctacatgccctcagtggtggaaaccttggaacagatgcagcgcaagcacggtggaatgctcgtccgtaaccccctgagccgcaatagcacccacgagatgtactgggttagttgcggcacggggaacatcgttagcgccgtcaacatgacaagtcggatgctgttgaaccgcttcactatggcccatcgcaagcccacctacgaacgggacgtcgatttgggcgcaggaacaagacacgttgcagtggagcccgaggtggcgaacttggacatcatcgggcagcggatagagaacatcaagcacgagcacaagtccacgtggcactacgacgaagacaatccctacaagacctgggcgtatcatggcagctacgaggtcaagccttccgggtccgccagttcgatggtgaacggcgttgtcaagctcctgacaaaaccatgggacgtgatccctatggttactcaaatcgcgatgaccgacacgacgccctttgggcaacaacgggtcttcaaagagaaagtcgacacccggactccgaaggccaagcgcgggacagcacagatcatggaggtaaccgctcggtggttatggggctttcttagccgcaacaagaaaccccggatatgcacaagggaggagttcacccggaaggtccgctccaacgccgcgatcggcgccgtgttcgtggatgagaatcagtggaacagcgccaaggaagccgttgaagacgagcgtttttgggacctggtgcagaaggaacgcgagttgcacaaacaggggaagtgcgccacgtgcgtgtataacatgatgggaaaacgagagaagaagttgggcgagtttggcaaggcgaagggctctcgcgcaatctggtacatgtggctgggggcccggttcctggagtttgaagccctcggttttatgaatgaagaccactggttcagccgggagaacagcctgagcggcgtcgagggggagggcctgcataagctagggtacatcctgcgggatatcagcaagatacccgggggtaacatgtatgcggatgacaccgccggatgggacacccgtatcaccgaagacgacctgcagaatgaggccaagatcaccgatatcatggagccggaacacgcgctcttagccaccagcatcttcaagctgacgtaccagaacaaggtcgtacgcgtccagagaccagcgaaaaacggcactgtgatggacgtgatctcccgacgcgaccagagggggagcggccaggtcggcacctacgggctcaataccttcacgaacatggaggcccaactgatccggcaaatggaatccgagggcatctttttgcccagcgaacttgagacaccgaacctggctgaacgcgtcctggactggctcgagaagtacggggttgagcggctgaaaaggatggccatctcaggcgatgactgcgtagtaaagccgatcgacgaccggttcgcaaccgcgctgaccgccctcaacgacatggggaaggtgaggaaggacatcccacagtgggagccctcgaagggctggaacgactggcagcaagtccccttctgctcgcaccactttcaccagctaatcatgaaagatggccgggagatcgtggttccgtgccgcaaccaggacgaactggtcgggcgggctcgcgtgagccagggcgccgggtggtccctccgggagacggcctgcctgggcaagagctacgcgcagatgtggcagctgatgtatttccaccgccgtgatctccgcctggccgccaacgccatctgctctgctgtacccgttgactgggtccccacctcccggaccacgtggagcatccacgcacaccaccagtggatgacgacagaggacatgttatccgtgtggaatcgcgtgtggatcgaagagaacccctggatggaggacaagacccatgtgtcatcctggggcgatgtgccatatctaggcaagcgggaagaccagtggtgtggtagcttgatcgggctgaccgcccgagccacctgggcctccaacatccaggttgcgattaaccaagtgcgccggctcatcggcaatgagaattacctggactatatgactagcatgaagcgcttcaagaacgagggagatcctgagggcgccctgtggtaa

SEQ ID NO: 24352 - RNA, 9879 nt, synthetic construct
  misc_feature 1..9879: note = derived and/or modified CDS sequence (opt11) from DENV-1__FJ882569__SS-prME
  source 1..9879: mol_type = other RNA
tctgtgaccatgctgctgatgctgatgcctaccgccctcgctttccatctcactaccagaggcggggagccccacatgatcgtgactaagcaggagcggggcaagagccttctgttcaagaccagcgcgggggtgaacatgtgcaccttgattgccatggatttgggcgagctttgcgaggacaccatgacctacaagtgcccgcgaatcaccgaagccgagcccgacgacgtggactgctggtgtaacgccacagacacgtgggtgacttacgggacctgcagccagacgggcgaacatcgcagggataagcggtctgtggccctcgcgccccatgtcgggctgggattagaaacccgcaccgagacctggatgtcctcagagggagcctggaagcaaatccagcgggttgagacgtgggccttacgccaccccggcttcaccgtgatcgccttattcttggcgcacgctataggcacgtccatcacccagaaggggataatctttatcctcctgatgctggtgactcccagcatggccatgcgttgcgtcggcattggctcccgcgacttcgtcgagggtctcagcggcgccacctgggtggacgtcgtgctggagcacgggtcctgcgttaccacaatggcgaaggacaagcccacgctagatatcgagctactgaaaacagaggtcaccaaccccgcggtgctgcgtaagttgtgtatcgaggccaagatcagcaacaccacgacggactcccgctgtccaacgcagggcgaggccacgctgatggaggagcaggacgcgaactttgtgtgccggcgtacgttcgtcgaccgaggctgggggaatggctgcggactgttcggcaaggggagcctcatcacgtgcgccaagttcaagtgcgtgaccaagctggagggcaagattgtgcagtacgagaacctcaagtattccgtcatcgtgaccgtccacactggcgaccagcatcaagtcgggaacgagagcaccgagcacggcaccaccgcgaccatcacgccacaggcccccacttccgagatccaattgacggactacggcgccctgaccctggactgctctccccgcacgggccttgacttcaacgagatggtgctgctgaccatgaaggagaagagttggctcgttcacaagcagtggttcctggacctaccgctcccgtggaccagcggggcctctacgtcgcaggagacatggaatcggcaggacctgctagttaccttcaagacggcgcacgccaagaaacaggaagtggtcgtgctcggcagccaggagggcgcgatgcacaccgcgctaacgggcgccacggaaatccagacctccggcacaactaccatcttcgccgggcatctgaagtgccgcctcaagatggacaaactgacgctgaagggcatgagctacgtgatgtgcaccgggagtttcaagctcgagaaagaagtcgcggagacgcagcatggtaccgtgctggtgcaaatcaagtatgaaggcacagacgccccctgtaagatccccttcagcacccaggacgagaagggtgtcacgcagaacggccgtttgatcaccgctaacccgatcgtgaccgacaaggagaagcccgtcaacatcgaggccgagccgcccttcggggaatcatacatcgtgatcggcgcgggcgagaaggccctgaagctcagctggttcaagaaaggttccagcataggcaagatgttcgaggcaaccgcccgcggcgcccggcgcatggctattctgggtgacacggcctgggactttggaagtatcggcggcgtgtttaccagcgtagggaagctggtccaccagatcttcggcaccgcctacggtgtcctgttctctggcgtcagctggactatgaagataggcattggcgtcctgctaacttggctcggactgaactcgcggtctacgtctctgagcatgacctgcatcgctgtggggctcgtgaccctgtacctgggcgtgatggtgcaggccgacagtggttgcgtgataaactggaaaggacgggagctaaagtgcgggagcggcattttcgtcacgaatgaggtgcacacctggaccgagcagtacaagttccaggcggactcaccaaagcgtttgtccgccgccatcggcaaggcctgggaggagggggtttgcggcatccggagcgctacccgtttagagaatatcatgtggaaacagatctcaaatgagctcaaccatatcctgctagaaaacgggatgaagttcactgtggtggtgggcgacgtggttgggatcctggcgcagggcaagaagatgatcagacctcagcccatggagcacaagtacagctggaagtcctggggcaaagccaagatcatcggggccgacgtgcagaacactactttcatcatcgatggccccaataccccggagtgtcccgacgatcaacgcgcctggaatatctgggaggtagaggactacgggttcggcatcttcaccactaacatctggctgaagttacgggatagctacacccaagtctgtgaccaccggctcatgtccgcggctatcaaggattcgaaggccgtgcacgccgatatgggctactggattgaatccgagaagaacgaaacctggaaactggcccgggcgagcttcatcgaagtcaaaacgtgtatctggcccaagtcccatacactgtggtccaacggggtcctcgagtcggaaatgatcatccccaaaatctacggcgggccgatcagccagcacaactaccgccccggctacttcacccagaccgccgggccctggcatctgggcaagctcgagctcgacttcgacctgtgtgagggcaccacggtggtcgtggacgagcactgtggcaatcggggcccatcactgagaacaaccaccgtgacaggaaagatcatccacgaatggtgctgccggagttgcacgctgccgccactgcgctttaagggcgaggacgggtgctggtacggcatggagatccgaccggtcaaggagaaggaggagaacctggtaaagtctatggtaagcgccggaagcggcgaggtcgactccttctctctcggcctgctgtgcaccagtatcatgattgaggaggtgatgcgcagtcgatggtcccgcaaaatgctcatgaccgggacgctggccgtttttctattacttatcatgggccagctcacctggaacgacttaatccggctgtgcatcatggtcggggcaaacgcgagcgaccgcatgggcatgggcaccacatacctggcactaatggccacgtttaagatgcgcccgatgttcgctgtggggctgctgttcaggcgtctcacctcccgggaggtgctgctgctcaccatcgggctgtcattggttgcctccgtggaactccccaacagcctggaggagctgggagacggcttggcgatgggcatcatgatcctgaaacttctcaccgacttccagtctcaccagctgtgggccaccctactcagtctgaccttcattaagacgaccctgtcgctccactacgcctggaagacaatggcaatggtcctgagcatagtttccctgttccccctatgcctgtccaccacctcccagaaaacgacgtggctgcccgttttgctgggcagcctgggctgcaagccgttgaccatgttcctgatcgctgagaataaaatctgggggcgtcggtcctggcccctgaacgagggaatcatggctgtcggggtcgtctcgatcctcctgagctccctactcaagaacgacgtccctctggccggcccactgatcgcagggggtatgctcattgcgtgctacgtcatctccggctcctctgcggacctctccctggagaaagctgccgaggtttcgtgggaagaggaggctgagcactccggcgcctctcataacattctcgtcgaagtgcaggacgacggcaccatgaaaatcaaggatgaggagcgcgatgataccctgaccatcctgttaaaggcaacgctactggccgtttcaggggtctatcccctcagcatccccgccaccctgttcgtgtggtatttctggcagaagaagaagcaaaggtccggagttctgtgggacacccccagcccgcccgaggtggagagagccgtgctggacgacgggatctaccggatcatgcagcgcggtctcctgggccgtagccaggtaggggtcggcgtcttccaggagaacgtgttccacacaatgtggcacgtcactcgcggggccgtgctgatgtaccaaggcaagcgattagagcccagctgggcctccgtcaaaaaggatctgatcagctacggcggggggtggcgcctgcaggggtcctggaacaccggcgaggaggtccaggtgatcgccgtcgagcccggcaagaaccccaaaaacgtccaaactgcccccgggaccttcaagacgcccgagggtgaggtgggcgccatcgccctagacttcaagccaggcaccagcggttctcccatcgtaaaccgggagggcaagattgtcggcctgtacgggaacggcgtggtgaccacgagcgggacgtacgtctcggcgattgcgcaagctaaggcttcccaggagggcccgctgcccgagatcgaggacgaagtgttccgcaagcgaaatctcaccattatggatctgcaccccgggagcggcaagacccgacggtacttacctgcaatcgtgcgcgaggccattaaacggaagctgcgcaccctgatcctagcccccacgagggtcgtagcctccgagatggccgaggcgctcaagggcatgcctatccggtaccaaaccaccgccgtcaagagcgagcacactgggaaggagatcgtcgacctgatgtgccacgccaccttcaccatgcgtctcttatccccagtgcgggtgccgaactacaacatgataattatggatgaggcccactttacggaccccagctccatcgccgcgcgcggatacatcagcacacgggtcggaatgggtgaggccgcggccatatttatgacagccacgccgccaggtagcgtggaggcattccctcaaagcaatgcagtcatccaggacgaggagcgcgacatccccgaacggtcctggaactcaggctacgaatggattaccgacttccctggcaagaccgtgtggttcgtgccctccatcaagagcgggaacgacatcgccaactgcctgcgaaagaacggtaaacgcgtgatccagctgtcgcgcaagactttcgacaccgagtaccagaagacgaaaaacaacgactgggactacgtcgtaaccacggatatctcggagatgggtgccaacttcagggcggaccgcgtgatcgacccgcgacggtgcctcaagcccgtcatcctgaaggacggtcccgagcgggtgatcttggctggaccgatgcccgtgacagtggcctccgcggcccagcgccggggcaggatcggccggaaccacaacaaggagggggaccagtacatctacatgggccagccactaaataacgacgaggaccacgcgcactggaccgaggccaagatgctcctagacaacatcaacaccccggaggggatcattcccgccctcttcgagccggagcgcgagaaaagtgccgccatcgacggagagtaccgcctgcgcggggaggctcgcaagaccttcgtggagctgatgcggcgaggcgacctcccggtttggctgtcctacaaggttgcctccgagggcttccagtactctgaccggcggtggtgcttcgacggcgagcgtaataatcaggttcttgaagagaacatggatgtcgagatctggaccaaggaaggtgagcgcaagaagctccggccccgctggctggacgccaggacctactccgaccccctggccctgcgcgagttcaaagaatttgctgccgggcgacgaagcgtttccggtgatctgatcctggaaatcggcaaactcccgcaacaccttacccagcgggcccagaacgccctcgacaacctcgttatgctgcacaacagcgagcagggcgggcgcgcctaccggcacgcgatggaggagctgcctgacacaatagagaccttaatgctgctggccctcatcgccgttctgaccgggggagtaactctgttcttcctctcaggccgcggccttggcaaaaccagcatcggattgctctgcgtgatggcctccagcgttctgttgtggatggcgtccgtggagccacactggattgcagctagcatcatcctcgagttctttttaatggtgctgctcatccccgagccggacaggcagcgcacgccacaggacaatcagttagcctacgtcgtaatcggcctcctattcatgatcctgaccgtggccgccaacgaaatggggttgcttgagaccacgaaaaaggacctgggcatcgggcatgtcgccgtggagaaccaccaccatgccacaatgctggacgtcgatttgcatcccgcctccgcctggaccctgtacgccgttgcgaccactatcatcaccccgatgatgcggcataccatcgagaacaccaccgccaacatatccctcacggctatcgccaaccaggcagcgatcctcatgggcctggataagggctggcctatttccaaaatggacatcggggtgcccctgttggctctgggctgctacagccaagtgaaccctcttactcttaccgccgccgtcttgatgctggtggcccactacgccattatcgggcccggcctccaggccaaggctacccgcgaagcccaaaagcggactgcagccgggatcatgaaaaaccccaccgtggacggcatagtcgccatcgacctggatcccgtcgtgtatgacgccaaattcgagaagcagctgggacagatcatgctcctgatcctgtgcacctcccaaatcctcctgatgcggaccacgtgggccctgtgcgagagcataaccctggctacagggcccctgaccactctgtgggagggctcaccggggaagttctggaacacgacaatcgccgtcagcatggccaacatcttcagaggttcatacttggccggcgccgggcttgcgttcagcctcatgaagtccttaggtgggggccggcgcggcacgggcgcccagggcgaaacgctgggcgagaagtggaagaggcagctgaaccaactatccaagagcgaattcaacatctacaagcgcagcggtattatggaggtggaccggagcgaggctaaggaggggctgaagcgcggcgaaaccacccggcacgccgtgtccagggggaccgcgaagttacggtggtttgtcgagagaaacctggtgaagcccgagggcaaagtgatcgacctcggctgcggccggggcgggtggagttactactgcgccgggctgaagaaagttacggaggtgaaggggtacaccaagggcgggcctgggcacgaggagcccatcccgatggccacatatggctggaaccttgtgaaactccactccgggaaggacgtctttttcactccgcccgaaaagtgtgacaccctgttgtgcgacattggcgagagcagtcctaacccgaccatcgaggaaggtcgcaccctccgggtcctgaagatggtggagccctggcttcgcggcaaccagttttgcatcaagatcctcaacccctacatgcccagcgtggtagagaccctggagcagatgcaacggaagcatggcgggatgctggtgcgcaaccccctatctcggaacagcacccacgagatgtattgggtctcctgcggcacgggaaacatcgtgagtgcagttaacatgaccagtcgcatgctgctcaaccgcttcaccatggcccaccggaaacccacctatgaaagagacgttgacctcggcgcgggcacgcggcacgtcgccgtggagcccgaagtcgcgaacctggatatcatcgggcagcgcatcgaaaacatcaaacacgagcacaagtcaacctggcactacgacgaagacaacccctacaagacgtgggcgtaccacggctcctacgaggtgaagccgtccggcagcgccagctccatggtcaacggcgtggtaaagctcctcaccaagccctgggacgtgatccccatggtaacgcagatcgcgatgaccgacaccactcccttcggccagcagcgggtgttcaaggagaaggttgacacgcggactccgaaagccaagcgaggcacggcccagataatggaggtcacagctcgctggctgtggggtttcttatcccggaacaagaagccccgcatctgtacgcgggaggagtttactcggaaagttagaagcaacgctgcgatcggggccgtcttcgtggacgagaatcagtggaactccgccaaggaggccgtagaggacgagcggttctgggatttggttcagaaggagcgggagctgcacaagcagggcaagtgcgcgacttgcgtatataacatgatggggaagcgagagaagaaactgggcgagttcggaaaagccaaaggctccagagccatttggtatatgtggctcggcgcccgcttccttgagtttgaggccctagggttcatgaacgaggaccactggttttcccgggagaattcactctccggcgtggagggggagggcttacacaagctcgggtacatcctcagggacattagcaaaatcccgggcggcaacatgtatgcagacgacaccgccgggtgggacacacggatcaccgaggacgatttacaaaatgaagcgaagattaccgacatcatggagccggagcacgccctgctggccacctccatcttcaagctgacgtaccagaacaaggtcgtccgcgtgcagcgcccggcgaagaacggcaccgtcatggacgtgatctcacggcgcgaccaacgggggtctgggcaggtgggcacctacgggctcaacaccttcacaaatatggaagcccagctcatccgccagatggaaagtgagggcatcttcctgccctccgagctggaaacccctaacctcgccgagcgggtcctggattggctggagaagtatggggtagagcgcctcaagcggatggccatcagcggcgacgactgtgtggtcaagcccatcgacgaccgcttcgcaactgcactgactgccctcaacgacatggggaaggtgaggaaggacatcccccagtgggagccctccaagggctggaacgactggcagcaagtccccttttgtagccaccactttcaccagttaataatgaaggacgggcgcgagatagtcgtcccgtgtcgtaaccaggacgagctggtagggcgcgccagagtctcccagggcgcggggtggagcctgcgcgagacggcgtgcctcggcaaaagctacgcgcagatgtggcagctgatgtacttccaccgtcgcgatctccggctagccgctaacgctatctgctccgcggtgcccgtggactgggtcccgaccagccgcacaacttggtccatacacgcccaccaccagtggatgacgaccgaggatatgctgagcgtgtggaaccgagtatggatcgaggagaatccctggatggaagacaagacacacgtctcctcctggggggacgtgccgtacctgggcaagcgcgaagaccagtggtgcggatccctcatagggctgaccgcccgcgccacctgggccagcaacatccaggtggcgatcaaccaagtacggcgcctgatcggaaacgaaaactacctcgactacatgacaagcatgaaacggtttaagaatgagggggatcccgagggcgccctgtggtaa

SEQ ID NO: 24353 - RNA, 9879 nt, synthetic construct
  misc_feature 1..9879: note = derived and/or modified CDS sequence (opt11) from DENV-1__GQ199833__SS-prME
  source 1..9879: mol_type = other RNA
agcgtgacgatgctactcatgctgatgcccacagccctggcattccaccttaccacccgcggcggggagccccacatgatcgttaccaagcaggagcggggtaaatcccttctgttcaagacttcagcgggtgtgaacatgtgtaccctcatcgccatggacctgggggagctgtgtgaggataccatgacctataagtgcccgcggatcaccgaggcagagccagatgacgtggactgctggtgcaacgccaccgacacctgggtaacgtatgggacttgcagccagacgggagagcacagacgcgaccggcgcagcgttgccctcgcgccccacgtgggccttgggctggagacccgcacggagacctggatgtcgagcgaaggcgcctggaagcagatccagagagtggaaacgtgggccttacggcaccccgggttcacagtgatcgcgctgttcctggctcacgcgatcggcacctccatcacgcagaagggaatcatcttcatcttgctgatgctggtgactccctctatggctatgcggtgcgtaggcattggcagccgggacttcgtagaggggctaagcggcgccacctgggtggacgtcgttctggagcatgggtcctgcgtcactaccatggccaaggacaaacccacgctggatatcgagctactgaaaacggaggtcaccaaccccgcagtgcttcgcaaactctgcatcgaggccaagatcagcaacaccaccacagactcccggtgccccacccagggcgaggcgaccctgatggaagagcaggacgccaacttcgtatgtcgaagaacattcgtcgaccgcgggtggggaaatggttgcgggctgttcggcaaggggagcctcatcacgtgcgccaagtttaaatgcgtaaccaagttagaaggcaagatcgtgcaatatgaaaacctgaagtactcggtaatagtgaccgttcacacgggagaccagcaccaggtcgggaacgagagcaccgagcacggtacaactgcgactatcacaccccaggcccccacctcagagatccagctcaccgactacggggccctaaccttagactgcagcccgcggacgggcttggacttcaacgagatggtgctgctaactatgaaggggaagtcatggctcgtccacaagcagtggtttctggacttgccgctcccatggaccagcggcgccagcacctcccaggagacgtggaaccgtcaggaccttctcgtcacctttaagactgcccacgcgaagaagcaggaggttgtcgtgctcggctctcaggagggggccatgcacaccgcactgaccggcgccacggagatccagacttctgggacgaccaccatcttcgccggccaccttaagtgccggctcaagatggacaagctgaccctgaaggggatgagctatgtgatgtgcaccggtagcttcaagctcgagaaggaggtagcggagacgcagcacggcaccgtactggtgcaaattaagtacgagggcactgatgccccctgcaaaatccccttcagcacacaagacgagaaaggggttacgcagaacgggcgtctcatcacggccaacccgatcgtgactgacaaggagaagcccgtgaatatagaagcggagccgccgtttggggagtcctacatcgtcatcggcgcgggagaaaaggccctgaaactcagctggttcaagaagggctccagcatcggtaagatgttcgaggccactgcccgcggcgctcgccgcatggcgatccttggggacacggcctgggattttgggtccatcggcggtgtcttcaccagtgtcggcaagctcgttcaccagatcttcgggacggcctacggcgtcctattctccggggtgtcctggaccatgaaaatcggtataggcgtcctgcttacgtggctgggtttgaactcccggagtacctccttgtccatgacctgcatagccgttggcctcgtgacgttgtatctgggggtcatggttcaggcggattccgggtgcgtgatcaactggaagggccgcgagctcaagtgtggcagcggcatattcgtcactaacgaggtacacacctggacagagcagtacaagttccaggctgattccccgaaacggctcagtgcggccattgggaaggcctgggaggagggcgtatgcgggattcgcagcgcgacaaggctggagaacatcatgtggaaacagatctccaacgagctgaaccacatcctgctggagaacgggatgaagtttaccgtcgttgtaggggacgtcgtgggaatcctcgcgcagggcaagaagatgatccgcccacagcccatggagcataagtacagctggaagagttgggggaaggccaagattataggggccgatgtgcagaacacgaccttcataatagacgggcccaacaccccggagtgccccgatgaccagcgggcgtggaacatttgggaggttgaagactatggattcggcatattcaccacaaacatctggctcaagttgcgagacagctacacccaggtgtgtgatcatcggctcatgtccgcggccatcaaggactcaaaagccgtgcacgccgacatggggtactggatcgaatccgagaagaacgagacctggaaactggcgcgggcttctttcatagaagtcaaaacatgcatctggccaaagtcccatacgctgtggagcaacggcgtactcgagagtgagatgattataccaaagatctacgggggcccgatctcgcagcacaactatcggccgggctacttcacccagacggccggcccctggcacctcggcaagctggagctcgatttcgacttatgtgaagggactacggttgtcgtggacgaacactgcggcaaccgagggccgagcctgcggaccaccaccgtaactggcaagatcatccacgagtggtgctgccgcagttgcacgctgccccccctgcggttcaaaggcgaggacggctgttggtatggcatggaaatccgccctgtcaaggaaaaggaggagaacctggtcaaatctatggtgagtgccggcagcggcgaggtggactcattctccctcgggttactgtgtatatcaatcatgatcgaggaggtgatgcgcagccggtggtccaggaaaatgcttatgaccggcaccttagccgtgttcctgttgctgatcatgggacagctgacgtggaatgatctcattcgcctgtgcatcatggtcggcgctaacgcgagtgaccggatgggaatggggaccacctacttagcattaatggccaccttcaagatgcggcccatgttcgcagtgggcctgctgttccgccgcctgacgtcccgcgaagtgcttttactcaccatcggtttgagcttggtggcctcagttgagctccccaactcattggaggaactgggtgacggcctcgccatggggatcatgattctgaagctgttaaccgacttccagtcccaccagctgtgggccaccctgttatccctgacgtttataaaaacgaccctttcccttcactacgcgtggaagaccatggccatggtcctgagcatcgtgtcgttgttccccctctgtttaagcacgacctcccagaagacgacatggttacccgtgctcctgggctcgcttgggtgcaagccgttgacgatgttcctgatagcggagaacaaaatctggggccgcaagtcctggccgttaaatgaggggatcatggccgtcggggtagtgtccatcctactgtcctccctacttaaaaacgacgtccccctggccggccccctgatcgcgggcggcatgctcattgcctgctacgtgatcagcgggtccagcgctgacttatccctggagaaggccgccgaagtatcgtgggaggaggaggccgagcattccggcgcctcccacaatatcctagtagaagtgcaggacgacgggaccatgaagatcaaggatgaggagagggacgacactttgaccatcttacttaaagcgaccctactagcagtttccggcgtttaccctcttagcatccctgccaccctattcgtgtggtacttttggcaaaaaaaaaagcaacggagtggcgtgctgtgggacactcccagcccgcccgaggtcgagagagccgtattagacgacgggatatatcggatcatgcagcgcggcctgctggggcgaagccaagtgggcgtcggggtgtttcaggagaacgtgttccacacgatgtggcatgtaactcgcggcgctgtactgatgtaccaaggcaagcgactcgagccctcttgggcttcggtgaagaaggacctgatcagctacgggggtgggtggcgcctgcagggctcctggaacacgggggaggaggttcaagtaatagccgtggaaccaggcaagaacccgaagaacgtacagaccgctcccggcacgttcaagacgcccgagggcgaggtgggcgccatagccctcgatttcaagcctggcacgtccggatcccctattgtgaaccgggagggcaagatagtcggactgtacggaaacggggtggtgaccaccagcggcacatatgtcagcgccatcgcccaggccaaggccagtcaggaggggcctctgcccgaaatcgaggacgaagtgtttcggaagcggaacctcacgattatggacctgcatcccggcagtggcaaaacccggcggtacctgcccgcgatcgtcagagaggccataaagaggaagctccgcacgcttatcttggctccgacccgcgttgtggccagcgagatggcggaagcgctaaaggggatgcctatacgataccagacgaccgcagtcaagtcggagcacacaggcaaggagatagtggacctgatgtgccatgccacctttactatgcgcctgctttccccggtacgggtgccaaactacaacatgatcatcatggatgaagcccacttcaccgaccccagctccatcgccgcgcgtgggtacatcagcacccgggtcggcatgggcgaggccgccgccatcttcatgacggcaaccccgcccggttcagtggaggcgttcccgcagagcaacgccgtgatccaggacgaggagcgtgacatcccagagcgttcctggaattctggctatgagtggatcaccgacttccccggtaagacagtctggtttgtgccttccatcaagagcggcaatgacattgccaactgcctgcgcaaaaacgggaagcgggtgatccagctctcccgcaagacattcgacacagaataccaaaagacgaagaacaatgactgggactacgtcgtgaccaccgatatcagcgagatgggcgccaacttccgggccgatcgcgttatcgacccgagacgctgcctaaaacccgtcatcctgaaagacgggcccgagcgggtgatcctggcaggccccatgccggtgaccgtggcctccgcagcccagcgccgtggaagaataggcaggaaccacaacaaggagggagatcagtacatatacatggggcagcccctgaacaacgacgaggaccatgcgcattggacagaggccaagatgctgctggacaacatcaacaccccggaggggatcatccccgccttatttgagccggagagagagaagagcgcggccatcgacggggagtaccgcctgcggggcgaggcgcgcaagacctttgtggagcttatgagacgcggcgacctgcccgtctggctgtcgtacaaggtggccagcgaggggtttcaatatagtgaccggagatggtgcttcgacggcgagcggaacaaccaggtgctggaggagaacatggacgtagagatatggacgaaggaaggggagaggaaaaagctgcggccgcgctggctggacgcccggacctactcggaccccttggccttgcgcgagtttaaggagttcgccgcgggccggcgcagcgtctccggcgacctgatactggaaatcgggaagctaccgcagcacctcacccagagggcccaaaacgccctggacaatctcgtgatgctacataacagcgagcagggcggtcgagcttacagacacgcgatggaggagctgccagataccatcgagacgctcatgctactggccctcatcgccgtgttgactggcggtgtaacactgtttttcctctccggccgcggccttggcaagaccagcattggcttactgtgcgttatggcttcaagcgtcctgctgtggatggcctccgtcgagccccactggattgcagcttcgattatcctcgagttcttcctgatggtgctcctcatccccgagccggaccgtcagaggacgccccaggacaatcagctagcctacgtcgttatcgggctgctattcatgatactaacggtggccgccaacgagatgggcttactcgagaccacgaagaaagacttggggatcggccacgtagcggtggagaaccaccaccacgccacaatgctggatgtggacctccatcccgcctcagcctggacgctgtacgcggtagcgactaccatcatcacaccgatgatgcggcatacgatcgaaaacacaacggccaatatctcccttaccgccatagccaaccaggccgcgatcctcatgggcctggacaaagggtggcccatctccaaaatggatatcggcgtgcccctattagccctagggtgctacagccaggtgaaccccctgacgctcaccgccgccgtcctgatgttagtggcccactacgccataatcgggccggggctccaggctaaggccactagagaagctcagaagcgcaccgcggccggcattatgaagaaccccacggtggacggcatagtggccatcgacttggacccggtggtgtacgatgcgaagtttgagaagcaactggggcagatcatgctcctgatactgtgcacctctcagatcctcttaatgcggaccacctgggccctgtgcgagtcaatcacactcgctacgggcccactgacaaccttatgggagggcagcccgggcaagttctggaacacgaccatcgcggtcagcatggcaaacattttccgcggctcctacctcgccggggctggcctggcgttctccctgatgaagtccctcgggggcgggcgtcggggcacaggcgcccagggggagaccctgggcgagaagtggaagcggcagctgaatcagctcagcaagtcagagttcaacatttataagcgcagcggaatcatggaggtggatcgaagcgaagcgaaggagggcctgaagcgcggggagacgacccggcacgccgtctcccgcgggaccgctaagctgcgatggttcgtcgagaggaatctggtaaaacccgagggcaaggtgatcgatctcggatgcggacgcggagggtggagctactactgcgccggcttgaagaaggtcactgaagtaaaggggtacaccaaaggcgggcctggtcacgaggagcccattccgatggccacatacgggtggaatttggttaaacttcactccggtaaggacgtgttcttcacgccccccgaaaaatgcgataccttgctgtgcgatatcggtgagagctctcccaatccaacgatcgaggagggccgcacactccgggttctgaagatggtagagccctggctgcggggcaaccaattctgcatcaagattttaaacccttacatgcctagcgttgtggagacgctggagcagatgcagcggaagcatgggggcatgttagtgcgcaacccgttgtccaggaactcgactcacgagatgtactgggtctcctgcggcaccggcaatattgtgtccgccgttaacatgacctcccgcatgctgctgaacagattcacgatggcccaccgtaaacccacatacgagcgcgacgtcgacctgggcgccgggacgcggcacgtggccgtggagccagaagtcgccaatctggacattatcggccagcggatagagaacatcaaacatgagcacaagagtacgtggcactacgacgaggacaacccctataaaacctgggcctatcatggctcctacgaggtgaagcccagcggatcagccagcagcatggttaacggggtggttaagctgctcaccaagccctgggacgtcatcccgatggtgacccagatcgcgatgacggacaccaccccgttcggccagcaacgtgtcttcaaggagaaggtcgacacacgcacgcctaaagcaaagcggggcactgctcagataatggaggtgaccgcccgctggctgtggggtttcctgtctcggaacaagaagccccgcatttgcacccgggaggagttcacgaggaaggtgcgttctaatgcagcaatcggcgccgtctttgtggacgaaaaccaatggaacagcgcaaaggaggccgtggaggatgagcgcttctgggacctcgtccagaaagagcgagaactgcataaacaggggaaatgtgcgacctgcgtgtacaacatgatgggaaagcgagagaagaagctgggggaattcggcaaggccaagggcagccgtgccatttggtacatgtggctcggagctcgcttcttagagttcgaggccctgggctttatgaacgaagaccactggttctctcgggaaaacagcctctccggggtggagggcgaaggtctgcataagctgggttacatattacgcgacatttcgaaaatcccaggcgggaacatgtacgcggacgacacggctggctgggacacacgtataacggaggacgacctgcagaacgaggccaagattacagatatcatggagccggagcacgccctacttgccaccagtatattcaaactgacttaccagaacaaggtcgttcgggtgcaacgccccgcgaaaaacggaacagttatggacgtgatctcgcggagggaccagcggggatctggccaagtggggacctatgggctaaacaccttcactaacatggaggctcagctgatccgccagatggaaagcgaggggatcttcttaccctcggagctggagacgcccaacctcgcggagcgggtccttgattggctggagaagtacggcgtggagcgcctaaagcgaatggcaatcagcggagacgactgcgttgtcaagccgatcgacgaccgttttgccactgccctgaccgccctcaacgacatgggcaaagtgcggaaggacatcccccagtgggagccctccaagggctggaacgactggcagcaggtccccttctgctcacatcacttccaccaattaatcatgaaggacggacgcgagatagtcgtgccatgccgtaatcaggacgagttggtcggccgtgcccgggtctcccagggtgccggctggtcactgcgcgagaccgcgtgtctcgggaagagttacgcgcagatgtggcagctgatgtactttcaccgtcgcgacctgcggcttgccgcgaacgccatctgctccgccgtgcccgtcgattgggttcccactagcaggaccacctggtccatccacgcccaccaccagtggatgaccacggaggacatgctgagcgtgtggaatcgggtttggatcgaggagaatccctggatggaggataagacccatgtctccagctggggtgatgtgccatacctgggcaaacgcgaagaccagtggtgtggctcccttatcggcttgacagcccgcgcgacctgggcgtcaaacatccaggtggcgatcaatcaggtcagacgcctgatcggtaatgagaactatttggactatatgacctccatgaagcggttcaagaatgagggggaccccgagggggccctgtggtga

SEQ ID NO: 24354 - RNA, 9879 nt, synthetic construct
  misc_feature 1..9879: note = derived and/or modified CDS sequence (opt11) from DENV-1__FJ882570__SS-prME
  source 1..9879: mol_type = other RNA
agcgtgaccatgctgctcatgctgatgcccaccgccctggcgttccacctgactacgcggggtggtgaaccccacatgatcgtgacaaagcaggagcgggggaaaagcctgctcttcaagaccagcgccggcgtcaacatgtgcacccttatcgccatggacctgggcgagctgtgcgaggacaccatgacctacaagtgcccccggattaccgaagccgagcccgacgacgttgactgctggtgtaatgccaccgacacctgggtgacctatgggacgtgcagccagacgggcgagcaccggcgcgacaaacggagcgtggccctggcgccccacgtgggcctgggactggagacccgcaccgagacctggatgtccagcgagggcgcctggaaacagattcagcgggtcgagacgtgggccctgcgccaccccgggttcacggtgatcgccctatttctggcgcacgccattggcaccagcatcacccagaaggggatcatcttcatactcctgatgctggtgacgccttctatggccatgcggtgcgtaggcatcggctcccgcgacttcgtggagggtctcagtggcgccacctgggtggacgtcgtgctggagcacgggtcgtgcgtgaccaccatggccaaggataagcccacactggacattgagttgctgaagaccgaggtcaccaaccccgctgtgctgcggaagctgtgcatcgaggccaagatcagtaacacaacgaccgactcccgctgccccactcagggcgaagccacgctgatggaagagcaggacgccaacttcgtgtgtcggcgcacgttcgtcgaccggggctgggggaacggctgcgggctgttcggcaagggtagcctcatcacgtgcgccaagtttaagtgcgtgaccaagctcgagggcaagattgtacagtacgagaacctgaagtactcagtgatcgtgaccgtgcacacgggcgaccagcaccaggtcgggaacgagagcaccgagcacggcaccaccgcgacgatcacgccccaggcccccacctccgagattcagctgaccgattacggcgccctaaccctggactgctctccacgcacgggcctcgacttcaacgagatggtcctgctgaccatgaaggagaagagctggctcgtccacaaacagtggttcctggatctgccgttaccatggaccagcggggctagcacctcccaggagacctggaacaggcaggacctgctagtcaccttcaagaccgcccacgcgaagaaacaagaggtcgtcgtgctcggcagccaggagggcgccatgcacacggcactgacgggggcgaccgagatccagacctccggcacaacaaccatctttgccgggcacctgaagtgccgcctcaagatggacaagctgaccctgaagggcatgagctacgtgatgtgcaccggttcctttaagctcgagaaggaggtcgcagagacgcagcacggaaccgtgctggtgcagataaagtacgagggcacagacgcaccgtgcaagatccccttcagcacccaggacgggaagggcgtaacgcagaacgggcggctgatcaccgctaacccgatcgtgaccgacaaggagaagccagtaaacatagaggctgagccccccttcggcgagtcctacatcgtcatcggcgcgggggagaaggccctgaaactctcttggttcaaaaagggctctagcatcgggaagatgtttgaggccactgcccgcggcgcccgtcgcatggcgatcctgggggacacggcctgggactttgggtccatcggcggagttttcaccagcgtgggcaagctggtccaccagatcttcgggaccgcctacggtgtgctcttttccggggtgagctggaccatgaagatcggcatcggcgtcctgctcacatggctcgggctgaactccagatcaacgtcactgagcatgacctgtatcgccgtaggcctcgtaaccctgtacctgggggtcatggtgcaagccgactccggctgcgtgatcaactggaaggggagggagctcaaatgcggcagcggcatctttgttacaaacgaagtgcacacctggacagagcaatacaagtttcaggctgactcgccgaagagactgtccgccgccataggcaaggcgtgggaagaaggcgtatgcggcatcaggagcgcaacacgactggagaacatcatgtggaagcagatctccaacgagctcaatcacatcctgcttgagaacggcatgaagttcacggtggtggtgggggacgtagtgggcatcctcgcgcagggaaagaaaatgatccggccccaacccatggagcacaagtacagctggaagtcctggggcaaggctaagataataggcgccgacgtgcagaacaccaccttcataatcgacggcccaaacacaccggagtgccccgacgaccaacgcgcttggaatatctgggaggtcgaagactacggctttggcatattcaccacgaacatctggctgaagctgcgggactcatacacacaagtgtgcgaccaccgtttaatgagtgcggccataaaggacagcaaggccgtgcacgccgacatggggtattggatcgagtccgagaaaaacgagacttggaagctggcccgggcaagcttcatcgaggtcaagacctgcatctggcccaagagccacacgctgtggagcaatggcgtcctcgagtccgaaatgatcatccccaaaatctacgggggcccgatcagccagcataactaccgccccgggtacttcacacagaccgccggcccctggcacctgggcaagctggagctcgacttcgacctgtgcgaaggcaccacggtggtagtggacgagcactgcggcaaccggggaccgtccctacgaaccaccaccgtgacgggcaaaatcatccacgagtggtgctgccgatcgtgcaccctgccgcccctccgcttcaaaggggaggacggatgctggtacggcatggagatccggcccgtcaaggagaaggaggagaacctcgtgaaatccatggtgagcgccgggagcggcgaggtagactccttcagcctggggctgctgtgcacctcgatcatgatcgaggaggtgatgcgcagccggtggtctcgcaagatgctcatgaccggtacgcttgcggtgttcctactcctgatcatgggacagctcacctggaacgacttaatccggctgtgtatcatggttggcgcgaatgcgagcgaccgtatgggaatggggaccacctacctggcgttgatggccacgttcaagatgcgcccgatgtttgccgtgggcctactattccggcgcctcacctcccgggaagtactgctgcttactatcgggctgagcctggtcgcctccgtggagctacccaatagcctggaggagctcggcgacgggttggcgatggggatcatgattctgaaactgctcaccgacttccaatcccaccagctgtgggccactcttcttagcctgacctttatcaagaccacactttccctccactacgcttggaagacgatggccatggtcctgtcaatcgtttccctctttccgctctgcttaagcaccacctcccaaaagaccacgtggctgcccgtgctcctgggctctctggggtgcaagccgctcaccatgttcctgatagcggagaacaagatctggggccggaagtcctggcccctaaatgagggaatcatggcggtaggggtggtgagtattttattgagctccctgctcaaaaacgacgtacccctggccggccccttgatcgccgggggcatgctcatagcctgttacgtgatttctgggtccagcgcggacctgtcccttgagaaggccgccgaagtgtcatgggaagaggaggccgagcacagcggcgccagccacaacatcttcgttgaggtgcaggacgacggcaccatgaaaatcaaggacgaagagcgagacgacacgctcaccatcctgctgaaggcgacgctcctggccgtgtccggcgtctacccgctgagcatccccgccaccctcttcgtgtggtacttctggcagaagaagaagcaacgcagcggcgtgctatgggacactccaagcccgcccgaggttgagcgggctgcgctggacgacgggatctaccgcatcatgcagcgggggctgttggggcgatcccaggtgggcgtgggagtcttccaggagaacgtatttcacaccatgtggcacgtgacccggggggcggtcctgatgtaccagggtaagcgcctggagcccagctgggccagcgtgaagaaagacctcatcagctacgggggagggtggcggctgcagggtagctggaacactggggaggaggtgcaggtcatagctgtggagcctggcaagaaccccaagaacgtgcaaaccgcccccggcaccttcaagacgcccgaaggggaggtcggggctatcgccctggactttaagcccgggaccagcggctcccccatcgttaaccgcgaaggcaagatcgtgggactctacggcaacggggtcgtcaccaccagtggcacctatgtcagcgcaatcgcccaggccaaggcttcgcaagaggggccgctgcctgagatcgaagacgaggtcttccggaagcgcaacctgaccataatggacttacaccccggcagcggaaagacccggcgctatctgccggccatcgtgcgggaggccatcaagcgcaagctgcggacactcatcttagcccccacgcgcgtggtcgcctccgagatggcggaagccctgaaggggatgcccatccgctaccagaccaccgccgtaaagagcgagcacacaggcaaggaaatcgtggacctgatgtgtcacgccacgttcaccatgcggctgctttcacccgtccgtgtgcctaactacaacatgatcataatggacgaggctcacttcactgacccgtcctcgatcgcggcccggggatacatcagcacccgcgtgggcatgggcgaggccgccgccatattcatgactgcgactccgcctggctccgtcgaggccttcccgcagtccaacgccgtgatccaggacgaggagcgggacatccccgaacgctcctggaacagcggctacgaatggatcaccgacttccccgggaagaccgtgtggttcgtcccctccattaagagcggcaacgacattgccaactgcctccgaaagaacgggaagcgcgtgatccagctgtcccggaagacgttcgataccgaataccagaaaaccaagaacaacgactgggactatgtggtgaccacggacatcagcgagatgggagcaaacttccgagccgaccgggttatcgaccctcgccggtgtttgaagcccgtgatcctcaaagatggtcccgagagagtcatcttagccgggcccatgcccgtgaccgttgcctccgccgcgcagcggcgcggccggatcggacggaaccacaacaaggaaggcgatcagtacatttacatgggacagcccctgaataacgacgaggaccacgcccattggactgaggcgaagatgctcctggataatatcaacacccccgagggcataatccccgccctgttcgagccagagcgggaaaaatcggccgcgattgacggagagtaccgcctcaggggcgaggccaggaagacgttcgtggagctcatgcgccggggcgacctgcccgtgtggctctcctacaaggtcgcctccgaggggttccagtacagcgaccgccggtggtgtttcgacggcgagcgcaacaaccaagtgctggaggaaaacatggacgtcgagatctggaccaaggaaggggagcggaaaaagctgcgcccccggtggctcgacgcccgcacctactccgacccgttggccttacgagaattcaaggagttcgcggccggtcgccggagcgtctctggtgaccttatcctggagattgggaagctgccgcagcacctcactcagcgcgcccagaacgccctggataacctggtaatgctccacaatagcgaacagggcgggcgggcgtaccgccacgccatggaagagctgcccgacaccatcgaaaccctgatgctactggctctgatcgccgtgctcacaggcggggtcaccctgttcttcctgtccggccggggcctcgggaagaccagcatcggcctgctgtgcgtgatggcctcaagcgtgctcttatggatggcctcagtcgagccccactggattgccgcctcgatcatcttggagttcttcctaatggtcttgttaatcccagaacccgaccgccagcggacgccccaggacaaccagctcgcttacgtggtgatcgggctgttgttcatcatcctcaccgtagccgcgaatgaaatgggactactggagaccaccaagaaggacctcggtatcggccatgttgccgtcgagaatcaccaccacgccacgatgctggacgtggacctgcaccccgcctccgcttggaccttatacgctgtggccaccaccatcatcaccccgatgatgcgccacaccattgagaataccaccgccaacatctcattgacggcaatcgccaatcaggctgccatcctgatgggcctcgacaagggctggcccatctccaagatggacatcggcgtccccctgttagccttagggtgctacagccaggtgaaccccctaacccttaccgccgcagtgctcatgctggtggcccactacgccatcattggccccgggctgcaggcgaaggccacccgggaggcgcagaaacgcactgccgccggcatcatgaagaaccccaccgtggatggcatagtggcgatcgacctcgaccccgtcgtgtacgacgcaaagttcgaaaagcagctggggcagatcatgctgctcatcttatgcacctcccagatcctgctcatgcgcactacgtgggctctgtgcgagagcattaccctggccaccggcccactcaccacactgtgggaggggtccccgggtaagttctggaacaccaccatcgccgtcagcatggctaatatcttcagaggctcctacctggccggggcgggactggctttttctctgatgaagtccctagggggcgggcgccgggggaccggcgcgcagggggagacgctcggcgagaaatggaagcgccagttgaaccagctctccaagagcgaattcaacatatataagcggtcagggatcatggaggtcgaccgtagcgaggccaaggagggcctcaagcgcggcgagacaacccgccacgcggtgtcccggggcaccgccaagttacgctggttcgtggaaagaaacctggtcaagcccgagggcaaggtgattgatctgggatgcggccgcgggggctggtcatactactgcgctggcctcaagaaggtgacggaggtcaagggttacaccaagggcgggcccggccacgaggagccaattcctatggccacctacgggtggaatctggtgaagctgcactctgggaaggacgtgtttttcacgccgcccgagaagtgtgacacgctcctgtgtgacatcggggaaagcagcccaaacccgaccatcgaggagggccggaccctccgcgtgcttaaaatggtggagccttggcttcgggggaaccagttctgcatcaagatcctgaacccctacatgcccagcgtggtcgagaccctcgagcagatgcaacgcaagcacgggggcatgctggtgcggaacccgctgtcccgcaacagcacccacgagatgtactgggtttcctgcgggacgggcaacatcgtctcagccgtgaacatgacctcccggatgctcctgaatcgcttcaccatggcgcaccgcaagcccacctacgagcgggacgtggacctaggcgccgggacgcgtcacgttgcagtggagcccgaggtggccaaccttgacatcatcggccagcggatcgaaaatatcaagcacgaacacaagagcacctggcactacgacgaggacaacccctacaagacctgggcctaccacgggtcctacgaggtcaagccgagcggttccgccagcagcatggtgaatggggtcgtcaagctgctgaccaagccctgggacgtaatccccatggtcacgcagatcgccatgacagacaccacccccttcggtcagcagcgcgtattcaaggagaaggtggacacgcggacgcccaaggccaagcgcggcaccgcacagattatggaggtcaccgcccggtggctctggggtttcttaagccgcaacaagaagccccggatctgtacacgtgaggagtttacccggaaagtgcgcagtaacgccgccatcggagccgtgtttgtagatgagaaccagtggaactccgccaaggaggcagtcgaggacgaacggttctgggatctggtgcagaaagagcgcgagctccataagcaggggaagtgcgccacctgcgtctacaacatgatgggcaagagggagaagaagctgggggagttcggcaaggccaagggaagccgggccatctggtacatgtggctcggggcccgattcctcgagttcgaggcgctgggcttcatgaacgaggaccattggttctcccgcgagaacagcctgagcggggtggagggcgaagggctccacaagttgggctacatcctgcgggacatctccaagatacccggtggaaacatgtacgccgacgacactgccggctgggacacgcgcatcaccgaggatgacctccagaacgaggccaaaatcaccgacatcatggagcctgaacacgcactcctggctacctccatcttcaagctcacgtaccaaaacaaggttgtccgggtgcaacgccccgccaagaacgggaccgtgatggacgtcatctccaggcgggaccagagaggctccgggcaggtagggacgtacggcctgaacaccttcacgaacatggaggcccagctgatccggcagatggagagcgaggggatattcctcccctccgagctggaaacgcccaacttggcggagcgcgtgctcgactggttagagaagtacggagtcgagcggttaaagcgaatggccataagcggggacgattgtgtcgtgaagcccatcgacgaccggttcgccaccgcgctcaccgcactgaacgatatgggcaaggtgcgtaaagacatccctcaatgggagccctccaagggctggaacgattggcagcaggtcccgttctgcagtcaccactttcaccagcttatcatgaaggacggacgggagattgtcgtaccctgcaggaaccaggacgaactcgttggccgggcccgagtgtcccaaggggccggatggtctctgcgagagacggcgtgcctgggtaagagctacgcccagatgtggcagttaatgtacttccaccgtcgggacctgcgactggcggcaaacgcgatttgttccgccgtccccgtggactgggtgcccactagccggaccacgtggagtattcacgcccatcaccagtggatgacgaccgaagacatgctcagtgtctggaaccgcgtttggatcgaggagaacccatggatggaggacaagacccacgtgtccagttggggcgacgtaccgtacttgggcaagcgggaggatcagtggtgcgggtccctgatcggtctaacggcccgggccacctgggcgtctaacatccaggttgccattaaccaggttcgccggctgattgggaatgagaactatctggattatatgacaagcatgaagcgcttcaagaacgagggagaccctgaaggtgcgctctggtga

SEQ ID NO: 24355 - RNA, 9879 nt, synthetic construct
  misc_feature 1..9879: note = derived and/or modified CDS sequence (opt11) from DENV-1__GQ199834__SS-prME
  source 1..9879: mol_type = other RNA
agcgtgaccatgctgctcatgctgatgcctaccgcgctggcattccatctgaccaccagaggaggggaaccacacatgattgtgaccaagcaagagcggggcaagagcctgctgttcaagaccagcgcgggggtgaacatgtgcaccctcatcgccatggacttgggcgagctgtgcgaggacaccatgacttacaagtgcccccgaatcacggaagcagaacccgacgacgtggactgttggtgtaacgccaccgacacctgggtcacctatgggacctgcagccaaacgggtgagcaccggcgcgataaaagatcggtggccctggcgccccacgtgggcctggggttggaaacgcgcaccgaaacctggatgtcaagcgagggcgcctggaaacagatccagcgggtcgagacctgggccctacggcaccccgggttcaccgtgatcgccctattcctggcgcacgccatcggaacctccattacccagaaggggattattttcatcctcctaatgctggtgactccctctatggcgatgcggtgcgtcggtatcggcagccgcgacttcgtggaggggctcagcggcgccacttgggtggacgtcgtactggagcacgggtcctgtgtgaccaccatggccaaggataagcccacgctggatatcgagctcttaaagaccgaggtgaccaatcccgccgtgctgcggaagctctgcatagaggctaagataagcaacacgacaaccgacagccgctgccccacccagggcgaggccaccttaatggaggagcaggacgcgaacttcgtgtgccggcgaacgttcgtcgatcgcggatggggtaacggttgcggattgttcggcaagggcagcctcatcacttgtgccaaattcaagtgcgtgaccaagctggaaggcaagatcgtgcagtacgagaacctaaagtactcggttatcgtgaccgtccacactggcgaccagcaccaggtcgggaacgagtcaaccgaacacgggaccacagcgaccatcacgccccaagccccgacctccgaaatccagctcaccgactacggagctctgactctagactgtagcccccgcacgggcctcgacttcaacgagatggtgctcctgacaatgaaggagaagtcctggctcgtgcacaagcagtggttcctggacctgccgctcccctggaccagcggggcctcaacgtcccaagagacgtggaatcggcaggacttactggtaacgttcaagaccgcccacgccaagaagcaggaggtggtcgtgctcggcagccaggagggagccatgcacaccgccctgacgggggccaccgaaatccaaacctccggcacgacgactatcttcgcagggcacctgaagtgtcgcctcaagatggacaagctgacactgaagggcatgagctacgttatgtgtaccgggagcttcaaactcgagaaagagctggcggaaacgcaacacggcaccgtcctggttcagataaagtacgagggtaccgacgccccctgcaagatccccttcagcacacaagacgagaagggggtgacgcagaacggccggctgattaccgccaacccgatcgtcaccgacaaagagaaaccagtgaatatcgaggccgagcctcccttcggggagagttacatcgtgatcggcgcgggcgagaaggccctcaagctgagctggttcaagaaggggtcctctataggcaagatgttcgaggccaccgcccgcggcgcccggcgcatggcgatcctgggcgatacggcttgggacttcgggtccatcggcggcgtctttacatcggttgggaagctcgtacaccagatcttcggcaccgcctatggggtcttattctccggcgtgtcttggaccatgaaaatcggtatcggcgtgctcctcacgtggctgggcttaaactcccgcagcacctccctcagcatgacctgcatcgccgtaggcctggtgaccctttacctgggcgtaatggtccaggccgattcagggtgcgtcatcaactggaagggccgtgagctgaagtgcgggtcaggcatcttcgttacaaacgaggtgcacacctggaccgagcagtataagttccaggcagacagcccaaaacgcctgtcggcagccatcggcaaggcctgggaggagggggtctgcgggatccgcagcgctaccagactcgagaacatcatgtggaagcagatctccaacgagctgaatcacatcctgctcgaaaacgggatgaaattcaccgtggtcgtgggcgatgtggacgggattctggcccagggcaagaagatgatccggccgcagccgatggagcacaagtactcttggaagtcctggggcaaggccaagatcattggggccgacgtccagaataccaccttcatcatagacggccccaacactccggagtgccccgatgaccagcgagcctggaacatctgggaggtggaggactacgggttcggtatctttaccacgaacatctggctgaaacttcgggacagctacacccaggtttgcgaccaccgcctgatgtccgcggcgatcaaagacagcaaggctgtccatgccgacatgggctattggatcgaatccgagaagaacgagacgtggaagctggctcgcgccagcttcatcgaggtgaagacatgcatctggcccaagagccatacgctatggagcaacggggtgctggagtccgagatgatcatccccaaaatctacggcgggccgatcagccaacacaactaccgccccggttacttcactcagactgccgggccctggcacctgggaaaacttgagttagacttcgacttgtgcgaaggcaccaccgtcgtcgtggacgagcactgcgggaatcgtggcccgtccctcaggactaccaccgtcacggggaaaattatccacgagtggtgttgccggagctgcaccctgccacccctgcgcttcaagggcgaggacggttgctggtacgggatggagatccggcccgtgaaggagaaagaggagaacctcgtgaagagtatggtgagcgccggctcgggggaggtcgactccttcagcctggggttgctctgcatttccatcatgatcgaggaggtgatgcgcagccggtggtctcgtaagatgctaatgaccgggactctcgccgtcttccttctgctcatcatgggccagctcacgtggaacgacctgatccggctgtgtatcatggtgggggccaacgcgagcgaccgcatggggatgggcaccacctacctcgccttgatggccaccttcaagatgcgcccgatgttcgccgtggggctactattccggcgcttgacgtcccgggaagtcctgctcctgactatcgggcttagtctcgtggcctctgtggagcttcccaacagtttagaggagctcggagacggtctggcgatgggcattatgatcctgaagctacttaccgatttccagtcacaccagctgtgggccacccttctgagcctgacgttcatcaagaccaccctctccctgcactacgcatggaaaactatggccatggtcctgtcgatcgtgtctctcttccccctgtgtctgagcacgacgtcccagaagaccacctggttgcccgtcctgctggggagcctcggctgcaagccgctgacgatgttcctgatcgcggagaacaagatctgggggcgcaagagttggccgttaaacgagggcatcatggccgtgggtgtcgtcagcatcctgctgagctccctcctgaaaaacgacgtgcccttggccggtcccctcattgcgggcggaatgctgatcgcctgctacgtcatcagcggctccagcgcggacctgtccctcgagaaggctgctgaggtcagctgggaagaggaagccgaacactccggggccagccacaacatcctggtggaagtgcaagatgacggcaccatgaagatcaaggacgaggaacgggatgacaccctgaccatcctcctgaaggcgaccttactcgccgtctccggggtgtacccgctcagcatccccgccacgttgtttgtgtggtacttctggcagaagaagaagcaaagatctggcgtcctgtgggacactcccagcccgccggaggtcgaacgggccgtgctcgatgacggcatctaccgcatcatgcagcgggggctgctgggcagatcgcaagtcggggtgggggtgttccaggagaacgtattccacaccatgtggcacgtgacacgcggggccgtgctcatgtaccagggcaagcgcctggagcccagctgggcgagtgtcaagaaggacctgatcagctatggcgggggatggcggctccaggggtcctggaacacgggggaggaggtgcaagtgattgccgtcgagcccgggaagaaccccaagaacgtgcagaccgcccccggcaccttcaagacccccgagggtgaagtgggggctatcgccctggacttcaagcccggcacgtccgggagccccatagtcaaccgcgagggcaagatcgtgggcctctacgggaacggcgtggtcaccacaagcggcacctacgtgtctgcgatcgcccaagccaaggcgtcccaggaaggcccccttcccgagatcgaggacgaggtattccggaagcgcaacctaacgatcatggatctgcaccccgggtcaggcaagacccggcgatacctcccagcgatcgtgcgggaagcgatcaagcggaagctgcggacgctgatcttggcccccacgcgcgtggtggcatccgagatggccgaggcgctaaaaggcatgccaatccgataccaaacgaccgctgtaaagagcgagcacaccgggaaggaaatcgtggacctgatgtgccacgccacgtttacgatgagactcctgtcgcccgttcgcgtcccgaactacaatatgatcatcatggacgaagcccatttcaccgacccaagctctatagcagcgcggggctacatctcaacccgcgtggggatgggcgaggctgccgccatcttcatgaccgcgacgccgcccgggtccgtggaggcgttcccgcaaagcaacgccgtcatccaggacgaggagcgggatatccccgagagatcttggaacagcggctacgagtggatcaccgacttccccggcaagaccgtgtggtttgtgccctccatcaagagcgggaacgacatcgcaaattgcctgcggaagaacggcaagcgggtcattcagctctcccggaagaccttcgacacggagtaccagaagaccaagaacaacgactgggactacgttgtgaccactgacatcagcgagatgggtgccaatttccgcgcggaccgtgtcatagacccgagacggtgtctgaagcccgtgatcttaaaggatgggcccgaacgggtgatcctagccgggcccatgccggtcacggtcgcgtccgccgcccagcggcgtgggcggatcgggcgtaaccacaacaaggagggagatcagtatatttacatggggcagcccctaaataacgacgaggaccacgcgcactggaccgaggccaagatgctgctcgacaacatcaacacccccgaggggatcatccccgccctgtttgagccggagcgggagaaatccgccgccatcgatggcgagtaccgcctgcgcggggaggcgcggaagaccttcgtcgagctcatgcgcaggggcgacttacccgtctggctgtcttacaaggtggcctccgaaggcttccagtatagcgaccggcgatggtgcttcgacggggagaggaacaaccaggtcctcgaagagaacatggacgtggagatctggacgaaggagggcgagcggaaaaagctgcgcccccgatggctagacgcccgcacctactccgaccccctcgccctgcgcgagttcaaggagttcgccgcggggcgccggagcgtcagtggagacctgatcctcgagatcggcaagctgccccagcacctgacccagcgcgcccagaacgcgttagacaacctggtcatgttgcacaacagcgaacaaggcgggcgggcttaccgccacgcgatggaggagctccccgacaccatcgagacgctgatgctgctcgccctgattgcagtgctgacgggaggggtgactttgttcttcctgtccgggcggggcctaggcaaaaccagcatcgggctcctgtgcgtaatggcctcctccgtgttgctctggatggcttccgtggagcctcactggatcgcggcctcgatcatcctggagtttttcctgatggtcttactgatacccgagcccgaccgtcagagaacgccgcaggacaaccagttggcctacgtggtgatcggcctcctgttcatgatcctcacagtcgccgccaacgagatgggactcctggaaaccaccaagaaggacctgggcattgggcacgtggccgttgagaaccaccaccacgccaccatgctcgatgtcgacctacaccccgcctccgcctggaccctgtacgcggtggcgaccactatcatcactccgatgatgcgccacactatcgagaatactaccgccaacatcagtctgaccgccatcgccaaccaagcagcgatcctgatgggcttggacaaaggctggcccatatccaagatggacataggggttcctctcctggcgttgggctgctacagccaggtcaacccactcacgctgaccgccgccgtgctgatgctcgtggcgcactacgccattatcgggccgggactgcaagcaaaggcaacccgggaggcccagaaacgcaccgctgccggaatcatgaagaaccccacggtcgacggcatcgtggccatcgacctggaccccgtggtctacgacgccaagttcgagaagcagctcgggcaaatcatgctgctgatcctctgcacctcccagatcctgctgatgcggaccacctgggccttatgcgagagcatcactctggcgaccgggcccttaaccacactctgggaaggctccccggggaagttctggaacacgaccatcgccgtgagcatggcgaacatcttccggggctcctatctggctggcgccgggctggcgtttagcctcatgaagtccctgggcggaggccgtcgggggactggcgcccaaggcgaaacgctgggggagaaatggaaacgccagctgaaccaactgtccaagagcgagttcaacatctacaaacggtcgggcatcatggaggtggaccgcagcgaggctaaggagggactgaagcggggcgaaacgacccgccatgccgtttcccgggggaccgcgaaactgcgctggttcgtggaacgaaacctggtgaagcccgagggcaaggtcatcgacctgggctgcgggaggggagggtggagctattattgcgctggactaaagaaggtcacggaagtgaaggggtataccaaaggcggacccgggcatgaggagcccatcccgatggcgacttacggctggaatctcgtcaagctgcacagtgggaaggacgtgttctttacgccgcctgagaagtgcgacactttgctctgtgacatcggcgagagctcccccaacccgacgattgaggaagggcggacgcttcgggtgctgaagatggtcgagccctggctccgggggaaccagttctgcataaagatcctgaacccctacatgcccagcgtggtagaaaccctggaacaaatgcagcgcaaacacggcgggatgctcgtccggaatccgctgtcccgcaacagcacccacgagatgtactgggtgtcctgtggaaccgggaacatcgtgtccgccgtcaacatgacgtcccggatgctgctcaaccgattcaccatggcacaccgtaagcccacctacgagagggatgtggatctgggcgcgggcacccgccacgtggccgttgagcccgaggtggcgaacctggacatcatcgggcagcggatcgagaacattaagcacgagcacaagagcacgtggcactacgacgaggacaacccctacaaaacttgggcataccacggctcctatgaggtgaagccgagcgggtccgccagcagcatggtcaatggcgttgtcaagctcctcaccaagccctgggacgtaatacctatggtgacccagatcgcgatgacggacacaacccccttcgggcagcagcgcgtcttcaaggagaaggtggacacccggacgccgaaagcgaagcgcggcaccgcacagatcatggaggtgaccgcccggtggctgtggggtttcctctcccgcaacaagaagccacggatctgcacccgcgaggagtttactcggaaggtccgcagcaacgccgcgatcggtgcggtgttcgtcgacgagaaccagtggaactcagcgaaggaagccgtcgaagacgaacggttttgggacctggtgcagaaggagcgcgagttgcataagcagggaaagtgcgcaacctgcgtgtataatatgatggggaagagagagaagaagttaggagagttcgggaaggccaaaggcagccgcgccatctggtacatgtggctgggcgcccggttcttagagttcgaggccctcgggttcatgaacgaggaccactggttctcccgggagaactcgttgtccggtgtcgagggcgagggcctgcacaagctcgggtacatcctgcgggacatcagcaagatccccggcggcaacatgtacgcggacgacaccgccgggtgggacaccagaatcacggaggacgacctacagaacgaggccaagatcaccgacatcatggagccggagcacgcgctcctggccacgagtatcttcaagctgacctaccagaacaaggtggtgcgggtccagcgtcctgcgaagaacggcacagttatggacgtgatcagccgcagggaccagcgcgggtcgggccaggtcggcacgtatgggctcaatacctttaccaatatggaggcccagctgatccggcagatggagagcgaggggatcttcctaccctccgaactcgaaacgcccaacctggccgagagagtgctggactggctcgaaaagtacggtgtagagcggctgaaacgcatggctatctctggcgacgactgcgtcgtgaagccgatcgacgatcggttcgccaccgcgctgacagccttaaacgacatgggtaaagtgcgcaaggacatcccccagtgggaaccttcaaagggctggaacgattggcagcaggtccccttctgttctcatcattttcaccagctgatcatgaaggacggcagagagattgtggtgccgtgtcgcaaccaggacgagctggtcgggcgggccagggtgtcccagggtgcaggttggagcctccgtgagaccgcctgcctgggcaagagctatgcgcagatgtggcagctgatgtactttcaccgccgggacctacgactggccgccaacgccatatgctccgcggtgcccgtcgactgggtgccgacgagccggacgacctggtccatccacgcccaccatcaatggatgacgactgaggacatgctgagcgtgtggaatcgtgtctggatcgaggagaacccctggatggaggacaagactcacgtgtccagctggggagacgtgccgtacctaggcaagcgtgaagaccaatggtgcggttccctgatcgggctcacggcccgcgccacttgggccagcaacatccaggtcgcaatcaaccaagtgcgccggttgatcggaaacgagaactacctggactacatgacgtccatgaagcgcttcaagaacgagggggaccccgagggcgccctatggtga

SEQ ID NO: 24356 - RNA, 9879 nt, synthetic construct
  misc_feature 1..9879: note = derived and/or modified CDS sequence (opt11) from DENV-1__GQ199835__SS-prME
  source 1..9879: mol_type = other RNA
agcgtcaccatgctgttgatgctgatgccaacggcactggccttccacctcaccacccggggcggggagccccacatgatcgtgacgaaacaggagcggggaaagagcttactgttcaagaccagcgccggggtaaacatgtgcactctcatcgccatggacctgggcgaactttgtgaagacaccatgacttacaagtgtccccggattacagaagccgagcccgacgacgtagactgctggtgtaacgccactgacacctgggtaacttatgggacctgcagccagacgggggagcaccgtcgcgacaagcggagtgtagcgctcgcgccccatgtagggctcgggctggagacccgaaccgagacctggatgtcaagcgagggcgcctggaagcaaatccagcgggtcgagacgtgggccttacgccaccccgggttcactgtgattgccctattcctcgcgcacgcgatcgggacctccattacccagaaggggatcatcttcatcctcctgatgctggtgacgcctagcatggcgatgcggtgtgtgggcatcggctcgcgcgacttcgtggagggactcagcggggccacatgggtggacgtcgtcttagagcacggatcctgtgtgaccaccatggccaaagacaagcccacgctggacatcgagctcctgaagaccgaggtcaccaaccccgcggttctgagaaaattgtgcatcgaggctaagatcagcaatactacgaccgactcccgttgtcccacccagggcgaggcgaccctgatggaggagcaggacgctaacttcgtctgccggcgcactttcgtagacagagggtgggggaacggctgtgggctgttcggcaaggggtccctcatcacgtgtgccaagttcaaatgcgttaccaagctggagggtaagatcgtgcagtacgagaacctgaagtactccgtgatagtaaccgtgcacacgggcgatcagcaccaggtcgggaacgagagcacggagcacggcaccaccgcgaccatcacgccccaagcccccacctctgagatccagctcacagactacggggccctgaccctggactgcagcccgcgcacgggactcgacttcaacgagatggtcctgcttaccatgaaggagaagtcctggcttgtccacaagcagtggttcctcgacctaccgctcccttggaccagtggggcgtcaacctcgcaggagacgtggaaccggcaggacctgctggtcaccttcaaaaccgcccacgcaaagaaacaggaggtggtcgtgctgggcagccaggagggagccatgcacacggccctgacgggggccaccgaaatccagacctccggcacgaccaccatatttgccggtcatctcaagtgccgcctgaagatggacaagctgaccctgaagggcatgtcatacgtgatgtgcaccgggagcttcaagctcgaaaaggaagtcgcggagacccaacacggcacggttttggtgcagatcaagtacgagggcaccgatgctccatgcaaaatccccttcagcacccaggatgagaagggtgtcacgcaaaacggccgattgatcaccgccaacccgatcgtgaccgacaaggagaagcccgtgaacatcgaggccgagcccccctttggcgagtcctacatcgtaatcggcgcgggcgagaaggcgttaaaattaagctggttcaagaaagggtccagcatcggcaagatgttcgaggccaccgcccgtggggcccggcgcatggcgatcctgggcgacacagcatgggactttgggtctatcggcggcgtgttcacgagtgtagggaagttagtccaccagatcttcggcaccgcgtacggcgtgctgttttccggcgtgagctggaccatgaagatcgggatcggcgtcctgctgacgtggctcggcctgaactcccgctcgacctccctgtctatgacctgcatcgccgttgggctcgtgaccctgtacctgggggtcatggtgcaggccgactccggttgcgtcatcaactggaagggccgggagctcaagtgtgggagcggcatcttcgtcacgaacgaggtgcacacctggaccgaacagtacaagttccaggcggacagcccaaagcgcttatccgccgccatcggcaaggcgtgggaggaaggggtgtgtggcattcggagcgccacccgcctggagaacataatgtggaagcagatatccaacgagctaaaccacatcctgctggagaacgacatgaagttcacggtcgtggtgggggacgtggtgggcatcctcgcccaagggaagaagatgatccggccccagcccatggaacacaaatactcctggaagtcctggggcaaggccaagatcatcggcgccgatgtgcaaaatacgaccttcatcattgacggtcccaacaccccagagtgccccgacgaccagcgcgcttggaacatctgggaggtcgaagattacggcttcgggatattcaccacgaacatctggctgaagctgcgggacagctacacgcaggtttgcgaccaccgcttaatgtccgcggcaatcaaggattctaaggcagtgcacgccgacatgggctactggatcgaatccgagaagaatgagacgtggaagctggcccgggcgagtttcatcgaggttaaaacctgcatctggcccaagtcccacacgctgtggagcaacggcgtgttggagtccgagatgattatccccaagatctacgggggcccgatcagccagcataactaccgccccgggtactttacccagaccgccggcccctggcacctggggaagctagagctcgacttcgatctgtgcgagggcaccaccgtggtagttgacgagcattgcggcaaccgggggccgtccttacgcaccaccaccgtgacgggcaagatcattcacgagtggtgctgccggagttgcaccctaccgccgctccgctttaagggtgaggacggctgctggtacgggatggagatccgacccgtcaaggagaaggaggagaaccttgtgaagtccatggtgagcgccgggagcggcgaggtagattccttcagcctcgggctgctgtgtatctccattatgatcgaagaggtaatgcgcagccggtggtcccgcaagatgctcatgacgggcaccctagcagtgttcctgcttctgatcatggggcagctgacgtggaacgacctcatccgactatgcataatggtcggcgccaatgcgagcgaccgcatgggaatgggcaccacctacctgaccctcatggccaccttcaagatgcgcccgatgtttgccgttgggctgttgctccggcgcctgacttcccgagaggtgctgctcctgaccatcgggctaagcctcgtcgcatccgtggaattgcctaacagcctggaggagctcggcgacgggctggccatgggaatcatgattctgaaactcctgacagacttccagtcccaccaactgtgggcgacgctcctaagcctgaccttcatcaaaaccacgctctccttgcattatgcgtggaagacaatggccatggtcctaagcatcgtgtccctgttcccactgtgcctgagcacaacctcccagaaaacgacgtggctccccgtgctgctgggcagcctcgggtgcaagcctctgaccatgttcttaatagccgaaaacaagatctggggccgcaagtcctggccactcaacgagggtataatggcggtcggcgttgtgagcatcctgctgtcctccctcctcaagaatgacgtccccctcgccgggcccctgatcgccggcggcatgctgatcgcctgctacgtgatcagcgggtcgagcgccgatctttccctcgaaaaagcggccgaggtgagctgggaggaggaggctgaacactccggcgcctctcacaacattctggtcgaagtgcaggacgacgggaccatgaagatcaaggacgaggaaagagatgacacgttgacgatacttctgaaggccacgctgctcgcggtgtccggcgtatacccgcttagcatccccgccaccctgtttgtgtggtacttctggcagaagaagaagcagcgctccggagtgctgtgggatacccccagcccgcctgaagtcgagcgggcagtgctggacgacggcatctatcgcatcatgcagcgcggcctcctagggcgcagccaggtgggcgtcggggtgttccaggaaaacgtatttcacacgatgtggcacgtcacgcgtggcgccgtgctcatgtaccaggggaagagactggagccaagctgggcctccgtaaagaaggatctgatctcctacggcggcgggtggcggctccagggctcctggaacaccggggaggaggtccaggtgatcgcggtggagcctggcaagaatcccaaaaacgtacaaaccgcccccgggaccttcaaaacgcccgaaggcgaggtgggcgccatcgcgctagatttcaagcccgggaccagcggctcccccatcgtgaaccgcgagggaaagatagtcggcctgtacggcaacggggtggtgaccaccagcggcacgtacgtcagcgccatcgcgcaagctaaagcctcccaggaagggccactccctgagatcgaagacgaagtgtttcggaagcgcaacttgaccatcatggacctgcaccccggatccggaaagacccggcgctacctcccggcaattgtgagggaggcgatcaagcgcaagctgcggactctgatcctagcccccacgcgcgtcgttgcctcagagatggccgaggctctgaaaggcatgcccatacgctaccagaccaccgcggtcaagagcgagcacaccggcaaggagatcgtggacttgatgtgtcacgcaacgttcaccatgagactcctgtcccccgtgcgcgtaccgaactacaacatgatcattatggacgaggcccacttcacagaccccagcagcatcgccgcccggggatatatcagcacccgcgtcggcatgggggaggcggccgccatcttcatgacggccacaccccccggctccgtggaggcctttccgcagagcaacgcagtgatccaagacgaggagcgggacatccccgagcgctcctggaacagcgggtacgagtggatcaccgacttccccggcaagaccgtctggttcgtgcccagcatcaagagcgggaacgacatagccaactgtctgcgaaagaatgggaagcgagtgatccagctctcccggaagacgttcgacacagaataccagaagaccaagaataacgactgggactacgtcgtgaccacggacatcagcgagatgggcgccaacttccgcgccgaccgggtcatagacccgcgccgatgtctgaaaccggtcatactgaaagacgggcccgagagggtgatcctggcgggccccatgccggtcaccgtggcctccgccgcgcagcggcggggacggatcgggcgcaaccacaacaaggagggtgatcagtatatctatatgggacagcctctgaacaatgatgaagaccacgcccattggaccgaggcgaagatgctgctcgacaacatcaacaccccagagggaatcatacccgccctgtttgagccggagcgggaaaagtcagccgccatcgacggggagtaccgcctgcgcggcgaggcgcggaaaacgtttgtggagctcatgcgccggggggacctgcccgtttggctgtcctacaaggtggcgagcgagggcttccagtacagcgaccgccggtggtgcttcgacggtgagcgaaacaatcaggtgctcgaggagaacatggacgtcgagatctggacaaaggagggagagcggaagaagctgcgcccccggtggctagacgccaggacctactcagatccgttagccctgcgggagttcaaagagttcgcggcaggccgccggagcgtgtccggggacctgatcctcgaaatcggcaagttaccgcagcacctgacccagagagcgcagaacgccctcgacaacctggtcatgttacacaactctgagcagggcggacgcgcctaccgccatgcaatggaagagctccccgacacgattgagaccctgatgcttctcgcgctgatcgccgtcctgacgggcggtgtgaccctcttcttcctgtccggacgggggctgggcaaaaccagcattggcctgctctgcgtaatggcttcctcagtcctgctctggatggcgtccgtggagccccattggatcgccgcaagcatcatcctagagttcttcctgatggtgttgctgatccccgaaccggaccgccagcggacgcctcaagacaaccagctggcatatgtggtgatcgggctcctgttcatgatcctgaccgtggcggccaacgaaatgggcctcctcgagaccaccaagaaggacctggggatcggccacgtcgcggtggagaaccaccaccacgcgaccatgctcgacgtcgacctgcatcccgcctccgcctggaccttatacgctgtagccacgactatcatcacgccgatgatgcgccacaccatagagaacacaaccgcaaacatcagcctcacggccatcgccaaccaggccgccatcctcatggggctggacaagggctggccgataagcaaaatggacattggcgtgccgctcctggcgttggggtgttatagccaggtcaaccccttaacgctgaccgccgcagtcctgatgctcgtagcccactacgcaatcataggccctgggctccaggccaaggccaccagggaggcccagaagcgcacggccgcgggcataatgaagaaccccacggtcgacgggatcgtcgctatcgacctggatcccgtggtttacgacgccaaattcgagaagcagctcggccagatcatgcttctgatcttatgcacctcccagattctgctgatgcgtaccacctgggccctttgcgagagcatcaccttagccactggccccctgaccacgctctgggagggttccccgggtaagttttggaataccaccattgccgtcagcatggccaacatcttccggggatcctacctggccggcgctgggttggccttcagcctcatgaagtccttggggggcgggcgccgaggtaccggggctcagggcgagacgctgggcgagaagtggaagaggcagctcaaccagctatccaagtcagagtttaacatctataagcggtccgggatcatggaggtggaccgcagcgaggctaaggagggcctgaagagaggggaaaccacgcgacacgcagtatcccggggcaccgccaagctgagatggttcgtggagcgcaacctagtaaagcccgaggggaaggtgatcgacctagggtgtggccgcgggggctggagctactactgtgcggggcttaagaaggtcacggaggtgaaggggtacactaagggtggcccaggccatgaggaacccatcccgatggccacctacgggtggaacctcgtgaagctgcactccggcaaagatgtcttctttacgccaccagagaagtgcgacacgctgctctgcgacatcggggagagttcccccaacccgacgatcgaagagggacggaccctgcgggtgctgaagatggtggagccctggctccgggggaaccagttctgcattaaaatcctgaacccctacatgcccagcgtcgtggagaccctggagcagatgcagcgaaaacacggcggaatgctagtcagaaacccgctgtccagaaacagcacccacgagatgtactgggtctcctgcgggacgggcaacatcgttagcgccgtgaacatgaccagccggatgttgctcaatagattcacaatggcgcaccgaaagcctacctacgaacgcgacgttgatctgggagccggcacgcgacacgtggcggtggagcccgaagtcgcgaacctggatatcatcggccagcgtatcgagaacatcaagcacgagcacaagagcacctggcattacgacgaggataacccctacaagacctgggcctaccacgggtcctacgaggtgaaaccatctggttccgcgtcaagcatggtcaatggggttgtgaaactcctgaccaagccctgggacgttatccccatggtgacgcagatcgccatgacagataccacgcccttcggccaacagcgggtgttcaaggagaaggtcgacacgcggaccccgaaggcgaagcgcggcaccgcccagattatggaggtgaccgcccggtggctgtggggattcctctcccgcaacaagaagccccggatctgcacacgtgaggagttcacccgtaaggtgcgtagcaatgccgctatcggcgcggtattcgttgacgagaaccagtggaattcggccaaggaggccgtggaggacgagcggttttgggacctcgtccagaaggagcgcgagctgcacaagcaggggaagtgcgcgacctgcgtatataacatgatgggcaagcgggagaagaagctcggggagttcggaaaggcgaaggggagtcgagccatctggtatatgtggcttggcgcaagattcctcgagttcgaagccctcggcttcatgaacgaggaccactggttctcacgggagaacagcctgtccggcgtggagggtgaggggctgcacaagttaggctacatcctgcgggacatcagcaagatacccgggggcaacatgtacgccgatgacaccgcgggctgggacacgcggattaccgaggacgacctgcagaatgaggcaaagatcaccgacatcatggagcctgagcacgccctcttagccacctccatcttcaagctgacataccagaacaaggtcgtccgggtgcagcgccccgcaaagaacgggaccgtcatggacgtgataagccgtcgtgaccagcgcggctctggccaagtgggaacctacggcctcaacaccttcacgaacatggaggcgcagctgatacggcagatggagagcgagggaatcttcctcccctccgagctcgagacccccaacctggccgagcgcgtactggattggctcgagaagtacggtgtggagaggctgaaacgcatggccattagcggggacgactgcgtggtgaagccaatagatgacagattcgccaccgccctaaccgcgctcaacgacatgggcaaggtgaggaaagacatcccccagtgggagccttccaaaggatggaacgactggcagcaagtccccttctgcagccaccacttccaccagctcatcatgaaggacgggagagagattgtcgtgccgtgccgcaatcaagacgagctggtgggccgggcccgcgtatcccaaggtgccggctggagcctccgggagacggcctgcctgggcaagtcttacgcccaaatgtggcagctgatgtacttccaccgccgggatctcaggctagcggcaaacgctatttgctccgccgtgcccgtggactgggtgcccaccagccggaccacctggtccatccacgcgcaccaccagtggatgacgaccgaggacatgctgtcagtgtggaaccgcgtgtggatcgaagagaatccctggatggaggacaagacacacgtctccagctggggcgacgtcccgtacttggggaagagagaggatcagtggtgcggctccctgatcggcctgaccgcacgggccacgtgggccagcaacatccaggtggctatcaaccaggtgaggcggctcatcggcaacgagaactacctggactacatgacgtccatgaagcgcttcaaaaacgagggcgaccccgagggggcgctgtggtga

SEQ ID NO: 24357 - RNA, 9879 nt, synthetic construct
  misc_feature 1..9879: note = derived and/or modified CDS sequence (opt11) from DENV-1__FJ898386__SS-prME
  source 1..9879: mol_type = other RNA
tctgtgaccatgctgctaatgctgatgcccaccgcactagcgttccacctgaccacccggggcggggagcctcacatgattgtgaccaagcaggagcgtgggaaaagcctgctgttcaagacctcggcgggtgtcaacatgtgtacactcatcgctatggatctgggggagctgtgcgaggacaccatgacatataagtgccctcggatcaccgaggcagagcccgacgatgttgactgctggtgcaatgccaccgacacgtgggtcacctacgggacctgttctcagacgggggagcataggcgcgacaagcggagcgtggccctcgcaccccacgttggtctcgggttagagacccgcaccgagacatggatgtcatccgagggggcctggaagcagatccagagagtggagacgtgggccctccggcatcccgggtttaccgtgattgcccttttcctggcgcacgccatcgggacatccatcacccagaagggaatcatctttattctgctgatgctggtgacgccctctatggccatgcgttgcgtcggcatcggttcccgcgactttgtggaggggttaagcggcgccacctgggtggacgtggttctggagcatggatcgtgtgtgacaaccatggccaaagacaagcccacgctggacatcgagctcctgaagaccgaggtcaccaatcccgcagtactccggaagttgtgtatcgaagctaagatctcaaacaccacgacagactcccggtgccctacccagggtgaggccaccttgatggaggaacaggacgccaatttcgtttgtagacgcacgttcgtcgaccgggggtgggggaacggctgcgggctgtttggcaagggctcgctcataacgtgtgctaagttcaagtgcgtaactaagctggagggcaaaatagtgcagtacgagaaccttaagtactccgttattgtaaccgttcacacgggcgaccagcatcaggtagggaacgagtctaccgagcacggtaccaccgcgactatcacgccccaggcccccacaagtgagattcaattaacggactacggcgccctgaccctggattgtagcccacgcacgggtctcgacttcaacgagatggtgctgctgactatgaaagagaaatcctggctagttcacaaacagtggttccttgacctaccgctcccctggacatcaggtgccagcacctcccaagagacgtggaaccgtcaagacttactggtgacattcaagaccgcacacgccaaaaagcaggaggtggtcgtgctcggctcccaagaaggcgccatgcacaccgccctgaccggggcaaccgaaatccagacctccggaaccaccacgatatttgcagggcacctgaagtgccgcctcaagatggacaagttaaccctgaagggcatgagctacgttatgtgcaccgggtccttcaagctcgaaaaggaggtcgccgaaacgcagcacggcaccgttctggtgcagataaaatatgagggcaccgacgcaccgtgtaagatcccattcagcacccaggatgagaagggggtcacacagaacggccggctcatcaccgcgaatcccatagtgacggacaaggagaagcccgtcaacatagaggcggagccgccttttggagagtcatatatcgtcatcggcgcaggcgagaaggcccttaagctgagctggttcaagaaagggtccagcatcggcaagatgttcgaggccaccgctcggggcgcccgccgcatggcaattctgggagacaccgcctgggacttcggatccatcggaggcgtattcaccagcgtcgggaagctggtgcaccagatattcggaaccgcctacggggtactgttctccggcgtgagctggacgatgaagatcgggatcggcgtgctgctgacgtggctcggtctaaactcccgctcaacatccttgagcatgacctgtatcgccgtgggcctcgtgactctgtacctaggcgtcatggtacaggcggattccgggtgcgtgatcaactggaagggccgggagctcaaatgcgggagtgggatcttcgtcacgaacgaggtgcacacctggaccgagcagtacaagtttcaagccgactccccgaaacgcctttccgccgccatcggtaaggcctgggaggagggggtctgcggaatccggagcgccacccgcctggagaacatcatgtggaagcaaattagcaacgagctcaatcacatcctgctggaaaatgacatgaagttcactgtcgtggtgggcgacgtcgttggcatcctagcgcaggggaagaagatgattcggccccaacccatggagcacaagtacagctggaagtcttggggcaaggccaagatcattggcgccgacgtgcagaatacaaccttcattatcgatggccctaacaccccagagtgccccgacgaccaacgagcatggaacatctgggaggtagaggactacggctttgggatattcaccactaacatctggttgaagctgcgggacagctatacccaggtctgcgatcaccgccttatgtccgcggctatcaaggactcgaaggccgtgcacgcggacatgggatactggatcgagtccgagaagaacgagacatggaaactggcccgggcttcattcatcgaagtcaagacctgcatctggccgaaaagtcacacattatggtcaaacggggtgttggagtctgagatgatcataccgaagatctatggcggcccgataagccaacacaactaccgacccggatacttcacccagaccgcgggtccctggcatctcgggaaactggaactcgatttcgacctttgcgaggggaccacggtggtcgttgacgagcattgcggtaaccggggcccgtccttacgcaccaccaccgtgacgggcaaaataatccacgagtggtgctgccggagttgcaccctgccgcccctccgcttcaaaggggaggacggctgctggtatggtatggagatccgacccgtcaaggagaaggaagagaacctggtgaagtccatggtgagcgccggcagcggggaagtcgattcattcagccttgggctgttgtgcatctccataatgatcgaggaggtgatgagaagccgatggtcccgtaagatgctcatgaccggtactctggctgtgttcctactcctgatcatggggcagctgacgtggaacgatctgatccggttatgtatcatggtgggcgccaacgcctcagacaggatggggatgggcaccacatacttggcacttatggccacattcaagatgagaccgatgttcgcagtgggcctgctgttccggcgcctcacctccagggaggtcctgctactaacaatagggctgagcctggtggcctccgtggagctccccaatagcctcgaggagcttggtgacgggctagcaatgggcatcatgatcctgaaactgttgaccgatttccagtcccaccagctgtgggcgactttactcagcctaacgttcatcaagacaaccttgtccttgcattacgcctggaagaccatggctatggtactgagcatcgtgtccctgttcccgctctgcctgagcaccacctcccagaaaaccacctggctgcccgtgttgctgggctctctggggtgcaagccgctaacgatgttcttgatcgcggaaaacaagatttggggccgcaagtcctggccccttaacgagggtatcatggccgtcggtgtggtatcaatcttactgagttccttgctaaagaacgacgtccccctggccgggcccttgatcgccggaggcatgctcatagcgtgttacgtgattagcgggtcctcggcggacttgtctcttgaaaaagccgcagaggtcagctgggaggaggaagccgaacactccggcgccagccacaacatactcgtcgaggttcaggacgacgggactatgaagatcaaagacgaggagcgggacgacaccctaaccatcctgctcaaggcaacgctgttggccgtgagcggggtctaccccctcagcattcccgccacgttgttcgtctggtacttctggcagaagaagaagcagcgcagcggggtgctgtgggacaccccctctccgccggaggtcgagcgagcggtcctggatgacgggatttatcgcatcatgcagcggggcctcctggggagatcccaggtgggcgtcggtgtttttcaggagaatgtcttccacacgatgtggcacgtcacccgtggcgccgtgctgatgtaccaggggaagcgcctcgaacccagctgggcgtccgtcaaaaaggacctgatcagctacggcggtggatggcgtctgcaggggagctggaacacgggggaggaagtccaggtgatagccgttgagcccggtaagaatccgaagaatgtccagaccgcccccgggacattcaagacaccggagggagaggtgggcgccattgcactcgacttcaagcccgggaccagcggctcccccatcgtcaaccgcgaggggaagatcgtcggcctgtatggcaacggggtagtgaccacgtcaggcacctacgtctcagccatcgcccaggccaaagccagccaggaagggccgctgccagagatagaggacgaggtatttcggaagcgcaatctcacgattatggacctgcaccccggcagcggaaagacccgaagatacttacccgcgatcgtgcgggaggccattaaacgcaagctcagaaccctgatcctggcacccaccagggtggtggcctcggaaatggccgaggctctcaagggcatgcccatccgatatcagacgaccgccgtcaagagcgaacacaccggcaaagagattgtcgacctgatgtgccacgctaccttcacgatgcggctgctatccccggtgcgcgtgccgaattacaacatgataatcatggacgaggcccactttaccgacccctcttccatcgccgctcggggttacatctctacgagagtgggaatgggagaggccgccgccatctttatgaccgccacaccgcccgggtccgtggaggcctttcctcagagcaacgctgtgatccaggacgaggagcgggacatccccgaacggtcctggaactcggggtatgagtggattacagattttcccggtaagaccgtctggttcgtaccctccatcaagagcggtaacgacatcgccaactgtctgcggaagaacggcaaacgagtgatccagctgtcgcggaagacattcgacacagagtatcagaagaccaagaacaacgattgggactacgtcgtgactaccgacatctcagagatgggcgccaactttagggcggatcgcgtgatcgacccaagacggtgcctcaaacccgtaatcctgaaggatgggccggagcgtgtgatcctggcgggccccatgccggtcacggtggccagtgccgcccagcgacgcgggcgaattggccgcaatcacaacaaggagggcgaccagtacatctatatggggcagcccctcaataacgacgaggaccacgcgcactggacggaggccaagatgctactcgacaacatcaatacccccgaaggcatcatccccgccctcttcgagcctgaaagggaaaagtccgccgcaatcgacggggagtacaggctgcgcggagaagcgagaaagaccttcgtggaactaatgcgccgcggtgacctccccgtttggttatcctacaaggtggcctcggagggcttccagtacagcgacaggcggtggtgcttcgacggtgaacgtaacaaccaagtgttagaagaaaacatggatgtcgagatatggacgaaggagggggagcggaagaagctccgccctaggtggttagacgcccgaacctactcggaccccctcgctctccgggagttcaaggaattcgccgcgggacgacggagcgtgtccggggatctgatcctggaaatcggcaagctgccccagcatctgacccagagagcacaaaatgcgctggacaacctcgtgatgttgcataacagcgagcaaggaggtagagcctaccgccacgcgatggaggagctgcccgataccatcgagacactcatgctgctggccctcattgccgtcctgacgggcggggttacactgttcttcctaagtggtcggggactgggcaagacatcgatcggcctgctctgtgtcatggcctccagcgttttactgtggatggcaagcgtggagccccattggatcgcggcgagcatcatcctcgagttcttcctgatggtgttactgatccccgagccggaccgccagcggacgcctcaggacaaccagctggcatacgtcgtgattgggctcctctttatgatcctaacggtggccgccaacgagatgggcctgctcgaaaccacgaagaaggacctgggaattggccatgtggcggttgagaaccaccaccacgccaccatgctggatgtggacctccacccagcctcagcctggacgttgtacgctgtggcgaccacgattatcacaccaatgatgcgtcatacgatcgagaacacaaccgccaatatcagcctgaccgccatcgcgaatcaggcagcgatcctcatgggcctggacaaggggtggccgatctccaaaatggacatcggggtaccgctgctcgccctgggctgctacagccaggtgaacccgctgacgctcaccgccgccgttctgatgctcgtggcgcactacgccataatcgggcccgggctccaagccaaggctacccgcgaggcccagaagcgcactgccgccggtatcatgaagaatcccacggtggacggaattgtggccattgacctcgacccagtcgtatatgacgccaagttcgagaagcagctaggccagatcatgctcctgatcctttgcacctcacagatcctcctaatgcgcactacctgggccctctgtgagtcgatcacgttagcgaccggcccccttaccaccctgtgggaggggtccccggggaagttctggaacacgactatagccgtcagcatggccaacatctttcggggatcctacctcgctggggcaggcctggcgttctcgctgatgaagtccctcggaggagggcgtagaggcaccggggcccaaggagaaacactaggtgaaaaatggaagcggcagctgaatcaattatccaagagtgagttcaacatctacaagagatccgggatcatggaagtggaccgcagcgaggctaaggagggcctgaagaggggtgagacgaccagacacgccgtgtcacggggcacggcgaagctgaggtggttcgtcgaacggaatctggtgaaacccgaggggaaagtgatcgacctcggctgcggcagaggaggttggagctactactgcgcagggctgaagaaggtcacagaggtgaagggctacacgaagggcggacccgggcacgaggaacccatcccgatggccacctacggatggaacttggtaaagctccactccggcaaggacgttttcttcacgccgcccgagaagtgcgacaccctgttatgcgacatcggtgagagctcgcccaaccccacaatcgaggaggggcgaaccctccgcgtattaaagatggtcgagccctggctgcgcgggaaccagttctgcatcaaaatcttgaacccgtacatgcccagtgtcgtagagaccctagagcaaatgcaacgcaaacacggcggcatgctggtgcggaacccgctctcgcggaatagtacccacgagatgtactgggtcagctgtggcaccggcaacatagtgagcgcggtgaacatgacatcacggatgctgttaaatcgcttcacaatggcccaccgcaaacctacgtacgaaagagacgtagacctcggggccggcacccgacacgtggctgtggagcccgaggtcgccaacctggacatcatcggccagaggatcgagaacatcaagcacgagcataagagcacgtggcactacgatgaggacaacccctacaagacgtgggcctaccatggttcctacgaagtgaagccgtctggctcggctagttcgatggtgaatggggtggtgaagctgctcaccaagccctgggacgtcataccaatggtgacccagatcgcaatgactgacacaaccccattcggtcaacagcgcgtgttcaaagagaaggtagacacacgtacaccgaaggccaagcgcggaaccgcccagatcatggaggtgaccgctcggtggctgtggggcttcttgtctcgcaacaagaagccccggatctgcacccgcgaggagttcacgcggaaggtacgctcaaacgcggcgattggcgccgtcttcgtggacgaaaaccaatggaacagcgccaaggaggcggtagaagacgagcggttctgggacctcgtccaaaaggagcgcgagctgcacaaacaggggaagtgcgcgacctgcgtgtacaacatgatgggcaagagggaaaagaaactgggggagtttggcaaagcaaaggggagccgcgctatttggtatatgtggctcggcgcccgtttcctggagttcgaggcgcttggcttcatgaatgaagatcactggttcagtcgcgagaacagtttaagtggggtagaaggcgaggggctgcacaagctcggctacatcctgcgggacattagcaagatcccgggaggcaacatgtacgcggacgacacagcaggatgggacaccaggatcacggaagatgacctgcagaacgaggctaaaatcaccgacatcatggaacctgagcatgcgctgctggccacctccatctttaagctgacctatcagaacaaggtcgtgcgggtccagcgccctgcgaagaacgggacggtaatggacgtgatttcacgccgggaccagcgcggctccggccaggtggggacgtatggccttaacacctttaccaacatggaggcccagctcatccggcagatggagtcggaggggatattcctgccctccgagttagagacgccgaaccttgccgaacgcgtactagactggctggagaaatacggagtggagaggctcaagaggatggccatcagcggggacgactgcgtggtaaagccgatcgacgaccgattcgctaccgcgctgacagccttaaacgacatgggcaaagtgcgcaaagatatcccccagtgggagccctccaaggggtggaatgactggcagcaagtccccttctgctctcaccacttccaccagctcatcatgaaggacggccgggagatcgtcgtgccgtgccgcaaccaagacgagctggtgggccgtgctcgtgtctcccaaggggctggatggagcctccgggagaccgcctgcctgggcaaaagctacgcccagatgtggcagctaatgtattttcaccgccgcgaccttaggctcgccgccaacgccatctgctcagctgtgccagtcgactgggtccccacgagcagaaccacctggtctatccacgcccaccatcagtggatgacgacggaagacatgctgagcgtctggaaccgcgtgtggatcgaggagaacccctggatggaggacaagacccacgtctcctcatgggaggacgtgccgtaccttggcaagcgggaggaccagtggtgcgggtccctaatcggcctgactgcacgcgcaacctgggcttctaatatccaggtggcgatcaaccaggtccgaagactgatagggaacgagaattaccttgactacatgacatccatgaaacgttttaagaacgaaggggaccctgagggcgccttctggtga
